United States Patent 9,518,277 (GENETICALLY ENGINEERED MICROBIAL STRAINS INCLUDING CHLORELLA PROTOTHECOIDES LIPID PATHWAY GENES) - sequence listing, part 11

SEQ ID NO: 39275 - DNA, 16482 bp, Chlorella protothecoides
  modified_base (484)..(493): a, c, t, g, unknown or other
  modified_base (586)..(595): a, c, t, g, unknown or other
  modified_base (688)..(697): a, c, t, g, unknown or other
  modified_base (843)..(911): a, c, t, g, unknown or other
  modified_base (1244)..(1253): a, c, t, g, unknown or other
  modified_base (4664)..(4684): a, c, t, g, unknown or other
  modified_base (4773)..(4782): a, c, t, g, unknown or other
  modified_base (7737)..(7746): a, c, t, g, unknown or other
  modified_base (7965)..(7974): a, c, t, g, unknown or other
  modified_base (8824)..(8833): a, c, t, g, unknown or other
  modified_base (9443)..(9452): a, c, t, g, unknown or other
  modified_base (11052)..(11061): a, c, t, g, unknown or other
  modified_base (11192)..(11201): a, c, t, g, unknown or other
  modified_base (11365)..(11459): a, c, t, g, unknown or other
  modified_base (14528)..(14537): a, c, t, g, unknown or other
  modified_base (15355)..(15364): a, c, t, g, unknown or other
  modified_base (15680)..(15689): a, c, t, g, unknown or other
  modified_base (15962)..(15971): a, c, t, g, unknown or other
ggcgtcggcaccgtgcccgggggcgggagcagggctgggtcggcctgcagcgcagccagcacggcgcgcatgccgtccagcggcgcgccgcccgcggcgccggcggcgggcgggtagaatagccccgaggcggcgtcgtgggcccagcccgcgccctccagctgcggccagacgctgtcccagaacacggccttgagcggcaagctcgtggccaccaggctgtccaccgcgcgcgggctgagcagaaagcccgggtcgccggggtcctcggccgccacgcctgcggcctccacgcctcgcacaaacgcatcgcgccccgtcagcgccaccaccgcggggacgaagacctgcaggggcagcgcgcgccggccgtagtcgtcggccgcgtgcttgagcatgctctgccccgccgcgtccaggcgccccgctggttcatgttcgatgaggagggggtaatgtgaccaaggagaacattacttccatnnnnnnnnnnccctgcctcatacacatcctgcagggcatgcatgtgacgaactccagacatccgtgggtcacccagccccgctctctcctcaccggccgcgannnnnnnnnntcctgcctcatacacatcctgcagggggagcgtgtgacggactccagacatccgtgggtcatccagccccgctctctcctcaccggccgcgannnnnnnnnnattcatgttcgaggaggaggggttaatgtgaccaaggagaacattactttcatcgagcagccaagatgcgcatgcatgcgagggctgggtgcaggctctcagaaggcccaggagtgcccaaggagagcagccacagggatgggccnnnnnnnnnnnnnnnnnnnnnnnnnnnnnnnnnnnnnnnnnnnnnnnnnnnnnnnnnnnnnnnnnnnnngggtggggaggatggcggtgaccagcttgcgcccacgcagcagctcatcgccggtgtgcccgctgcggtatagctgcctgtaccgcttccccaccacgctgtgcttgaacaccttgtagtaaaagaccacgcattcggcctcctgcgacgatgggaagggagaggggccgcggggggacgggttggcggcggctccgccagctgctgggtccctaatttctgggaagtgatcacgcaatccgggggacccccccgggggaaggggtgtcgtgagacgcgcaacgtcctcgcgagcaggttctccaggccctcaccgagcgttggaccagcttnnnnnnnnnnggagtgtcgtgagacgcgcaacggcctcgcgagcaggttccccaggccctcaccgagcgttggaccagcttggaaaccgccctaaaatctcgatcaaacagtttcatggccaggttgaaggccgcgacgtctgctgcgctgaaggtgggtagtgggtgccagtcggaggtcgccagggcctcggcccagaaactaggggggatggggccatcgggggccccaggacccggcagctcctcgatttggtactggggccccaaccgcacgtccgtggaggcctcatcggcgtgcagcatggcgaagacgtcggagcgccagagggagcccctggggctaagcagcccatctggctcgtccatggcttgcaggccgtcgggcgtgcgaatgggagcagaaacaaatgcagcgatgcagggatggcgctcaggggtgggatccgggttgatgaggagaggccgtgatgggagcctgctccggcaagccctgaggtgcgcaccagggtttacccgcccgcaaaaccccagcgcgccagcgcccctgggaatttctctcgtactcccatggctctgcagcagtctccccaaggtcggtcatcgagttggaatttcaggggcgggcttgtggtttccaagcctcgcgcaggacaagggggaagggaggggcggggagggtcacccgccggcgtctcggaccaggtacagggcttgtggggcagggcaagggatcttgtgggactggcgggggatcttggggccaggcagggattcttggagccaggcaggggtgtagggtggtgcaattgtgcggggcaatgggggtgcatgcgagcctcaaagaacatgcagggtatgggacggcagccggggggatgccagcgtccgcagcgcctgaagtcgcagccatttcctgtacgccgctcccaatggagcgcccgcgccgcgctgcctcgaccccacctccacgtcgcgggccggcccgcctcctccccaggctcgccgcccgccgtgcccagccctgccgctcaggagacgtggcggacctgtacggagcgatgctgctggctggtgcgctggatgtcggacaccaccaccaccaggtccttggcggccaccaggttgcggcgcttgagcagctcaaaggtgcgcgtcacgttggtctccgggtcgtcctcgaagcggacgaggaaagggatgacgccccagcgcaggttcaggcgctgcctcacctcctggctgtcggtgaaggcgaagatggggcagtcggggcggtagcgcgacagccaggaggcgttgacgccgcggcgcgtgaacacgaagatggcggcggcgcccaggttgtcggccatggaggcggccgaggcgcagacctcctccccgatgcgcgcgtccagggaccccgcgatgcgcggcagcgcgatggcacccgacccctcctcccggcaccagccctcgatgcgcgcggccacgatgcgcagcacctccagcgccttttgcgggaacagccccgccgcggactcgcccgacagcatcagcgcgtccgcgcgctggcgcaccacgtcggcgatgtcgctcacctcggcgcgcgtgggcgtgggcagctcgtgcatggactggagcaggtgggaggccacgatcaccggcttgcccgcctgccggcagcgcaggaccacctctttctgcacggagggcacgtcctccaggcggatctgggcgcccaggtcgccgcgcgcgaccatgacgccgtcggccgcgtccacgatttcggccaggttggggatggagtcgggggactccaccttggcgatgacgtcaatgtcgcgcgccgaacggctctgaatgtaggacttgaggttgttgatcacgtccgccgacttgacaaaggacaccgcgatgaagtccacgccctgctgcactgcaaagtccacatcaacccagtccttggcggagaggacagggagcatggcgttcttggcgcgcacgggccggccaccgcggcggaaggtcaggttggcgcgggacagcaccaggccggggtccaccacgcggcagtacacgtcggggccggccttgccctccacctccagggacaccatgccgccgtcgatcacaatctcgtcgcccacctgcaggatttttttttttggggggggggggaagattggtattggtatcatgaaattgcgatcacttgccagggactgcgctcagcactccaggtcgccaccagcctcccacagagtcgacaccgcaaggtccttccctcaccctcacctgcacgtcctcggcaaaggcgtcgtaggacacggcgatggcggcgtcgtcgcccaggctggcggccgggtcgcgcacggtgaacaccagctcctgccccgtctcagccttgagcggggcggccatctccatgatgtgcacctcgctaccctgcgtgtccatcatgatggccacggagtagcccttctccttgttcagggcgcgaatgtgggaaatgatctccgcgtgccaggcgtgcgagccgtgggacatgttcagccgggccacgttcatgccgttgctggccatggcgtccagcatctccttggactcgcaggccgggccgatggtggcgatcagcttggtacgccgtgtggagcggaagcctggtgcagaagcatgttgggttggggggttgagaacgtgctggggccgctcgctcatagggggcctggagtgcccagagcaagcgagtcggtgctccggctaggccgacccatccacacccactcgccccgatccctgcgcagatgggactcccgtacacaccaaacatgcacacatcccaccattgctgctcagctcctgctccagcacgctgtcgacctcgatctcgggggtgcgggaggtggtcaggggggttgcgacgtctgccactgccacgctggaagagcccgccctgcggggtttccgcccgttgccctttgtgttggagctggcaaacacgcgggcggggtgaaggctggagcggtggctggcaggcagcgcggccggtcgggccaacccggcacgggcgagggctgccgacatggcgtgggtaggggtgggggggggaggtgcgcggtgggtcgatcaaacttggtgcgctgtcatcacttgatgcgctactggatctcaatcggccggagagcctgcgggtgggtggtacttgaagctggcagatggctgaagcaggcgggacgcccccccggatcacgccttccgtgagcgtgggtgatgccctgctgaatgggtcagcaggctagggtttaaccgcggcttctgttccctttcactactctggcctgtcctcttctaccttatgctaacagtgtcgagatgggggggcatcagccccacggcgtgggtgtgagttcagccagtggtgctgaagggctgcatnnnnnnnnnnnnnnnnnnnnntaggtgggtagaggattggctgaaggggggccagctgacggaggcttgcagcgcagtgaccaaggggtgtggtctctaaagaatgcttnnnnnnnnnngggggtcctcgatgacctccttgatgcgcttgaggaaggtgaccgcctcgcgcccgtcgatgaggcggtggtcgtaagtcagtgccaggtacatgagaggcctgaagttcaggtgggtagaggattggctggaggggagccagctgaggggggcgtgcagcgcagtaaccaaggggtgtggtctctaaagaatgcttccccttcctcctcatgccatggggctgaagatgtcgcctctcatcgcacccctccctggccacatacatgtgagtagcgcccccccagcctatcagcatcagtcctcaagtccaaaacttgcatggtgacgggagcccccctcctcacccaccccaagaacacaccctcacgcgcgcacctggcgacgatctggccgtcgacgaccgcgggcttgatgttggtggcgtgcatgcccaggatggcggactgcggcgggttgatgatgggcgtggagagcatggagccaaacacaccgccgttggagatggtgaaggtgcctcccgccatctcgtcgatggacagcgcgccgtcccgcgccttcttccccagctcgttgatggtcttctccaccgtggcaaagctcatggcatccacattgcgcagcaccggcaccaccagccccttgggcgtggccaccgccaccgagatgtcgtaatagtcgcggtagatgatgtcgccgccgtcgatcaccgcattcaccgccggcaccgtctccagcgcgttggccgccgccttgacgaaggcggacatgaagcccagcttgacgccgtgcttctccaggaaggcgtccttgtgggccttgcgcaggtccatcagcgcggtcatgtcgacctcgttgaaggtggtcagcagcgcgtacgtgttctgcgcgttcttcaggcgctccgccacgcgggctcgcaggcgcgtcatcttcacccggcgctcggggcgggggccggaggaggggggggcgccgcccggagcggcggccggcttagaagcgggctcaggcttcttgggcgggggggaggcctttttcggctcctccttctttgtctcctccttcttgggcgcctccttcttgggcacctcctcctttggcgcctcctccttgggcgcctcctccttcttggcgggggcggcaccgccctcactctcctcaatcaccgcaaagagctggcccacggtgaccgtgtcgccctccgccgccttgtactccttgaccacgccaggggtcttgttggggtacttgatgtccatggagaccttgtcggtgtccagcgtggctagcacggagtcctcctccaccgtctcgcctggttaagcgaggagggtcaaggggttggaactgcgagacaggccttgcatcatgtgtgtacaaaggtggcgcttgacttcagtctttgtgatcacccagaaaacaagatccatgaccgagctaaagtaaaggaagacagccttccccaggagaccaccccgccctccaaagtacctggctggaccaggatggtggcgacggttccctcggtgatggactctcccatgctgggaacctccacctccacggtcttccaggctgcaggcgtgctggagatgcagcgaacagccggcacccagctggctgtcgtgggcagggcccggaggctaaaacccacagacggcacgccttgtaggcctggtcaagaggaaagttaaggaattcataaacataaagatggcaagtcaacgaccggcgaccgagggatgtgtggaatggtcgaactcacttgagaaagccgcggcatcgctcctcaacaacccccaaacacatgcagctgcaccggtctgcgagatgttgtggggtaaattttagtatcggggatctatttcatcgatcgcaggctggttgtgcactccatgcttggggttgggcccccacctgctggctgggtctgcttcccccaagggcgcggagggcggccagggcccccctccgcccggagaggcctaaagctgagactaccatcctaggctcatatcaatccaggatgtttgtctcagagtgggccatgggtttctccccttgctcaccacatattcccttctgacttagtcacactcccactgcttagcacgtgcgcagcagcagctgggtgccccacacggcacggtttcagctgggcgcgagctctcggggaagaccatcagcgctactgggtgctctgacaggtgatcagtgcaggatgtcttgaatcatctgattgatcctggataaattatagggtagcgagtgcccggcagagtcagttcctggctccggtaaagaggcggagaaccgacaccccagtgttacgggactgggtagaggtggacaccttcggccatggatctagtggtggcaaactgtccttcccaggtgagatgcttcgacgcggtcggcacattcacgagatcatgcttgctgtaactgctgcccgcaagatcactccagcacacacctccgcccctccccacggagcaggatatggccaagacaaacaaggtgtttgtggccccgaggactctggcaaaaggcacagcctatctcgagatatccagctagtgagtccttttgtgggtcagtcgacataccatggcctggcagcaggctcttcaagttgtcagccgcgcaccttcatcccccccttgcacagtgtctttctggcggaggaggagcccagcatgcagccgggcaaggttggcatgaatgcgatccagcgcagggtcatccgggcgagctcgggggacaccgtggcggcccagcccttcatcccccctgggacccactttggcgcggtgctcctcaacgccgagctggagcccatctcgcgacgcgggggggaggtagacctgcctgcacccgaggtggagactcacatccagtccagattcgcagaccaggtgatgagtgcatgccgaagagagttgcttgttgcnnnnnnnnnngcccgaggtggagacccacatccagtccagatttgcagaccaggtgacgagtgcatgccgaagagagttgcttgttgcttgtggagcaacgagttcaggccgtggagtggcctctgaataagaatctattgaatcaatggctgcatctcgatgctggagtggttctaccccacaaggcctccatgctgtacgtatggagactgtctcagtcccatggcnnnnnnnnnntgtggagtggcctctggataggaatctattgaatcaatggctacatctcgatgctggagtggttctaccccataaggcctccatgctatacgtatggagactgtctcagtcccatggctgtccaagccatccgcctgtgtgcttgccagcaggacactgccatcaccccaccccctcacaggtcttcacatcgggtcaggagctgacctttgagttccagggcctcaactacctgctgagagtcagcacgctgaccgtagtggtgccagggggggagcagcagactgtgccgcgggccatgctgtccctggccaccagctgcgtgtttgaaacaagaaaggggagcggcatcaagattgtgggccagaagaggtggggcgggcggctttggatcagcgccgcgtgcattactgtctgcacttggcaggatctctcgaatggattccagctcgtcaggagtgtagtacatgcctggttgcgtgtccatgatgattgtggcacagctccacactcccccatcacacccctcgccccccagcatcatgacctcccagctgttcaagcagcgcgaggtgtcctttgagaagctgggtatcggaggcctggattcccagttccgggagatgttcaggtctggcagatgggcactgggggaggaggcggcagtatcccgggaagtgagcatgaggagagtcctgcgtttcaggctgcaaggttgttaagactcactgcatgcaatggttgggaggatgtgcatccttggctgcatcctttgtctcctcatcgcagccagctcccttctacaccaccaggcgagcgttcgagtcccggcgcctccccccctcggttnnnnnnnnnnagcagtatcccgtgaagtgagcatgaggagggttctgctttttaggctgcaaggttgttaagactcactgtatgcaatggttgggaggatgtgcatccttggctgtatcctttgtctcctcatcacggccagctcccctctacaccaccaggcgagcattcgagtcccggcgcctccccccctcggttgtggagcggctggggatcaaacaccggaaaggcatcctgctctatgggccgccaggtgagatgcttggtagagtgtgggccgatcatctctcgcatgctcagcatggtgctggggtgacgtccaagctggcggcaataatgtggaggggaagggttttgtgcacggctggaaatgcacatttgcaggccccagaatatgcacgcctggcacccccatctcaggcacggggaagacgctgattgcccggcagctgggcatgatgctgaacggcaaggagcccaaggtggtgaacgggcctgaggtgctcaacaagtatgtgggggcctcagaggagaacatccggaacctcttcaaggcaaggcgtgagcgtgggtatgaagggcagggttgggggggagcttcaaatacggatgctgaggcnnnnnnnnnnagagaacatccggaatctcttcaaggtaaggcgtgagcgttggtatgaagggcagggttggggggagcttcaaatacggatgctgagtctgggcaagcagccatggggggtggggtgggggtgcacacagcgaccttgtgctggattaacggaaatgctggagctaaaggaggatgtggttcccaacccaaggactcaacgcgagtacttacatcagtaaaatctaaacctaccgtgcacaggacgccgaggaagactacctgaagaacggggacgattccgagctgcatgtcatcatctttgacgagatagacgccatttgcaaggtgggacatgccacctgcgcttccctccacaagggatacccacttcttgctgaggttgccaagcgatctctgttccgtcatgcagttcagaccgcaaccttcttcatccgctgactccgtcgctgtcacgggcgccaccacctccagttcacccctgcctctctccacccatcctctgcagtctcgcggcagcgtgcgggacgggtcaggcgtgcacgacaccatcgtcaaccagctgctgaccaagatcgacggcgtgaacgcgctgaacaacatactggtgatcgggatgaccaaccgcctggagctcttggacgaggccttgctgcgtgaggggcggctggacgtccacatggagatcggcctgccagatgagaacggccgcctccagatcctcaaggtgaggagtcgtgttgtggggatggtgaatgaggacaccaagcagggtgcacatacccatgaaatcgaggggggaggttgtgctttgtgtgcacggaaacacatgggcagcctgtctccctgctgactcaattctgtggtacgcatctacgcccttctgtctcatgctactgcacgcccctgacacacagattcacaccaggaacatgagcgagcacggcttcctggcaggggacgtggatctcgctgagctggcgcaccgcacccagaactacaggtgggagattgggtggcagggttcaggccgcacattgctcgggaaggggagaggctggggcgctatgctctggagtgcattggagcggcacctgcagctgtgatggaagagtccatgcaccagttacccctactactttgacctcgcccccaacccccctgctgcagtggcgccgaattagaggggttggtacgttccgcaacttcttttgcgttggaccgcgagaccgacatggccgacttgtccaagccggtggtggaggagaacatccgcgtcacgcgcgccgacttcctgcgcgccctggacgaggtgaggccctcctacggcgccgccaccgagacgctggagcagtaccgaccgggcgggatgctggacatcgggccgcagtaccacgccaccctggcggagctgcagcagctgctggaaagcgtggagcagcaggaggcggtgcccctctccgccgccctgctctggggcgacagcggaacggggaaaacgggtgaggctcagtgtgcatggctggggtggtgcatggttggggtggtgctggcatgagctattgcctattgctgtgggctgggtgacgagggaacaaggnnnnnnnnnnctgcgctgtgggcagggtatcgtcatgctcgtccccctccaattcctcccacacctttgcagccctggcctccaccctggccatcgacagcgggtttccctttgtcaaggtggtgaccaccgactccatgnnnnnnnnnngacgggtgaggctcggtgtgcatggctggggtggcgcatggctggggtggtgctggcatgagctattgcctactgctgtgggctgggtgacgagggaacaagggcgattggggtgagccctttgagaggctgcgactctggccgtttgtcactggcatgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggggtattcggacgccgcccgctgctcccagatcaccaaggtcttcgaggaggcctacagggtgagcgagacgggaggagcatggggtcaaagaggagtgagggctgatccagggggagtctcgcatctcgttcctgcatcaggcattgggcacagggcctctcaagtcctcctcctctctccatcccccctcctgcacccccaaagtcgccgctgtcgctgatcgtgctggacgacatcgagaacctgttggcctatcgcagcgtgggcctgcggtatgccgacgccgtgctcagcgtgctgatcgagtcgctgaagaagctgccccccccggggcaccacctgtttgtcatcggcaccaccagcaacaaggagatgatgcaggtgttgatgagagcgggattcggtgtgggagggggtgacaggttcaacagcgtgtgtcctgtagtcaagcacaaggagatgtggcctgccatcacgtcgctctgctcttctcgcccaagcaagggttcacagcatcttgagcgcgaccccaaatctccccctctgctgccagaccctgggcctcagcaagtacttccagctggagctagaggtgcccccactggactccaccgccgtgcagatggtcctggcggcgagcggcgcgccacgcggtgtggacgtgagtggggtggggcattgctcgctgcgtgggtgcttggttgtgagagggatgaagaggacgatgccgtgttggcccggcagtgttgtccgctgcacgtattcccaaagtcatcctgatgctctgacgcatctggtttgatgcaagcaccatcatcccccctctcaatacctccgctccttccagttctccgcggcggccgagaccctgtacggcgagagggtccccatcaaggacctactcttcgccctgcatgtgtctgcacagggcctggcccccggcgagactaccgtctcggcctcggccttccagagggtgtgggcccgcatcgccaaagcagaggcatgatgtgcgcgtgctgtatgttggatgtggactgctgtaacaccgaggttcttctcagcagggagccctgatgggcttgtccccaggcagctgcaatgaaaacagcagcaagagccagcacttcccactggacccatattccaagagctgcagagaaggttacaataaagtatactgtaagcgggagacgcagcgatatcagtgcagtgagtcaatttcatgtacagggccacacaagctcgagggtcatcgaccgtcacacctcctcccgtgcaatggtggccgtcttcggggtgcgctcaccgcccggcctcccctttggccgctcggcctctgcctcggccggccgcgccttcttccgccgctgccctgtcgcccccgccgcgtcctcctcctccgccaggcgcagggccgccatgcgccgcgcggcatagaccttggtgatccccgccagcacctccttctccggcgcctcgaaggccgccagctgcctgcccagtaggccctcgatggccctgactagttccacatcgtactgcgtcacgaagctcagggaccagccggcgcgccctgcgcgggccgtcctgccaaccctgcaatgatggatttggtgaggggggccgagcggtggcatcaggggctggtatggcatggaggggtgcacagattgtgcatctacccagccctgctgtggaccctttgaggaggaccctgaggagcaaactacatggccatgaggtccaaaaagaggccttgcacgaacactgctgtgcactccaggtgcagttgcacccacacgtcgatatatccaccacccctctgcacacacactgccccaacacgcgcacctgtgcacgtaatcccgcgcaaggtggggcaggtcgtagttgaccaccagatcgacgtcggggatgtccagcccgcgcgcggccacgtcggtggcaagcagcacaggcacgacgcccgcgcggaacctgtccagcgccgccacgcggtcgcgctggggcaggccggagtgcagcgccgcggccttgatccccagttcggccaggaggtgctggagcagggagcagttgcggcgcgtggagacaaaaacaatggcggagcgcagcttcagcgcctcgagctgctccaagaggtacaccaggtacacctccttcacctgtgcacgaggaggcaaaggagaagtgtgtgctgaggtgcatactgtagcgctgggagggacatggatcgaagatgaccgagcatggggcgcatggggtggctgcaaagcctcgggctcctcactcttcctctgcatcaagcccactcatgcctcgacgccaacccagcctggttggccacgtggggcgacaggcacgccccaggccccgaggaggaagctgatcaggctcccccacccccccaaacgattaccgaccttctgcggtaggagcatgtactcctccctcagccgcgcggcggtctgcagcccggcgtaggcctcgtagaagaaggcgtcgcgcaggaggtcgcgctgcaggcccaccagcgtgcgtgtcatggtggcactgaagagcagcgtctggcgctcctccggcagcgccgccaacaccgtggccagctccggctcgaagctggcgtccagcatgcggtccgcctcgtccagcactaagcagcgcacgcgggccaagcaggcggccagcccggggtcctgggcaagcagccccgccaggcgcccgggcgtggccaccaccaggtgcgggcgctgcgtcagcgcgcgcgcctgggcctgcccgtccacgccgccgatgatgaccgcgtcgcgcagcgcgccgccggaccccagcgcacggaagtggtcggccagctgcagcgccagctccctgcgcgtgcatgagaagagagggggcgaaggttcggtctcggatgaacaaggtatcagcctggaggaggtaatggggggaagcgtgtgtgcaccctcagcagcggtgtgccagcccagaatgcgaaggtcgatcgcacactcctcaggccatcctccaacgagcaagaatccatcttcccagccacctggtnnnnnnnnnntggtctgggagggacaaggtatcagcctgggggaggtaatgggggggagcgtgtgtgcgccctcagcagcggtgtgccagctcagaatgcgagggtcgatcctacactcctcaggccatcctccaacaagcaagaatccatcttcccagccacctggtgggcgtcaagaccagggcaaagacgccaaaggggtcgcgcgccagcagctgcaggatgggcagtgcaaaggctgccgtcttgcccgtcccggtttgggacaccgcgatgacgtcccgcccagccaggatggcggggatgcaggcacgctgcacggcggtgggcgacggcatgcccagcccgcggcacacccccgccatccagtcggagagccccagcgagcgaaaggtggcggtgtcgtcctcacccgccttggcgccactgggaggcaccgccaccgctgcggggcgagtcacggtcttgggtagtgcattttcttccttcctcggtcttgtcttgagcttggaaggaggcctggcgaagagggcgatgccgccctcttccaccatgtcctcacagggcttgtcgctcgcctgggctcttcttcaggggtttacgcgatggcaggcaggaggtgtatgtgcaatgattgttcggtattcattcttgcagtccttgtagaaagaacttcgactatacgtgaacgtgcatgcatggcgcctgcgcgcgcaggcaggttgctggggcgcgcccttcgttagaggctcttcggtagagaccccccctgcatgcgcgtgacaccccccctcgtttccctcacttgagttcgtgacgagttgcannnnnnnnnnttgcagtccttgtagaaagagcttcgactatacgtgaacgtgcatgcatggcgcctgcgcgcgcaggcaggttggtagggcgcgctcttcgttagaggctcttcgttagagacccccccttccatgcgcgtgacacccccctcgcttccctcacttgagttcgtgacgagttgcaaactccaggcaccgagggaagtgggtgttccataaaaaatgcagactgcggtcttaaagaaagcagaaactgaagaatagaaccattggccgcccgcgacagccgatacaggatcctggtatcatggggaggcggaggcgnnnnnnnnnntagaaagcagaaactgaagaatataaccactggccgcccgcaaatgccgatacgggatcctggtatcatggggaggcggaggcggcgaggggaatgcaccccgaggctgagcggcagtctcacatcagttgtttggggcagggggatccgatgggccccgcctcacccggtgcctcccgcccgctctttgcacgccagcggtgcccctccacggtcgtaagggggggggcaggcgccgtccccccggaatccctcgcttcacgtgaccgtccnnnnnnnnnngcccccggcgcctcccgcccgcccccggcacgccagcggtgcccctccatggtcgtaggggggggcaggcgccgccctcccggaatccctcgcttcacgtgaccgtcctgccgtaggcgatgcccgcgatgtagaggtctttcgcccacttttccttgacgtgctctgaagggaaggtggaggtgcgcagcgtctcctgcgtctcgtcggggatgacgcggcgcgggacggagagcacaaaggcggcctggtcggcggtggccgcgccggcggtgatgcggtagcccaggtcccagcgccggtgcacgccctccgaggggtactggaagtccagctccaccacctggtccatgaagccggcgccgcgcgacatgaccaccgcccactgctgtcgtcgtcatggatgggagagggtggtgaggagggagtgaagggcgacgtcgggagcagggaaggggggcccctgcgtcagccacccaccctttcacccaatgagcctgcccgccccccc

SEQ ID NO: 39276 - DNA, 61 bp, Chlorella protothecoides
ttggatttgtgtgattgagtcagggggggggggcaggcaagtgcgtgttggtggagggctg

SEQ ID NO: 39277 - DNA, 66 bp, Chlorella protothecoides
agacagcggagggaggaggggactgccacgctgcgctcctgtgctcaaggctgcttgctggaatgc

SEQ ID NO: 39278 - DNA, 61 bp, Chlorella protothecoides
gggggggggaggaggtgtgaggagtgggaccgcggcatgcaccgactcggaccgcagcctg

SEQ ID NO: 39279 - DNA, 61 bp, Chlorella protothecoides
tgctcgcgacagcggcgtatcggctgtgggaacctgtaccgtcgtcgacgccatgcagtga

SEQ ID NO: 39280 - DNA, 61 bp, Chlorella protothecoides
ggaaaatgtggctgggcgtcctcggatgggcagggcgacagccctaataccaggaagtcag

SEQ ID NO: 39281 - DNA, 72 bp, Chlorella protothecoides
ctccgagccagttccagctcccccaacatcaggtacatcaccggcagtgctctttggtggaaacatgtcccc

SEQ ID NO: 39282 - DNA, 76 bp, Chlorella protothecoides
ggcggggggtggagaagggatcccacggccccttgtgatcgcagggcagattgcccaagtttcagcggaagccaag

SEQ ID NO: 39283 - DNA, 106 bp, Chlorella protothecoides
ctgttgtcaaagcgccccctttgctcaccttgcacaccctgcgcacaacccctattcccctctcccaaataacaattgcaggacccagatcaaggtgacggccatt

SEQ ID NO: 39284 - DNA, 76 bp, Chlorella protothecoides
cccatctgacgattgcttagatgcacccgtggtgaccctgaccacatgcggtgcgagcctctacccgaatatctgc

SEQ ID NO: 39285 - DNA, 61 bp, Chlorella protothecoides
cagtatacacgatctgcgcacagctgaccatcttcatctgccaatggagagcacagccacg

SEQ ID NO: 39286 - DNA, 92 bp, Chlorella protothecoides
attgccaggcacggggttgtgcacggtgcagtcttggcactcgtccgttgatcgtcagagcgcctctgacatcgatgtctatctcccgtcca

SEQ ID NO: 39287 - DNA, 64 bp, Chlorella protothecoides
gagaggagagtcgtggggccatggggcattagtcatgcatgcaaggctggggtgggtggtggtg

SEQ ID NO: 39288 - DNA, 100 bp, Chlorella protothecoides
ccgggcgcccagtcggccaggacgcaggctggtgcggggcccgagtcggcacgggggcatgctccaccaggacgcagcacgacgacgcgcccgctgagct

SEQ ID NO: 39289 - DNA, 119 bp, Chlorella protothecoides
gaggggatggccagtacgtgagcactcccttgatgcagggcgattaggtgtccttaccccacatcctctgaaccatcaccatggtgcctgcagcagcatccatgtaccaatacacaact

SEQ ID NO: 39290 - DNA, 61 bp, Chlorella protothecoides
cggtggggggctgggggaggtggcctgcagcgctctctaatcctatgatccactgactcga

SEQ ID NO: 39291 - DNA, 408 bp, Chlorella protothecoides
  modified_base (111)..(281): a, c, t, g, unknown or other
accctgtgaccctcagcctcatctcccctctgctatcccccaacatggtcaggtacctgtatgtgcgcatgctgtgcagccccggggtctatggcgtgccgctggacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggaagggggggattgggaggggggaaatgggagggagagtgatgttgtgagtgcatatggggaagggctttgtcacgggactgggtttgtcattgcatgagagggtggtgggagggcaggtag

SEQ ID NO: 39292 - DNA, 104 bp, Chlorella protothecoides
cacgaatacggaaatggctgacaggatcgagcacaccccctaccacacgaaagaaccttctgacctggaagccaccgctggtcccagcattgtttatccagacg

SEQ ID NO: 39293 - DNA, 8570 bp, Chlorella protothecoides
  modified_base (107)..(116): a, c, t, g, unknown or other
  modified_base (1208)..(1217): a, c, t, g, unknown or other
  modified_base (3027)..(3036): a, c, t, g, unknown or other
  modified_base (4766)..(4775): a, c, t, g, unknown or other
  modified_base (5740)..(5749): a, c, t, g, unknown or other
  modified_base (6095)..(6104): a, c, t, g, unknown or other
  modified_base (6240)..(6249): a, c, t, g, unknown or other
  modified_base (6693)..(6702): a, c, t, g, unknown or other
cactcactccgtgttgggcctgggattggcgcacacgctcgtcagatctagattggtgtcgacctttgcagtggaggccctgctagtgcctggcagagcatttctgnnnnnnnnnnacacacgctcgtcagatccagattggtgtcgaccttcgcagtagatgccctgctagtgcctggcagagcatttctgggaggcctgatgctcgggggggatgcctctgtccaggtggggagagggtcagttgggtaacaacggaatgatctcgctctggaagccacgacgcgcgaatgattgccgtggaactcagcacgagattgcattttcaacagccagtccacagatgcaaagcccgcgttcccacttgaggggttgagactgccatcagccggctcacgctgcgccgcggatcccgcgagctccgacaagcggccaacagagaatatggagtaggtcaatgtgaccgccagcacggtgagaatgatcagaaccctccggcgtgacgaagacaatgtttgctccagccacatcgtgcccctgtcctgccctacaaggcacaaagccgcatgtccctcgacagtgattgccaggggtacaacgcccgcaatatgctcaagtgtgtttggagggcgacctgcgcacggaaaattagcgaggtggggcatagtccgcatggttccggacgacaaacggaagcccgtccaagaattggcgcctccaagcgccattctcacgaactcgctcacattggacaattcaaccctgttgcattttcacattgtgacttgtccatactgtgacaaggaactaaaaagcatttacacttttgctgactattttatgtggagataatggcatgtgactctgtgtgttctctggtgtgcgccacgagaagccgcacacctctgcactctgaacacaattggaacagcttgccactgatttactcaacacccaccaatactggtaccattaagcgggcttagagggctaacggagtaccactttctatgagggcaggtctgagtgtgaacatttgacagaacatttgacagtacacatgtttcaatcatgtcgtcccctcaatcagctactcccctgactctggaggcttgaggtgacttcttcatactatcaggtgagtggaagctaagtccaggatcccacgtggaaaccaaaatttgacaggagggcctagtccatccgcnnnnnnnnnnaagtgtgaacattggacagaacattggacagtacacgtgtttcaatcatgtcgtcccctcgatcagctattcccctgactctggagacttgaggtgacaccttcataccatcaggtaagtggaagctcagtccaggatcccacgtggaaaccgaaatttgacaggagggcctagtccatccgcctggcacacgcgtgcgcgaccatgccctcgtggcaagcagcctcctctcctatcgattctcctggcacacatgcccatcacgggataactccagctctgtgtaacatccaaaaaatgtaagttgtttgatagaaagtcgtcggttagctgcgcacagcgagagcggcatgacttgctgtgggtcgcttcgaatgttatcccatactcgcgccattcatggctgtggcttcagcatacactagggtctccatggggcatccgcactttcgcgcttaaaacactggcggggcgtgagatctctgctagtacaacaagacccgaaactggatctgcgcgcggttttgcccaagagtccgtgaccggatttcctttctgggattctgccaccgaaatcccgccactgtcgtcgaccgaatctgcgggcttgcctagctcgtgtgccccattccgggctcggtaaacccacggggacctgaaattacccattataagtggtgacgcggagagggagcgccgaaaaccccttcccagggggtttgcgataacccctaggcgtcgcgcaaccctgcgctggcggggacttgactgtggatgagccgcgccggacgctgaaagcgccccgatcaggtcctgaaggctcccggcagctgcaatttcagcagtttgacctccaccacagcgacctgtggcagcactcgggccctgcgccgcacgcacccggctcggggtgccccgcccagcggagcccatgtcgacgattctgcgccagtggtggcagaataagaccatggagctgacgtgagtcggcaggagcgtgggatggcggggggttggcctgcaaaccgcctcgcatgcctgccgttcgtccaggccctgaccctcccgtgggctgccagcccaaccctccccaacctgaccccgggccgggatccgctgactcagcaccgccctcttcccccccccagcaaaacccggcgtgccagccccagcagtcccgggacctcgacctccggcccccccaccccccctcccctcgagtacattccccccatccccggcctcctccactaccgccagatgggcgggctgggcacgggggccttcggccgtgtgatcctggcgcgggacacgcgcgacaacgcgctggtggccatcaagctcctcccccgcggcgacttcatcgccaccttcaagacctacgtcatgcgggagatcatgcaccagggctcgctctggcacccccatgtcgtcgcgctgcgggaggtgttcaccacgccgcagtacctggccatcgccatggagtacgcggcggggggggacctcttccgccacctgcgccacgagcgccccgcccagcgcctgcccgaggcagaggcgcgccgcgtcttccagcagctcgtcatcggcctggactactgccacaccagggtgggcgcacgcggaggaggggggccctgaatttgtcaggagggccaaggaaccgtggccggcaggacgaggggcggacagacggcgctgggcgggtgcgggccctgcaccactccccctgccccgtagactcacccacgaagctcctcccccatcccgtcccagggtgtcgcaaacagggacctgaaattggagaacnnnnnnnnnnccgctgggcgggtgcaggccctgcaccactccccctgccccgcagactcacccacaaagcgcctcccccatcccgtcccagggcgtcgcaaacagggacctgaaattggagaacctgctcctgtccacgccctatgggaacggggcggcacccagcctgaagatctgtgattttgggtactccaaggtcagttggcctggagaggaggctgggaggggatggggaagtgagcgggcggccgggcgccctgaagcctgctgtcccccaggcggccagcgccacctgcccttgtgcgcaacggtcacacaaggctactgttgaagggaacagtgttggccccttttcgatactgcagcatgagctgaactccagtgccaagaccggggtggggacgcccatctacatggcacccgaggtcatctacggcggcagcaagtacaatgccaaggtgggcggcacaggggcagcgggtcggccgttttcttgcttgcctttgccctgttcccaatggatcccctccaccatagcctgagagggtcggtgccagagacaccgcttgatcgcatccctgcaatgctcccttccacaccctccctttgccccctctgcgtgcagctggcggatctctggtctgtgggtgtcatcctgtatacgatgcttttcgggcagtatccctttgccgcggcgcagcccaacgactgcgagtatgcgcgcaagatcatcaaggcagaggttggtgtggtggggcccgtcggaggtggggccgctggtcgtgctggggaggagtgtggggccagtggggctgtcgccagccgggcgcagcacctctttcctgcatgtgggcgtgcaggtccgggggcttgagcagcgcaacccctcccacctccaccctgcgctggcacgccgcgaggcctgcaccccctgcccctccgcagtacgatgtgccgccgagcgtccctgcctcggcggacgtcctggatctcctggcgcggctgctggtggcggacccgcggcagcgcatccccatcgccgagatcatgcagcacccctggttcctccgcgacctccccctcggcgcggccgacatgaacaggttctatctggaccgcgctcccgtcctccacccggtgaggcctgcagaagagcttccgagttgcaagcggggatgggggttggcgcgcatatgcaaagctggaagcatgggtggtggctgtgggagagcgcgtgctcagttgggcaatccctctcgggagggcgatggcgattccatccgtcctcacaagggccacttgcgctgtcctccagctcatgtcgctccacttgcgctccctccctcacttacgatctacatgcccttaccttgtccctcccccccccgcgtacctcccatgctccctgcagctcgaaaaggacatcgagcagatggtggacgtggcctccggccccgtgtcggcgcaggaggccccgctggcctgctccttcgacggcgtgcggctgctcagcatccagatgagccagggcggcacgtcgctgggcatgctgggctcctcccagcatggatacctgtccagcacctcctcggcgcgcatgcagagcaccctggggtactacggcgcgcagcccaacgcctcgctcatggtgccctgacgcgccgtggcgggccgattggaaccggagagcacacccggagcgaggcacgccgccgcggctggctggtggccctggagcannnnnnnnnntagaaagcacatcctgagcgaggcacaccgccgcggctggctggtggccctggagcaaggcttgccaccatggcaggctgatcagggtccaggtagaatgccgtgccctgcaatggccccccactcccctcccacccccttcacggagtcggccccggaggccctcccaccaccctctcatcatggcaccattgcttctcagcttgctcttcccagtgtacaaacttttcactccttggcctctactctgcctgccgtcgcaaagcttgggacttcttggccgccgacggtcacagacctggtcccttgtcactgtacacttctcttcttccagcctgcctgctgggagggggggggctccttgccccgcgcttgctttcattgcgtaccaaggatctctccccccctattaacctttgtgtggctaacttgctgtcccatgccgctgtgccaggttgaattgccatgaatttactggacaaatggagcaacatcggaggggccgagcctcccaaagcgtccaatgcaagtctttcttctgtaagcaggcatattcgacagggtgcaccctcggcaaggtggtcatccgagacagttcacaagagagggatggggccagacactagatcttgaggcccaggtagcccaggagggccacaccgatgaggcccgccgccactgtcgcccagcgagcggcatcaaaactggcgccgctggtctgcgaggcattgggagaggtgggttttggcgttgagggtgggcaggaatgagggcgacacacgcagcaaagggtggccctgcggacagcctcaacaaaagggggggggagcagcctgtcagggcatgcgcctgcatgcaaggaggtccctgtccccgaacctccaccgtggccccccctgcacccaccgctccagactcggggtcgaaacgcacaaagcggcgccggggcgcattgcactgggggnnnnnnnnnngaaagggggggagcagcctgtcagggcatgcgcatgcacgcagggaggtccctgtccccgaacctccaccgtgaccccccccactgcacccaccgctccagactcggggtcaaaccgcacgaagcggcgccggggcgcattgcactgggggcacacatagtcgctgggcaggtcctcccagggcgtggcgtcgcagtagatgtagcctggtgtagggaggcgggggaggaacgatgagaccctggactggatctggggtcagggcaagcatgcgtgtgggcatctccagtatatgtgacaagcatgcctgacattgcccggccacccctgcatgccctaatatgannnnnnnnnnggcatctccagcatatgtgacaaccatgcctgacatcgcccggccacccctgcatgccctaatatgaacatatcgataacttcaaactccccccaccccaccccgcaggtccccctccagttccccgcgtctgtcnnnnnnnnnnctgataacttcaaactccccccaccccaccccccaggtccccctccagttccccgcgtctgtcctgcacccctctccacagcattctcaccgcagtccaggcagatgtgggtggccctctccttctccgtggcgctcagccggcgcccgaaccgggggggcgcgctcttcttgaccaggcgcttgacgtccacgctggtgttttcccccttgaccaacaccagggtgatgggagatggggccgcctggatggccgagcgtgcaaagctctgttgagaggttgagcggtggaggagggggggggggtttgagggacacaagtctttaaatgccatgacatattaagaaacactcgctggacaccagcaggtctgccagccaccaacttcccctgtacagcccatacttgggatgtgctgcgacaaggtggaagcctgctgtgcannnnnnnnnnggcggtggaaaggggtgggagtattttgaggaacacaagtcatagaacgacatgacatactaagaaacacttgctggacaccatcaggtctgccagccaccaactttttctgtacagcccatacttgggatctgctgcgacaaggtggaagcctgctgtgcacatctcgattacccctggtatgtcgctaactcctgccacctcaacacccttctccatgcacttgccagcttgtcggcaggccacagctcatcaccgaagaaggatgaggtgtagatgacggtgtcgccaacctggactcccgccttggcagcgttgccagatgcgctcttgacgcggaggcccccctgtggggtccgcccctgctccagcgtctgcagagaggggcttagcaaggggctgagatgccaaagagacagtgaattgtaaaatggacacacagaaacaagcatcgggggcccacaacttgtgtggagagcatgccttctgagagccaagcagtgcacgaccttaccaggccgagaggcttggagatgtcaacctgcgagtgttgcggtgtttaaagagtccatcaggaagaccgaatcgaggggtgccggtgttcagggtcctccatgaagaagtggacaggctgccacctggtctcccatcaccattcatgaaccatgcagcacctggacttgctgggccctctgctgcttggtggcagcagcggttgtggtcatgtgcaggcgctttgccgacaccctggagggcggggcctgcagggacaggcggctgccggtactgaatccggcatgcctcgagcccatggaccggggctgcacttggggctccacacggatccctagacccgcatgcaggactaacgacgccatggtgtttcggcaatgtgtcgggagagtgcctcgggtgcaatgccgaagtaatcaacgagaggacaggccagcagaggtcatcatgcgggggtgtggtggacatcatggcggaaatcctaagcgatggccgagatgcgccctttccttcgtcaccgtgcgtcatctggcgcgtcaattagcgatggatcccctccaaggttgcaggcgctggtccatgacgacatcgagttaccccgagttgtgggcataacccaccctcctgacgtggtctgggagaagagcgtgctgcagggggtgccagtgagcagggctcagggctccgagcctacctgggcacacgaggccctggggcgacgacctcgcacccatggcactcgaagccacacttcataaagccgggcaggcggtgcttcgtcgcagcatctctgtcgtggcatggtgcgcggggtgccagcgatcccgcagttccggagtctctgggtgcttgttggcgatgccttgcccacggcctcggggtgcagggccactcaacctccacttcccaaacctctgcatcgcaggggccgcaacctggagggccagtgcggcgtgtccagcacccgccccgtgcttgccggccctgaggccgtgcaggggctgggccatgccgaatcaggggtgccccacctctcggccggcaagtcccactccgcggcggttctggggaatggggaggtgtggacctggggcgatggcaccgcggccaagctggggcacggcacctccgacccctgcgcctcgccccaccgcgtggagagcctcgtgcaccgagcgcgagtgggcagcgcagcgctcggccggcaccactccctcttcctagacgacgagggcgggctgtggagtgcgggcgagtcgcgcgtggggcaggccaccctgggactggagtcctttgccgccgagcaggccgcagcggtggcgcggcggggacctgggcccgccgccggcgccgcc

SEQ ID NO: 39294 - DNA, 101 bp, Chlorella protothecoides
gggcagggttgatcactttctcaaccctcattccgcgcgcgcgcattcggtggcgaggcgtcacactcccacctcctcctcatgcgcctcacgtgcatgcc

SEQ ID NO: 39295 - DNA, 61 bp, Chlorella protothecoides
gacaggctggatctcggggtcagccccggcttcactggcggccggggaggcgccctgggag

SEQ ID NO: 39296 - DNA, 17397 bp, Chlorella protothecoides
  modified_base (119)..(128): a, c, t, g, unknown or other
  modified_base (214)..(223): a, c, t, g, unknown or other
  modified_base (855)..(864): a, c, t, g, unknown or other
  modified_base (2215)..(2224): a, c, t, g, unknown or other
  modified_base (3200)..(3209): a, c, t, g, unknown or other
  modified_base (4310)..(4319): a, c, t, g, unknown or other
  modified_base (4419)..(4428): a, c, t, g, unknown or other
  modified_base (4583)..(4592): a, c, t, g, unknown or other
  modified_base (4650)..(4704): a, c, t, g, unknown or other
  modified_base (4854)..(4863): a, c, t, g, unknown or other
  modified_base (5215)..(5224): a, c, t, g, unknown or other
  modified_base (5701)..(5710): a, c, t, g, unknown or other
  modified_base (5922)..(5931): a, c, t, g, unknown or other
  modified_base (6467)..(6476): a, c, t, g, unknown or other
  modified_base (7525)..(7534): a, c, t, g, unknown or other
  modified_base (9489)..(9513): a, c, t, g, unknown or other
  modified_base (9572)..(9581): a, c, t, g, unknown or other
  modified_base (10062)..(10071): a, c, t, g, unknown or other
  modified_base (10672)..(10681): a, c, t, g, unknown or other
  modified_base (11065)..(11074): a, c, t, g, unknown or other
  modified_base (12286)..(12295): a, c, t, g, unknown or other
  modified_base (12662)..(12677): a, c, t, g, unknown or other
  modified_base (12822)..(12831): a, c, t, g, unknown or other
  modified_base (13336)..(13345): a, c, t, g, unknown or other
  modified_base (13727)..(13736): a, c, t, g, unknown or other
  modified_base (14244)..(14253): a, c, t, g, unknown or other
  modified_base (14870)..(14961): a, c, t, g, unknown or other
  modified_base (15365)..(15374): a, c, t, g, unknown or other
  modified_base (15592)..(15601): a, c, t, g, unknown or other
  modified_base (15878)..(15887): a, c, t, g, unknown or other
  modified_base (16147)..(16156): a, c, t, g, unknown or other
  modified_base (16629)..(16638): a, c, t, g, unknown or other
  modified_base (17327)..(17336): a, c, t, g, unknown or other
gcccgcagagcctggcggtgctgtcagggctggggccggcgggcgggacgggcggcgccgcgcgcgcctcgccccagcccagcccccgtccgggccaggcggaggaggggcccatcttnnnnnnnnnnagggaggtgagggcaaaggaagagggaggcgcacaacaggatggggagggggcaagcgtctccctggatgcacctgcctgactacnnnnnnnnnntgggtcggggggggggagctgaggaggcggtggagggattgcagggaggtgagggggaaggaaaagggaggcgcaccacaggatggggaggtggagtgcgtctccctggatgcacctgcctgactacacccgcacacctctttgaccctcccctccacccccccccccaaaaagcagacgtcccagagcgtgctgaccatgctgagcacgctgcgcgagcgcatgcgcagcaccagcgacgagcgcgtgtttgccgcactgggtgacgcggcggacaagggcctggaggcctcgccctccgccagcccaaaggcctccaccgcggagccggaggaggcggagtgcggcatctgcctggacgcgggcgtggaggtggccttctccggctgcgagcacgcgctgtgcctgtcctgcgcgcgccacctgacccaggcgggcaagcgcccgccgcactgccccttctgccggcgcatggtggtggggttcacgcgcgtgccggccgcaccgggggccgcgcgcgtgccgcggagcgggtgacctttgcccccgaacgggggctgtggcgctggatccctctgccatgcccccccggtccaggcctcgtctctccagcaccagtctgacagtacctnnnnnnnnnnttgccccccccgtcgagccccgcgtctctccagcaccagtctgacagtacctctcgccaccctcacccttcgatccgacagtacttcacgcctcccttggctcgccagcgcgggccccccgtctcttgactctgcctcccgtgggcgcgacccacagctcacccgccacctgcttgtctcgccgccagacccatctcccttgctgtcccccttcgcccgcgctcgcgccgcgccaccccctcccctcgcaagccatgcatacatacacacttggtctttttgtgactgtaccgacctcttgagtttcgaacgacatgcactcgtgcgctgctcacgggcatgagtgcccctctgctcgacccacatgcgttgaaagaatgacgtgcggggtgagcggcgaagcacaggcaaggtggggaataaagcgccctgggaagggacgaggcgcgtcagaaaccgccagagtgtgcctgggccttgctctggaagtacctgctcagggcaggcactgggcatgggtgagtctgcgggaggcactgtccaagagggtgtggcggagggtggggccaaccaggcagtcgagcgacatggccaaacatctgagaggcgccgccagcagcagaacccctcccttcaacatcggcgtcgactcacttgaccacgaactgggtggtgtccaggaatcgtcgagcacagttgtcgaggcaggctgtttccctgctgctgagagagctacctgggcttggagaggcagtgcgactgtgagcatcccttcatggaggctggcacagacaacaatgccgactgcgagccatgctccaacagtacaatccgcccacttcagtacctggcgtgcccatgcacttgtcccagcactcgtctgtcaggcgggccaccgtctgctgaagttgggcctgtgaggagcgtgcagaggggtggcggggcccgggatgactcatgcgccccaaggacgcaaattcctgggccatgcatgcggtgatcactcgatatttactcaccttggcctgctcctccattatgaattgctgcagctggggcgagaccttctggtcgggtgctgccgacatcgtgtgcaagtcaccgaacggctacaggcactggtggacacctcaggtccggtggagcgcttccaggactgtaaaaattgcaataattgcactttcgatcaatggaacgatgcaggaccagaggacatgcccgcttaacggaggctgatggttgcatggcgacccacgtgggcgagcgcccaaagctggcccacaacacaccgccagcatggcagtggccagccacttgagggcatcttcaaaggttcagcggcaataaacannnnnnnnnngacgatgcaggacctgagaaaatgcccgcttaaaggaggctgatggttgcatggcgacccacgtgggcaagcgcccaaagctggtccacaacacaccgccatcatggcagtggccagccacttgagtgcatcttcaaaggttcagcggcaataaacacctcgcagatacatcgattctacccggtgtgcatcaagatgaccacgaccgtcgcggtgcggaccgactccgctcggcgactcctatttctggtcacgagcgtgggacgcacctcggatgccatcaccatcacccttgacgaatctctccccacggaatgcctcgtacctgagggcacctcgggctgtaccctgaaggcggctgctgttttcctgacaggactctccacccagaccacccagctcttgggagtggagcccaaggagattcagacccaggtgggcaggcccaaagagtgtctgttctgggcatggtgaatgtgatatctgggattgagggatcctccacattcagtgcggccttttggtgtacagcagctcacaaagactgcctggctggagacatgaccccgtgtacgaaatgcatcttaagatatgaacttggattgtctgacccctcctctctccatcccatctccaggtggaggaatacgtttcgaaatatggcgacctgccggctgtgactcccgcagacctggcggatctagatgctcacctgctgacgaggacattcatcgccggcaatgcactcacgctggctgatctggtcacgtatgccgccgtagcgccagccctggtgaggactgggccactcgactatgttgcatgctgggtcatgcacagcaggtgcccttcctcggcatccgcggtgcctgcggacgccaggtaggttgtggagtggactgttgtcagagagaaccaaccccacactgacactcctatcccagcctcagcaagcccacgtgaccccatccctccnnnnnnnnnngctatgttgcgtactgggtcatgcacagcaggtgcccgtcctcggcatccgcggtgcctggggacaccagctaggttgtggaatggactgttgtcagagagaatcaaccccacactgaccctcctatcccagtctcagcaagcccacgtgaccccatccctcccacagtcctctctgccgcccaaggagcggtcccaactcccaaacctggtccgctggtacgaccacatccacttcaccgccgaccccgcatgctactacccggacctggagatctccaagcctgtattcgcctcccccggccccagcgcaccaacgcccgcccccgctgccgctgcgggaacagctggaaataaggaggggcccaaggcgtctccagaacccaaggctgctgctaggacccaggcgacagggcctgaggggcaacagccgcgggcaaagaaggagaagaaggccaaggaggccaaggaggcccaggtggcggctgcaccggctgcaccggccccagccgaggaaccactggttgatctgctggacttgaggtgagtcaagggtggcatgcagaggccttgtcttggtgtgtttgtgtgggatccagtgcggtgcaccgagatacattgacgagtatgaaggattttgccgtccccatgcctttgatacctggtgttggtgtggtggcattgctgcatctcaaaagccactgcatcagcagacggtcttgcatcgactcggcgggtacaacctgctccctagtcttcaacctggtatcctccacctcccttgcatagggtgggcaagattgttgcggtggagcgccatcctaatgcagagtcactatatgtggaaaccattaacctgggagaggagaacccccggcaggtgaagtggcgtgccaaccctattttgaggagtgctccatgcgtctgctaggcaccgcccgaggcgatgccgcaccccttgtgcacgcgtgtcaaagtgctctgcccttgtccttgctaatcacccaggaggatctgccagtccacccccccaccccccctcccgctgacgtgcagctccttataaccctccctgcagatcgtgagcgggctggtgaaattnnnnnnnnnntccctatttcgaggagtgctccatgcgtctgcgaggcaccgcccgaggcgatgccgcacccttgtgcatgcgtgtcaaagtgctctgcccttgtccttgnnnnnnnnnntgtgcccattgaggccatgcaggggcgaacagtggtggtcgtcaccaacctcaagccagccaagatgagggacgtgatgagctacggcatggtaagcacctgagttcagaaggaatggtgggaagacatggtatcagggcctctggtgtgtcggnnnnnnnnnngctgacgtgcagctccttacaaccctgcctgcagatcgtgagcgggctggtgaaattnnnnnnnnnnnnnnnnnnnnnnnnnnnnnnnnnnnnnnnnnnnnnnnnnnnnnnnggcacctgggttcagaagggatggtaggaggacatggtatcagggcctctggtgtgtcggtggcgtggccctcgagtgccgcacctcctggcaatgctgcccaccatgaccactgcgtacgccctcaaccctaccaaccacaggtgctcnnnnnnnnnnttgccgcacctcctggcaacgctgccaccatgaccactgcatccgccctcaaccctaccaaccacaggtgctctgtgcatccaacgatgcgcatgacaatgtggaccccatcatcgtgcctgagggggtgccggtgggcgaacgcatcacctttgaggggtgaggactgcattgggggggggtgcctggattcgagtctgggcgccatgtggctacgcttgaggggatgaatcatgtgattccatcatgctcactgatggcaaagggaagtattgcatcggcgtcgcgtatggcatggccaactatcaacattcttccaaatttcaactcaggtacacgcgtgagccggagnnnnnnnnnncatcatgtgattccatcatgcttactgatgccaaagggaagtaccgcatcggcgtcgtgtatggcatgaccaactatcaacattcttccaactttcaactcaggtacacgcgtgagccggaggcgcagctcaacccacgaaagaagcagtttgagaagattgcgcccagcctgattgtgcttccaggtgaggctcctgggattgtgacgagccggggctgtcaccatgatgcacggcagtggtacaaaacaacttactgacaaactcctcccgcctcttgatgcagacggcatctgctcgtacaagggagtccctttcatgaccagcaggggccctgtaaccgcgacaattcctggagctcacatcgcgtgaactggcattgaacgtcaactttgttgcaaggtcagggagaagtgtcacgaaatgctggcagatagggagggctgttcagccagggcagcaggctggcaagacaannnnnnnnnntgaaatgctggcagaatgggaggggctattcagccagggcagcaggctggcaagacaaacgtggaaagactgaagtgagatcaaaggggcaggattggcaactcccgagtccccgccctcatgtggccgcttgggcatcggcgtcaccctcaggcgccgccgcattgtggcccagcatcctgccgaagtgctggcggcacacagccgcgtannnnnnnnnncgcaggattggcaactcccaagtccctgccctcatgtggccgcctgggcatcggcgtcaccctcgggcgccgccgcatcgtggcccagcatccggccgaagtgctggcggcacacagccgcgtaccgctcggcaccgcccaccacctcctgccgctggtcggcaactgagaatcggacagtgaagggcgcggctgtcgtgaccccggactgggcgcagtactggcaccgtgcagtcagcttggtcacggagtctgcgtgcggaaccaaatccagcatctgtcgcacgttttgtgggtggggagggtgaactgattggggcatgtcttgcatactcacattgctcagaaacagcctcagacagtgcctcttggagaccaacacatgctcgttttggtcgctggcatcctctagatcttctggcaggagttccacccacggttcgaggtgctagctatcaaggcacagacactctagcaccgatccgcacacctcccccaaggatgtatccgctccctccatcccaaaacctacctgnnnnnnnnnnagatccccacgcctcccccaaggatgaatccgctccctccatcccaaaacctacctgtccgaagcgctgccgcatgaagtcgccgtccaggcctgccagcacccagagtttgccctccccatcagccgtcgagctgcagatgtggaagaggtcggggaagaactgtgcctcatccacggcgacaacttggtacttggcccagcgatcccctgccatgctgcggaacacctccagcgagggcacagcataacaggcctgcagaaggtcgacactgaacaatgagatggcgcgagtgctggcccatggtgaagccatgggtcccacaaattggaggtcaagatgcaattcaacatccaccaccctcacaggaagacactagaggctttacaatacacagacattcttaccagcaacacactctctgccaccggcacaccttcttcacgccgtcgtgggtgacaacatgcgagtccgagtagcgactatctttgctgctcttgaccagcgccaccgtcaaccctgccgcctccagcctctccacgcgtcttagcagctcgctggactttccggcaaacataggccccatgatgagttcaatacctccatgtgccggcttattggccggtgggcggtcgagctccccggacacatttggccggatgtcagatgggtggagggtgctggtgaaggcctgtctggacagaggcaacgcgctgcggacacagaactgcgagcgtcgggcgtacgggtgcagaactccgtgtcggaaaatctgggatcggggaatctgcacgcgcagggccatggatgccacgagggtggccatcccggacttcccggacactggtttcttgggtggcaaatgggcagagcgctgatttgcaacaccactccgcaggcgaatgtgaagagtgccaggatgtcaatacttacatccgacggtaggccgaattgctaccagaagtccacatccgcaaggacaacgatggcaatgccacgctgtcaggaccaagcccacctcgcgcccagagcactgctggcgacatttnnnnnnnnnntccgaattgctaccagaagtccacatctgtaaggacaacgattgcagtgccacgctgtcaggaccaagcccaactcgcgcccagagcactgctggcgacatttcttacgatagcaagggcaaatctatcatccgcaatatacgaatccatctacatgcattcttaaacctgttgagggtgcctttgatgcgctccctgtagcaaagtgcacccaacgtgcatggtgggcagcactcgccaaactccacgccccggccggtccggcttggacgatggacggcgatgatcacctccagctcattgcgcttttagaagagatcaaggtgtctgatgcatggcccgggaggctggatggagctagaggtactgttcgcgctgcaatcacattgtgcatgctgttgcctcatgacctttccctcctgaccccaggcttgctggcgctgcgtgctccggcactctgggtgcagaacgccaaatgcatacaccggctccctggaggatgttctgggtgaggggagcccagaccttccctccgccaccatgacactgctccagacccatgccctgaaaactggcatgggcgccccctctcccgggccggtgtgccctctctgcctgggcagcctgcaggaagaaccccatgcagacggggaggcaagcctgccaagcgccagcctccagcctgccgtgcaggcggtggtggacaagtacgaggtcccggtcggccagggcttctccctggacgtcagcctgccggcggccgcagccgtccgcgctcgggcgctggccgtccgccaccccggcgcctgcgccggcgcctgcgtggacctgaaggaggcgctgcgcctcagattcacgccgcccctggaggccgtgctggggacgagctgtgcgcccggggcggggctgcgcttgaccctggcgctcagcgcaccgggcgttgcgggcgagggcgcctggctggcgcagggcatccagcagcaggtggaccagagccggcggcggcgccacaccggaaagcggcggcacggcaagcaggacatcgtccccgccggtgggtgacagtggggaccagggtacagatggtggggtttggggtgagggaccttggcgggaagtacaggggaagtggcaggctggatgaccccctgtgatgtttactcgtgagacgctgctgtgtaacccctgggccatccaagtgattgcctcctgaaggctgcgaaacctaggaccccttccaagaccatgatgcactccctccagtatcgtccacccaacttatcatcccacactcccgatccccaaacacatgcagatgcgatggtggcgtcggcccgcctggtggaccagctggcggccttgaccccggcggccttcctcagcgcctgccctgcgtcggcggcgtccctggccccgccgcccgcccccgccacgctgggcctgcgcgcctgtcgcgcccctttccacctgggcgggcggtacaccaagctggggcgcgatatcccacagtcgccctggttcatcgacggcgagcgccgggggggggtctcgctggaggagcgcctggcggcggtggtgctccccggcctgcgctgctccgacgcctccttcctttcttctggccgcgaggacatggacgtccgcatgctgggcaccggccggccctgggcgctggagctgcgggacgcggggcgcgcgccgccggaccatggcgcctgcctggacctggagcgtgggatcaacgaggccgaggcggggcgcgtgggcgtgcgaggcctgcgcgtcttgaccccggccgaggtagctgccatcaaggccgaggacggggaccgggagaagtcgtatgtggccctgtgctgggccccgcgtccgatgggcgagcaggaggtggcgcagctggaggcgaggcaggggctggtgattaagcagcagacgcccatgcgggtgagggggtnnnnnnnnnnnnnnnnnnnnnnnnnaaagaaggccttcctggaagcttgggaaccctgattcccaggccgcgcccgcgctgtgnnnnnnnnnntgtgtttgcggccatgaggggttcatggcttgccgtgcgctggcacctgagctacccaagaagccccccctggaagcttgggagccctgattcccaggccgcgcccgcgctgtgcgacaacgcaaacgtgccccgcttcctcacgtgcaggtgctgcacaggcgggccaacctggtgcgaccccggaccgttgtgtgcatgcgcgtgaggttggtgccgtcctcctcgtgcttcctgctgggcctgcgcacccaatcggggacgtatgtcaaggagtttgtgcacggtgaggggcgggtgtggagatgttggctgtaaagtgatgcctgaagtaatcaggctggccctgaaagggcaggctgaagaacgaccccctttcgaaggtgagcaccatctcattgcaatgtccctggtacaggcgacctggggcgcacagtcccgtgcctaggggacctgctgggcatgcctgtgaccatcctgnnnnnnnnnntgtgatgcctgaagtaatcaggctggctctgaaagggcaggctgatgaatgggcccctttcaaaggtgagcaccacctcattgcaatgtccctggtgcaggcgacctggggcgcacggtcccttgcctgggagacctgctgggcatgcctgtgaccatcctgcagctggacgtcatggacattcacatggatttctgagctgcgcgtcacgcgcggcccgctggtgctcggaggcgagtgcttccaacagtaatccggacgggtgaggacttacagatgtggcatgaaaatgcggtcgattgtgggctcgaggcaatacagaacccagaacccgggatgcatcattcgtctatgtcctccgagagcgtatcgcgaattcatactgtatggaataacacgcctggttctaacaaaggcactgcccccttgaccgtgtcaggagcaagccgagacttcgtactgagcagtgcatccgctggcatgcattgcgcacgtcctatgccacaaaatacaatgaacgcagatgccccgactgggatttgagagtggatcccgaactgaacaatgcaggcgatgaggtcgaagtcaaagcccgccgggnnnnnnnnnntcgagacttcgtactgaacagtgcatcagctggcatgcattgcgcacgtcctatgccccaaaatgcaatgaacgcaaatgccccgactgggatttgagagtggatctagaactgaacaatccaagcgatgaggtcgaagtcaaagcccgccggggcaacgtgccctaatataacgtcatcgctcttcatgagtgcggggtccgaggcgccgtgacatgcatacggggtccagacaaaatacagcattatagctcatattgttttgactatacatcattttcaaacacctcatcacagcaccctggggggttcggcgccgtagatcgagtgctttgaagcacgcccgtgtgcgtaccagattccatcgacacccaggcctttgannnnnnnnnntatattgttttgactatacatccttttcaaacacctcctcacagcgccctggggggttccgcgtcgtagatcgactgctttgaagcacgcccgtgtgcgcaccagattccatcgacacccaggcctttgaacacacacagtatgctgcgagccatctcccggaccttgaccagatcatgcaatgcccccgccatctggaaaccaattcaggagtcggcgggttcatgggaaatgcgtcgcggcggtgcgaccttcctaactcgtagcttctcggctcaggcaaggagaggatcgtgcaggccggttgggtagagatgggccgctgaactttgcatgcatcccgcatgggatcatgtcatccagattccccccctcgcaacaagggttcctcgcacacccaccccatgcgcgcagccggcgtctgcggaaaagctgagcaccccggaccccaaggaccactccacctacaatgcggcggacaacgtgatgccccaccccggcctgcgtgccaccgcctcctcccccgaggcgggtggcaaggacaagagctactggctcatgcagcccatctacagcaaggagtatgtggagagcgtggagccccaccaccaggtacccgaggccttcttcgagaaggcgggctactacggggtgcaggccatgcgctccctcttcgacgtggccaccgggtacggccatcagatgacggaggagaggtggctgcgccgcattctgttcctggagaccgtggcgggtacgaggcatgggataatggggtgggataatgacaccgcgcatgcctagcctgcccaccctgaatctcgtcagcattcaagagccgctcccctgcaggcgttccaggcttcgtcgcaggcatgctgcgccacatgcgctccctgcgctccatgaagcgcgaccggggctggatccacacgctgctggaagaagcagagaatgaggtgcgggcggctgctcggctggcttgctggggatttagggcagagtcgggcaccttgggtgtcaggaacaatgggtcacccttctggcggtccagtaggccgacatcgtcccccggcactgctattcaaggcacctgcaagtgtgtgccatcccagggaagtttgaccggccatcccagaacatgtccccgaatctcccccccctcccaccccccctttcccgtgcagcgcatgcacctcctgaccttcctgnnnnnnnnnntggcactgctcttcaaggcacatgcatgtgtgtgccatcccagggagtttgaccggccatcccgtaacatgtccccgaatctccctcccaacccccccccttcctgtgcagcgcatgcacctcctgaccttcctgcagttcagggagcctgggcccttgatgaggggcaccgtgctcctcggccagggtgcgtggcggatgggccaggcgctgggttggagctgcatcagttgcacaggcagcggccagcgtatgccttgagtgtgggaattctacctgctagaagagttggcgatgccatgtcttggttggcacgagccgcctcattctccagagccccccccccccccccccccggcgcgggggnnnnnnnnnnnnnnnnaggtgcattttcacttgtgcaggtatgcattttcactcgtgcaggaagacaccctaccaactcgtgatgtggggatgcttcgtctcgtcacttcactgctacttacaaactgctcccctgggcttgtacgaacaggtatctggannnnnnnnnncatgctgcaggcgtgttcctcaacttttacctccttgcctacaccatctcaccccgcacctgccacagctttgtcgggtgagtgcactgcacagactgtctgatgggaagagggtggttgggggttgtacgcgctggtgtgcattttcactcatgcaggaagagaacctaccaactcgtgatgtgggggatgcttcgtctcgtcacttcgctgctacttacaaactgcgcccctgggcttgtacgaacaggtatctggaggaagaggcagtcaagacctacactcgctgcatcaaggtgcggtacggaggatggtacaggctgccggtatgcgcccatgccacgtggccgagagggggatgcctggactcgtcgcagggaagtgctccctctgcgccccttgtccataccgggaaaccccatccgttcgtcccctttcccctgccaggaccttgacgctggcttaatcccgcagtgggagaaaaaggccttgcctgaaatcgccnnnnnnnnnncgcgctcatgccacatggccgagcgggggatgcctggactcgtcgcagggcagtgctccctctgcgccccttgttcatgccgggaaaccccatccggtcgtcccctttcccctgccaggaccttgatgctggcttaatcccgcaatgggagaaaaaggccttgcctgaaatcgccatcaagtactggcagctgagccctgatgccaccatgagggacctcctgctggctgtcagggccgatgaggtgggctggatgctgaatgaggggaggacgcggttcctgcagtgagggaaatgtttcctaagccatgctcaggccggggcggtatgtttgggcctcccaggttcaggctcccagaccgcatcaggcagcccatcttgnnnnnnnnnnccctgcaggagggaaatgtttctcaagccatgctcaggccggtgcggtatgtttgggcctcccaggttcagtctcccagaccgcatcaggcagcccatcttgctgggccgtgcttcgcacccccgcctccctttctggtgatgcgtgcctcatgcgggtgtcacactccccctctcacaggcctgccacagccatgtgaaccacgccttctcccacatgaagccgtcagaggagaatcccttccttccagggacggtgcacgtgccctaaaggactcggcaagggtactgtgcctaagattgtgagcgactacggattgaagagtttgtctagactaggcttccaagattcctttacggcctcatctatttctccaacctccctgctttactagatagcttggctctggccccactatccggcttactcaccacccactcaggacgtgaggaagaatgagatgtattctcctatcacgcatggaatttgagcgcaaattgttcatctnnnnnnnnnntaccacccactcaggacgtgtggaagaatgagatgtgttctcctatcatgcatggaatttgagcgcaaattgttcatctggccctctccatcacccctcgacagcgcgcataatgcgtcaggtgcacccagagacggctgcatgtatctgcctttattgtagattattacaaggacgatccatttccatgtacagtctcatcgaagcactcttgagggggtgaggggcccaccgttgggctgcggctcgtgcctctccctcttcacggcctggcctcgatcacggcggagcccatctggcccggcatggacccgctcgagcttcccatacgccgatttgccactccgattgccgaggccgtgagggacaatgccgtcgtggtggtcattggcgaaacagggtctgggaagaccacccagatctcgcagattctgctggatgccggactgggggcgggcgggatggtgggcgtcacccaaccacggagagtggtgagtactggtggtctgtctgaccctgagcggcccttggatgcctgagggtgcctcgattcttcgcccttgagtgcaggcaggcaccggctgctccattgctgcccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaggaggtgggatatgcggtgcggttcgaggagtgctgctcgcgcaggacctcgatcaagtacctgacaggtgggtttgaagaagggaggggaagggacggccgtgctcgctcaccccatgctggccttgggacgctgccaggcaggcaatggcagcgggacacaacctgcctgggtggcccagtctgcgctcaaccgttgagtgcccgtggatgctcttcggggacttgcgggtatcgccatcaaccagggcacgccctccccgaccgtgacagatggcacgctgctccgcgagctcctgcacgacccttccctctcgcggtacggtgtgatcgtgctggatgaagcccacgagcggtcactgaatactgacgtcctcttcgccctactcaagaacctgnnnnnnnnnncgaagcccacgagcggtcgctgaacaccgacgtcctcttcgccctactcaagaacctggtggccaggaggtgcggccccgggctttgatggccagcggagagggggaggggaaagcggggggccgtcaatgtgcttctctctgcccctcagcggatggcttgcaggaggaggagtgcccgtgggcctccatcttggcgagcctccgcttagcagtccnnnnnnnnnnatttgatggccagcggagggggggaggggaaagcggggggccgccaatgttcttctctctgcccctcggcggatagctcgcaggaggaggagtgcccgtgggccaccatcttggcgagcctccgcttagcagtccctgaaaccgccctggtttcctcccaccctcaccctgaccaggaacccccctctcaagctggtcatcacctctgcaaccctggacggcgagaagttctcagcctactacggtgcctgccccgtgttcgaggtccctggccgcnnnnnnnnnngccagggacccccctctcaagctggtcatcacctcagcaaccctggacagcgagaagttctcagcctactacggcgcctgccccgtgttcgaggtccctggccgcgctttcccagtggagatcgtgcattcgctggacgatcacagcgcagactacctggaggccgcggtggacacggccctagacatccactgcaaccagccggagggtgggtgtgggggggaggaagggggcagcatgctgaggcgctggagaggtgnnnnnnnnnnggtggagattgtgcattcgctggacgatcacagcgcagattacctggaggccgcggtggacacggccctggacatccactgcaaccagtcggagggtgggtgtgggggggaggaacggggcagcatgctgaggcgctggagaggtgcgggcctgtaatgcatctccagtcacaggctgcgggcactctgggtgaatccctcgttccacctcgacacccccaggtgacatcctggtcttcctgaccgggcaggctgagatcgacaaggcggtgtgccagctgaatgcggcagtgcgcgcgctgccggccgatgcggcgggggacctgctggtgctccccatctacgctgcgctgcctccagacatgcaggcaagggtcggtgcttgagtgtgagaaggcgcggcggcctctcgagggtgcagggcgctcgaggtggtgatgacgaggcgcacggcgcagtggccggcggcgccnnnnnnnnnnatcttgagtgtgagaagggcgcggcggcctcgcgagggtgcagggcacccttggtaatgatgatgaggcgcacggcgcagtggccggcggcgccctccccttgcccagggcccgtgcctgaggctggcacaggtcccgctggcgcctgaatcccccccctcccgccctccagcgcaggccagggtgttccgccccgccccgcccggcacccggcgctgcattgtggccacaaacatcgcagagacctccgtcaccgtggagggggtggtgtacgtgattgaccccggcatgtccaagcagaaggacttcaatcccgccacggggttggaccgcctggaggtcggacccatctccaggtgggaaggaggggttggggcaggggtgagcaggcttggtgcagggtcggatggacgagaagtcgttgtgttcaagcgcatgcatgccaaagggagtacacatgacgaaggagggaaagtgtgagggggccgcggcgtgcttgggccacccgagctccaccagctgggaacgctgatgccctccccgcccccaacacccctgtaccagggtccaggccacgcagcgagccggtcgggcgggccgaacccgaccgggcaagtgctaccggctgtacacgcaaaagtactacgagcgccagatgcccaacacggtgtgtgtgtgtgtgggggggnnnnnnnnnntagtgaaagtgtgagggggccgtggcgtgcctgggccacccgagctccaccagctgggaac

SEQ ID NO: 39297 - DNA, 162 bp, Chlorella protothecoides
ggagctgccagggagtgcagagccacgccagtgtgtggacgtgattatggactggtagggccaccccatgcaccctgcagatcccttacagaggtacttgcagaaccaggcaccatccttcatccgacatcacatcagctctgcacctgctgtcacggcaga

SEQ ID NO: 39298 - DNA, 79 bp, Chlorella protothecoides
ggggaagggcctgcttcgtcctccgacgtcccttcgtcgaccatgttcacatcgctgccgctctcgtcgctgccgggcg

SEQ ID NO: 39299 - DNA, 251 bp, Chlorella protothecoides
ggggtgggtggggggggcaagctcctgatgcaggggtgggcctggggctgccacgtgcgtgcatggctggcacctcactgcaggggaaacgcgggacctgtgctgcgccgcggcaggccagtcgcagacatcggggaggtaagatccgcatgcaaccactgctccctatcatcccgaggcacaaagatgcagtacagaggctcaatcttaccaggagttgggactcgtagttgacgtaaaatgcgctggcc

SEQ ID NO: 39300 - DNA, 17823 bp, Chlorella protothecoides
  modified_base (9904)..(9913): a, c, t, g, unknown or other
  modified_base (10031)..(10040): a, c, t, g, unknown or other
  modified_base (10273)..(10282): a, c, t, g, unknown or other
  modified_base (10387)..(10396): a, c, t, g, unknown or other
  modified_base (10818)..(11039): a, c, t, g, unknown or other
  modified_base (11113)..(11122): a, c, t, g, unknown or other
  modified_base (11334)..(11343): a, c, t, g, unknown or other
  modified_base (11705)..(11714): a, c, t, g, unknown or other
  modified_base (12642)..(12651): a, c, t, g, unknown or other
  modified_base (12819)..(12828): a, c, t, g, unknown or other
  modified_base (13152)..(13161): a, c, t, g, unknown or other
  modified_base (14156)..(14165): a, c, t, g, unknown or other
  modified_base (14964)..(14973): a, c, t, g, unknown or other
  modified_base (15522)..(15531): a, c, t, g, unknown or other
  modified_base (16121)..(16130): a, c, t, g, unknown or other
  modified_base (16192)..(16414): a, c, t, g, unknown or other
ctcccacccacccccctacccaccaccagcttgcgatagaccagtcggcggtcgagcagcaggtcctgggcaaacacgtcgttcacgaggtagggccggcgcaggaccacatactgctgggcctgtggaatgcgaggtacggtggcggggtcggctcccggcaggccgctgcataccagcacttggccgagtctcgtcacgcatgcctcgcccatcgtctcgccatgcgacctggccgcgacacaacaaccccacgcaccttcttgagggggaagccctctgagtgccacgccaggaggcaccccaccacgggccagtcctccaccggcgcgttcaggatggtgtcgtccccgaagaccacgacctcaaactcgccgtagcgggacaggcgcttcattatgttggccatctgcttggacctggccttcttgtccatggcgcagatgccgaccacgatcttgggcaggacgtcctccccttgggacaggcgcggggcggagtggaccctgttgatggccgggggggccccatcctgcttggcctgctgctgccccaccatggaggcaacctggtccctccggaactcggccagggtggtgctctgggctgatctcatgtgaaacagcaggatcctcctagcccgagtgatggacccagaagaagatcacagggtcaagccgcaacggcaggcatgtactgccttagccgtgcactggagggaccgcgagggatgtcactcgacccaataacccttgagagctaccgtcccctgtctattcacagacaagaccacctgggcactactcgatgcttgcaacctcggttgtttgttgcaggagagcttctctcggccggtggttgcatgcgaatgaagcatattcgacacccacgtgcggaaggtgtccatcgtcgaaaatatttctgcagtctgagaattctgttgaaatacgggcactccccccccagattcattcaccagggcaccaccgatcagcaacggctgatatgcacaacgaaatacccgcactcgaaaaaaatagaccactctaggatctttcgtgcaccagtttccgtcactcttcccgtggacggggctcgcacaccgtagtgtctatggcagggcatgccaccttcggattgataggcacatttcttctcctatcatttttgggtgggagcgtggtggaatccagcgcatctgaggttcaggagctgacagacctgaacttcgaccgatacgtggacggcacctccccatggatgatcgacgtgtatgccccctgtgagtctccagaggttgcgtaccaacatgagggtctgctctttgatgtgtcacccgggtgggcggggcacatgatcatcttgacgagcccctcgcatccttctaaacagggtgtggaccatgcaaggccctggccccagtctgggaggatctggctcgagaattgaagccgctgggcatcagggttggcagggtacgcgcctctctggcacagctgtggggttgtggatgcctggccaatgagattctaggcatgatctgctcccggccaggccgaggtatcctatgactcccccttccccaacatacacgcactttcagatcgatggtcctgcaaacaaggtgtcgctgcagcgtctgcgagttgctcacttcccccacctgttccatgtcattggtgatgagttgagagaggttcccagcatggcgcgctcgctagaagaggtgaggctgaggagccgtggctaggttgtggtgttgacatgggtgtatccctatcggaaccattgacctgagcaaacatagggcaagagaggagactcctcaatttttcagtaaagaagagcctgccatgtctgcccctcacacagtcacaattacagctgggaatgtcacatgaacacgtgaaccctcgccctgtgcagttgcaagactttgctttgacagggtggcgctccactcagccacggagaggctgcagttcccctgtttctacttgtggtcgtgccataggtgcagtgaagaagtgagcatgtagttggagtgtgccggtgttgcttgcagactggagcatgggtctgagaccataactgatcttgaccggaacatgatacccttcctcccctgctgccacagattgggtccaggaactagagctgggtacatatggctgcacaaggagcatggcctgagccatgtcaccatctgtgctatgtttctcagtctaccactctcactaggtaggcgaggatgtatctgagcagggttgtcatctgctcctcgcgggtatgtttgtatcggtcacttgccttgcaggcaagttctccctggcacctgccaacctgatttgttttagcctggagggtgatgcagcggcctgtgctctgaggccctctggcatttgagggtgtgacacaccctgcctcttgcagggctggtgctcatctgtgtgctggattcgtacaacacacgctttgcaagaggcaatcttcatcaggactgattcttcaaggatttcggcactgttaccaaggcctgtgagcagggatcgcttgctgcaacgggacactgggcgtcgtgcacagcacgccgagcgtccatccttccattctccatgcgcatttcccagctgcctcaacagcttcccccaagcatcgtgaccttctccagctccactttgagtgtctttcaaggaaaccggtcatctattgcgttggggagcagatacatggccctgggactgagggacttctaccctttattgtatttgtgcgtcatgcagagcaaactcctcctgacccagccttctacgctggatcgtcccacccctgtggatgtgaaagtacaaatccatggtcgacgttggaaaaggtctccccgcgcccctcttggcagagagagcaggctgcctccttggacactcggatcaacatgtgctggtggtctccccaacaccctggagaatgctccctccgccttcgttggacctcttacaaatcatgcaaacggcttttccgtgagaagccgtgcaatgcacaggtagggacaatgatggtcaccagattgactccccagaaaagggttggaaggtcaaggatgtgcagcttgaggccctgcctgagcagaccatccatccctgggaaggcctactattccaagcatacctcatttgaaggactggacagtgccaccaaaccacaccctgtggacagtagcagcggcgcacctgcatcgctgctcagcatcccaagcaacccggccccttcacctaagggcgatccagaggtcgacgagaaatacacccggctgtcggcacagattctcaattatagagcagggagcgcagtaggagcgcgatgcactctacaagtacattttggaagctgatccgcctgtgttgcccgcttgatcggctgatatcatcccgtacgagcggcgcatcaaggccagagcacgccgcatccgctcccatcttgagaggaaaggcggcaagaggcagcagactgtttcggcaagcatatgagggccatgataagcttgcacctggtgtggatcccatgtttgcaagcggtcagcttagcaaccaggcaggcagagcatgtggggggcggcagtgccttcggacgggcaagggcgaggaggggaccgccctcccatcccatcccctcccttggccacctcaggcctcgacggacggagtccccgggcacggccatcaggtgcaaacagtgcttcgtcgccgttgcactcgatactctaccattccaatgatatttcaacacaacaatctgccttgcggggcgcgttcgcaccccgacggcgcatggcaaggccctgcaaagttcgaaaacctgtcgaccgaacgagggggtctcgcaccgcaaacaagcatttaaagttatatttaaggcgtctttaacaacgtttgagggggggatgccggcagaaggcggagttgcgacttgtcccggggagcggaacatgtaatacagcactccccccctcctttccgaaggggacgttgcacgcgcgcagactcgaggggtagttgttcaatgcatcacacggaatgatcatatagcgtcccatgttttagtattgcaattgcgcttcgaaactccctctggtgcaggggtcttcccaaccacctggccttggatgctgggccgactgctcgttcaattgcctggctgtccatcctgccttgccacataccgcctggcaccgtgcagcaacgtgctccggtgcaggccttacctacccaagacgcggggcatggccgcagacaaggaggaggcgatgccctccggccagacggtggacggcgacggatttgtttcccatggcaatgggtttacagactccacggcccaggcatgttcgtccaatgctcaagccatgctcttgcttggagactgagagacgtagattgccgagctgcgggacagcgccctgacacaatccctgaccggccatccttgccaaccccgcgcaggctctcccagccaagaagaaaaggaaaaggaaagagaagcccccgcccctgccaccccccccgctgccagacccatcctccttccctccctacaagccctccccccacttcagattcgagctcatacaccagtgcgtggggtgttgggggccgaaagctttgtgcgagcggttttgggtggagttccagagccgctgcctccccctgcagccccggtgtccaggacggggcatgccagggactcagcaccgccgcactcacggcgcctggccctgcgagccgcacgctgtggctctggcatcaccccctcgcgacccagcccctgccccctcggcccaacccccgcccaggtccaagaagtctgcagcgcgggtgggcaggatccacacaccccacggcgtcatcgacacgcccggtttcgtggccgtgggcacgaacgccgcgctgaaggccgtggacggcgcttgggccgatgcagaggggctgcagctcatgttctgcaacacctaccacctcctgctgcaccccggccccgaggtggtggccggcgccggcggcctgcatgccttcatgggccgtcgggaccggccgctcatcaccgacagcggcgggttccaggtcttctcactggcctacggcacggtgcacgaagaggtcaacgagctgaagcgcagtcaggggccctccaagcacaagacggggaacctgatgaagggcgtgacggaggagggcgtccgcttctgcagctacaggtgggagggtgggaggaaggggggggtctggggtcggctcctggagccccattgcttggtgtacctggatcggaactgcagcctagcatctaccctgccatgatcttggccggtgacccaacctgaccgccagacacagcaaggcatggtggggtggaggacccacccaagtacccccctcctcatccgccgcagggacgggtcccacatgctgctcacccccgagtcgtcggtggaggcgcagaaggcctttggcgcggacatcatcctccccctggacgagctgccgccctaccacatcgccgacgccgacctggaggccagcctggggcgcagccaccgctggatggcgcggtcactgcgcacccacctggccgatccgcggcgccaggccatgtatggcatcgtgcacggcggcatgtccatcgacctgcgccggcggtccgtcgagtacctctccgccctcccctttgacgggtttgccgtcggggggagcatgggcaaggacaggtgcaacggtagattgtgaggggtgcggtgggggccgagacgtcgcgagaggccagcgtggaactctccctggctgggcctactactctgtgccactcagagggtcgctgcatgcccaacatgtcccgccgaccaccaccgcccacacccctctgatgcagggaggacatggtgggcctgctgcggcaggtcatgcccatgatgccacgcgacaagccgtgccacatccttggcatcgccgaccccgccaccctcccacagctggtcccctttggctgcgacacctttgactcctgctaccccacacgggcgggccggcacgggaccatgctgaccccgatggggaatgtgcgagtggtgagtggggccagagtctggcgcggcagcttggaccctggcgccggattttgtgatgtatggggatgaagggccgacgcaccagcgctggggcgccgcatgggcccagcaggaggctgtgtggaataatggcccttgatctcctcctccacatcagcatgcctgccatcatggaccctgcctcctcgtgatgtagtgcaaggtgtcgcgccacgtcccctcgtccggcatgcagatctctggcaagttcaagaatgcgcatcaccccccggttgaaggttgcacctgctacacctgcaaaacccacacgtgaggagggttttatgggggtgggtgttgcggaatcacatctgtaatatgagggtgccaaaggctgctcacctaatgacctggtgagcagcagccaaaccacacctctccatattccctgtccaccctctccccctcagactcgcctacctgcaccatctcaagaaggcaaatgagccgctgatgagcacactcttgaccatccacaacatccatttcatgtgcaccctgatgtcggacctgcgccaacaaattctggccgatgagatttgacgggacccaggcctgtgcactggcctgtggtctcgggcagggcacccctatttataactttacaggcattcaggagaataacacctcaagtacacctccatcggatcatcgcttacaatcttacacgaggggctggtagatagagaggctgcaaatatcaggagtatgagggtggaacaccagtactgaaatcatggcaggggacggcgctgaagggtgtttcgcaaacatttgagggccgtactgtggcggcatactgttgggcaatcttgcttgggcaggggcatgatgtctgcctgcaaagaggggtccgtgcagcatcagggtttgcactggtcaggcagcgctgcgcagccgctccagcaagtcgatcttccggccttcggtggacagtcccttcttctgtggaaggagagcagaggcaacagcagcacatcagagtgtgctgtgtaggggggaattgaccagtacaccctgcagagctccctttgcccccaaaggaacccacctccagcagagacttgagctgcttcttggacaggtccttgctcgctgactctgccttcgcagcctgtgtgccagcaaagctgcgctgcaggctggcgggcagacggtgcttgccgaagaagccaatgggtgcacgcttggactctggcgccgcgtcataagaggggctggtggctgctacggtgtaaccgtgtgccagatagggaggggtaggctacagtgagtttatacaactcctttgctgatacacctgtggtcctcccgcctgcatctgtgctggcacagctgtagggtaaccctcttatatttccatgcaagcatgcacaggaatgcccatgcgcccatgctcgtctcccaccttgaagagcctctggaagttccactgacacctgctgtgtcggtccatgccattcatccaccacggtcacggcagctccgcccgggacatcgactgccagtcgccgattgctccctgtctgccactccacaatgccacttgggcccaacacaacgtacctggtgctcacggtatcaacaaggagctgtaaagagtggtgtagacatgtgtggtgcaagcatcatgcagatgataaccctaatgaacacagtgagggccacacttacttgtactcaagctcatccctgtacagataagatgcaaggagatgtggtgtgagtgaatcgttactcccgagcctggtccggttgcaagtagcagcgggcggcttccatcataatactgtcacccgccggtcctcacccgggcgcgacttcggcagacactttccactcgtccccttcggaccagtccatgtgcagatctgggatcggctcccatcctgatctggatgtaacgatggagatggtttggccgaagctcactcgcttgggcaggcggaactgcactttggccttccccgcggcggccccgaagggggcttgtctatgcgacagggcagttgagctgacctgcataatggcgtggtgattttatccagttttgaatgtgcagtttgttggcctgtcgatcgcctttccctcgtgagcctagggtcaacttgtccaccgaatttcgaaaacaggaaagaatagcgttctttccttttgctcagggggctttaggaggtacagagacggctgcaccccttaccgcctgcagatcgactctaccttcccaggccactgatgaattcccttctattggcaaagtatcacagggcggctgcaccaccctctacgcgttctgccaaggggtatgggagcgtgcaggtagggaagaaggggaatgaaaaggccgggtagctttcacagcgaggacgaggtttgtacggagatgggctggtacgtttctgggtgcgggccttcgctctgcctactgcgcatgcttccccgtttccgagacggggaggaggaaggaggtcctggagggcacggtgcgcatgcgcgcgcgcagcacccgccgcacccgggccaccagcgcggccgtctcggcgtcgccccgctcactgcacaccaggaagagccccgccaccacccccagtgcgccggcgtcccaggcgctgagggcctcccccagcacgcaggctgccagcagcgcacccaggaagggctgcaggcactggaaggcggccacctggctggccggcagcgtctgcatggcccaggccaccacaaagtaccccgccacagagcagaccaggacccagtagaggagtgggcccagcagggcggggggcaggctccagcccgccgcgggagtgctcacgagcgcggccagccccatcagggccgcggctgttggttcgtgtgtggagggtgcggggttggggagcagggggttgagggcgagcgctcgagggcatggcacacgtggggctacatgcatctctgcccagcctctgaccagtgccccatgcaaggagcagagcggcacgccgtgcaccccagaccacccccccccccttcccattagaccgtgcgccgcggctccccctcaccgccagtgtaggcccaggctgccacggagatggcggggtagcggcccaccagctgcttggcatagacgtagtagacggccatggcggcggtgttgaagacgaggcacaggttgcccaccagcatggcgtgcgcggcggcgaggcccgcgggcgaagtgggcgccacgccgcccgcgccggccatgccaccgaagaccatggccgtggcgcccaagacgctgagcccgatgccggccagcttgcgggggttggccgcctcctggcgtagcgcgatgcccagcagggcggtgaagacagggatggcgggctggatgcaggtggccaccaccacgccagacaggtcgatacccagcatgtagagcagctggctggcaaagaggcagacgccgagcaggacgacgagggggaggtcgcggcgggccgggaccagggtacctgttggggaagtaagggggggggaaggaagatgggggaatgtgatggagagagggagggccatgttgcagccagccagatgtgcgcacggtctcgtggcggcgctgcatggagctgcggcgagggctgggcggcgatccagagcccgctgccggggcgacacggccaggatataccgcccagcaaggggaattgccccccccccccgtactcgtccacccagcccacccttgtattgggcgaggcccagcaagatgggggctgcggnnnnnnnnnngggggcgacacggccaggatttaccgcccagcaaggggaaccgcccccctttcccccgtgctcgtccacccagcccacccttgtatcgggcgaggcccagcaagatgggggctgcggnnnnnnnnnngctggacacaaaaggtggtgggctggggaagagtgggggtgggctagacctcaggggtggcgggctggatctcagcggtggtgggctcaatttctggggagatgggctggctagggctggggatggagttgggccagggaatggtgccggcgtaggtaatagttccgagggtgttggcgcaggggagtcaacagactcgacatggtagtttggatcgtcctcaaagttgtctnnnnnnnnnnctgggccagggactggtgccggcgtaggtgacagtcccgagggtgttggcgcaggggggtcaacagactcgacgtggtagtttggatcgtcctcaaagttgtctnnnnnnnnnntggcctcacgggcaaaggcaaacactaccgggttgaagccggggtggctgctcccgccgtgcacctcctccaggtctgtgatcacggacttcaggtacacggagcccacgacaaaggagctctgcgccagggcaattgctgcctggcggcgccatgctgcagggtgtgcatgacaaggggggggggtgttcaagcctgtactaagggtgagtggccccacctttgtccccttgcaggaggaatacacccagcacatccgaacaggccagggccttcctgacagctgccgaggtcgcaccttcatgccgctgaccaacaccaggcaccaggctggcctcggccaggtccgccacaaggatgaccttgcccttgttgctgggcatagctcccgcgccctgttccgagtcaccaccgtccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaattggcggtcaggcggtcggtctgatcatcgaccacgacttgagtccgacgagctgtcgacctgagtccnnnnnnnnnnccgggaacgtctgacatcgtacagctccctgtgagctttcctgttctacaaagggtcttgagaaaggtgaaacctcccctttcgtcacctggagcgccactgaatgggccgggagctggcgcattggcccgtgcaccggtcaggcatgctccgaggatgcacaccacgaggatgtgtctcattctatctgcttgcgaacaggggacgaaggnnnnnnnnnncggcatgtttaccgggacgttgcacgcgtcgccaagcgttcacatgcaagccaaagtgtgtagcagttgggtgtccgctggtccttgctcctggcctcggcgcatgatcggatggatctaggcactgaactgactcctgaatgtgcttcctaagaagcaatcctgtccttgtgccgtcagatgtcggcgacgcggtgcgcgaggggccaattggcggtccggtcggtcggagggaagtagcttcccgcagtgaaaatccggctctccagcacaaattccatcagtccgtgtgtccttcccagcaacagtgcaccgccattacatacgaatgaagccaagccactctggcaagattgcaaggnnnnnnnnnnaaaaagcggcacaagcaccggggaatagctcagattaaggcgactggaaagtcactcactttcgaatatcattcaatcctgatcgggaaaatccgcatccggaacgcggcgagatcacgtcagactgctgaagacaggcggtcggtctgatcatcgatcacgatttgagtccgacgagctgtcgacctgagtcccgttgattgtgtcttaataaatagggtaagagccgggagttcgcacttcagaatgtgaatctcaagaaggatattgctatagcatgggcgcagacctttcttcagccctggagttgtgttgccattctgcactcctcggcacagacctcatgctcccacatgtctttaccgacagaacctgtgctgacctcagctgtatgataagtcccaacacttgcatgcttcaagcctcatcgttgattcattgcagggcgtgctgctgagccagtagctcccgagccttcctgtgtgtgcggacgatgatttcatgtttctggcatccaaaggaatgcccaagcattggcccacctgatcgagccacccactcgctcacctcctccgggcctggagctgcgcctcgtgtctttgtacaggcccggcagcttctgcctccccaccaaacacctcaagctccgaagctgggtcaatgtagaggggcagctctgcaggctcccctgcttttgggggctgtgggatggcagcggtgggtccttgctgccgtcccacaagccacggtggcacgtccaaagcagctgctgcactagggccgggtgccgagccctcggtgggcggatgcacaggctctgcagcgacaagcggttggtgcaagggcatcgtcgtcccaggcgcctctgcctcgtccagttcaccagtttcgcccacaagcctcctttgggaaaaggggcgacacattnnnnnnnnnnccccaggcgcctccgcctcgtccagttcgccagtttcgcccaccagcctcctttgggaaaaggggcgacacatttggatgagcatggagcgctgcctggcaaaaccacatgcgcaggagatccactcccggctgtccccactagatgctggccacatcacggtcctcnnnnnnnnnngaactgcatgcgcaggagatccactcccggctgtcgccactagatgctggccacatcacggtcctcaggttcctgacctgtagcgtttgtgatcggggtgggctgggtccaggaacgagaaggtcccggtcgtgcccatcaggcctgcgacgcgcctctcaaatgcagggccatgctcctgcaatgggatgcacgggcagagagtgggcataggagactttgtttacagcaggtgcttagcagaggtcatgaaatcaagggtcagggatttgggattcgtaagagaaaggtgccttccactcccaggagcaaagtgtacagcannnnnnnnnnatgtttgcagcaggtgcttagcagaggtcatggaatcaagggtcagggatttgggattcgtatgagaaaggtggcttccactcccaggagcaaagtgtacagcaatgcctgcaccaacgcgacctctgccacccatcggaacaggcataccaaacgcatacccagatgctcctcattatgcgcatctccacccccgtgaaggggtgcacaaacacagcgtctgtgcgtccactcacctgcacagaagcagccaggcgctgcatgactctcaacaagctcgatgccgtgtcagggcctgggctgagatcctgtgccacatgcaaggcctcgacccctgtgtcctcctctggcaggccggtcagccacttgaagaatgcgtggcgggcgtcctccggctgcaggaagccgaagaggggctggcgggcatggcgcactctcatcaggatctccagctgtggacccccgccccgcacggcgcgcgcagcctgcagcatcacctgaatcgagggcccagggtcacaaggtctggccggcacatcaagcaggaggcgcacggtgggaagggcgagaggcagtgtcataactgaagagtacacctgggcactccctttgcccatcattctacaccgcgcaggacacaccttgaggtgacgcagggtggtgggcgccacaccagccagtcgcaggttcccagggactctgccggtgggctggaaagcagggtcatcattgccgggctcgggcgcgctgggagcttggggttcctccactcgactgctgtcactgagtgtggccccatactcaaagggaactgcagctccagtggagatggggtgctggcacggggccatcaggtctgcagagcagttgtggagtacggcgattctcaaaacggaccagcatctgctcgttccacagcattgctgtgcaagcatggctgagcatgcttgccaggcagtggtacgcttgggacattcgtgcttccactggctgtnnnnnnnnnnactgtgcaagcatggctgagcatgcctgccaggctgtggtatgcttgggacattcgtgcttccactggctgtcccatacccaagtgcccgctgacctggcgacggggatgtatcgctggacgatgcaaaatctgctcgtgcggccaaggtgtctgcgtaccgctcaccatccagctcaatgtctgagagggtgcgctcgtgtacaggtgccgagtcgccgagaggcgagtctaaaagcagcctgccagggagagagggggtcattgctgtccatttgattttcatgacaaggataaggcttacctgaaaccttcatatacacaatcaccacatggtattcgcatcaatagattcagagaatcgaaggatgtcggttgcatcccctctcccagagaattctgagcgagcttgcctggcatcaaaccggtccacgagagtgctgggcaggccccagcatctgagcaggttaccatcgtcttccaaggccaaagccgtttcgtcacccctcacaatatcacattgaatcccatgcacgtgcagctggagtgtgtctgtgtctctccgagtgcctgcgaacgcctggggccgggtgtgcttgagcatgtaaaaggaggagtgttccttccaaagaggttgggctgatctttttatatgccaaattactctgggcaagggttcaagatataaagcgaggtgtacatatccaataatacaggtcactcgtcgaataatttcgaaacgggatgcgagcaccttcaagcaggcatgcttgccacgttgcagtacgacgactgatatnnnnnnnnnngatgatttcgaaacgggatgcacacacatgggcaccttcaagcaggcatacttgccacgttgcagtacgacgactgatatattgcatttcctgaaccaacaaacaaccattcaatagtgtaggcgccaaaacccacggaagctatgttgataccctcaaataccaatcatgatgaccctcatcaacatgaaattcgaaacaggtcaacaacggagaatgggactgcctggggcactgacacattgtagtctgccgacccatcgtgacgggataggttcacaggacgatctcaggtacagaagccaaagtatcatccaactcagtgcaccctcccgttcaggtgatggcctgtatcttcatccaaaaggagctgctgggacttaatcagacataatgttgtttgtactcaagttggaccttcaaacatgaatctgatcagcaaggttacccttacaaggacgcacgtgtgtctgcaccacggatggaaggcgggagagacgacgttgttgtgtaatctctccgacacccatttggaccccgcccggcccnnnnnnnnnncaaaaggacgcacgtgtgtctctgaaggcgggagacgttgcgttgtgtaatctcggcagaattccgacacccatttggaccccgcccggcccccaggaccccccaagactacaatgtgctgttgttgaaaagcaaatgaaggcccaggggaagtccgcgggcctcggtagccccccctctcccgctccgtcgagtgtctccgtgactcgcctcctgctcaatgtgtccctggcccgcatcgtgctgtccctgagtggcattttaaaccccgtacaaaacctggtcagcggccagctcctcctcggagtcagcgtatggcaggttaccagggacctgctccggagagcgctgtacgtgctcggatacctcagcgcccccgtgcagctggcctggctgcagagcctgagtcggtacagcctggtcaacgtgcgtaggtggcatgtcgctgcaggtgagaccatgggggagggaccccgagggcccggtcgggccccggacacgttgccaccaccttgtgtgtggggtggagggccttggcgggagggccctgcccagccctctccaaggcctgcctggcagaccgagcgcannnnnnnnnngcgcgtcgtgctgtccctgagtggcattctcaaccccgtacaaaacctggtcagcggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcgggccccggacaccttgcgaccaccttgtgtggggtgtggagggcctttgggggggtgggccctgcccagcccactccaaggcctgcctggcagaccgagcgcaccgccagcgcggctccgcgttcagtccagtacagcaagaccccgatcgtgggggtcttgctgtactgaggtctctggagcatgtctcgcccaggatgtcgttgcactgccgcagtcttccctccacgcctcgccgcccccctcttcccaccaacccaccccatcccaccaaccccctccctctacaaaaacatcagccgcgtgcgtcgggtacggcgtggtgcagggggtgcgcaggcggctggcggacgctcgcgacgagggcgcgcgcgtgcgcgcgcgcctggcgctgcgcatgtccgaggccaagtcctatttcgagtggagcgtgctggcgaccaagctggacgcggcgcgtggcgcggaccccgcggcgcgccgccgcgccgaggcccgcctctacgatcgccgcctgctgcgcgagaaggtggcgcacctgcgcaaggttcgcgcgctgggcacgctgggcgagcagatgttcgcgctgcgcgccgacctgctccgcgacctgggcggcatgacctcgcccgacctgcacgacctcttccccgtctgccccgagcccatccgggagtacatcgaggaggtgaagggccagctggaggatgtggctgcctgcggcgacctgcccctggcccagcggtccaccttcctgagggagacgcggcatgcctttggccgcaccgccctcgtcctcaccggctccggcgacgtggccgggttccacctgggcgtcgtgcgggcgctgctggagcacttcatgctgccgcgcgtcatcgccggcaccggtgcgggggccatagtgtgtgggctcatggccacgcgcaacgacgcgcagctggcgcgcctgctgaacggcctggacgaagtggatgccgcgctcttctccaccgctgctggccaactgggcggcgcgggcggcctgctgcggatcgcgctcagcggcggctgctatgcgtcccccggcgggggcgacgcggtcgattcgagtgcgccttcctatgcaggcgcctccacatcggccccggccaccccccccgctgtgacccgcaccctgagcgacccgcggcgcgaggcggcgctgctgcgcctgcgtcacgcgctgggcgacctgaccttcatgcaggccttcaatgccacgggccgcgtgctcaacctggcggtggcggggttgggcggcccgcgcgcgccgccgcgcctgctcaactacctcaccgcgccgcacgtcttcgtgtggagcgcggtggccgcggccaccggcgccgcgccggccggcgcgggactggtggcgctcggccccg

SEQ ID NO: 39301 - DNA, 61 bp, Chlorella protothecoides
ttgcataaagtgagaggttcgaacggtgacgggccaaacagagctgggctggtgcctggct

SEQ ID NO: 39302 - DNA, 647 bp, Chlorella protothecoides
  modified_base (254)..(263): a, c, t, g, unknown or other
  modified_base (562)..(571): a, c, t, g, unknown or other
ctgccgctgcaggcgcggctgcaggccatgcaggcggcgcggcgcgtgggctccccccgcccggccccgcccacggccatgcactcacgcgcgcaggcgatcgcagagcgctgggacgacctgcgcgccaatcgcatcacctttgcggagctgctcggcgggggtggcggcagttgcgggacgagtgtcacacccacgccgtcgcagcggccggacgttacatgtccggccgcagaggtggtggacctgctgtnnnnnnnnnnaggcggcagttgcgggacgggtgtcacgcccacgccgtcgcagcggccggacgttacaggtccggccgcagaggtggtggacctgctgtactcccccgatgcggcgcccgggccctcatgtgtcagcggtgggcgggatcagccagcgccggccagacccagttccggcgcccgccccgccaccatcgtgcccggacgcagcccgtatttccagagtccccacggcacgccccccggcgcgggcatgccgcctgcggcgtcgccgcgcggctccggccgcaccgtgggcgccgtgcgcnnnnnnnnnngggcacgcctcccggcgcgggcgtgccgcctgcggcgtcgccgcgaggctccggccgcaccgtgggcgccgtgcgc

SEQ ID NO: 39303 - DNA, 76 bp, Chlorella protothecoides
gagttctcgaggcccgagacggattgatggatgaccggtggcgactgtcgttgccagcgatgaggcccagaggggt

SEQ ID NO: 39304 - DNA, 154 bp, Chlorella protothecoides
gctggtcagacgccgcgtcagcctggtggcactggcggcgtacctgtgtgtgtgttgaagggaagggggggtgggggggggagaaggggtgaggtggcctcaggaggagaagaaaggggggccgggtgggatgagtcggggtttggcggcggcg

SEQ ID NO: 39305 - DNA, 63 bp, Chlorella protothecoides
cccgatccacccgccgccgggcctcccacttggcccgatccacccgccgccgggcctcccact

SEQ ID NO: 39306 - DNA, 99 bp, Chlorella protothecoides
atcccactgtagtgagcacaagagcaaacaaggttatcaggtgacagcacgctttctcacgggctggggggttggaaccctcacaagctgtttctgccc

SEQ ID NO: 39307 - DNA, 78 bp, Chlorella protothecoides
gtgacctccgctcgacgccgccacccatcctcggccccccgcagagccgcggcatgctcgacctccacggaggcggcg

SEQ ID NO: 39308 - DNA, 61 bp, Chlorella protothecoides
ccagcctccgcgttgcagggtcgagggaggggcgtgtaactccgggacccccgcataccgg

SEQ ID NO: 39309 - DNA, 134 bp, Chlorella protothecoides
tgagctggctgcctcgtgagcgtgcttgaactgcagcgcctggtgaccgagtctcctcctccagtaggagccaccctggtgccgatctcgcccttcgcacccaatctccttgtgtgctctctgcccgccgtcat

SEQ ID NO: 39310 - DNA, 2687 bp, Chlorella protothecoides
  modified_base (318)..(327): a, c, t, g, unknown or other
  modified_base (787)..(796): a, c, t, g, unknown or other
  modified_base (1282)..(1520): a, c, t, g, unknown or other
  modified_base (1581)..(1590): a, c, t, g, unknown or other
  modified_base (2397)..(2505): a, c, t, g, unknown or other
cggcggaggccagcggcgcggcggcgctgcaccgcgcgcgcgccgacgccacggccgcgcgcgtggcgtacaaccgcgccaagcggcgccagtacttccccgacctccgcggctacaacatcacgttcggggggggcggcgtgtacggcgcctgcaaggacatctgcatctccgagatccgggggacggcggtggtggaggcccgtccacccagcgtgccggggggtccggccacgcttgtcctggaggggcatgcgcccaggtgaggggggtggtggggacgttgtagtcttgcggggatgggtggggtgcgggggnnnnnnnnnntgcgtgccggggggtgcggccacgctcgtcctggaggggcatgcgcccaggtgagaggggtggtgggggcgttgcagtcttgcggggatgggtggggtgcggggggagccagtggtcacctgtttcatccgtgggagaggagagtcgtggggccatggggcattagtcatgcatgcaaggctggggtgggtggtggtggcgatccaccccgtgaccattcgccgggcctggcagatggcgaccagaggctccatgccctcttcccgcgcgacacgacactgcggcctgcattgaaaaatgcacaacaatccccccccagcagtctatccttgcagactctgacccacacactcatgccccatccctccccctttccacagacccaagccggtgccgcgccggagttcgaatgacaggcaggacaataacggcgcgggcaggtctgccgccggcgccggcnnnnnnnnnnctcccacgcgacatgacactatggcctgcgttgaaaaatgcacaacgatcccaccccagtagtctatccttccagactctggcccacacactcatgtcccatccctccccctgtccacagacccaaggcggtgccgcgccggagttcgagcgacaggcaggacgataatggcgcgggcaggtctgccgccggcgccggcagcgaggcttcctctggacggagagcgggcacggggcctcctgaaggagcgtccacgcaggccgctcggggtccgccaggcaccgcgcacaacccaagggaggagctggagcccaagcctggtgcgagcacctttgcagcccttcccagcgagcacagaccgtcagcaagtgcgggaacagatggcagccccggtgggtcgaccaagaccccgccctcacacggattcttcccaccccaggtcagcctgcctggcggctcgggcgcggggcctggtgcagctggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttggccaaggcagtcgcctgttgggttctgagaagctgcacggaggcgacggcattcnnnnnnnnnngaggagcgcccacgcaggccgctcgggggccgccaggcatctcgcacaacccaagggaggagctggagcccaagcctggtgcgagcacctttgcagcccttcccagcgagcacagaccgtcggcaagtgcgggaacagatggcagccccggttggtcgaccaagaccccgccctcgcacggcctcttcccaccccaggtcagcctgcctggcagctcgggcgcggggcctggtgcagctggcagcggcccgcaggcgccgctgccccccatcccccccaaggcctccaaaagcaagatgatggcgctcaagttcatggctcgcatcgggagcaagaaggagaagtacaagggcagcgacagtgcagaggtgcgcctcggggtgatggggctgggttcgggcagtgccaatgtctgctggctgtgacattgtgttggttcgtggtgtcagcgtctcacagtgcagttctgacgggactttggccaaggcagttgcctgttgggtcctgagaagctgcacggaggcgacggcattcggagcgtggccctgtgaatggcaggggtgcgtccttgaggctcctcctgaaccccatgcccgccagattgaactactgctcccccgctcccaccccccacatccccccgctcccaccccctcatcccccgctcccacccatgcacagctggagctccgacacgacggcaccccccccaagaagtccatgaagtccctggcgtccaagctgctgggacggaagagcaagggcggggcgggcccggactccctttcccgcgccagtccgggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctcggtggccgacgacctaagccaggcgctggacgccgaggaggaagagggcgaggcggcgggcggcctggcgcggccgagcaccggcggcggcctggcgcgcccctccgtggcctccgcccccggtcggcggctggagacgctcgccgaggccctggcggagggcggcggcgacctgg

SEQ ID NO: 39311 - DNA, 73 bp, Chlorella protothecoides
caccaagcaggtgcattggtgggggtggggtggggataagagtgaggtggggtccccacaggcctcagatggc

SEQ ID NO: 39312 - DNA, 179 bp, Chlorella protothecoides
tgactccccgctggcaataccctgcgacagtggtgcagcatgggagggtttacggtgttgggacttaccaaataaagaacctgaggcaagcaagagtttgctgtgggagcaacacaggcattagcgaggaagctgtcttccagcagcttcagggaatcagccctttcgacatgccggac

SEQ ID NO: 39313 - DNA, 156 bp, Chlorella protothecoides
tgctgtgaaagcgccggcatccgcgagcgcgaaggagccggccggcaagcaacgcagggtcacgccagcgcagaacaaagcgactgcagttgacccatcgtcgagctcagacgccgcctcctctggtgacgaaagcagcgagtcgggtgagaaggg

SEQ ID NO: 39314 - DNA, 79 bp, Chlorella protothecoides
gctgagggacgacctgatgaccatgctgatcgcgggccacgagaccacggcggctgtgctgacttggacgctgtactgc

SEQ ID NO: 39315 - DNA, 61 bp, Chlorella protothecoides
cggcttcaacgtcatcgtggtgtcctccggcgcggtggccgtgggctgccagcgcctgggc

SEQ ID NO: 39316 - DNA, 62 bp, Chlorella protothecoides
gtgtgtgaggacttggtgtgccgctttggaggggggcctccggggccactggagtgtcccca

SEQ ID NO: 39317 - DNA, 68 bp, Chlorella protothecoides
agttcagggccatgcccagtccttggcaaatctcccccccctgagaaacagcaagataaggactcaca

SEQ ID NO: 39318 - DNA, 76 bp, Chlorella protothecoides
cctccagcttcagccagtccatgaaactgacagaggtgcagtgtgcggagggcagggagacgtgagccagagcggg

SEQ ID NO: 39319 - DNA, 79 bp, Chlorella protothecoides
ccgcccctgcaaggagctggagaaccggcgacagagggcgtcgctgcgtgcgctggccatgctcctggtgaagaccacc

SEQ ID NO: 39320 - DNA, 61 bp, Chlorella protothecoides
cgccctgaccctgccggagacccccatcccgctcaaggtggcccgcctcttcctcctgtcc

SEQ ID NO: 39321 - DNA, 96 bp, Chlorella protothecoides
aacggccatgggtgggtggtggaacctgcagtgaggagggtcggcaaagaaaggggagggtgaggacctcgcaaaaggttctgcagcaagaccaac

SEQ ID NO: 39322 - DNA, 71 bp, Chlorella protothecoides
cctgtgcgtcgtcacttgccatggaacatgtgctcctggtttgcggagatgcctgggcgcgaagaccaatc

SEQ ID NO: 39323 - DNA, 77 bp, Chlorella protothecoides
ccctaaccctaaccctaaccctaagcctaagcctaagcctaagcctgaccctaaacctaaccctaaccctaacccta

SEQ ID NO: 39324 - DNA, 61 bp, Chlorella protothecoides
ccatcaagcacaaggccgccggtgccaccctcatcgcagacggcgacgaggcgcggtggaa

SEQ ID NO: 39325 - DNA, 61 bp, Chlorella protothecoides
cagcctggggtgatcaacgccgatcacccctgcatcctccatcctggatctcgacggcaat

SEQ ID NO: 39326 - DNA, 61 bp, Chlorella protothecoides
atgacagagatttctccagacccaagctgtgtcgctcgggaacacccactcctgatcctga

SEQ ID NO: 39327 - DNA, 381 bp, Chlorella protothecoides
  modified_base (124)..(315): a, c, t, g, unknown or other
tcccccgagacgagtgggacggatgttgaagctgagctgtacaacaaagtggtaggtgcctgaactcatgcagcatctactcctgatgtgtgcctggagtgggatagccacaggcatgttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtccttcctgccctgatgcagtagatgtacacaagctccaaaacaagtccccacctgcacccaa

SEQ ID NO: 39328 - DNA, 105 bp, Chlorella protothecoides
tggaaggggtcctcagatgaggaggacggtgggccagggctcagtcggctgctgctgcgacgctgctcatctcggtggttgtgggtcggagatgagagcagggtg

SEQ ID NO: 39329 - DNA, 64 bp, Chlorella protothecoides
ctcgtctcaccgtattgcctgtgcaggtcgacccgcgccctgtccagactatccaacgccccta

SEQ ID NO: 39330 - DNA, 75 bp, Chlorella protothecoides
cattgccattcagcctgactttgaagccatcgcaagagctgcttggtatttgaaactgccacagagatgacccga

SEQ ID NO: 39331 - DNA, 73 bp, Chlorella protothecoides
gtaacactgctctggatgtgtgtgatccctttgtgtgcgcaattcagcggacctttcgtccaacagccagttg

SEQ ID NO: 39332 - DNA, 2347 bp, Chlorella protothecoides
  modified_base (132)..(141): a, c, t, g, unknown or other
  modified_base (361)..(370): a, c, t, g, unknown or other
  modified_base (890)..(899): a, c, t, g, unknown or other
  modified_base (2192)..(2266): a, c, t, g, unknown or other
cgggggagggggtgggggcgcgggggaggagggttaggttgcaaagtgaagggaggtgttgaggagtttccacgcaatacccccccggcggacaatacccacacctgacgctgcccacccatccacaggagnnnnnnnnnntgaagggaggggttgaggggttcccacttaacacacccccggcggacaatacccgcacctgacgctgcccacccatccacaggaggagacactgtccacgctggaatatgcgcaccgggctaagaacatcaagaacaagccagaggtggggtggaaaatgtgtattaagaaggaaggcaggatgtgcccgcctggattgggtgactggggcaaagggggnnnnnnnnnntaagatgtgtattaaaaaggaaggcaggatgtgcctgcctggattgggtgactggggcaaagggggtgtgtctgcatctaggaggagacaagaaggaggccgtctctgtgttggcaaatggcatgggtgcctatagatgttgcgtgggtttaaaaacctgcaggcacgggacaagatctttgttacacgatgctgtctggcccagctcgctcaggcatcaccttccctccctcccatcatcaacgcagatcaaccagaagatctccaagaccacgcacttgaaggaaatgaatgtggagatcgagaagctgaagctgatgctcaacgccacgcgcgagaagaacggtgggcgcgtcactggggcgaatgagctggacgctgctcagcatttgtgggagacctggccgtggagggggaatcaggccattcagggtgccacaatttacaagcaggcccaccaagcaggggcctggcctggggtatcaagatacccttggagacatggaccccatgcctgccnnnnnnnnnntaggggtctggcctggggtatcaatacacccttggagacatggaccccatgcctgccaacattcgccctacgctcaacgttcgcctccccacaggcgtgtacatccccaccgcccagtatgatgaggagtgcgaggagaggaagttcctgaacggcaggggggacttgagagcttggcgatgtaatgctcttggaaccccttttccagagagtctgctgtgcaatgcggcttgccttggcaatgcacaataacaacctgacttgctctgagcagatctacgccctctttcctacaatcacactcactccccgcgccagggtcctggaacttgaagaagccgcagaggccagcggcgcacagcacgaggcagagaaggctgagctggccgccgcggccgagagtcagcgccaggtcctggagcagcggctggaagaggtgggaaggtgtggggttgtgagtggctgggtagagacgagggatggcaagccgaggaacatgtagttggggagcagcatgcatgggcaggagcggaggagaggctttcgagcacaatccacgaggagaggcatatgtctcagggatgtgaagcctgcaaagggctgcatcacagtctcggtcgtccccttgacgtttcacaaagcaggtcgaggcggcggctgccgtgctgcgtggcgagctggaggaggcccatgtgcgcatcgaggagcgcgatcacctcatcctctgccagcagcggcacgaggcggcattggcaggtgcggggcggtgtgtacgagggggatacgatggcgccttggtcgtacccgcaggagttcctgcagcatgacagtcgaggcaccgcaccgtccgcatcgcgacccctccttgctgaagtacctcgggcttcccacccaaaacacccaccgccgtgccacacaattaccgcagaccacgcctcgcggctgacgacagagctgacggccgcggcggcggaccttgccttcctgttcactcgcgtcgaggccaaacaggcgctggaggacggcaactgggaggtggtcagcgggctgcgagcccggctgcaggagcgcgtggcgacggcgcggacggcgctggaggcggggacggcgcgggcggcccaggccacccaggaggccggccgcatgtggggcgaggaggcggcacgccgcgccatgcggcgcgagcggctggcagctgacgaggcggaggccggtcgggcattggacctcatgtcggcggcggggagcgggggtatggaggccgcacgggcagctttcgaggctgccgcagannnnnnnnnnnnnnnnnnnnnnnnnnnnnnnnnnnnnnnnnnnnnnnnnnnnnnnnnnnnnnnnnnnnnnnnnnngcggcttccgcgcgctcggagcggctggccggcgcgcggacggagtgcgaggcctcgcgcgcgcgcatggcggcggcgggc

SEQ ID NO: 39333 - DNA, 120 bp, Chlorella protothecoides
ggcagaaacatcacctcctggtcgctgcatcctgtgcggcagtggatgtgcagactctgatcctctctggcgctccccgggctccgatccgcatgctgaacgcctcgacataaaaccctg

SEQ ID NO: 39334 - DNA, 119 bp, Chlorella protothecoides
cagccctgcacatcctgaatcttgcgcggtgagtgaccgacagaaggtggcgcgcagaacagccctttgctgtgtcgtgctggaggcagtggtgttctaccgacaggaggcgcggcgga

SEQ ID NO: 39335 - DNA, 76 bp, Chlorella protothecoides
cccatgaccatacctcaggctcacctgggaggagtatgcgaccagagcaaacctcagggcatcggtgccgcactcc

SEQ ID NO: 39336 - DNA, 409 bp, Chlorella protothecoides
gtggccgccgcctgcgccgccgcggccgcctgggcctgcgccgcggccgccgccgcctgctgctgctgctggagcgctgcagccacctgctggccgcgctgcgtgttgggccccacgccggccagcatggcctgcagcgcggcctgctgcgcgccagcggggccgcgcgccatcgtccccggcagcgccgggaactcctcctcctggaagcccacgcctggggatgcgccgccgccgccgccctgctgctgctgcagcttggcggccgtgccgccgccggggcccatgcccagcagcgccgcgaagctggcgtccccgccctccccgtactgctgctgctgctgtgcgagctgcgcgagctgcgcggcggccatgccgcgcgccgcggcggcccccggcccctgcgcct

SEQ ID NO: 39337 - DNA, 80 bp, Chlorella protothecoides
ggggtctggggaaggaggttgtgcgtggggctcacacagtgagacatctgggtgagcgccacacgctgggttgcatgcat

SEQ ID NO: 39338 - DNA, 61 bp, Chlorella protothecoides
gctgccatcgtcatcgggtgacttgtcctgaatccaatggtatatgaggcctgggattatg

SEQ ID NO: 39339 - DNA, 74 bp, Chlorella protothecoides
tcctcgcgctggcaggtgtgggtgggtaattgtgggtggaagggttgggggggcaatatgtgtgtgttgggggt

SEQ ID NO: 39340 - DNA, 103 bp, Chlorella protothecoides
gtcccaaagcttgtgtgttgccctgtttgaacccgctggtagcatggtatccctccaaaaccaactgccttgccccccacaaactcccacaacccacaggcaa

SEQ ID NO: 39341 - DNA, 61 bp, Chlorella protothecoides
cgccaagggtctgaacgacatgatggggaacccagacgctatgcaaggcatgctcaagcag

SEQ ID NO: 39342 - DNA, 7700 bp, Chlorella protothecoides
  modified_base (468)..(477): a, c, t, g, unknown or other
  modified_base (1170)..(1179): a, c, t, g, unknown or other
  modified_base (3012)..(3021): a, c, t, g, unknown or other
  modified_base (3450)..(3521): a, c, t, g, unknown or other
  modified_base (4882)..(4891): a, c, t, g, unknown or other
  modified_base (5560)..(5569): a, c, t, g, unknown or other
  modified_base (7237)..(7246): a, c, t, g, unknown or other
  modified_base (7315)..(7364): a, c, t, g, unknown or other
tggctggacgccgcggggctggccgggttcgccggctgcgggcttgccgtgccgtccccggacctgctcacccccgcgcgcgcggcgggggcgctgtggggctgggcgcccgcacagccgcgcccgcagccgccgctggcgcgcgggccgagcctgcatggctggtttggcgcgctggcgcgcgccgtctgggacctgctgggcttcgcccgggtgcagctgcagtaccggccggtgcgtctctgtggacgagagtaatcagtgccttgtttctgttcttttttgggggggggcggcttcactgaggatggtcttgggcagcggtgcggcacaagagcgagggtgtcggccagcaatggggtgccatccctcgcacgcccacgagaagcgaagaagggggtgcgcatattagctcagcccactgcttgctggagccaaagggtgcacacatgtcgaacccctcccctnnnnnnnnnnggtatcagctcagcccactgcttgctagagcctaagggtgcacacatgtcgaacccctccccttcccaaccacccaaccacccgatccaggccggctgcgcggtgatcgacgcggcgagcggcaggtgggagtcggtcagctgcgcacaggacctgcacaacgcgtgccgggcggaggcacggtcagcgacaaacggcacggcccccgcctggtggctggcggccgactgggtggtcgcgccgggcgcgcgtggcgagtgcccgccggggacgagggcggatgcgccccggcacggcgtggagaacgcggcgctgtcgcgggcggtgcgcgccgccaaccggaccgcggcctggctgccgctggcgggggggccaagcagctggaccctggacgccctaccggcgtggtcgtgacatgcgcaggctctgaacctggagcagggtcgcctttggtgactcgtgtatcatatgtggttatctctttggagaatttcctcgcaagaagggcacctcgtgcccatgcgcttttgccacgcacactcctgggcgcccaggtgagcgccttccccacggtgtacggcaccctggtgcttcttcgccagacctggggcaagaatactttgtcacagaggacaggatggtttatgggacagggtgggcgagaaggacaagcggccagctagaagttgaacnnnnnnnnnnccttcgccagacctggggcaagaatactttatcacagaggacagaatggtttatgggacagggtgagcgggaaggacaagcggccagctagaagttgaactcccccgtagccttgtgcaggaggtagtccctaccatccagctgcaggatgcagtgccgcaggttgaccttccaccgcgccttggaccggtgcaccttgtcaaactgacccagcagctgatcctccgagtcactccccaccgcatccacgtctgaaaagggtcacagggattgtgatgggcttgggtgagagagcattgccagagcttgggtgtcgaatggggtcccgtgtccttgaggcaattgacgagcggcatcactcagcccctcctttgagctgtccgggcgtgcattcaccaggtctgcaccaccagacacaacttcagcaccttcgaggtcgtcgtcctcgttaagttcatcatcgtctagctccacatcatcaaggttgtcctcgtcctcggcctcggccccagccggcacagaagagctagggtcggagacgccggctgcctcctccgcggctccatcctggcaccgtgttttttggagagcacatcagcatgaccatgcgcatgtgtcaatgatcctcgccactgcagcagccacatagaaggaagagttcattcaccactcttcccttgaacccccaccaccaccgacgtacacactcccatctggccaccagcgcacccattgagggatggaaggggtctgaatggcctctgtcttcacaagcttggtggggggcgtgtcacccgtctcgatgatgggccgtttcctgtcgccatggtcgagcgcggcagcaccaagccctgggctctggtccttggtgggtctggcagccaggaccgaggcgtcctcgctaagagtgagggcgtctgctgctcgtacgccctccttgctctgcctgaagggttgatgggagctcgggaccgagatgacactgctccacaagccttcgtgtctagcacctcttcccacccatcctcctcagtcgactcacttccccgacggatcgtttgccttccctagcactccaagttttactatgtgggactcccaaagggatcgaagctcgtccagcacggctctgcggagacggtgcggtgtgtgctccttgatcgcttccgcaacctccccaattccagtcatgcaacccccccgtccagcgcgccatactcactcatctactccttcctgcacgaagtcggccttcacgttggccacgacatcatctatgacgccctggtacacgcccagggtagcctcgcccacaccgggacgaccggccttctcgcccccagcacgcgacatggtggctgtctggcggatgggcagggcctggcatgccgctcaagtaccagggcccccacatgcagcgcctgggggggctcatgggatgaagaaggcgggaggaggacgtggccgaagggcgcacctcgagactatctcgccacgtacggtcctcaccatggccatcagagttcccgccacacctccttcctggtgctccgcgaccgttcctctgaagttgtcaggtctggtgttctaatcaatgtggctccgccttcacacgagtccatggctggagcggcgacagggcagtggaccatgcacgaagcattggcatgacgccctcggcgtggatcctccaccccccccttcagagcaggcctcctcccggggagggcatcctgccagaggaccccggcgacagcgtggtcagcgtggcaaaagggtccctcgcccccgccgccctcaccaggtcctcgccgccgccctgcggcgtgcccnnnnnnnnnncgaggaccccggcgacagcgcggccagcgtggcaaaagggtccctcgcgcccgccgccctcactaggtcctcgccgccgccctgcggcgtgcccgcggcgccctgggtccagcgcgtggtgccccccggggaaagcacggcagggctggacgtcggtgcgccgttgctcagccccgcgaagaaggacgtgtccaggggcggcaccggcgggcgaccacccggcggtgcccctggcggcgccgcctgccacggcgcggcgtcgaccccctgggcgccgaaaccaaaggcgtgctgcgcgccgggcagcgcaaacgggtctgcgccgcgggtcggctggccgtggcccggctccgccccgtaggcggcaaaggggtccggcccggcaaaggggttggccgacgcgtggggcggggcctgtgcgccgccggnnnnnnnnnnnnnnnnnnnnnnnnnnnnnnnnnnnnnnnnnnnnnnnnnnnnnnnnnnnnnnnnnnnnnnnngcggggcgacgtccagtccctcgagcgtcaggccccccagcaggtccagcggggagggcgccgcgtgcgccggggtgcgtgccggggtcccggggtcgctgcccagcaggtctcgctcgcgcggcggtcccgtgccggcgccgggggagcctggcgccccccccggggacgccaggcccccgccagagccgccatccgggccctcctccccccccgcgggctcctggctgggggccaggaccatgcccgggtcgctggacagcgtgcgggggtgggacgcggcgccgccctcgccggctctcccggaggcggagtgtgccaggcggcccttgcgcaggggcccgctcctctgtgcagtggaggaagagagggatgggtcgggacaagggggttgtgcagcctctttgtccctggggagggtgcgggcaggggccccgacgacccctccccaggaagcgcgccatgaaatggagagggagctgggccgctggcacaccctcgcgttccaccccaccctcccggaaaaagcaccacgacaccccccaccaccttgggcagcgcggcctcgccctccggccgcggcgcctcggccaggtactcctccatgctggccacgaagtcggcgggcggcggggtgagactgggcagggagcgcgcggcgctcacgccgcccagctgccccacggcggcgtaaaaggcgctgagcgcgtcggtgccggcgctggcctcgcggtagatctccagccccttaactgtgtggggagaggggggggaggagaaggggatcaggttctgagctgggatgggtctctcagcggggtcatggacggccaccgctgggacagggatgcagcgcgcggcggggccggctccgagcccccaacccacctcccaccagcaaacctgttgcccaccacgacgcgcagcagaccacaccgcaggtccaccacagggaccccacctgcttgcaagtagggcatggagaagtaggcgtccgccaggttgatgacaccctcgctcagcgccttgtacagctggaaagactcgcgcaccacggcgtccagcgctgcctgttgggagggaggagaattcggggcaattcgtgctttcttctcatggctctgatgggctggtgcatccttgccgggccagtacatgcggattccaggccgcgctcccatgaagggtgaggggcacagccctgcacctccaatcccagacgcccggaatcaggtcggcaagcagcccagcacggcagcgacgcccagccgggagcgtcgtacggtggggaggcagctttgcacccaggccaggcatacttcccctttccaacaaaaccgagaaactcgccagggccacgnnnnnnnnnntgtcgtacagtggggagacagctttgcacccaggccaggcatccttcccctttcgaacaaaaccgagaaactcgccagggccacgggatcgtgggtggccgcgccgcgcggcacgcagtccaccaggtgccgctgcaggcgctggagcaggggtagctggtgcagcagctccgccgccggaagcgtgcggaaccggcccgcgccgcccggcgagcgctgggcgtcggcggggccgggcggtgccccgtaccccgccgcgccgtagccggctgcgctttccccccccggcgcgcccgcaccggggccgcctgccgccacggcgctgcaggtccagcgcacggcggcgtacagccgcagctgctcgtccaggtacttgccgtaggcgcgcacaaactctgagaagtcaaaccggccctcgatgttggtggtgtcgatgaagttgtccacgcccagcgggccgcggccgcgggcgggcgcgcccacgcgattgatttctccccacacaccctcatccgtctcggccatcaggcggtggatggtgatcagcgacttgagcgctgtctgcgtgtggagtaggggtggggtggggggcgttagacaaggtttcagaaagagcagcgagaatgttgcatttgattacgcgcctgcagagcctctacgcagcacgannnnnnnnnnccgagaatgttgcatttgatcacgcgcctgcagagcctctacgcagcacgacgctccaaatgagggagcggcgggtcagggacaagatcggcctggcacagtgccaggctctacccattcgcaggacgagaccagagggaagccatgggcaggactcgggggggggaggaacccatggcggaatcacatcctgcacccatcaatcttgaggaaaccactggctcaacccatgatcctccactccccgcgcaccagccagtcagaggcgttgtgcaggcgctgaaggaggtgggacaccacgtagctggcggagccgctgccacccccgccgctgacagccagcttcagggctgcacaggtttcgaatgagagggggtcttatctatccccctacacagtcgacacgcatccgtgccacacaacatatccctgcacagcactaccaaaccaatcacggcgcccctccattcgcacttctgacatgtttctcctttggagggacccgggtttggggggtggtggccttcactaatgcaacatccagcagctgcgtcgtggcatggtatccggcagggtgggatggtgggacagggcatgctccgcccctgctcggtagcatcagagccatgccggccgcgggacacaccctccagccaccccaggacacaccttggtgtccgagcgtgaggtctttgcgcccgccagcttccatgtgtccgacgcccgaagaccaaactgcctaaccgactgtttcaagctctgcgcagtggttaactcagtcatgaccagagatcgggatgatggtgctcgcgctcctccaggtgagatcgcctcgcctccgtggaaccgacaggtggccttgatcggtgcgcacagcccagcgtcagtggtaatgcatgatggtcaggtggtcttaccaagctgatgggggggtttagggggaccttcagatgttgctctccttctctgtacctgacatgaaaaaccgaaagaagaaaccacgatcaccgctgtgctgcccaccccctcgtgcggggcaacgaacgccgggaggggaggatccaccagaagactctgctcaagaatctagcctgtgtaccaagtcttaaccccctgtgctctgcgacgcctcatactccgcgaggctgtggaaggttccatcaggactgcccccctaccctcgctacccacaatgtcccgctctgctgccgaccgaggctgcctggtgtacgtgggtaacttgcccgacgacattcgcgagcgtgaggtgcgtagaaggtggattgatgtgagctcggtcagggtggacttgccaccctggccggcatccgcgtcgcgatgacgtgcgcttcccgtgtgccctgtttatacgaagtgcctcctatgaagcttctcaaggtcctcccatggctcttgcacgcagatcgaggacctgttcgccaagtatggacgggtccgtcaggtggacctgaagacccccgcccgcccccccgcgttcgcattcgtggagttcgaggatggccgtgacgctcaagacgccgtgcgcgggcgcgacggctacgacttttacggccacaggctgcgcgtggagctggctaagggcggctctcgtggcggcggagactttggcggccgcggcggcggtggcttcgatgaccgcgggggctnnnnnnnnnncaagggcggctctcgtggcggcggagattttggcggccgcggcggtggcttcgatgaccgcgggggctnnnnnnnnnnnnnnnnnnnnnnnnnnnnnnnnnnnnnnnnnnnnnnnnnngagttccgcccccgctccactggcttccgcgtgaccgtgcgcggcctgcccatgtctgccagctggcaggacctgaaggaccacttccgcaaggtctgcaccccctcctacaccaacgtcatccgcgagcgtggcgaggcggtcggcgtcgtggagtttgacaacgaggaggacatggaccgcgccatccgcaagctggacgacaccgagttcaagaaccccttcgagaaggcgtacatccgcctcaccgaggagggcgggcggggcaggcccgccggcggccgtggccgctcccgctcccgctcgcccagccgctcgcgctccccccgcggcagg

SEQ ID NO: 39343 - DNA, 94 bp, Chlorella protothecoides
cgcactgcctccctgcagcgggtggggtccaggcgtgccccggccgcatcggatcgccggggcagggcgtgggaggacggtagccagtgactgg

SEQ ID NO: 39344 - DNA, 76 bp, Chlorella protothecoides
ggacgcttgtgacagacctgctggcctgcagggaccccactcccacggcggtggagcaaacatgacatgacctctc

SEQ ID NO: 39345 - DNA, 106 bp, Chlorella protothecoides
gggggtggtcatgcttgcgctgacgtcataggtgtcgccctgagcttgtggctcaccagtccagcttgcggtagatgagaagattgtcagggacatgttcagagaa

SEQ ID NO: 39346 - DNA, 61 bp, Chlorella protothecoides
gcccccccacaccttgggactaggttggcggtggtgaacagggcgaacgctgtggcgggca

SEQ ID NO: 39347 - DNA, 61 bp, Chlorella protothecoides
ccgagggtgcgctgaaatgtgttgcggcgggcggcttcaaggggcacgacgccaaatcgac

SEQ ID NO: 39348 - DNA, 18735 bp, Chlorella protothecoides
  modified_base (672)..(681): a, c, t, g, unknown or other
  modified_base (1918)..(1927): a, c, t, g, unknown or other
  modified_base (2200)..(2209): a, c, t, g, unknown or other
  modified_base (2273)..(2282): a, c, t, g, unknown or other
  modified_base (3120)..(3129): a, c, t, g, unknown or other
  modified_base (3258)..(3299): a, c, t, g, unknown or other
  modified_base (3948)..(3957): a, c, t, g, unknown or other
  modified_base (4039)..(4048): a, c, t, g, unknown or other
  modified_base (4172)..(4181): a, c, t, g, unknown or other
  modified_base (4485)..(4494): a, c, t, g, unknown or other
  modified_base (5579)..(5588): a, c, t, g, unknown or other
  modified_base (6031)..(6040): a, c, t, g, unknown or other
  modified_base (6620)..(6629): a, c, t, g, unknown or other
  modified_base (7601)..(7610): a, c, t, g, unknown or other
  modified_base (8345)..(8354): a, c, t, g, unknown or other
  modified_base (8842)..(8851): a, c, t, g, unknown or other
  modified_base (9274)..(9371): a, c, t, g, unknown or other
  modified_base (10208)..(10217): a, c, t, g, unknown or other
  modified_base (10882)..(10891): a, c, t, g, unknown or other
  modified_base (11506)..(11515): a, c, t, g, unknown or other
  modified_base (11769)..(11778): a, c, t, g, unknown or other
  modified_base (12315)..(12324): a, c, t, g, unknown or other
  modified_base (12380)..(12389): a, c, t, g, unknown or other
  modified_base (13698)..(13707): a, c, t, g, unknown or other
  modified_base (13867)..(13876): a, c, t, g, unknown or other
  modified_base (14567)..(14576): a, c, t, g, unknown or other
  modified_base (15019)..(15065): a, c, t, g, unknown or other
  modified_base (16412)..(16421): a, c, t, g, unknown or other
gccccaccgtcctggccgacgcgggggcggtgctggccgcccacgcggccgcggcggccgagctgcgcggctccccgaccctgcacgccctgctcgccagggtgctggccctgggcaacgttctcaaccacggcgggcgcctgggcgccgcgccaggcttccgcctgcgcggcctagccaagctcaacgacacccgcgccctggacggcaaggccacgctgctctcctggctggcaggccagggcgcggcccaggagccgtgtgtggggcgcagccggggtggcgggggcgacggcctgggtggcggcggcgtgggtggcgacggcgtccagcgtcctggcgatggcggtggtgcagcggcaggaacaggagaccgtggaatgtgtgcgcccccgcccgccacgtcacctggaggagagctgcagcagcgccgggccgcgccgcccactctcctggctgcccgcctccccgcgctggcgtcgccccgcctgcgcgtccccctggctgacgtggcagagcagctgggggagctggaccgccagctggccgccgcgcgggtggaggtggagcgcgcgcgctgcggcgcggcggcggcggactccggtgcgcacaaaggtgccgtcgcaccaaaccccgacgcggtcttcctccaggccgtggaggcgcgagtgnnnnnnnnnntcgcggcggggaactccggtgcgcacgaaggtgccgtcgcaccaaaccccgacgccgtcttcctccaggccgtggaggcgcgagtgaccgagctgagcgccgcgaccgcggctgcgctggcacagttggaggccgtgcgcggtgtggtggctgccgccgccgccttcttcggcgagaacgccgccgccgtcgcggcgtcggagcaggagttgtgggccgacctgcaggccttcatctccgcctacacggccgccgagaaggcctgccacgcgcgggcagccgccgccagccccagcccgaggcgggggagcggcgccttggggcggagcgcgcggcgcgccagtggcctcgatggtggcacaggggcgcgagacctgtctgcggcgctggatgcggccgccgcttaggtgatggcacgtcggcgctccggagaggtgtgtgcttcagacctacacagacccatgcaaccggctactcctcccagcctggccaccgctctggctcaccgctttaaactgtgcggtgttgggtgggtgggggtgattccattgcaaccctgactctagcagagcaccaaacaaccctctacttccttctactgacagaccacttgcatctccaacccatctacttgcagtctcgcttgacagcatctcgcccgattgactcctgcagctgaaactcccactgctcgatccgtgtttcctcgcattctgttcatgttacaagccgtgtcagccacggcaaaaggtgtcgcaggcctgcgctttgctaaggtcgcatccgcgcaggcttgccaggcgcgccttgcagcgccctcacagcgagacatgatccccttccccctcctctcatttcctccccctgccccccctccgcgtgttgatgctgttggccagcagcctgtccaggaactcccgctgcgcgcgcaggctgtccagcagcgcatcggcctcgccgccgggcaggccctctaggtcctccagccgcgacacggcgtattgcgcgccgctggcggcctgcagcaccaccgcagagggcggggcggcggccgccgtgaaccgcccgcccgcccgcttctgctccgtgacgtaggtgataggcatctgcacggcggggccggagaagggcagcggcgtggccaggggcaagccgttgaagagcgtgcctgcgggggcagctgcgcgcggaggggccgccccgccgcgccgcggcgggacgggaggccggcctgcgnnnnnnnnnnggcgcgcggaggggccgccccgccccgccgcggcgggacgggaggccggcctgcgaagagggaggggagtgaaggggtgatcgtagatgagtcagggccgggcagtgggcgcgaatgtcgaaagagagatgttggtcgtgcaggatccacagtggcggaaagtcctccgcacctggcggcccaggcgctgcagctgtggagtcctttggtgccgggtccccaccagagcctttgtcttggtcagcgcctggtcgcggagcaggcaggggaggnnnnnnnnnnagagatggtgggctgcaagcatgcataccgtcaggcaatgcaccaacagtagccctcccctgcnnnnnnnnnnaagtcctttggtgccgggtccccaccagggcctttatcttggtgagcgcctggtcgcggagcaggcaggggaggacctgccggccctgacgcttcgtccccggtcctggcggccatgcgccgcgtctgtaccgttcgcaagaccgtggtcggctcgccggcggcgcgtttccgcgtggtgcccctcgcccgcgtgccgggagcgagcggaggcggggcggccaggctggccagcttctcctggacctctcgcagacccgcggcgctgtagtcatccggcagctcctcccgcaggcgggccagagtcatggagcggacctgggaagggggatgacgccgatgagatggtgggctgcaagcatgcatactgtcgggcaatgcaccaacagtagccctcccctgcctccctgccgcacaacacaccgacttgggaagcttgactagttgtcttcgacactcgttctgcaggccgagcacggcgtcctctgtcgcagaccatatctcggcgatgcgagtttccactgcagggagtcatgggaacagagggtggagctgcatgtggtcctctggcagcagcatcgacaggatgaggctgcaggacaaaactccactaactcacgttgtgcctccagggatttgtactggctgcgtagctcggctgggagtgggggggtcgaggatcccggctcccccccctcacccaccacctcgtcatcctctggcacagaggcgaggaccgccttccttaccctgggaggcatcccagacacctggtggtgcagtactacccttttcaaaacagtgccctagctcgaggtgcgacgagtgggagacaagannnnnnnnnntagtactaccttttttaaaacagtgccccagctcgaggtgcgacgagtgggagacaagagctgcgcgacagctcctcgcagacgtacgcaagtccaagttgaataccggagcagcttcccgccaagcannnnnnnnnnnnnnnnnnnnnnnnnnnnnnnnnnnnnnnnnnggtgtccggcccaggctgccgctcgattctcaactataccctcctaaacttctgcctgaaagttctatgtccaatacagcacttcaaatcaagcgcgagatttgctcgcaaagcagaggcgccagaagggtcactccccctcctccatggggctcggcacactgatctgcgatgggagttgcccggtagtcagcgcctcctcgagcctctgcacctccttcaaggtcgtggccgcggcaatggccgccctgatggcggtggcctgctcgggtgtgggtccgctcctcgtgctgggctccgccgacgacgcggcggccgcagcggcgggcagggctgccttcacctgcagaggaggggacatggatttgcgatcgagttgagctgctacgtaagggggcgggggcaacgtgcagggcagccagtttgcgaggccccaagccatccagcagcgccggctaccctcagacccctcacctctgccaggtcttcatcaggctcaaaggtagccgccggagccggcgcaagacccatggggtactgccgcacagcttcctgccgctctgtctgcttcacttttcggaagtccaagaccttgaggtggggcaatcgactgatcacatacagcctgaaggcaagggaatcgaggggnnnnnnnnnncacgtgagggggcgggggcaacgtgcagggtagccagtttgcgcggcccccagccatccagcagcgccggctaccctcagannnnnnnnnntaggggtgtagagggcaggccaacgaggcacaagccatactttcttgtaacaaccttggcacagcaaacagccttgctcgggcatgcactcacgcgcacatcctcgcacctgtaccccttctgnnnnnnnnnngaggggtgtagagggcaggccagcaaggcacaagccgtactttcttgttacaaccttggcacacccaaacagccatgctcgggcatgcactcaagcgcacatcctcgcacctgtaccccttctgctttgtgatgggattctccaagaggctcaggtacttcaatcgtggcaaagtccgaaggggctcaatgtcctgaacaatagtcagtggaatggaggggaactcatgagaagccgatggaaacagaggacatactcctgaatgcacgggctccctcccagctggttgcaaggcagagatctnnnnnnnnnngatgtcctgaacaatagtcggtggaatggaggggaactcatgggaagccgatggaaacagaggccatactcctgaatgcacgggcgccctcccagctggttgcaaggcagagatcttgccctaacacaggcatcttccaccctcaccgtcagatttgtcaacttattgttggtcaggaggagccattccagggcaggcacagacgctgcacagcaccgagggggcagaatttaaagcctgggcgccgagtctgtatctcagtcaactatgtgagccacgcactcggagttacgcacatggagattctggcagggctgctctggcatcccacccaccttccaggccgcggccaatcttgatgacacgattgctgttcaggtgcagcaccttgagacgcaggagcttggggaagccctccaggcgcacaatgccattatccgagaggtcgatgctgtcgaattggttctgaacgggtgacaaggttgggggggagcgtgggtgatgggaatagcccaacccggatcccgcccagcaaggagcacactctcgacgcacctccgtcgccccgagattctcaatcacgttgatgcggttggcacgcatgtccagctcgtactgtcccacgcagttcatatactgcgggctgcgaaggatgagctctggcgtcagcctgcccagcactcttggccctgccaacgctcccacacccctcccatcgagcgccatggagatgaatggggactgtgcgttgccttgcacctcgcagcacgtggccacttccgcttgtacgttgcgatgtggtccgccttcctcgaaagagcacaggcttgcacgtcaaagcttcccgctataattgctacctaagaaacgaagtacgagataggatgcgagcactgtgtgtcgagacaccaaaggcaatcttggcgaggcgaggaagtcggtgtaaggaggctttgcgggggcgccatattcggggtatgaggctttcaatgatcatttccttaggaactcaccagacaatcccctctagatcctctcatgttacattctgggccccgatgcatgcagtgtgagtaaggtttgtnnnnnnnnnnatgaggctttcgatgatcatttcctttggaactcaccacagacaatcccctctagatcctctcgtgttacattctgggtcccgatgcatgcagtgtgagtaaggtttgtacgagggcaagcacgtaatgcgctgagagtgctgctgacattgtcaggtcaaccaaggccttcaacatagcataaacgccgtgggaaggccctgccggggccgatagaggtgagcacggagtggcggaaaagatatgcagaggatcctgtgataatagatacctgtaagaaggtgtcactaggcggttgcattcggtttatggggttctggaaggcagttgctagaaaaaggatggcccaaaagatcctagcatccagattcatgttggcccgccggggggtggcacaggctcattgacgtgacgctctccccaaaggtggatgcgtcgctctnnnnnnnnnngcacattcatgttggccggggggtgggtggcacaggctcattgacgtgtcgctctccccaaaggtggatgcgtcgctctccccgctggaatcatgccgcgtgtcgccgcccccttccagcagacagaggggaaattcgtcgcagttgcacacctcaatcatgtggttatctgccagcaaggtaagaagacaccaagacttactggaagaggtggccactcatactactcaacaaacaggctttcaggctcctccacctgccgcagcgagcatgaaccttgcatagaacccaggcacaggcttcccccatcccgtcatccagcaccatcagcctaccagggtcatggaagaagagctgcctcatctctaccccgtcctcacaacatcgctgcacgacgtatttgatcctgaagtcgtccagctggcgctcgacggtgtccaggtcttgagcctgtcagaccatgagtgaggttgttaccctaaacacatggttgccaccagcacggcatggcctggcaatggtggatacacaatctgatcaccgcttccttactcacgaggaagctcagatgattcgactnnnnnnnnnngcggcaaggcctggtaatggtggatacacaatctgattaacgctttcctactcacgaggaagctcagatgattcgactgaggtacgatgctgctcttgtccttgttgactggagtccccctgatcaggtgtacgcccaggccatgccgccagagcctgtcacgcagtcgggttgggcggagaggcattaggtctgccctgatgaaacgagccgaaccggccccgtgaggtctgcttcctggcatttaaagccaaattcgactcaccagcatccatcgaaatggaaactcgatggtcggcgcaccaaggtgaatcccagcacgtccctgtggggtcccgcagctgaagctatgaggaattccgatcgactcaaagacccgtgctgttacgactatcgaggaagctaaattcgcagtgagattgaacctacctgtagaactgagctgcaatcgcgacatctgcgacgacgaaagaaacatggttcagggtgcctaaggccaaactcatgtcggagatatggcgcctcgagcaatcagcactcgagacatgcatcggacgcggggataaagaatgatgcatcatattgtatttactgggtacgtgtgtgttgggagcagacaacagccccgtgctcggcgtacgacgcaatcttttttctgttgagaatcttgaaatcttcgcaccacgggtggggcccgttcttgctccctgacgaatttcttcaagagcctccctgacataacgaagattccacacttccttcaaagactatcgatggtccaacagaagtgtgctcgatattttcacactcatttgtactgggtatagctcgcatgcgacgtattgcaagcaaggggtgaacgacccccctggtcatgaggaatcaataagatcgcaaacgacctgacgcccttgtacattgcaaaattatggatggattcgttcatctgtttggtgagtgcagctgctggcnnnnnnnnnngggtatagctcgcatgtgacggtgatcgaccccctggtcatgaggaatcaataagattgtaaacgatctgacgcccctgtacattgcaaaattatggatggattcattcatctgtttggtgagtgcagctgctggccgtgaggtatcgttctgtgcagactgcgtggtgccccactcacagcttcggatgatctggttctctgcagcgtcccagatcctctctcgcggacttacatttggattgaatctattgagcgccagatcgctcactccgcaggcatatggggtaagttcacggctcgatcgtgattggctccgcctttgcggaccttgctcggcggaccatgaccacacctcccccgcaccacaggtcgttgccatccagctgcatctactgaacacaaccctgctgttcctcagccgggaaggcttccgacgcggctgtttgcgcatcgatgcacggaaaccaggctcggtgctggccacatctgccctctgcatccccctgggtgcggtgttctctgccctgagcatatggctcctggttcagcgccgcccaggggacgtcgtttggcaccaggccctccagctgcaaggtgtggaggctgttttcgtgaaacagcacatgccgctgcaactcggccgccggtgctcacggccggttgagcgcggtagcccaagtgtcttgcaatgattgggatccgtctccacacccactcacaggccttgcggtcnnnnnnnnnntcagctgcaaggtgtgaaggctagtgttgtgaaacagcacatgccgctgcaactcggccgccagtgctcacggccgtttgagcgtggcagcccaagtgttttgcgatgattgggatccctctccacacccactcacaggccttgcggtcgttgtggagctgctgagcgagccgctgtacgtcctcgccacggtgcggaagcagtacagcctgcgcgtcggcgtggaagccggggcgcagctggctaagagcgtactgatcgccggcctgctggcccgcccggacgcggaccccgccgtcgccttctccctgggtcaactggcgtacgctggggccaccctcctctgctacgccgcatggggctgctccctgcggggtgtcctcggtggcgcagggtcggcggaggctcgcgccggcgcgccggcaggtttgaaggctgccccctcgccggagcagcgcgcagccgaccaggctgccacagacacgcgnnnnnnnnnnagaggctcacgccggcgcgccggcaggttcgaaggctgccccctcgcaggagcagcacgcagccgaccaggctgccacagacacgcgccccggcctggacctccccgccctccagttgtcgggcctgtttggcgtccaggccgtgggcaagctggtcctggcggagggcagcaagttcacgctggcggcgctgcagagcagctacgaccagggcgtgctggggctggtaactaatctgggctccctcctggtccgcaccgtgttccagccctttgaggaggccgccttcctggccttcagcagggccgccgccggtgtggcaagggacggcggcgatggagtggcagaggggcggggggacggcggggcggagccgggcgacgcggcgtcaggggccgacattcgcggcggcccggggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtgacctttgccctggtggccgccgcctttgcccccgcctacgcccacctggccctgctccttggctacggccgggtctgggccgcctcccccgccccgggcgtgctgggggcctacgccgccagcctccccctgctcgccgccaacggcgtgctggaggcctgcgtgcacggctgcgcggggcggcgccagctggcgcgcgccaacgccgcgctggtggcgctgtccgtcgcccacgtggcggcgctgcttgggctgaccgccgcactgggcacgctgggcacgctggcggccgacgcggtcaacatggcggggagggtgctgtactgcctggcctgggtgcggcgcgagctgggcgtggcgccggccgggctctggcccagggcggggaccctgcgggcgctggcggttgccgcgctggccacctccgcggcccgcctgctcctcatgccggagagctcgggcttgctggccgccggccggcgctacctggggcccgggccccgtgcgacgctggatgccttgctgatggccacaggggagtattccttcctggcgcgcgcggcgctgcacgtggctcttggtgggacggccctggccgcggtggtggcggcggcgctcgcgcacgagggcgacgccctgcgccagctgcgcgccctgcgcaagggcgccaagtcggactgatcatgggcaggcggtttgttaacgatagcagatgggggcatgcgcctcagactgtgaaacatccacccggaccaggacagagagaccaatttcgaagggtcgagttcgtccgcctgtggtcctgctcgctgacgtggaggtcatgcgcgnnnnnnnnnnggaccattttgaagggtcgagttcctcgtccgcctgtgttcctgctcgctgacgtggaggtcatgcgcggtcggagacactccgacatgccgcgcccccaatggcttcccaatgctgagccatgcgccaggcctggaaaatcaggcccgagagcgagattcgatcagtcccctgcatgcccgctggctgcgatggtgtggtcgatcgcggccgtatgccggtcctcccgcacgaccggggctgcgtggcgacaagcatgccgcgccttctcctccgatccagggatccaggcatctcgccccgatgagcgtgaagccatggaatacgatgtgtgcatcgtgggtgcagggccggcgggtctgtcggctgccattcgcctcaagcaggtgagcaaagggaagggggaaagcgccaggatacatctgatgacgccgccctggtgcagatcgtggagggagcctgatctgaggtattcactcaaacaaacaacatccccaccatagcttgccaaggagaaggagcaggaaataagcgtgtgcgtgctggagaagggctctgaagtcggtgagctgggggggaagaggagggcatctggtcgtggtcggacctgtatcacgggttgggcatgggtcaatctatccctacactgcgcctctactaccacnnnnnnnnnntgaggaagaggaggggatctggtcgtggttggacctgtatcacgggtcttgcatgggtcactctatccctacactgcgcctctactaccactatgctacctggccacacacaatcacccgtgccgcacaggcgcccacatcttgagcggcaatgtcttccagcccaaggctctggacgagctgatccccagctggcgggaggacgccagctgccccatccacgccgtgcccgcagtcaaggaccggttctactatctcacaccgcggcgcgctctccgcatgcccacgccaccccagatgcacaacaagggcaattatgtcatcagcctgagcgaggctgtgcggtggctgggggcccaggccgaggaggcaggcgtggagatttaccccggcttcgcaggttcccacctgctcacctctgccagcggcgcctgtgtgggcgtgggcacgggggacatggggattggaaaggacggcacacgcaaggactccttcgccccgggcctggacctgagggcgcgggtgaccctgcttgcagagggctgtagggggtccctgaccaaggtgtgtgggcggaggcgccctattgtctgcttactgctccttggcagtgtnnnnnnnnnncagggggtccctgaccaaggtgtgtaggcggaagcgccttattgtctgcttactgctccttggcagtgtgtctgctggatcggggcaggactgctcccgttgtgcctgtgacagagcccgtcctggaaggggtgcagcttgtcgggtgctgcaaccccggcgctgctcgttgtctcacggtttaatccctctcgagcgccaataccatcccccatgcctctcccacacacgtgcaggaggcactgaagcgatannnnnnnnnntacggttcaatccctctcgagcgccaataacgtccctatgcctctctcacacacgtgcaggaggcactgaagcgatacagcctgagggagaaggcaggtgctgatccgcagacctacgccctgggtctgaaggaggtctggcaggtagggtcgggtttcggccatgtcgagcaacaaggccccgaccgcgcagagctccactcgccatggtgcactccctggctccccttcttgcagatcgaccccgccaagcacgagcccggcacggtgtggcacacgcttgggagccccctgccctggaacacctatggcggcggctggttgtaccacatggcagacaaccgggtctccctggggtgcgccgtgccagtgggcgggtgtgtcgggacgctgcctgccttcattcttgtgatggccgtgaaggtcagaccctgagaaccacccctgaccgccagcgccccttgcaatcccccctttccaccctggccagcaaagcccccccatatcacactgcagcctggtggtgtcgttggactnnnnnnnnnnatctctttgtcaaaacctgaaatacgcagtatggggcgaggacactcagcgagggnnnnnnnnnngccctggccagcaaagccccccctttacacactgcagcctggtggtgtcgttggactacagtaaccccaacatgaatctctttcaagagttccagcagtacaagcgccaccctgccatcgcccgtgtgctggaaggagggacctgcctgcaggtgggtgctggggtgtggcggggagcgatggtgaaaatggtggcagtgggcagcgggcgtgatcttgttgccggttgtggattcacattctcttcatcataacctgaaacttgcagtatggggcgaggacactcagcgagggcggaatccagtccattcctgccctcacattcccggggggtgcgctcattggtgacggcgcgggcttcctcaacgttcccaagatcaaggcgagaggggcatgtgggctgcaatgggccccggctccttggctttgcactgagggattgcatgtagttacgttcctgtcaagcatcctctcagttgtgcacttggacgccgcctcacaagccatgcatgcctctcgacctgcctcacccatctctcacagggcacccacaccgccatgaagagcggcatgctggcggcagaggcggctgctgcagagctggccaaggaacccaccgccgcaggccgggccctcgacctgggcgcctacgagaccgcgatgcatgactcttgggtgcacacggagctacaccgggaacgaaacatccgaccctccttcgggctgggtgccgggatctggggcgggcttctgggctccgcgctggaagcgtatgtcctcaggggaaaggcgccctggaccctgcggcacaggtggggccggctcctttgctttctgccagcgacctgcaagagtgtggggggccgccgatccctgatcccatgtccatgaacaagaccctccccatctcgaggctccatagcacgcccttccactccccccttccttccacaggcggccggaccacgaggcgctggcgcctgccgcgcaggcggcgccgagggagtaccccaagccggacggcagcctcaccttcgacctgaacacctccttgttccggagcgggaccaaccacgagcacgaccagccgccccacctgcgcctgcgcaacgccaagctgcccgaggccatcaacctgccgcggtatggcgggcccgaggcgaggtactgcccggcaggtaggagtgcgaggggggttgatttgggaattcaacagggcgtaagctccgcgtgcgtgtgtgtatcatagattgagatattgaaccttgcacccatgaatggggccagtccaagccaggaactcgaaacnnnnnnnnnncgctgcgcgtgcgtgtgtgtatcgtagattgacatgttgaaccttgctcccatgagtggggccagtccaagccaggaactcgaaacagcctcctgagcacgacgaccagcacggtcactcccagctgccgtctcccaccgcctccatgcaggtgtgtacnnnnnnnnnnaatcaacatgatcactcccagctgctgtctcccaccgcctccatgcaggtgtgtacgagtacgtcccctctgagcacggaggccagaagctgcagatcaatgcccagaactgcctgcactgcaaggcctgcgacatcaaggatcccacccagaacatccagtggatggtgcccgagggcggcgggggcccaaactacacaatcacctgacgaggtcaggggagagggatgtcctgaagagattggcgacacacatggccgcccgcagaatgcagtcgctgtgtgaagaatgaactggtccgagtgaggccctctggtgcctgtgagaccccccttgtagtccccagcgagatacgtgcaaatggaaggcgagcctgctcacacagcgctccagcccataccatgtgaagctgcagatccggcgcctttggtgactgcccaccctcggggagcaagcgagctttccgcaatcgactgtttgttcccctttatggagggtaagctctgcctggaagctctgggctgagcttgtgcatgaaggcggggagtcaccaaggcttgcaagcgcgacacagagaacagcccactgagggagcgacgcctgtggttgtcatcgtgcacagtcatgttttctgacgatgagatgcccactctgccctcaccccttgcaactgcgacctgtgattgcctcnnnnnnnnnntggggagcaagcgagctttccgcaatcggccgtttattcccctttttggagggtaagctctgccttgaagctctggattgaccttgtgcatgaaggcggggagtcaccaagacttgcaagcgcaacacagagaacagcccactgaggcagcgacgcctgtggttgtcatcgtgcacagtcatgttttccaaaaatgagatgcccactctgccctcacccccttgcaactgcgacctgtgattgcctctgttacatccaagctggagggacaaacatgtggcagcctgcaaagaagtggtgacctgcaaaaagaagagggaaagatcttgacaatgtgtgaatttggacgcctctgggcatgcctcactctgcctgagtacagcatctgatgcaggcagcaaacatgctcaccacaagagagcctgcccctgcttggtccctcnnnnnnnnnnnnnnnnnnnnnnnnnnnnnnnnnnnnnnnnnnnnnnntggcgccagccatgcctgccttcttggttccgcggaccttcttcagcctgttcttcctctccttcctctgcttccttgacttggagacagcctcggccagaccgttctgaggagggcattgggttgggggtgcgggatcaggcaggtgatgagatgcctcagggaaacagcggggtcacacagcaccaagctgcccagtactccgaaaataagatggccatgagtcgcccatgcttcctcaccctgacgatgcggtgggtgggctcaaacttcttgaaagcctccaggctgtcgtagatcaggccaaagccagtggacttgccgccaccgaactgggaaaaggataaaggaatggccgttggcgtcatagctctgaacgcttcacgaatgcagagaacctccaggtgacgctcagcatccccaagcgccccccaccactccactgctctgaccccttcaagcgccagtcaccccacacctgggtgcgcagaccgaagacggagatcagcttgtcgtccttcacgtcgtacagcttggcgagcttctcgcgcaactcggtctgcgaggggatgaggagcacgcgacgcctcagcatggtgcaccgatcccaccaccagccacggagtcacgcccagtgcactatacatgcatcaaatcgtcggcgatagctcgctgacatccggcgcagtccttcacggcgctgctccccaatcctcgcgacgcctggctctatggcgcccgtaccttggagacattcgcgcggccggggtgcagcacgtccaggacctgcgtgcgtgtgggtgtgaatcggactgagactcttatcaggagctagattggcgctcagcatccagggcgctctccgcagtggcaggactcacaaactgccgccgtgccagcagccggttcgtgatgaacttgcgagtgcggagggtgcaggccttctccgccatgttgaacgagcctgaggtgccacccacgtcgttcactgccgaaagagggtctcccaggggccatcccccggtatgtcgccgagctctgcaaggagcgtggtaccgcgggggtaccgttctataccattgtgacggcggactgggccctccccattcaccttgtcccggccgcagtgaaatgctggctacaagcgctatatttcgagctttcgttctagccaacactctgcatgatagagatgattcatgcaaaatgttccatgaggctgcagcaccccgtcaggtggaacaacatgattcatcatgcctggctgagtgacagagtcgcgaacgcttgttgcccaggtcgacctttactctcgacagcacttgcactccataaaaatcgacttgnnnnnnnnnnggagtgacagagtcgcgaacgcttgttgcctagatcgacctttactcttggcagcacttgcactccataaaaatcgacttggtatcttcactgtaaccagtgtagagataaacagagcctgggaggaacggcatgtccgctgcagacgtccagggtgccgcaccattccccaggcatgctcgccagtccgcctgcaccctcctcagtgcccacccttgggcatggcaggggtgtgcttaccctgctgcgcggcgtgagcggccagcgcggaggtccgtcgcttggccgcggcggtgatggcctcgcgggggtgcaggttgggcggcgtgtgcacgtacctgaccctggagccccgcaggtagaggtactctgcggcccgcgtcggaccctggaggggggctatgctggcggactccagctgcaggtccaggccgtcgccaacggcggtcagcacgccgcgcacgatggtgtcgcagtgcagctcgatgactaatcgcatgcccaccagcgcttccaggtagcaggccagcgtggggggccgtctcctgggacccatggccgggacttctcgccttgggcggaggggttgcgctctatgattgcagcgtctgatgcgcccgccgccgtcaccaccggaagcgagtgcggcggatgtggaagagggcccggaccagcagggtgttgaccaggatgacgctgagcagggggtggtgactcagccagtcgcgcacggggaagcggggtttgggacgggggggcagcgcgtcggccgggggccctttggcagcccgctgactcagcacgaaggcctgccgcctgctgaaacgcactcggtcggatcgactgagggcaaggctgcgtggaggggagggtgccgtggattgaggtgatagtgacggcttgggatggagcagttgccctcatcaaaggggtggcacctctccccatcccagaacgctccatgccctgccccatcacccctgcgcaccgaaagtagggcaatttttccaccaggggtcgctctgggatgggtgagaacctccgcagaaaggccttggcctcggcaagaaactcgacggtgtgcagcagggtgagtgcaaagtagtccctcctcctcagggcagccagaccctcgacgatttcgaatcgcaggtcctcgggatagagtttcggaggaatcagccggggtaggcgacgatggcgactcgcagcggccatgtattatggagaagagggggttgggtcccgcaatcatgcattgcggggcactggcgtgggcgattggcacgggaatgtgatgtgtgtgggtatcggccttgatctgcatcccacccgcgccggcgccacttccgctcccagggcgcgggatatgccccaagggagtcgttgtctttcgggaacactctgtccatagggaaagtacacagagtatacacaagacgcatatacagcctgcgggatatggcccgctgactcatgcgagccttgctgtccgggctgcgactcggttggggaccagcaccctgccgtgcccgcctgtgcgcaggctcccaccagccgggccgtgccgtgccgaggcgcgtgccagccagggccatgtccgaggcggctggcgaggcggggcggggtgaggccgtcgtcgagtccctttccccaccacccctcccccctcagctcctgagtgtggcgcccatgatggactggaccgacctccactaccgtcagctggcccgcatgatctcccgccacacctggctgtacacggaaatggtggtggacaagaccctgatccacaaccccgaccacgaccgcttcctctggtttccccccgagcagcaccccatcgtgtgccagctggggggcagcgaccccgacgaactagcggccgcggcgcgcatcgtcgccggctacggctacgacgagatcaatctcaatgtcggctgccccagcgaccgcgtggctggtgcgggctgcttcggcgcggccctcatgctccggcctgagctcgtcgctcgctgctgcgccgccatcgccgccgccgtggacatccccgtcaccgtgaaatgccgccttggtgagcgtgtgtgtggggggggtgattctgagggccagggatcttgtattcaattggaactgtgagataaaagcagcacattgcatcgtagaatggcccctgtcgagccgccgcctcctgcgcagcaagatggagggggtccctccctgcccggtctgctctggacctgcgtcaggtcccccgcgcatccccctttggggtcacaagaccttctcttacccccccaccccacccccaccc

SEQ ID NO: 39349 - DNA, 161 bp, Chlorella protothecoides
gtcagagatgatagctgtgcaaaatcctacaagacactcatgctcagaatactgatcactatggaaaagtcaaagcctacacaccctcaaagatagtttcggctgttccgcagagcgggactcaaaagcacgctgcactgcacagcacttgcctcgtcttg

SEQ ID NO: 39350 - DNA, 68 bp, Chlorella protothecoides
attgtttgatctgcccttgacattcctgtgccagcctagactcgctctcaacacagtactcgggaagc

SEQ ID NO: 39351 - DNA, 65 bp, Chlorella protothecoides
ggggggggggtgaaagagggagggcgagtgcgggacacggagcaggcccgcccaaggtcgggctg

SEQ ID NO: 39352 - DNA, 72 bp, Chlorella protothecoides
tgcagctgcgccctggtcgcccaagcccatcgaggccccccctcccccgcccctctcaagctcgcacctggt

SEQ ID NO: 39353 - DNA, 31103 bp, Chlorella protothecoides
  modified_base (399)..(408): a, c, t, g, unknown or other
  modified_base (581)..(590): a, c, t, g, unknown or other
  modified_base (1147)..(1156): a, c, t, g, unknown or other
  modified_base (1405)..(1414): a, c, t, g, unknown or other
  modified_base (4251)..(4260): a, c, t, g, unknown or other
  modified_base (5862)..(5905): a, c, t, g, unknown or other
  modified_base (6094)..(6103): a, c, t, g, unknown or other
  modified_base (6180)..(6189): a, c, t, g, unknown or other
  modified_base (6266)..(6275): a, c, t, g, unknown or other
  modified_base (6746)..(6755): a, c, t, g, unknown or other
  modified_base (7524)..(7533): a, c, t, g, unknown or other
  modified_base (8819)..(8924): a, c, t, g, unknown or other
  modified_base (10500)..(10543): a, c, t, g, unknown or other
  modified_base (11802)..(11811): a, c, t, g, unknown or other
  modified_base (12368)..(12377): a, c, t, g, unknown or other
  modified_base (14580)..(14589): a, c, t, g, unknown or other
  modified_base (14657)..(14666): a, c, t, g, unknown or other
  modified_base (14750)..(14759): a, c, t, g, unknown or other
  modified_base (14817)..(14826): a, c, t, g, unknown or other
  modified_base (15148)..(15157): a, c, t, g, unknown or other
  modified_base (15602)..(15611): a, c, t, g, unknown or other
  modified_base (16536)..(16545): a, c, t, g, unknown or other
  modified_base (16613)..(16622): a, c, t, g, unknown or other
  modified_base (16737)..(16938): a, c, t, g, unknown or other
  modified_base (17722)..(17731): a, c, t, g, unknown or other
  modified_base (19597)..(19606): a, c, t, g, unknown or other
  modified_base (20157)..(20166): a, c, t, g, unknown or other
  modified_base (20682)..(20691): a, c, t, g, unknown or other
  modified_base (21146)..(21155): a, c, t, g, unknown or other
  modified_base (21219)..(21228): a, c, t, g, unknown or other
  modified_base (21746)..(21881): a, c, t, g, unknown or other
  modified_base (21980)..(21989): a, c, t, g, unknown or other
  modified_base (22216)..(22242): a, c, t, g, unknown or other
  modified_base (22717)..(22726): a, c, t, g, unknown or other
  modified_base (22981)..(22990): a, c, t, g, unknown or other
  modified_base (24228)..(24237): a, c, t, g, unknown or other
  modified_base (25246)..(25255): a, c, t, g, unknown or other
  modified_base (25548)..(25557): a, c, t, g, unknown or other
  modified_base (26354)..(26403): a, c, t, g, unknown or other
  modified_base (27345)..(27354): a, c, t, g, unknown or other
  modified_base (27819)..(27828): a, c, t, g, unknown or other
  modified_base (29012)..(29021): a, c, t, g, unknown or other
  modified_base (29089)..(29098): a, c, t, g, unknown or other
  modified_base (29586)..(29595): a, c, t, g, unknown or other
  modified_base (30322)..(30331): a, c, t, g, unknown or other
  modified_base (30520)..(30529): a, c, t, g, unknown or other
ccagcagcgcgggggcgcggcggtgccagggcagcgccgccgcgcgcgcgaccgcggcgcggaggtcgcgcaccagccgggaggagagcgctgggggcaggcgccggacggccgccaggtccagcaccgcgcgcgtgcactgcaccgtgtagtcgatggccgagttgtacagcccgcgccgcgccgcggcggacatctggcggcgcgggaaggcgggccacacaggttcccgaccctgcgcgggggcgcgtgggtggggtgggcgctgaaacaggtgggaaggaggactgcttctccgtatgtgggagggcaggtgggcgagaggggggacaagtcctggagcaagggtgggacagcgcatggcggggcgggatgcgcagcatcgatgtgagaggacannnnnnnnnnggggggggcaagtcctggagcaagggtgggagagcgcatggcgggacgggatgcgcagcatccacgtgcaaggacaccaagcggcagtctgctgcgggtgcgatggcatgggaccacgcccccaggcacgcccctgccctgttctccgacgcgcagtgcacccacctcgcggnnnnnnnnnntcccgtgaccccaggcacgcccctgccctgatctccgacgcgcagtgcacccacctcgcggtccgctctttcctcctcctcatacaggtgcgcaaagtaggcattgaggaccagcagcgtgctcacgccctcgctgggggcaacaagattgggttgtggagagtcatcggcagatggtgttggtgcgcagcatgaacaaggctgagcgcaggcagcgcaccatggacgcacggaccctgcctgcagcagctgcaaatgttcgcggagacgatgccacggagcacaagccgcatcccaccacacacccagggctcacttgcgaatgagtgtgatcaggatgttgcggcggctggagaggaagtgccatgcgtcccagccgatgggtcgctggcgtggagcaagtgggaggagacggtgcaaaagtgacaatgttggacaatgctgtgcagcatgttcacatgccattggagagcatctaccatccccgagacctcgtctgggttcgcggcaaaaccactgcacccacaacaaacacaccgtcttcagggagaggagcnnnnnnnnnngcccccgagacctcgtctgggttcgcagcaaaaccactgcacccagaacaaacacaccgtcttcagggagaggagcgagaggggcagaccttccacctgctccaaggctggtgaatcaccgctaaatccctctgtgcccagcctcgcctccttctgtgcgatgcatggtgacggatcacacatggcgtagctgctccaatgcaaaggcagtgccgcctcgttccccgtgcggcagtttccccgtgcctnnnnnnnnnnagatcacacatggcgtagctgctcctatgcaaaggcagtgccaccacgttccccgtgcggcagtttccccgtgcctcccctctttcccacacctggaacacgtcgtcatcatagggctgcccgtacgaaaaggcaagtgctgggttgtagtgtttcgagatcagatcgagtcccagtcctgcggctacaacggctgctgtcggggcaggcaagagcctgagtgtaaggcccaggctggcactgctcgccatggccgcgaagcctcgaccagcccctcccagcacctcgtgccgaatcctccaaggtttttagattttgatgcagaaactcggtgcaagtatcatgtgccctgcttgttggatccagtcatcgagtgtgggaacgtcaggacacgcgcgcagaattcgtcggggtcttcaggcacgctttcctccaccctcatgatggttgcccgaggcccacgcatccgacgatcgcctgccccattcccggcacatgcgcagtgaggcaggggcagaactgaccgaagtatcgctgacacattccagatacacactctcgacgctgcatcctcggctcgccagagatgaatgtacctggcgttatcgccaccgcgggtgcaccctgcatggggcactccatgccatcttctacagccctcaggtgcataaacgctcaaagcctcagaccttccaagctggctaggcatggtgagtcttctctgcgtcgcattctggaggcatgcggggttgccccacaccgcccgagtacatgtgccggcgctgctgccgctgtgaggtccacacccagaccagcaatccccctcccgagccgtgcacccacatggccaccaacctcttgcccccatcccttgcaactttcaggaatgggacggtcatctgctgcatgcaggacgctgcgcatgatccctgcggcggccgccacctccctggagtttgtcaagggcaagcccgagccgtctgtgcccgaggtgaagctgacgaggagccgcgatggctccagtggcgtggcgaccttccgcttccccagcccctccgtgttccaggaggaggcggacatgagcgacatcaccggcctctacatgaacgatgaggaggggacgctgaccaccgtggaggtcaccgcgaaatttgtcaatggcaagcccgatgccattgaggccaagtacgtcatgcgaaggtgagcgtggctggcacagtgggagtgggaggagttgttgtgcattgttgctgggagtttctgcaaccggggtggcgggctcatgtgctgagccagccgctgtgtggatgtgggacgcacctcaacccatgccactgcgcatgcccggcctgcggggacccatctcacccaaagtacaactgacacccgcacccctttgtccccatcgagtgcagtgccatcgagtgggacaggttcatgcgcttcatggagcgatatgcagaggagcaggggctgggcttcaccaagggctgatcaccctgcctgggcttgctcttgtccttgagcctgggggtgaccccctcccctgccatattgctgctgttgtctcattcaaaaaattgatacaacgtccaggagcacagcaaaggggctactccctccgagaaggcaggcggagacatgtgcacactgggctggatgctgggttggtgcatttggcaagggtctgctaggttccatgcggcgctgcaactcgggaaccaaatggccaagctgggacgatctacaccggccccggccaggccctctggccttggatgaggaggatggccgcccccagtgcggcgatgcttgtcaagctggacaggacggcaaccactgccgcggaccgccgcttcctcctggcccctggggagctgccgcggagctgggggaggaaggtcgctcgcaagcgcaggatggtggcccgtgcggccttgatgcctgtgcaagttgggggccatgcatcgactcgggttgcactgactgtgagctggggttgcagcgggagggccggccgagggtgaatgcgggccgggaccaaaccccgcccatgaccacctgtacaccccacagcacccgctcaccctgcgtccggtcgaggggctgggctgggaccttccacagcccctggacgaggtaggcgtctgggatcactgcctggcccagatccaggtaccgcagcgcggagggcggtacagcgcggtacagcgccgcggcgtccctggccagcgcatcggccccggggccagagggcgacaggaccttgaggcccttcagtgcagcgtacacggcgggaccatccgagccacatgcaaacaccgcttgcctgcagctctgcagtgagggttcatggcagggtgtggttggaggtgtgcagaaatggtggagagtggcctcccacgtggtaggcaacgcctggaatgcggtgcattccaaccccatccagggttcctttgagaagcaacaataacacagacagaatcttgcacgtcagccatccatgtacctgcccacaccccatgctgtgttcaacaaacaccaagtccatcattcagatgccctgccctcacccctccagctccccttgacagccactgcggccaggtagaggggcatgagggggtgggaggcgaggaacaggtcgaagaggcggcatacttggttcaggtctgccacgtcgtgggcaaaccaggtgaggtgccagctcagcgcgaagaacgggacctccagggccggctcgtccaaggaaagaaggtgggtgtacagctgtgggtcagcctgttggggggggagacgtgtaatgtcatggatgggggggtgtgggggcgaggagnnnnnnnnnncaaggtgggtgtacagctgtgggtcggcctgtcggggggaagatgtgtgatatcatggatgggggggtgtgggggcgaggagacagcgccgtcgtgagccagacccctcagggcgctggtgctctgagttcaatctccctgcatgtgcagatccttgggtcagcttcatcgcgccatgccagttccccttcccccctccccagccccagtgtgaatggccctcctaccgcgcgcagcaaggggtacagcaggccgagggtctgcgtcgccgccaggaggtcgggccgcgtggcatcccgcaggtgagtcaccaccagttgactcagcacggcggcgccgcccgcctcgcccagcgtgaacaagagcacggacgcgacgtcgtgcaggccctggtagtaccagacatcatcctggtaccgcagggcgcgcaggaggacacggcgcagggccagccgcttgagtgcccgagcctcctcggtccagcctgtggatgaagcacgccaggattggagaaggaaggtgcagatgatgcctgaacgggctcgacccagcgggcatggatgttgattgatcacttcccaacagggcagcattgactcgctggccaactacaattccccttccacccccccttcatgacactgcattgacgtggacacatcccactccttatggagaattgtatcaaccccacctcgccacaaccttctgtgaatgcccagagcgagcggtccaggtcacatgcgatgacctgcagatcccgcttctcggcggctgtcagggcgtccccctgctcctcctgggattcttgcaggctgcttatgagtccgagggactcggggagcccgaggagtagcggccagaccctggtacgcagctgcgggcggggatagtgtgggtggtgagatagctgaccaggccatcactgtaggagcgtgagcgcagcttgtgctttttgttgtccatcgcgaaaacttccaactcgaggcttttgcatacctggtgggagggaatgccgcgaaccgccaccagcttcctcagtcggatcacatcccgctgcgtgggacagagagcacatgccacagattctaatgccttatacaggttttacactctagaagatgaaatagaaatccaacccaccctcttctcactggttcctcaagaagaatgtcattgatgagtgcgacagtctccgcgtcgcgcttggcttctgggctgctcaactgaggacccgacttccgtcgacccctacccatgcggcatgagggagtggaaaaagggtttaccggggtcttgggtgtccccggagccgcaaagagtgcgaattcgctgacactgagtaagtgcatgagatccccggcttgggcgcgcgcgcgtacatcgacttttgcatgcagcggttgttcctttggcattaacgctacactacaagaagtcagtgagatcgacgacgactcaagatcaggcttgtggcaagaatgaaggtgtacgtcaaatgactacaatgtgatgcgatgggactaccttgacttgctgacaccagcaatcacacagcatagatcctggtctgcctggtatgaagctgagagtgactaccannnnnnnnnnnnnnnnnnnnnnnnnnnnnnnnnnnnnnnnnnnntgctcgcagcagcggtctgaacgggtgggcctcccaaacgactgacggggttcggaacgcaatgcaagtagttgcatgccttgattacattctaatggtattcgcaacattaataagatgcgaagcagggtcgccatgcctatggggctccttgtctcgtgagatggcctcgaatcggtactggcttcnnnnnnnnnncaagattggtttagtatcgtggagtcttgagctcagctaccgaaactggagctgttatactcgagaccccgcgaaannnnnnnnnnaaagattgggatagtattgtggagtcttgagctcagctaccgaaaatggagctgttatactcgagaccccgcgaaannnnnnnnnncagttgcatgtcttaattacattctaatggtattcgcagcattaattagatgcgaagcagggtcgccatgcctacggggctccttgtcttgtgagatggcctcgaatcggtactggcttccgagtcccggcgagcagggcatgcattgagcgggacaaaaagttcgacaggccacccatgcagcaacacactctccaccgtcccccgccgagctcgttgtgtggtcatcatcaaatttctcccgacggcaatcttattgctttggttttcgtcggggctgtatccaagggaaatcccagccagtcacgtcgccctctatgctccaccagaggggaggataatctcggctttataccctcccagagccagcgccaaagccgcctatccgctttacatacaacttaatgccggataaggtcgatagacgagattcggcggtcccaggtggagcaggacaggcagacgcgcagnnnnnnnnnntccgctttacatacaatttaatgccggataaggtggacagacgagattcggcggtaccaggtggagcaggacaggcagacgcgcagccgtccgttaaggagctgccggctggagatgggctgaaaggacccccctccccccgcgacacggaggacgaggtggagtctcacggaaagacggagcgggcggccagcgtgtcgggcaccggcaaagtgaagaagatttcgtattttcagctgtaccggtgcgtaatgggtgcgggcccgctccccgcttcgcaccgtcgcagaattaacccggcgcgtgctcagccccccaccccacattctcttcactacgcccagatacgccgatcgcacggacaagctcctcatcctggggggcattgtgggcgcaggactgaatggcgctggcatgcctgtcttttccattgtctttgggtgagcgcccattgacatactctggtggctgtggggtggggagtgggcaagggtggaggagcgtgtgcccacctgccagacctgcctcacccaacaccccctcattctcgctccaatgtgcaggaacctgatcaacagcttcggtctgaatgtgctggatcccgatgtgcttaaagaccaggtcaatacgtaagtcgggccaaatgtggggtagtgtgtgtgagtctgtggtgggtttccacccaggatcgttgagcacattccagcggtcagaccgcgccgcgagagcgtggacttttaccctgtcgcacagcctgggcacctcaccnnnnnnnnnnagggtttccacccaggttcgttgaacacattccagcgctcagaccgcgccgcaagagtgtggacttctaccctgtcgcacagcctgggcacctcaccatcccacccctgcatttcgcggccgctgtagtctgctgagcctctcggtccgcaccccacatctcaccaacccctccccaagaaactttcaacccccgccctccccctcacctctcctcgcagcatcgtcccccagttcatctacatcggcatcgcctgcttcgtgggctcctgcgcccagatgttctgctggacctacaccgcggtgcggcagaccaaccgcatccgcatgcgctacctccagtcggtgctcctgcaggacgtgggctacttcgagtcggagaccagccccggcgcgctgatgcagggcctgaacgaggactgcatcaccatccagtccgccatcggcgaccgcatggggcgcacgctgttcaacctgttcaccgccataatcggcatcatcgtggccttcacccgcggctggagcatgaccctggtcatgctggccgtcaccccgctgctcatgatcgccgggttcctcatcgccacgctggtcgcgcgcctgacctcgcgcatgaaccaggcctacgccagggccaacacgctggccgcccagacgctgagcaatgtgcgcacggtgtacgccttcaacggcgagcagcgctcgctgaaggggtacgaggcctcgctggaggatccggtgcgcgtgggaatcaagcagggcgcctttgcgggcatgatcgttgggttcaccaacctggtggcctttggagcttacgcgctggccctctggtacggctccacccggatcctggcgggggagtacacgggtgagtttccttgtgctgattgggtgggtggtgggtggggagccggtttggggtgggggagggagagtggcgagggtgcacgaggaggaaggtgcgaggaaggtgccatgaggctggccattgctcgccccggttcctgccggtcagtctccccatggtccatccttggacccctggactcatggtactgcattgtcgacgacacccctccccctcccctcctctcgccaatccctcaggcggccaggtcctgaacgtcctcttcgcggccctgatcggaggttttgccctgggccaggccgcgcccaacctgcagtacttccagcagggcgcgacctcaggcgcgcgcgtgtatgccgtgatggagagggagcctctcatcaacctggacgcgcctggtgagggggaatggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgcatgtgcgctgccggggtggtgtcaccgaagcgtgagacccaccccatcctccctcccctcaccacccctcccactttgtccccgccaggtgaggagctgaaggaggtgtctggtgcgctgtcgatcgtggacgtggacttcaactaccccgcccgccccgatgtccccgtgctgcacggcttcagcctggagatcgcggcgggggccaccgtggcgctggtgggcgagtccgggtccggcaagtccacggtcattgcgctgctggagcgcttctacgaccccaccgccggcgcggtgctgctggacggcgtggacctgcgctcgctgcagctgcgctggctgcggcgccagctgtcgctggtgtcgcaggagccgatgctgttcgccaccagcatccgcgacaacatcgcgctggggcgggcaggggccacggacgcggaggtggaggccgccgcgcgcgcggccaacgcccacggcttcatctccgcgctgccctccggctacgccacgcacgtgggcgagcgcggcgtgcagatgagcggcgggcagaagcagcgcatcgccatcgcgcgcgccatcctgaaggcgcccaaggtcctgctcctggacgaggccacgtcggcgctggacgcgcgcagcgagtacgtggtgcagcgcgcgctggacgcgctcatgcgcgcctgcaccaccgtggtggtggcgcatcgcctgtccaccgtggtgggcgccgacgtgatcgcggtggtgggcggcgggcgcgtggtggaggccgggacgcacgccggcctgctggctgcgggcggggcctacgcgaccctggtgggcatgcagcgggccagccgtcgcgacgaagcggcggtgagggcgtacgaggccgaggaggccgaggaggacgacgacgacagcggggagggcgtggctgagctgggcatggccgggtcggggcgcgcggcctccggcggcctggtgcctgccgactttggcgcgccgcggcgcgtcgcctcgcggaccacctcgcgcacgctgtcgcagcccggttcgccggtcggcgcgcgcatggacagtctggtgggcgccgccgacccggcggtcatggccccatccaaggccctgaccccaggcatgacggggacggcggccatcggcggctgggctcgcttctggaagggcgtgggggccaccaagggtgggaagggcggcgcgccatgcgtcccgcgcccgcaccagcgccccgacgaggccaagcccaaggcggtgtcgatcgggcgcatcgcgcgcctgaacaagccggagctgcccgcgctcttcttcggcctgatcgggtcgggggcgctgggcttcatgatgcccgccttctccatcgccttttcgtccctcatctccctcttctacaccgtcggtgagggggagagtggggcatgtcatgttatgggtggggggaggtttccggtgccttgcagccccaagtgaggtgctggtagcaaagccccagcctccatcatgctggcgactcctcagcctgcgttgcgcccagggggtctcaacccccccccccccccccccccccccnnnnnnnnnnnnnnnnnnnnnnnnnnnnnnnnnnnnnnnnnnnnacccggaggagctcaaggccgggacccggaagtggtgcctggtcttcctgggcatcggcttgggcgccatgctcttctccatcatccagtcctatgcttttgggctcatgggtcagcgcctggggaagcgcgtgcgcgtgctcatgatgaccgcgctgctgcgccaggaggtgggctggttcgaccaggagtccaacaacagcggcgtgctgaccagcaagctgtccaccgacgccctggcggtcaagggccagttcggcgacaccatgggactcctcacccaggtgggtcgctggctggttggttggtggagggtgggggccatggccgggcatggcctggagatgcatgcaggtgacgtggcggccaggactcgctggagccaccgacccaggagtgcatttgcttcgtcggtgccgccccctcttccctcctccaagcatccaagcccacgtgctcaccgccccccccccctcgtcgacagaacctggtgaccttcatcggcgggtacgcgctggccttcagccacggctggaagatgacgctggtggtgacgtcggtggtgccgctgatcgtggcggcggcctggatccagaccaagtacatcaaggacgcggcgacgcgcgaggacggcgccttcgcctactccaaccagaccgcgcaggaggcggtgggcaacatccgcaccatcgccgcctttgccatggagcgcggcgtgaccgacctgtacgagggccagctggtggagccgacacaccaggccaagcgccgcggccgctccggcggcctcggcttcggcttctcccagtttgtgctcttcggtgcctactccctggccttctggtacgccggcctgctggtgtcgcgcggcgagtccaccctggaggaggtgctcagcgtgttcttcgccatcttcctggctgcctttggcgtggcccagagccagatgttcttccccgacgtggccaagggccgcgccgccaccgagcgcgtcttcgccatcgtggaccgtgtccccgcgatcgacgcctccgacccgtctggcgaccgcatcgccgactgtgcgggcaccatcgagctggtggacgtcagcttcgcctaccccctccgccccgacgccctcgtcttccgcgacttctccctctccgtccccgccggccgcgtcgtggcgctggtgggcgagtccgggtcaggcaagtccacggtcgtgggtctcgtggagcgcttctacgaccccctctccggctcggtgcgcctgnnnnnnnnnnagggtcgggcaagtccacggtcgtgggcctcgtggagcgcttttacgaccccctctccggctcggtgcgcctggacggccgcgacctgcgcgagctcaacctgaagtggctgcgctccgtggtgggcctggtcagccaggagcccgtgctcttcaccatgtccgtggccgacaacatccggtacggccgccccgacgccagcatggaggaggtggaggccgccgcccgcgcctccaacgcacacaagttcgtggcgcggctgccggagggctaccacaccctggttggcgagggcggcatccagctcagcggcgggcagaagcagcgcatcgccatcgcgcgcgccgtgatcaaagaccccaaggtgctgctcctggacgaggccacctcggccctggatgccgagagcgaggcggtggtgcaggaggcgctggaccgcctcatggccaaccgcaccaccattgtggtggcacacaggtttgttgccatgttgtttcggtggtggtggtcggtgggaaatcggagtggtgtggggttggacgaggcgaccatccacnnnnnnnnnncgcacacaggtttgttgccatgtcgtttcgggggtggtggtcggtgggaaatcggaggggtgtggggttggacgaggcgaccatccacgccgcatcgctgttcccggcccatctgcgcggcagcagcccaagccccccacatcaacaccacctcccaccagtcacatcacccattcacccaccactcccttcccccaggttgagcaccatccggcacgcaaacagcatcgccgtggtgtacaagggcgtgatcgtggagagcgggacgcacgacgagctcatgggccggcaccacggcgcctacgccaggctggtgcagcatcagctgactgggctgagcggctaggctgcgaggcgctggacgcttttgcatgcgaggggggagacatgcgccaccccgcatttcagaacatgaatcgcacggcaagaaggggagcggaagtctctcccaacttcattctatgtagaacggctgcgcaccttcacccgcccagcttcccggagatccggcagcggtcccctccggtatgcacaccaccgcacagctggacacgacccttgcacttctggccattgcctcgttctcccgtcgacccagggcccttctgcccggaatcaaagttgctgccgcaagaccttgccccccctccgatttgatgtgactgaacacccctgtaccaaatcaggacacgacaagctgcaggacaagttcatgcaacgaagatcaaacagagaaggggggctgctcactgcactgcgcctggaaggtgccactccccagcctcaagacagtggggccccctcccccgcccactcctgtgtgctcaggctgtccatgcaatcgtggatggccctgatgagagtctgcggcgaccccacgccccgctcttcctcttgctttggggcaacaccgggccccaggtccagccccaggctcttggcatggatgcccggggtgtgccacttctcgtccccggaatcgtcggaggaggggaccgccaggcggcgaggggtggtgcagggatcggtgacgcagtcgcggcgcagttgggctgcgctttccagcctggaagtccagaaggccagcttctcgggggtggggtttgtggctgccgacgcctctgccagacctgggacagaggggggcgaggtgtgatgggggttggcttccttggtgccaggctgagagggcaatggggggccactgtcagggcagcccaagcaggccatgggataccaagacatactggtctctgcagagggggtggggttgatgtcaaccagggacatgtactcctcaatggttgtcagcagggtgtagtacgaggtctcccgcagggaaagcatgtcagctagctgcgtgagatgaggaaatgtccaagggaagggggtggaagttgagcaagggggtgggaggtgggcgcaggggcctccaaatagcaataaatggtaccctgccaagggacgccaaccccatcctttgccgtccttcaagtcatggtagacctccagctcctagcatacgtcccggcctgcctcctgcacaccaacccacacaacaacccacctcctccttctccgcctgcagcacagacaggcactgcttcaggctggcctcattctgctccgccagctgggcgtcgcgcctggcctcggcagtggcctgcctctgctcctccaggctgtgatcacgggccaccagcacctccccaagccgtaccacctccagctggagcccggcctgcgcctggctgtgactggcgacctcggcctcggcacgctccaaccgggccgttagatcatgtatgaactcgttcttgctgttcagcgcggccgctgccatgtcgacgaaggcatccatgtcgggaccgggttccccgccggagggttcacggggtcggatcagcctgatcagggaggtggggatgaatagggacacgatccagaccaggaaggcgagcatctggaaagcaccgaggtcatggatctgactacccgctcattggatctggctcgcaacagccggcagtccggacgcgagtaaccggcggcttcccccaaccgctccagatccaggtggctgttgttttgtacctccgacgccgcacgcgcagcagcaggagtgcctggactcttcctgactagagagctcttcgagttctgggcatggaattcgtttcaaaaagtcgtcgtcagtcacagnnnnnnnnnnacatctgggaagcaccgagttcatggatctgactacgcgctcattggatctggctcgcaacagccggnnnnnnnnnngagtgcctggactcttccctgactagagagctcttcgatttctgggcatggatttcgtttcaaaaagtcgtcgtcagtcacagnnnnnnnnnnaaggcatgggactctgcacactacatcaggcggcctgaatcaggcggggcgcctccgnnnnnnnnnntgcatcttgacggtcacaatggggatgggtgggtatcatgtgggcaatggagatgcacggggcgagggatgggactgtgcacactacattaggcggcctgaatcaggcggggcgcctccgtcctctgcttcacttgcttctcggccagtcggtcgagcatcacgccaaggttacgcaggcgggccctctcgtcgccctcccgcacaggggtctgccccggcttggctggggaaacctggagtcgttggtggagagtgcgagggtgtgaggatctgggtcctgggtgggcacgcctgcgcgggtgaacatccctcgctcctcnnnnnnnnnngggagtctgccccggcctggctggggaaacctggagttgttggtggagagtgtgagggtgtgaggatcagggtcctgggcggacatgcctgcgcgggtgaacatccctcgctcctcccaaaggagcaaccccccttctggctgcacagaaacacaccttggtggagtccaggggcgctccggccagccgcgcctcgaggcccttcagcgtctcctcgtgccggcccagctccgaggcccagtcgcccggggccggtccctgcgctgcgccacccgtggcctctgccgccgggtcggcggcggcggcaggggtggggcgcaggggggacttgtaggcctccgcgtcttcacctgccagctccaggccggcagatctaagagcgcccgccagctcctggcccgggtcttgttccctggcggcggccagccccacttccagctgcgcnnnnnnnnnnggcggggtgggggcgcagtggggacttgtaggcctctgcgtcttcacctgccagctccagcccggcagatctcagtgcgcccgccagctcctggctcgggtcttggcccccggcggcggccagccccacttccagctgcgctcgcagcgactgcgagggagagggccaggagaatttgggcccaggtggaggaaatcgggcattcaccaagacctgcgctcccaggccagaatatcccatgcacagtgaaggtcacccagctctggctgtcaaaggcaggaagccggcaggcatgccggcccaccaaaccctgcaccctcacctgcgcctccagtatggctgcccgggctttggcctcggcggctgaggtgcgccgatccgccaggcggacggccgcggcggccgcggcgtcggcggcgcgcactgcggcctccgtgcggtgctctgcctcgcgcgcccgctcctcccaggtcgcagccgtctcccgcaggcactccaggtctgcctgctgggaggcagggacctgctgctgcagcgtggcggcctgtgcaggcacagcagcttgcgcgggcagacgctggggcgaggccggcggggttgccagctgggcggccgctgtccgggcagccatctccttgtctgcgacagtggggtgagttgcaactgggatccgtgggaggcacagaggtgtggaggttgggtgattcctcacataaattctactggatggcgattccctaagatcacagcaatgacaatctcacacccaactccacaaagaggtgacgcaggcccagtgcatggcgctcacccctacccccacccctccacacacacacaccttccgcctggcgctgcagcctgactatctggccgtgcagcgccagctcccgttcctgcgcgccgcgcttcagccccgcctgcnnnnnnnnnnagcccgggctttggcctctgcggcagaggtgcggcggtccgccaggcggacggccgcggcggccgcgnnnnnnnnnngcgctggggcgaggccggcggggtcgctagctgggcggccgctgtcctggcagcgatctccttgtctgcgacagtggggtgaggtgcaactgggatccgtgggaggcacagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcaggccgtgcagcgccagctcgcgctcctgcgcgccgcgcttcagccccgcctgccgctcctccgcttccgtcagcttggccttgagcgcgcggatggccagcttgtacttgtggcacacgccctcccgctcacgaaggctgtgctccagcgactctgcgcgctgcctccagcgcgccacctccgcgtcctccggctcccaggccgacctcttctgggtggcgccacccagcagtgcgaccttggcccgcaggatctcccgctcctgcagcaggtcctgggcctccgcagtcttcctctccagcgcggccgccaggcggccggcctcccgctgcagcccgtcgcgcactcccgtccagcagcgcatggcgtcggcggcgcgcgccgcggatgcctccattcgctcctgcaggtcggcggccgcctgcgcactgcgcgctgcgcgggtgatggcggcggcgtgctccgagcgcagccgcgccgccgcgctggggctcagcgtgctcgaggctgtcgcctgggcggagagggccgccagcttctcctggttggcagcattggcggcgctgagctccgccaggatgcggtcgcgctccgcaatctgctgagaggcctcgtgctcgatacgctgtgccgtgctctgtgacagggggggagcaggggcatggtgggcagaacaacatggaccaggcacaacatacctcttccctggcaagggataggacaccccccccagcaaccaccccgctcctctcacctccttctgagccagttgggcgcgnnnnnnnnnnagaccaggcacagcatacatctttcctggcaagggataggacacccttcccagcaaccaccccgctcttctcacctccttctgagccagttgggcgcggagggtcaccagctccaccttggcctcgtgattctcgatcctcagatcccgcacctgggaggaggaggacggcggagatttgagtactggaatgtgagcaggtgcctgccgatgctcactctccccacccaaccctcacccattgaagatgcacatccccccccgtgccacacctgctgccgcagctgctcggatgcatcaatgatgctggacagagacttcttcccggcggatctgatgccggtgtgggtggcagagccaaggcgcatcaactgctcggcctcctccagggcggcctcgatcgctcggccagatgcagtggggtccacaccccctcgctctggcgtgtgggcactcaaaattgagctgatgccactgaccgaagcagcgtcgtcgtcctccatgacgtcgaagtgatcctggatcgccatgaaaccccgacagcgaccggtatgtgtgggacgttacagggttgcacggcaccacgatgcccttcctcggtgtcaatagcaaatttaccgtattggatctgatatcggatgtttcaaccgacctgccccggcccctgtaacgatatttacccgccgaattacctgccgtctgccagttcgacatttcggatcggcgtgataaggaaagcgggaattcaaccaaccaccaccaacacccagcgccggtcagggttcgtaggtgagcatggagcgcagccagcgctccgcctcctgctgcggcatgcccttgcgcgtggcgtagtcggtgacctggtcggtggagatcttgcccaccgcaaagtactgagacgccgcgccggcaaagtacagccccgacaccgaggcggcgggggtcatggagaaggactcggtgagccccatccctatcctcgcctcgatgtccatcaggtcccacatggtctgcttctctgtgtggtcgggctgggaggggtagcccggcgccggtcggatcccctgtgtgtgggcggcggttgaggtgagcgggcagtagggggtccttcgcgatggcatggctgagttcagaggctcggccaaacagagacgctgtgatgataccctgacatgacgtagcacagaggcgagaaatcgcagagtccctcccatttgcataacgccacgagtcgagctgtgcagtgtgagcagcgtgccgtcccgtgcgccaactactccccgactgcgcagcctccttgtggtagccctgtctcacgtacctggtacttgaccttgagtaggtcgtccacattgaggtcctcgtccggggcgtagccccagagttcctgacgcacgatggcgtgcagtttctcggcaaacgcctcggccaggcggtcggccagggcctccatcatgatgtaggagtagtcgtcgccggcctccttgaacgcctcgatcagcggctccacgcccatggctgcggtggtgtgcggggacatggaatgctgtttcacaggtagaaaatgcagagcagggtgtttcgggcacagcaatcggtattcccgcccatgccccatctccccgaaggacgcgctgatctctgcacagatccccagacaggatggccgggccccagacctgagttggcaaacaggcccaggtagtcgttcaccccactgctcttgggcgcgatgaagtcggacaggcagtagtacgggtcggcattctccttctcggcctgcgggggtacagggaggcaaggaggaggccttgggttggccgaaccagcccagcactgcagtcagcgctctccagtcgcagatcannnnnnnnnntgggcgtacggggaggcaaggaggaggccttgggttggtcgaaccagcccagcgctgcagtcagcgctctccagtcgcagatcatcagtgaagagatgcccaacactgccccgccaagaccaaattttgcaacgcacacacatgcagggtagtgtgcaccgcgacgcccgtattcctgctctccctgcttcccctgcccctggtcgcacctgctggcgcagcccgtagaacgtggctagcctctccgcgcggtcggcgccggcatacacctcgatgtcatcgcccaccgagttggcgtggaagatgcccaccacgccaacgaggcgcagcttcttgttgtcgatgatgtcctgatgggcgtttggagggggccaggggtttgggtggtgtgcagagggtcattggcagacacccctgcgactcacgccagatggcagactggtcgacacccgcgcagagcaccagtcgccttccagccctgcaactcccaactctgccgggaaaaggcccatgcacggcgcacccctcaacccagccctcgggcaccttgnnnnnnnnnncactcctgccggggaaaggcccttgcacggcacacccctcaacccagccctcgggcaccttgagcatggcctgggcctcctcgaagagcttgcgtgcctcgggccccaccgcctcatccttgaaaatcttggggtagccgcggttggggtacctgccgcgcagctgccagacctggaagaaggggttccagtcgatgtagggcaccacctcctccagcgggaagtcctcgtaggccttgaccccggtgaaagagggcgtatgcggcgcgttctccgcggaggcccagtccaccttgggcgcggcggcgcgggcctctgccagggtcaagtaccgcctgtcctccagcccggcgtagaactcgtcgcgcagctccgcatattgctccctgagccgggatgacgccgagtagggtttggtttgtggtcggggtttggtttgcggtcgggttttggtttgtggtcggtgtcttcgtgtgtgaggtttgacgacgtgaggtgtacacaaggaggcacggnnnnnnnnnngtgtggtcggggtttggtttgtggtcgggttttggtttgtggtcggggtcttcgtgtgtgaggtttcacgacgtgaggtgtacacaaggaggcacggcattgcagaggccaaaagcacgagcacgtggtgcatcacccgcactctccccattcccccctcccccgccccatttcccctttctttcttccacctgacgtcgacggcaaactcggccttggcccgcacgtcaagcagcgactggaccacgggcacggagcgcgaggcgtctagcacgtagaccacggggcccgagtactggggctcgatcttcaccgccgtgtgcatcttggaggtggtggcgccgccgatgagcaggggcagcttcagcccgcgctcctccatgcgcttggccactgcgggggggggagtgatgaggcgtgtgttgagggagcgtacgatctgggggagtgattcnnnnnnnnnncgtcgagggcatccgtacacactccgtttttctcccaaaaccccttgatcccagtgccccagannnnnnnnnnaggattgatgaggcgtgtgtggagggagcgtacgatctgggggagtgattctggggtcccttgcatctggatgcgtgcggggaaacagtgctggagtagattcttggcttgaccaagccatcaggaggcgctgggcgacaggcagcccagcttcaccccagctgccaaggcgcagggtcccacacggtgagcctgtagcgtcctgcgcagttgagggcatccgtacacactccgttttaccccaaaaccccttgatcccagtgccccagaccgcacagcactccctgcaccaaccactcctacccacccgtgaccatctcgtccaatgagggtgtaatgaggcccgacaggccgatcacgtcggcgttgtgctccaccgcggcgtccaggatcttctcccaggccaccatgacccccaggtcgatgacctggcgggcggaggtgatggggttgtggggtgctgtgaggacatacggttgcgagttgcccaagccatgacaataccgtcagccttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacgtctcccagctggcgtcgagactctaccccccacccacccccccaaaaaagtagggggagaaaacctccaaccttgaagttgttgcagcccagannnnnnnnnnaacccccaggtcgatgacctggcaggcgggggtgatggagttgtggggtgctgtgaggacataaggttgcgagttgtccaagccatgacaataccgtcagccttgctgagagggcgccaggttaggcatgcgtgtccacggcggagcccctaacaaacggcctcaactctcaagcccaaagctgggcgcccagccctcgcctcaagcatcctttgctgcccccagtnnnnnnnnnnnnnnnnnnnnnnnnnnnaccacgccaacaatgttcttgccaatgtcatgcacgtcccccttcacggtggccatgatgacgacacccgcgttgtcgctgccggtcttcccgctccgcgccttctcctcctcgatgtaggggatgaggtgtgccaccgcgcgcttcatcacccgcgccgacttgatgacctggggcaggaacatcttgcccgcgccgaagaggtcgcccaccacgttcatgccgtccatcagcgggccctctatgacctggatggggtaggggtaggcgccgcaggtgcggcactcctccgtgtccgccaccacgtgggtgtcgatgcccttcaccagcgcgtgctcgatgcgcttggtcaccggcaggtcgcgccaggagtcctgcgcttgggaggggaggggggcaggtgcgggtgttctgtcagtttcatgtgtgtggcagggggaagacaggaaaaggaaggtagaaggaacttggcaannnnnnnnnngaggggggtaggtgcgggtgttctgtcagcttcatgtgtgttgcagagggaagataggaaaaggaaggtagaaggaacttggcaaggggagagagcagggaatctgagggtggaggcagatgacaggggtccacactgggcgaagaatgggcaactgggtgcatacgcaagcaggcagactccacgatgcagccacatcctgaggcctgtgtacagcgcagggcaagctccagatccccccgcgctaaccccttnnnnnnnnnnagggtccacactgggcgaagaaagggcaactgggtgcatgcgcaagcaggcagacaccacaatgcagccacaccctgaggcctctgtacagcgcaggggaagctccagatccccccgcgctaaccccttgctcattcttatataccacccagcccaccaattgcccccctccaccaccccagccccaactccccaccccaaaccaatccactcgccttcttctcggcagcggccgcgcccccaacctgacccttgcgcttgaccgcggtggggtggctcttggggtcaagcagcgccgcatagtccagcaggcgctcagtggcattctcgcagcggttcagcagcacgtcctccaccagctccagcagctccttgtccagcagctcatacttgtcggcaatcacctggcagcgtggatgtgagggttttgtgtgtgtacgtgagcggaaggagccgcatgaggtggagttgagcagggggcccgcagcctctgcagattccagcgcgagaagaagattgcttgggcccactgcacaccagaccctcccctgatcaggcgtccaaccttgccagcgagcacacatccaccccacctgggcggcattcacgatgcccatgtccatccccgccgcgcaggcgtggtgcaggaaggcggagtggaaggcgcggcgcacgggctcgttgccgcggaaggagaaggcgatgttggacacgccgccgctgaccttggcgccggggcacaggcgcttgatctcgcgcgtggcgcggatgaagtccacggcgtagttgttgtgctccgccatgcccgtccccacggtgaggatgttggggtcgaagacgatgtcctgcgggtcaaagcccacctcctccaccaggatcttgtaggcacgcatgcagatgcgaatctgtgcagggggaaggatttgagaaaggagggttgcatgcaggcagcgggtgtggtcttcagggttgagcagggatcctgtcgagcaagacatgatgcagcgctgcgtgctgctgagtagccggcagcgcctgacacaccccaaactcaagcaacccaccttgtcctggtagccagcggcctggccctcctcgtcaaaggccatgaccacgacggccgccccatggcgacgcacgagccgggcatgctcccggaacttggcctctccttctttcatcgaaatggagttcactatgaccttgccctacaaggtgaacgcatggttgtggagatnnnnnnnnnngacccgtgccaaccgtgaggatgttggggtcaaacaccacatcttggggatcaaagcccacctcattcaccaagatcctgtaggcacgcaggcagatgcggacctgcatggtgggatgcaagggggcaggtggaaagggaggtgctgggagggagccacagctgctgagctgtgcatgctccacgaggtgcacaccagaattgatcctccgcctgctccaaagcctccccaccttgtcctcaaaggtggcagcctggccctcctcatcaaaggccatgaccacgactgcagcaccatgtcgcttcacgatcgcggcatgctcccggaacttggcctccccctccttcatggaaatggagttgacgatgaccttgccctgcgagatgagcagatgatgggtggaggttggtaccgagggcaagggaccagcagggtgtttggcatgtggcaaaggtagcacccagtcgaatgctgattctcaataacaattgctccgcccacctggcagcacttgaggcccgcctccacgatgtggaacttggatgagtcgatcatgaagggcacgcggctgacttccgggtcagagaccaggaggttgacgaagcgggtcatggcacccacgccctcgatcaggccatcgtccatgttgatgtccagaatgtcagcgccttggttgacctgcagacatggtgatacatcagcatcgacttggttgagtagatgtgtatgcagtcgacctgacttgaactcaccaatccctgaagctagcgccggagatcagtaccatcaatccacaagagctcatacctgagacactgcgatggctgccgccttgtcgtagttcccatccacaatcgccttcttgtagatggacgacccagcaacattgcaccgctctccaatgttcaaaaaggtgctccgcatgttctccgggttggggcggtagttaaggggctccaggccacagagacgcatgacgggctcgatcccatgcctcttgcgcggctcnnnnnnnnnngcgcgaattctccacattggggcggtagttgaggggctccaggccgcagagacgcatgatgggctcgatcccatgcctcttgcgcggctcatagccagcagcaaggtcgtggatggccttgatgtgttccggcccagttccacagcacccgcccagcaggttgaccagcttctcctcgcctgcaagtttgaaacacatgatgctatgagagctcacaacaatggacacaggatgcctctgcaaacacgcaaaggccccacgtcaccctctcctactcacagaaaggcttgatnnnnnnnnnntcaatggacacaggatacctctgcaaacacgcaaaggccccgcgccaccctctcctactcacagaaaggcttgatctcctcggccatttcgtggcccttctgatcgtatccgcccatggcattgggcagcccggcattggggtagcacaggatgtagcagtctacacattctgccagattggcaatgtagggcttcatgtcggatgcccccagagcacagttgagtcccacagccattggcttggcatggcgaatgctgttccagaaggcctcgttggtctggccactcagcgtcctcccagacatgtccacgatggtgccggagatgaagaccgggatgcgtacattctgcacaggaaagtgagagtgaggggcgagtcccatactgttcgggtacttgcccaaatatagcgcgacctccttcacgccgagacaaactccaccagtaaccgcctcagcaacatctactcaccaggtcctcaaacaagcgctcgagagcaaacacagctgccttggcattcccggtatcgaagatggtctccacaaggaagaggtcgacgcctccctcgtacagagccttggcctgctggtagtaagccagctcaacctcgtcgtaggtgatcccacggaaggcagggttctccacactcggagagacgctcagtgtcctgttggtgggcccgatagcccccgccacaaacttgcgctggccagggtggtcggccatgtacttggcagtcacctccttggccagcttggcggcggtgacgttgatgaagtgcacctcctccacagtnnnnnnnnnnnnnnnnnnnnnnnnnnnnnnnnnnnnnnnnnnnnnnnnnnttgtcaagtccaatcgtccactcatcaccagaacctccccacctgagagatggtagtgccattgaaggtgtttgtctcgatgatgtcggcgccggcatccaggaaggcattgtgaattgctgcgatgacatcaggcctcgacacgaccaacaggtcattgtttcccttcagctccgctgtgtgagtctcgtacctgggatgggtgtggtgagcaaccgccttagggccaccgatcgccgcattctggcaaacacactctagagtgggtgttcctgtctccctaccaactatctactaccaggaatgcccctcacctgtcacccttgaagtcgtcctccgtcagcttccacttctggatctgggtgcccatggcgccatcgatgaagcagatgcgcgactccagcagctcctccagctgctcaaaggcctcagtcctcctcatcctgtccacgtagggcgtgtacttgggcacggggggcaggtcggcctcgggcgccagggtgtccacgcccggcgcgatggggttgaccctgggcggcaggcttgccagcgcgctctcctccttcagccgccgtacggcggtggggggggacttggggtccagcagcgcggcaaagtccagcaggcgctcggtggagtcctcgcgccggttgagcagcacgtcctccacgtagccgagcagctccttgtcgatcagctcgtacttgtcggcaatcaccttgagtgtggggggaaggggaggaaggtcatagcttgctgaggaaagggggcccagaaaacacatgcaaggcgtctgccctggacaggccgtgctcacactggctgcacagccatatccaccggccttcctccctcacaagccccaccccacctgggcggcgttcacgatgcccatgtccatccccgccgcacaggcgtggtgcaggaaggcggagtggaagnnnnnnnnnngggcatcagcatgagtagcatggccgttcgtggtacgcttgtgctctgcaggagtttgagtagacaacggcgttgcatggaagctagcgatcccagtctgacagatgcacacactgccacacacgttcagcgcccacctggaacgctctcttgctccgaatcgatctgagcagcaggtgcaatgaaatgcatagcctgcggaggggggtggtcatctctcagcaccatggatgatatgcggcgctagcggtggctgctgcacaaacctaccacgaggaagagcagcactgggacggacacgactgccgtcgatgagatcaggagccacatccatggaagcagtaggtatgcagccacagccgcaagggctacatggacggccctgctgccggccatctggaagaacgggatgtcttcacgacccatactgggtgctggttccctcgtctctcacagccgcctgannnnnnnnnntgcgacatggacggccctgctgccggccaactggaagaacgggctgtgttcacgacccatactgggtcctggttccctcgtctctcacagccgcctgatttctctgtacatagggcgcacacgacaacacatacagaagagggaggagccttcctgtctcgtgcagcttgtaacaccagagtttgtgattcagtatcgcgtggcgcccgggattctcctcggccccggatttggtttcttgaacgcagctcgctggacggccgaattgcccaacgatggcgatgcagcttacgactcaacctcgagtcgagacacaaagcatgcggtgagaacattgcagtggtccagcgatggcggagtcgtcgtcctgtgctgggcccgcagattgtgagtcgtcgagcctgtatgccgatctgttgctggccctggtgggccacgagggcgacatcttcgagcgggatcccaaacatggagtcacccgcatcagtggcacagtgcattgggtgcctgaatccgacaggtgtgtgcagggagggggaggggagtgcggcacccaccgaggcccaggcccaccctcccgatcaagcctcgagcgcgccccacagactacacctggagcgcctgtgtcggctaggggatgcctgttccgagctccagggcttcgtggactcctcctggcagcactccagcctctaccgcgccgccctggctcaaggaataagcggtgagagatattgtggagggagtttggcaggttttatggtgacacatcctgacctggcctttgcatggcgcaccaggacaggccttgagtttgtcgaccgcatcactttgccttcccctgctgctccttgcccccagagctgctggacgtgtatgagagcagcgtcctggagctggaggagcagctgagcaggcagcctggcaccccggtcctcgccctctgccaccgcctcgaagagtttcaggtgcagggtgtcagacggggggcctggggggtgggacgcctgagggcgcgggcgtctcatgtgacatgctcacaggagcccgcaccgcggagcgagtggcaccctttacacccactctcacccccaccaatgatccccctcacacaatttgtttgacaacgttacaccgccaggcgctgctcccggccgtggcccgcctggtgcgccacgtcagcnnnnnnnnnnagggacctgcggggcgcatccctgctgcacgccgtgcacgccgccacgcgctgcggcgaccccgaccnnnnnnnnnnggggacctgcggggcgcgcccctgctgcatgccgtgtacgccgccacgcgctgcggcgaccccgacctggagtcgtgcgcgctgcgcctgctgtggcactgccagggtgtcgtgctgcggcagctccacgcctggtgcgtgcacggccaggggccgggggagtcggacgagttctttgtgcggcgggtggaggaccccgtgaatggcggggaccagccctgtgcagcagactgggcggcgggatttgaggtgagaatttggggagggagagaggagtggtgggttctagagatgggttgcggcacgcacggaaaagaaagagctgcctggtagcgagggatggaggacagggggctgccaagggaccctctcgcttcctgcacctcatttggccaagcacaaggggcttgcaatcaaaccctcatcgtacaggaggcatgtaaacccatggttcccataccgtgtgtcgccctccaccccaccgcccnnnnnnnnnntgcacggaaaagaaagcgctgcctggtagtgagggatggaggacaaggggctgccaagggaccctctcgcttcctgcacctcctttggccaagcacaagggacttgcaatcaaaccctcatcgtacaataggcatgtaaacccatggttcccctaccgtgtgtcgccctccaccccaccgccccaggtacccagcgacgaggccgacctgccccccagcgtcagcaccctcgccgcctccagcgcactcttcatcggcagggccgtccgtgtgctggcggggggcggcgacagcgtggagacaggagcaggctccgcctcgcatccctcagcttccatgccgccctcagcccatgccctgcccgagctgcagccgctgtcccgcggcctgctgggcctctgcgccgcccccagcttccgcgctgcgcagctagaccgtctgctggaaagcgcgcgggccggcctggccacccgggtctggcacctgctgcgcagcgcggagctgggcgcccgcttcgcctccatgcgcgactacttcttgctggagcggggcgacttttaccagcagttcctggtcgaggcgagcaaggagcatgggaggaggatggtagggggttgtctgtggactggctgcatgatgtgactcactagcctggaaggaagcatggatgccggaggtggacgccttggcatggagcatgggcggggtctcatgctcccctgccatnnnnnnnnnnagatgccggacaccttggcatggaacatgggcggggtctcatgctcccctgccatggccccggcgcggattcacggcgcatcacacgctcacacgccctggcccgcatcaccctcggcttggcactgtctgagcggggcctcaaaccctcattgcgccgatcccctccccccctccaaacgaacaaacnnnnnnnnnncccccgggcgcggattcgcgatgcatcgcccgctcacacgtcctggcccgcatcaccctcggcctggcactgtctgagcggggcctcgaaccctcattgcgctgatcccctccccccctccaaacgaacaaaccacaacatcgtgcaggccgcccccctgctggcgctgccgccccggccggccacggcctcagccgacgtgggcctcctcttccagcaggccgccgtgcacagcagcgcggatggggaccccgccttcggcgccttcacgctgagctggcacccgcccggcggcgggtgcccgcgcacaacgcccagcctgcacgtccctgcgcagggcccctgggacggactggccctgtccgcgtcgctggactggccgctgcagctgctcttccccgccgacaccctggcggggtacggcgcgctgtggcagctggccttccgcctgcgccgcgccgacgccgacctgggcgccgcctgggcggcgctgcagcgcatggggcgcggcgcgcggcgctccggcaatcgccgcgccgccgcactgggcgcgctgggcgccgcgcgctccgcc

SEQ ID NO: 39354 - DNA, 61 bp, Chlorella protothecoides
cttttagcacccatcctgaccggaatcagcacccgccgtgccctccgtggcaagtgtggct

SEQ ID NO: 39355 - DNA, 119 bp, Chlorella protothecoides
gggggggggcccatggagtagacctggggcgagggtcaatgggtcatgcctgggccgacgcaaggctggtcagggcgtcctgagggactgtgcatgccagtcaggcaggaatgagaccc

SEQ ID NO: 39356 - DNA, 137 bp, Chlorella protothecoides
ctcatgccggcagcaggtgggtggccgaggtggtggaccggatcggggccatggagcgtgtgcatcgggtccacccgagagccttgcgtgctggagctggagaggaattgggtgccgcaggggtccacattcctcgc

SEQ ID NO: 39357 - DNA, 65 bp, Chlorella protothecoides
ccagcttgaggcgcacaggcgggcgcaggaggcaggctcaagcggtgatttgccggtgttcaagg

SEQ ID NO: 39358 - DNA, 78 bp, Chlorella protothecoides
gctgcagtgtgctggtggcgtccaaatcctccaacatgcccggacgacccctggcccctccccctggttgcagccgag

SEQ ID NO: 39359 - DNA, 61 bp, Chlorella protothecoides
cccctttctgcgccgtgtggggaatgcagtgggatggtgtgccctgggaatgccagggaag

SEQ ID NO: 39360 - DNA, 9790 bp, Chlorella protothecoides
  modified_base (2634)..(2643): a, c, t, g, unknown or other
  modified_base (3555)..(3564): a, c, t, g, unknown or other
  modified_base (3622)..(3733): a, c, t, g, unknown or other
  modified_base (4162)..(4171): a, c, t, g, unknown or other
  modified_base (4769)..(4778): a, c, t, g, unknown or other
  modified_base (4898)..(4907): a, c, t, g, unknown or other
  modified_base (5316)..(5325): a, c, t, g, unknown or other
ccgcgcccgcacagcgccagcagctcctccagacaggcctctacagcgcgcggctccacgggcggcgcgcccgccgagccggcggggccggcgcggtgcgaggccacctggcccgccagccgcgccagacggcggtggtccgcgtagcgctgtaggatgcggctgccgtgcagatccacctcgccgtgcagcgtcagcaccgccgtcgtggccaggtctaaaggaaaggagacggggatttaaagggggggaggtggggggatctgtgcggagtgtgatagaagggcaccctgccggcctggaagtgccttcctctgaaccaaaggcccagcaacctgctgccaagataacatcatgctggcgctcaccgggacctgcacctccccccctcccacccacccgagctcaccaaggccgaagctgttgatgaagaggtccaggtgctcatcgacggccgacgccacgtccttgaacaggttggtcagcgcgcctacgtagtcgggctgggtgccctccaccgcgcccaccagcgcgtcgtggtcggcggcggcgcgggaggatatcatgcccgccaggtggcgcagcagcgcgtccaggccacgctgcgcctggcgcagcggcgggtgcagcgcggcgaagcgcagcacggcggcgtggtcgccggctgccacggccgccgtcaggcacgccgacactgcctcctccacgctgcgccgatgctgcgcaaaggcagccgcctgctcggcagagacgccggcgaggcaggccacgctgttgacgccatgctcggccggaggcgccacccccgccccgccggcctttgagccggcgacggccgtcggcgacgccccactaccccccagcgcggccagggtctgttcctccagggtcaagtactcgtccacgcagtgcactgcggcctcgtaatcctcgcgggccaaagcccgcgcgacgccctccaccgccgccgcccggcccagaaggccggcgatgtgggagagcgcgccctggacccgggtctgggtggcgtccagggcccgcacctgagagctgacgcgctgggccaggtttgcggagccggcggtgctttcttccagggcctcggcctccacggccagcatctgcagcgcctgcgagaaatggagagggaaagggcagacgatggggagtgtgaggctccaggatggactgtaaaaaggtacctcgcattccctggcttcctgcatggctgcaaaagtctccagcgcccgtgatgtgctgcactccattggtcccatccaaacccccaaccggcactatgccgcgcctcacccccttcctctcaacacctctgcctgccacaaatgttcacctcgctggtggaggcagtcatctccagcatctcggcctggatggcctcacgccttcccagcatcccctccagttcggtatcaatggcacgctcccgaactagagcggcactgagcaggcgggggatgtctgccggattggtgagctgccgcagagctgctacatccagaaccgcgctcccgacgtccatggtagctcccctgtcctaagacatgcgatcagggggagggaggagtgtcgcctaggccgcagctggcaatgatctgcacacaggttgtctactcgaagctcagtccggagatcccttttgcaatattttcatgatgaaatttgttcgatgagatattcggtgtgctttgcgcagttcctgcgatgtcacaaacatcccaagaagacgaggggaatcagagggattccggcttgagacctggcgccccagcacaggacctcaccaggagtggaagcaatagtgaggcccaaagcgcgccgagtcaaccacgcggttactactgggaacgggtgctaaatcttcaaatcgcatcctctgggccagcttggaagcttcgcgtttgggtcgagaagcctgctccagcgatccccctagcccttcccagacagagcgaggaggctctcttccgagcatgggcgcggtcgacgtgctggcctcggagcttggctccaaggtgcagctcgatgccatcacccgcgactacgtctgcgagccccgcctgggtaagggaggcaccaggtcttgggggtgccgcactcacccttgtcccgcaggagcaccctctgaccatcgctcgtcccacctcttgccccactatgcagagtaccgcaccgtcggtggcgtggctggacctctggtggtcgtcaacctggtcaaggtgcagcggcggggccgggtttggcgagctgagggtttcaccacctgcggagtatgggtcgcacgggtgggacatgctggcacctcaacctcacgagcctccgtctgtttcctctcgaccccaaacagaagccgatgtatgccgagatcgtgaacatccggctgggtgatgggtccgctcggcgtgggcaggtgctggaggtcgacggcaacagagccgtggttcaggtgttcgagggcaccaccggcatcgacaaccagaggacgaccctggagttcactggagatgtacgtgcaagacgagggtgtttgggtgttgggaggatggtgcagctggccgcaccaagtggatgcaggttgtttgataatcctgtgtgagaccgtcgtacccactgtcnnnnnnnnnnagtgtttgggtgttgggaggatggtgcatctggccgcaccaagtggatacaggttgtgtgaagatcctgtgtgagaccgtcgtacccactgtcccaccttcccatcctgtgcctccaatcacccgcaggtcctgaagaccccagtctctcgcgatatgctgggccgcgtgtttgacggctctggcaagcccattgacggagggtgaggtgctgggctgttgcatgccccggggtgtcctagtgtatgtgatactggagagtctgtgcaggcctgagcccgttcaggaatccctgccctggtttccactgctcctcccaccaacgcccgactccctcatctctgcccagcccgccggtgctggcggagcacttcctggacatcaacggcgcgtccatcaaccccgcggagcgcacctaccccgaggagatgatccagaccggcatctccaccatcgacgtgatgaacagcatcgcgcgcgggcagaagatccccctcttttccgccgcgggcctgccccacaacgacattgccgcccagatctgccgccaggcgggcttggtctcgcatggcgagggggaggattctgcgcgcgagccctttgccatcgtctttgcggccatgggcgtgaacatggagaccgcgcacttcttcaagcaggactttgaggagaatgggtccatggaccgcaccgtgctcttcctcaacctggcaaacgaccccaccatcgagcgcatcatcaccccccgcatcgccctcaccaccggtggggggagttgtggaggaagagaggcggggggggggagggggggttgattatgtttgtgaacgaagtgtgagcgcagccgggaacgcaagggagagcgtggcttggcccgctggcttgtttggtggatgagatgacatctcagggnnnnnnnnnnatggggggttgataatgtttgtgaacaaagtgtgagcgcagccgggaacgcaagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagccgagtacctggcttacgatgtgggcatgcacgtgctggtcatcctcactgacatggcctcctatgcggacgctctgcgcgaggtcagcgctgcccgcgaggaggtgcccggccgccgcggctacccaggtgtgtgtgtgtttggggagggggtgcatctggttgctcatgcttggtgggttggcaactccgcgggctagggatgtgggttcctctgagagcatggccgagcttgggagggtgccgatctggctgcacaaaggagtcggccctctcatcctcgaagctccagagcctgtctgacggcatgtgtctccctgctcgcctgatccacaccgacgctttcaggaacgcacacacaaacacatgtcaatagcatccccccttgccctcgcctccccaccctcaaccaaatcaaaggctannnnnnnnnncaagctccagcgcctgtttgacggcatgtgtctcccctgctcgcctggtccacactgacgctttcaggatcgcactcacaattacatgtcaatagcatcccccctttccctctcctccccaccctcaaccaaatcaaaggctacatgtacacggacctggcgaccatctacgagcgcgcggggcggatcgaagggcggcgcgggtccatcacccagctgcccatcctgtccatgcccaacgacgacattacacaccccatccccgacctgacgggctacatcacggagggccaggtgtacgtggaccgccagctgcacaaccgccaggtctacccgcccatcaacgtgctgcccagcctgagtcggctgatgaagagcgcgatcggggagggcatgacccgtgccgaccactcggaggtcagcaaccagctgtacgccaactacgccatcggcaaggacgtgcagggcatgaaggcggtggtgggggaggaggcgctgtcctccgaggacctcctctacctccagttcctggacaagttcgaagccaagtttgtcaaccaggcacggagacggggggggggggggggggggggggggnnnnnnnnnnctcatgaggagaggcaccatcttccgagtccctggtgtcgagtcagaaggacgagcatgctccctcaatgcctcaacaactcctcctccacaaaacgccatcaaacacaggggctgtacnnnnnnnnnnttcatgaggagaggcaccattttccgagtccctggtgatgagtcagaaggtcgaggatgctccctcaatgcctcaacaactcctcccctacaaaacgccatcaaacacaggggctgtacgagaatcgcagcatccacgaatccctggacctggcctggacgctgctgcgtctgttcccacgggagctgcttcgccgcgtcaccgccaagaccctggacatctactacgacagggagaagccggcgggcagcagtagcgcctagggctgtggcagagcctgggcatgggtgtgtccatgcgcaccgaccctctctccctttgctgtgtcacgagtggacgactccattgtaatcggcgtgtactggtgtgtgtccttggctcagtgtggagcgaattgcccgctggcagnnnnnnnnnntgtgtactggtgcgtgcccttgactcagtgtggagcgaattgcccgctggcagagcaggaaagaaggggctcggcagtcgacattccagacgccagattcaggcagcaagcacatcgatcacggcaagtccgtgaatcggtaaacgacagggggggacgaaatgtcagaagtgaatgaattggggggcaaaggggaacatgctgcaggatgcaggctcactgctgcacaagatgggcgtcccatgtcctctccaagaagacctggtgccctgttggcgcctacttgggaatgttattctgcaggtactggatccagtcgtagaagccggtggtccacctgccgtaggcggcctccaccagaccgtccatgtgggcggcggcctccttctcccccaggtccagccggaagcggtgccgcagctcgacggccgtcttggggcccctgaagcagggaaggtgcgaggaagccatcattgccacagtggccacgatgctttctgccgagctgcgagcctgcatggggaatgtggttggagactcgtttcagcacatggaacaaaggaacgtttgaacaaaggagggccgggctgagtgactgtccttcagcatgggcaacgaccctcacactcaccgtgaggaagcccttgatgcagagctccttgaagtggagatagctgggagaggtcttgctgcgcgccgggtcgatgatctcggtcatctcgtaactcagcttgaaggcagcattctcaaagccaaggttgccacctggtgcgcagtgcagagtggcatttgagagaattccgtggtcctcctacacactgtaggaggatacccgagggtgcagtctggatgcccctcagcccatctcacaacatgcgctccgccacccacctggggaaatgccaaggatgaagccaaagtcaatgtgcagcaggtgcccattgccatccaacatgatgttcccattgtggcggtccttgctctgaagcaggtagctggcgacagcatacctggagggttgagcacattgagggaaggggggggggggatggcaagggcatgtaggcaaatgattgtgagaagcttgcagtactcgcacaagtcattaagctctcatcctatcaagcccctcgaagcccaaggcacatactcccaccaccgcacccggcacaggagcgaatgaagttcttccgagcagcttcatgccgctctgtcccgggagggccatgctcacgggcaaatacctcagccagtccaccgtcggtgagctcgccctggcaaacagaggtggcatacggctcaggacagctctggggccgaggtcaaggtgccaaggcctgccagatgcatccaatccccaactcctcagcaccatgagtctcaccagctgggcacgggacttggagttcgggatgacctcaatgataccacactcatagcctgtggcgatgaccccatacggcaacaggtacaggtccagacccgccgtcaggaaggcttttttgagtaggccaatcacctttatgtggatgatggagggaagcaggattgataatcgcagtcgatgaaggatgctgcacaggtaggtgctgcatcaaccctcccatgccaaacaacccaattcctaaatcaatctcgatgtatccagcaggtctccatgcattgtgccagcattgactccccccttccctggcgttcacctgcagtgccaggatgtcttgcctgcagtcgtccccgactttgaagatgcaggcgcgggtctctggctcctcatcctccttgcccgacccctggctgcccgcctcctcgacctcgccgtctgcaaacccggggtggacgtcctggcgcacatgtaccttgaaggccaccaggatggggcacttggcggcagactgcaaagagagcaaggggggaaggagtttgaagtggaccacccgtggcaactcacacacagcatgcagacaaagcacatgttctggaaaaaagcaagggtcagcccaggcgtctggcatcctgcacaatcccctcagacctgcatgggagcggcggactctgggatgtgcgccagcacggtgcagtcggggttggttggcaggaagaggtcgcccctggggagctccacagcttttaggaactcgactgcagccgactttcgcttgtcctgcatgattaggcagggtaccatgtatgggtaagtcaggccatgcctctgtgcacctggcggaggaggtatgatttcctccaatctccttcttgcagagggtcaaaccccaatagcttcttgctgcactcctcctcctcacagaccactgtcgcccggacatgaattcgcccctcccatcctccttttacccaactccacacaccacaatcctcaccttgagaaccgggtacagcttccctgacacctcagtgatgtcatcaaagtatgccagctcgtccttcagcagatttgccacgtcctccgggagtcctgacattagcctggtccgcagcttgtcggcaacctgccacagtcctgaatccttgggggcagaccacccagaccgcctcacctggagggcatgggagcaggtggttgggatgtcgatcttcagtttgtggtcggagttgctgttcattgccaagcttgcaaagtcccggaggaacaacgtggtccacccggttgagacccaaggaaccatgccacaatcctctcgacttgctattaggggtttggcccaaccatccaaaaacacaatctcgttcaggtgctcacctgtgggtcaaaggcctcgtcggggggcgtgccttcggagcgcagctggcaggccaggaccacggcaaagtgcacagagacggccgcggcatcgaggaggaagcgggccaccacgccgtcgtggtcggtgcgcagcatctgcaccagctggggcaagaaaaaggccacctcctcggggttgcactcgtgcagggagcgcgagaggtactccagcacctcgggcttcctgcgggatgtggaggggtcagggattgtgtcgaaggtcctagtggattctgatgcaagaaactgccaaccagcccgccgtgacaccacatccaacttcacaccctgcccaggagtcagccagtgcttgcaacgcagtgaccaggtataattcactagcccctggtcagacacaccaacagcataacagagtacccaggccagcatgcatggattgcagcctcccattcgaaagtgggtccctgcaacatgtgtcacaccaagggctgtcccacaccgtcgactcactttccacccgcggaattgacgacagccagtgcttgcaacaggggcagcggcgcccagctctgcaggtgcaccagcttgtctgcggccgcgggctccccagccatctccgcgagcagcgcgccggcttgaggcaggagctgcagcgactttgcagcggcgttcaccagcacaaagcgctcgagttccaggcgcagggcgggaaatccagggaagcgatcctgcgatgggtggggggacacgacagcaatgatttggctgtgagtgcaggcagctggtcagactgcactgttccggacctttgcagagacaaactgcatgcagcgtgcagcacaccccgtgccctgccctgcacaccgacctccgtcgcacggctccgaccacaccttgagcgccagcgccaggcgaggcgaggcgatccaggccgccgcggccagcgtctcccactgcgccacggtgggccagtcgcacgcgactgctgcatgagccttggtgtccaggggcgactcccacaccgccagcctctccagctctgcggtttgggagggtgggtcagggaaaggaggtggggcgcggtgggcggcgcggagcctggcaatgcacatgaccgtggtgcatgcccacatccccagggtcacccaggcgatcctgaacatggccccagcacagcatccgacgcagcacctgaggacaggaggaagcgcagcagggccagtcgctgcttggcatcgtccaccgacagcctgtcgctggcaggccagatgggcaggcgggccacggcttcctggacggccgacaccgcccgcgtcgcctccctgagggttgatcggtgggttgatgcagagaggctgtcgaggggacaccacctgcggttgccccaatttcttaatcatggcaaggcaagggggagcacagagcaggttatcaagacgcccgtcggttttgcagcccacgttcccgatctcatggacctccccacccccccaaaacaattcctactgctcgcctcagtgccgcgccgtcggcctggtgccacgccaccggcgcgtcaaaccactccagcgccgagtccagggcgagcgagacccgggcacggtgcgcgcgctgcgcggccggcgcgcccggctcggcgtcggcgcagcgcagcgccagctgcgccaggcggaagcgcgtggcgcaggccgcggcggcgcggcc

SEQ ID NO: 39361 - DNA, 61 bp, Chlorella protothecoides
ctgcatcccggtgctggagcggatcgacacatcgcgcaacgagatccaggccctgctgctg

SEQ ID NO: 39362 - DNA, 61 bp, Chlorella protothecoides
gcggtggtcgacctcgccgcaaggaggggggtaacagcccgggttaggctggcgatactgt

SEQ ID NO: 39363 - DNA, 75 bp, Chlorella protothecoides
ggagcgatctgatcagagcacgacccatcccacgtaccctcaaaactcctcaaaccccccccccccccccccccc

SEQ ID NO: 39364 - DNA, 71 bp, Chlorella protothecoides
aaagcttcgctcgccgaggtcccggcattttcacggctctgcagtggtgaaacgatgagaagccgagttgg

SEQ ID NO: 39365 - DNA, 61 bp, Chlorella protothecoides
gaccgggttgaagttcagaggcagggagaggatctcatgcaagtgccatctgcaagattca

SEQ ID NO: 39366 - DNA, 77 bp, Chlorella protothecoides
acccggtcggggcctcagaaggccaagagcagtgcgtggggggatttcccacccccatcgcccgtccgagggtaatg

SEQ ID NO: 39367 - DNA, 76 bp, Chlorella protothecoides
atgtctggcaggcagcgcccctggtcgtgggcccccccccccccctcgcacgcctgcgcacttgaacaagcgcgac

SEQ ID NO: 39368 - DNA, 11098 bp, Chlorella protothecoides
  modified_base (134)..(143): a, c, t, g, unknown or other
  modified_base (1054)..(1063): a, c, t, g, unknown or other
  modified_base (1760)..(1769): a, c, t, g, unknown or other
  modified_base (2179)..(2188): a, c, t, g, unknown or other
  modified_base (2762)..(2771): a, c, t, g, unknown or other
  modified_base (4330)..(4339): a, c, t, g, unknown or other
  modified_base (4892)..(4901): a, c, t, g, unknown or other
  modified_base (5250)..(5259): a, c, t, g, unknown or other
  modified_base (5539)..(5548): a, c, t, g, unknown or other
  modified_base (5628)..(5637): a, c, t, g, unknown or other
  modified_base (6449)..(6458): a, c, t, g, unknown or other
  modified_base (8111)..(8120): a, c, t, g, unknown or other
  modified_base (8414)..(8423): a, c, t, g, unknown or other
  modified_base (8752)..(8761): a, c, t, g, unknown or other
  modified_base (9258)..(9267): a, c, t, g, unknown or other
  modified_base (10383)..(10392): a, c, t, g, unknown or other
gggggggcaggggggggccaatgattctatagcgtgaaagaagatgagcattgatcccctggcccctgtacctccatgtcagcctcgccacccgatgctcttcccaccactgcacccgctgtaccctcccaacnnnnnnnnnnccattgattctatagcgtgaaaggagatgagcgttgatcccccggcccctgtacctccatgtcagcctcgcaccccgatgctctttccaccactgcacccgctgtaccctcccaacccaggtcatccccccaacccccaaccccgcagatcatgaacccgcgtgtgatcaacccgctgagcggcaagccggtgagctggaagctgatgcccaccaccgcctccccgcccatgctggccggcgtcggctccgaccactacgagcgcggcttcttcgccaccaagcacctgtgggtcacgccctacgccgaggacgagatgaacccggcgggggaatacccgcacgacccccgcccgcaggccaacggcggcatccgcgcctggaccaaggcagaccgccccgtggccgacgccgacgtggtggtctggttcaacgtgggcctgacccactttgtgcgcaccgaggacttccccgtcatgcccgtggagcagatcgggttccacctcaagccctaccacttcttcgatgtcaaccccgccatcgacatcccccccgagcgcgacccgcgctccgtccaggccaagccctgctgcgacgagacccccctgccctcccgcgcggggcccgccctgccccgcatgtgagcccggcggggccgggcaagcgcgggactggtgtgcgggcgagccggggatcagtgtgcgagaccttccccacgcccccctgcctgcgaccaaatgcacccccccgccacacggttgacgaccgccgtgtgtgccccgctgaatcgctgcctgcactgatgcctgtcacaagagactgttcatggtgtcggggtggcgaggccgcagcagcagccgccgcgatccacccttcaagcgtgtggtcgtgcctggtggtccacggcatagnnnnnnnnnnagggtggcgagaccgcagcagcagccgccgcgattcacccttcaagcctgtggtcgtgcctggtggtccacggcatagcgtgcaaagcgctgcatgtcagtgcgcaagatgccctccacggtgggggtcagcacgctggcaaagggctgcaacaggccggggacctcgtaaccgatggtcagctccacgatgcatgactcggggccaaagcgccggaacagcagctggcccctggtgagtggttgcaaggaaaggagggatcagttggcagtggtgagggaccttggacccctcatgacaccctttgaagggcacgtctccagcagcacaagacaaaacatgactcccacacctgtttggcacctccagggacccccctggacccttgtagcccgggacggagcgccactgcatctgggtgtggggcttgttcggcagcgactccgacagccagctcaggctccactcctgcccaaacatgctggtggacagccgccactgcgagagcgccgggttctgtgcgtcagtctgtgggggatgcagggagggagggagcatgggtgaggtggtgagctgtggttgctggtttcaataatactaggaggtccacacttcatgctcccatcaccggcttcacatggcctggaatgcacttggtaaggcacagacatgccaggtgctcgtgtcaaatacagtnnnnnnnnnnagggatgcagggagggagtgagcatgggtgcggcggtgagctgtgattgctggtttcaatcataccaggaggtccacacttcgtgctcccatcaccggcttcacgtggcctggaatgtactcggtgaggcaacgacatgccaggtgctcgtgtcaaatacagtcgtatcacacgctcacacccaacgcccccattacctggacactgctgatccatggcatccagtcagggatgcgctccttgtcgtcccacagatcccaggccgtttccactgggacctggaccgacacctccgccctgcggcgccgcaagcgggtttgatggggcctgatgcgatagtctgcgagtttttggctagaccaggccctttcctcttgcaattcgcgctgggcatggctccatgcgggctnnnnnnnnnnggggcctgatgcgatagattgcgagtttttggctaggccaggccctttcctcttgcgattcgcgctgggcatggctccatgcgggctatgagcaagccatgcaccccacacctgttctccagccagacgctgcagatctgggactgcctcccccttgcgctatgcagtgatgtgggtaatgctggtttcacgcgagtttgtaggctccttgcggccgagggtgtggaggaaggcgcacccacgcatggccgggatccagcgagcttcatcgtcggtgcgctgggccaattgacaggggtctagcacaccatgcggccgcaaccgcgcgtcgggatggtcgagagacaaatggacgatggtctgggaacttgtcgcctgtgtgcgtacatatgcgcactccttgtcgtctgccctgtgcgcaccctgcccccccagatcgcgagggatcgcgatccggccctgtggtgctgcggacctctgaacagggggcaagacgcctgacgctcaccttactttgacattgcaatgcctacttcccaagacttcactcgagcctttgctgctgtcaggtcannnnnnnnnngacagggggcaagacgcctgtcgctgacctcactctgacattgcaaagcctacttcccaagaattcactcgagcctttgctgctgtcaggtcaatacacaccaaccgcacgcacactcaaggggaaaaaatagcgatgggaggagctgcaggcataccaggggtggcagcccgggctggcccgccaatagcatgtgcgagctcaaggatcaggagggacaggaggagcatgggggtgcatgcacaaagaggaacagtaaaccaccagcaggcgtcccgagcgagtgccgcggccggcgccgatccgcgcaaggtggcagcggaggagcggagcgggtgtgccagacccgggacgcccggcgcgtgcagggggggccaggttcccgggcctactgcgtggggatgggcgcgtagcccgcgggcgccttcttgggcgggagtttgcggaggatgaacaggacgagggcagaggggatgacctcggcgccgccgtagtagatgaggttgagcagcgggtgcttgagcacatccaggtcggcgtcctcctggtcgaaggccgaccaggccgtgatggcggagcggaagaggaagcaggtggcgcagatgctggtcacggcccccacctcgcgcagcttcttgttccggccccgcgactcgatggggaagtggcgcagcatgaagaagagccggccgccgaagaggaggaaggcgaaggccgcggcagcggagacgcaggccaggaagcagccagacagctccttgcccagctgcgcctgggagtccctggccagggagatgaacacccagatgccagactgtggtgagagagttttggggggtggaggagggtgaagcacaggccgagaggactggcatcctctcacaggtgggaagggggggatggccatacggaggggcggcactgcagcacgggccatcgccaaggggaggtcaccgtcacgagcagagcactcagaaaaccctgacccagcctttcatgcgtggcgcagcggtgagcaaaacagggagatgcggcagcgaaacctggggggttttgcagagcatgcagtgtgcaagacccactcccacttcctcctaccacgacagccaggcacattcacagtaacacacatgcaagcctcacctggatgccatagacgatgaggttgatgatgacaaaggtgggccgcagggcggtggtgggcagggaccgcgcctggtagtaaatctcggcccagaagaggaccagcagggtgtaggtggagaagaagagcaggccagggaggtccagcaggcccgcctgcaccaccaccaggggcaggcgctggacctggccacggaagaagaacaccgccgagcgcaggccgcagaccaggaagttgaggaggtggaacaccttctgcgtggtccagccgtactcgggcacccgcagctgaatgcgcacgatttggaccttggagggggtaaggggggggaggtgcacggtgaaggctggcatatgcatcgagtgaggagtgggggggccctgacccatcctggtgccctgaaagtgcaccccannnnnnnnnngtgcattgggtgaggagtggggggcccctgccccatcctggtgccctgaaagtgcaccccattgatgctcaccagcgcgaccagggctatgacaaggtaggagacggccagggtgtcgtaggcccccgtctgccaggactcatttctgtcaatctgtttccacctgtgctcgtggaagaaaggtggtgtcgaggcgccgcagggtgagacgccaggcccaccttcaaggcagtgccaccgccctgcaaccactcaccagtccgggagcaggtagtccagctcctccaggggacgcatggcgacttcaccccgctctcaatacggtaatattgcccttaaggcggcccgacctgccacggagcaaccccggtcactccgaagcgctccacaaaccgcggggttgagcgagtaacaactcgtgggggggagcgccaaggtttactggtctcacgatcgcgtctctccactaggagaatatctacaaggtagcacttctgtactccaagtattggacgtggcagagagcgggcctccgtatggattgttccggcannnnnnnnnnaaggagaatatcccacaaggtagcacttctgtactcctagtattggacgtggcagggagcgggcctccgtatggattgttccggcaggcaagcgcaaatgggtcaaggaaagggcgaattccacaagctggagccagtgcagaaacgcacccaaaatgccgtgttcacaactgaagggctccaaccagctacagatgaaacacagcctccagtacatcagaattgcacagaaggccactctcctcaaggaagaaaccgaagcctgcaattgcaagggcacaatcatgggaaaggcaggactgaaggccgagtactgaacttgggccagagtcacatcccagcgccatgnnnnnnnnnntaaggaagacaccgaagcctgcaattgcaggggcacaatcaagggaactgcaggactgaaggccgagtactgagcttgggccagagtcacatcccagcgccatgtctgtcagtcttcctcgaccaagctgatcatgtgcccatctggtcctcggatggaggcaacctgagacaggaagatcgagtgtcgcgagcagaaactgaattcatgcaagtatcgcgtcaatgtttatacacaagcccgcaacacaaaggcgtgcattaccttgccatacacagannnnnnnnnnagcagtgacagcatagatggtctggagaatggtacgtgcacgcaggtttacaaaaaccaaattgctgcatgcattgtcannnnnnnnnnaaagaacgagtgtcgctagcagaaactggattcatgcaagtatcgcgtcaatgttcatacacaaggcggcaacacaaaaggcgtgcattaccttgccatacacagagtggtggatcttgccgtccatgcgtcctcccatcgtcaagaggcgggtcagtgtatcctggatactctcaacattgaagctcaacactggactgaacccagttgtacagtaggcctctctgcaaatgcagtgacagcatggatggtatggagaatggtgcgtgcacgcaggttcacaaaaaccaaattgctgcatgcattgtcattacagcaagcgttcagccatccgcccccatcgtgcctaccccggcgccgtctgcaacgcgatggtcgtctccccgctctggagctccgcccatcgctccgtcaacacttttagggggagccccagcccttcattgtagtatcgtgcggctgctgccacatcccgttgcatgagcaggatgtagcgaagagacatcgcttacccgttcattcttcagtgtcgaacagggcctgcttgagcttcctttgctttgaggcggactgctggagcagcaaatgtgcacacgatgcagtttataaaggtacaaacggcgtttctagcattataccttgtatttcaagggcacttttgaagggctccaccaccttcaaaggacaaatctcctacttgctcctggcgtgagtttcgaatctattctgccaagctggatgatcaaggtgtatctgcttgcaaccggcaccgtactacatgaaatcgcgtcagacaggagcctcaggacgtnnnnnnnnnntcttgctcctggcgtgagtttcgaatctgttctgccaagctggatgatcaaggtgtatttgcttgcaaccggcaccgtactacataaaatcgcgtcagacaggagcctcaggacgtcttggcagcattgtaggtcttcatcaccatctgcacaaagaaagggtagctccgtttgtcaggaagaaccggtccgaagcatcctctctgctttgcatacccaagcctccaccactctcgtcacctggcgatacacggcttggtcctggtcccacaacttggctgcctggacatttagtggcgaatcgttgtttgggtccgccagcagcgactggatcgactgcagcacagtccggacgctgtatgcggctacagtgtggagtggtagtcagtggtgagcttccagtggctacagcatatggactggcaatgtgttgtccagcaaacaggtagtagacacccagtgtgccggcaccgacacacagcacaggtgttactgcagcaagaccccgtcacgcagttcctcccctggtacctgaccatttctccttcaggatgtccaggcagatgttgccctgaaggtcgacattggggtggaagcagggggtctcaaattttactgtcggcggcttgaaggggtagtctgccccaaagttcagggacaagcggaatgtaagctcctcaaaaacagtcccagatgctccctgcggtacggcaggggtgaattgtgtcagcgcatgatccatgctctacacaaggagactcgaccttcctgagaggtattgaaggtgcctcgctccgacatgtgcgatgcacgagcagcattggcactcaggcagggctcctgcgcctggaccagtagaatcctctagaataagactgctcctagcaagatgtgcaggacgcacctcaattgtgccaacccatgtgaagagggagtcgccctgtggaaatgcagagatgcccttctcgccactgctcatgaggctcataagctcctgctgtagcctcttggccacggcagcagtgtcgagccgctgaagaggctccgttgaacctgttttgatcggactcggctggcccccgatggagcccgaggtcgctgtggtgctcatggtctctggaacctaatcgcccctgctacgtaaacgcgttgtggggcccataaaaaggcaaagtatgtagcagatggatcgttttacttattaaagtgcgagtgctgaacctcatacctcgccacggtggtggcattgtgagacctcaccttctgctgcggcctggaagggtccggtggtgcaggaatcgagcagcaatccggagcttcagtacgcctacgaagaccgcacctgccaactgtagttgttatgttccgcaagacgtctctatggtcgtgtcgtgtacatgaaaccgtctccgcttacgtcacctgtctcgagctcgcagccgagtttgaacaggtcggtcctgctctccatgcggtgtacatgtggccgtggaccagccctgtacacaaatcatggtcagtgctgcttaagcaggcccaaacatgtttgacatcaacaatcttatcaaattgaggtagtaatgaacatctcactgcaagtgggacatgcctagggtctctctccccgtcactagtaaagggaactctcacccnnnnnnnnnnaccgtggaccagccctgtacacaagtcatggtcagtgctgtttaagcaggcccaaacatgttagacatcaacaatcttatcaaattgaggcagttataaatatctcactgcaagtgggacatgcccagggtctctccccccgtcactagtaaagggaactctcacccgttgatgttggcgacaggttagagttcttccatgacccccagcttgatacaggacaggttatggtcacatacccgagtacctactaggtctgatcactcatgtcttgagcagatgttagacactcgnnnnnnnnnncttagccagagcattcttccatgacccccagcttgcgacaggacaggttatggtcacatgccccaatacctactaggtctgatcgctcatgtcttgagcagatgttagacactcgcccttccctgcaagcagccactgttcgcgcgcgattttgaatgacatcgacagttcctcgcggactggccagatgcccccctgtcctcatcggaggtttgcggagcagaggaactttacatcgacacacatcgccgatttgatacaaaattttattagacagcccatgaggtgacaattattcaccataagctccgcccactggtgccagaatnnnnnnnnnncttgatacaaagtttttatagacagcccatgaggtgacacttatttaccataagctccgcccactggtgccagaatggcggacaagtcacctccggacactccacagcaaagcacgcctattgctcgcggcatcctgggcaacgtgcaagatgccgcctttaatttgtctgccattcgcaatacacccagtaagcctggcgcgcatgtaccgggggggatggcaatcaagggattgccgcaacggactctggtgcggtgggcaccccgtacagatctgctccacctttccgacgaacaggcagcaaaagcgcacggaaatggctctacaaccagatggcgactccgctgatggagccgctgggctggaaactgcgggccaacaacccggtgttccgggaggcaggcaactctccccacacagagtgagttcctactgaccggaacaggagtccccatccctgaaacaaccaaacctggggctctcatgtcatcaccnnnnnnnnnngctgcgggccaataacccggtgttccgggaggcaggcaattctccccacacagagtgagttcctattgaccggaacaggagttcccatccctaagagaaccaaacctggggctctcatgtcatcaccaagctccgttcctcctccgtcccatgcgaccatgactgggaggacctccttctcccccctcattcccacaggctcgccatcgccgacgaacctgggacccccgcccatgcccggatcgcgaccgcagccagcgccctgtccactccctgcggcagcgagaagcagatgattgcctgcgtctacccacgcagccacgtggtgggatcggggagcggcaacgctggggctgctctggagtctgaggcctcggctaccgaggtgagaccggttgggacgtggcagcacgccaggctggtcgctccaagcctagggcatgccggcatcagatgacatgttggttctgattcgtctcaagcgtgtcctttcgttcaaaacccagcagcactctgcagcctccatgggttccgaggccgtggactcgccagcatcctgggggagtgatgcggccactgatctgttggaggggggggaccccaccccgcgccccaccagtcgcaccctgggcctggaggagccgagcttcgtcacagcacagcgggtcgctgccgaggcaggcgacctgcctggccagaagccccagccagaggccctgcgtccagcccagcccctgccggaggtggaccgggaggctgccttggtgccttctgtcgaccctgcagaggctgaggaggccgccctgctcccccctctggccacttctgcggagaaggcacgcagctccctgctctcctactacgcccagaccggggtatgatgccagtgccttatctgcttgtggcttggatctggtagtattggggattgctgaggcctatctaacttgaatatcatcacaacgtttcacctctagtgggtcgacccatataagacatccccaaagcatgcgcactccatgcaggaaacccgcaccattgaggctggcgccgagccccgatgcgtcacgctgtcaccgacagatgccccggccccatcttcctccggcaaggtgnnnnnnnnnnacactgaggctggcgccgagccccaatgcgtcacgccgtcaccgacagacgccccggccccatcttcctccggcaaggtgtcgcgcgtcttgacccgcctcccaggagccctgccgctcgtggtccgagggctcgtgctgctgggtctcctggccggcctggcctgggtgccgctgaccgggcctccgcacctcctctcccgagccgcctccccggcgccaggtgcggttggtagggggggtggagtctgctcgaggattgtgtctcgtgcaagccagcaacattgtgactgatgctgaactttgagagtggttccccagtgatctaaacccttgctctccccgtcccgacaccctgctcaggactcaagctggtcgtgagcccgagggaactgctgcccctctggcgccgcctgcagtctgccgccgcggcgcaggcccccaccgcaccgatccccgcacctgcaaccttggcagaggctaacccctggaccctcccccgggccgtgctggatggccccgcggccgcgctttcccgcatcgtgcgcgccggcgcccccggcttggcgcccccggtcaggacgaagcccggtcccgcgcccgcccgcctcccgcgccacacctgcggcgtcgacacctgccctgccccctggcccgagccggggtcagaggggcccaacgcatggggagcggcggcgctgccctcg

SEQ ID NO: 39369 - DNA, 61 bp, Chlorella protothecoides
gtggggggatgtggcagaggaggcacgtgcagcgcttccctgctcggtgttgtcctatgcc

SEQ ID NO: 39370 - DNA, 14721 bp, Chlorella protothecoides
  modified_base (922)..(931): a, c, t, g, unknown or other
  modified_base (996)..(1005): a, c, t, g, unknown or other
  modified_base (2090)..(2099): a, c, t, g, unknown or other
  modified_base (2444)..(2453): a, c, t, g, unknown or other
  modified_base (2576)..(2585): a, c, t, g, unknown or other
  modified_base (4850)..(4859): a, c, t, g, unknown or other
  modified_base (4918)..(4927): a, c, t, g, unknown or other
  modified_base (5003)..(5012): a, c, t, g, unknown or other
  modified_base (5634)..(5643): a, c, t, g, unknown or other
  modified_base (6191)..(6200): a, c, t, g, unknown or other
  modified_base (6868)..(6877): a, c, t, g, unknown or other
  modified_base (8364)..(8373): a, c, t, g, unknown or other
  modified_base (9031)..(9040): a, c, t, g, unknown or other
  modified_base (9127)..(9136): a, c, t, g, unknown or other
  modified_base (10240)..(10249): a, c, t, g, unknown or other
  modified_base (10801)..(10810): a, c, t, g, unknown or other
  modified_base (11596)..(11605): a, c, t, g, unknown or other
  modified_base (11918)..(11927): a, c, t, g, unknown or other
  modified_base (12911)..(12920): a, c, t, g, unknown or other
  modified_base (13591)..(13600): a, c, t, g, unknown or other
  modified_base (13689)..(13795): a, c, t, g, unknown or other
  modified_base (14318)..(14327): a, c, t, g, unknown or other
  modified_base (14379)..(14388): a, c, t, g, unknown or other
ctgccccgttcgggggccgggtccgaggcgcctgagtccccgccgccggcggcgcggggacgggcggagccccacggagccggccgcccccgctcagagccgcggcatgcaggctccggcgcggccaagcgcggtgccgcctcgctgccggcgccctcctcgcagcacaagcgccacgccgtgccccagcccaggggggtggtgttgccaaggaggcactccttgccgggcccggcagcggcagcggcgccagccactcggcctgccgctgctcccaggcgagtgggccgggactctggcttgtcggggagaaatgtcttgacaccccagtgccccaggcgctgtttccgggggcatgcctcgcatttacttctccggtgcccagcgtgcgtgcatcacacccctgggtgtggttgtgggcatggaatggtgttcgtcgccgagccctcggtggcacctctgccgagcgtccccgcccccccccccatcacgatcacaatcccgcagtgtggcaccagcgtatcattccggcaccctgcaatccatggacgaccgccgccacaggcaggagcggggccatgcagaggcggagcaggcatcacgaggccccggcgccaccgacgcgcccagacagccggccccggccctggccggcggctcgaagtcggtgcagcccctgcccgaccggcgcttcgcgcagatgccccccatcccggcgcccgtcgccgcggccctgggccgggccccggcgctgctgagcgccgagatccgaacggcgcatgccgagcacgcggcctcgctggcgctggcgcgcctgcgccgcctgcgcggcgcggaggtggatctgacagagtgcgaggcgggggtggaggccaccgcgccgcgctggcgcgtgcccgccgcggccgcggcggggaggcgnnnnnnnnnngacagggtgggcatggcttgtgcctggattccctaatcacccctggactccctcaccatgaacannnnnnnnnnggctgcgcctgcagtacggccgggagagcgcggagcggtgggcgggggcgggggcggcgctgcacgcgcggcgggggtcgacgccctccctcctcccaggcacgtgcaatcggtggaagggcgggcgctggcggtcgcatggaccatggtccgcccagggggtgttcgtggttgactcatctcgcgaccgggtccctcctcgccttgatctgggagcacagggtgggcatggcttgttcctggattccccaatcacccctggactccctcaccatgaacagatgcgctggatgcagacacggcgccccctcagccgcccgcggccatccctttcttccccgtcgatcagggggagatggagcagcagcagatcgccatgatgcaggcgggggggcgcctgccagactatttgttcaggggattcgcatgtgtctgacatggtggcaacagcagcaacatagttagcagggaagctcatggcaacctcaagatcctgcggagcgctcaatgagggtttacgtgacggtcgtgcgagagatcctcatgacacatgagagcaacgtactcttggcatgagctccaggtcgcataatgtagcaaattcgcgcgcccatgaacacaacaccgtgtcacagttcgtgcatggaaccgtgggccatcccgtcggtcaccactgcggcgctttgtctagaggctttggccggagcccacagaaagggcgtgactgccctgccgaatacctatccatgtactccgagacttgtgccaacatgaatctggaggacccgctcgccacaggctttcagtctgggccattgcctcaggagccgtgcacctccagtaaggaccactcccccgaaggttcaatccccgtgtcctccgacaatgccacccgggagagcagcagcgctcctgaggccgagccggctcccaagcgcggcgctcgaggtggcaaggggaagccccgttcagggaacgccgagaaccaggcccggtatcgggcgcgctgcaaggtaggtggtgggggttctcggatgggacctcgacccatcaaggccggactcactccgagcagcaccattgcnnnnnnnnnntcgctgcaaggtaggtggtgggggtgctcgggtgggacctcgacccaccatggccggactcactccgagcagcaccattgccatgctccatgaagggagcgtgcgttgcatggaggttccaaggcgtaccttgtgcctgcccaccgctcagacgaaacgcatgggcttggagggcgtgtatcaatcgaccaaggaggccctggagagggagcagcgtgagagtgcccgtctcacgctggacacagcggtcctgacagggattctcagcgtgcgagacatgtccatcaaggtgctagaaggccctcaagaggtagggagccttgggtggaggaagggggggggggnnnnnnnnnnagtcctggcgtgcatgagcatgggaaggtgacacatggtacagcccatcttgggcgagtgcagaggaggggagacaaaagtgtccttgagagggtcaaagcgaggcagtgcactgcatcccgnnnnnnnnnncgggagacaaaagtacccttgagatggtcaaagcgaggcagtgcactgcatcccgccaccctctgtatccagcccggcagacttccgcatcacggctccgtgcccgctgcagggaccagaagccctcaatgacagtccgtcaaaccctggcctgaacgttcgttcgggcgagggcatctccccccgcctgcatgccgaggtgaagcagtacctggaacatgtggagcgcctcttcatggatctggcgctggcagaggggtgctccaggcagtgtgtcacgagcttggatctgacatggggtgagggggcgggggaatctcgtggtgtggaacggtcagggaccttcaagccagctgacgtgaggggggtctcgcagctcttggcatgaccaaaatggttgaggaatgccaggacctgctgtctggacagcaccttttccaccccagttgttttgtccagctggcttgcccctctgcctctttccccccacagatcaactcgtggagtatggagaagagattagggccatgaccgagacccagttctgtgcggccctggacagcttcagagacgctgcgcggtgggttgcctgggcttgttcccgggacggaatatcagaatcagccagtaggccttgatacggacccaaaatttcatgctggctggactgcgtgtcgggctgatcaaggggtgcctcccacgacctgcagcatgcgtccccggcatgcacccatcgccactgctgggacccctgtcgtgccgccagctacgtccccacccctcggccctgaactccacacttttccagggaagtaatagcagagctggacggcaccggctcccgcctgtgcctgctccagatggtgggcgcctggcagagcatggcctgcatgcacagcgtggccaccgcctgccgccccgacctcgtcatggccaccatggcgcaggcacaggcggctgtgcggcgcgacgcgctgcccgacgccgggtttgccgcgctggcacgcgcgctgcgcctgagcccggcgcaggtggccagcctggggcgcgtgcaccgccagcatgtggccatgctgtgcgcgctgggcggcagcggcgcggcgcagcgacgcagcgcggcggcggcggtggccacgggcgccgccgccgcgccggctgcctcgctggcgggcatgatggacgggtacctggaggcgctgtccaccgcggcggcactggagcgctacctggccggcatgaactccctggtctcctcctactgcagccaggtgttcatggtgctgggcgtggagcaggcgctgcgctggattggacaccttccccgcggcttccccgccgtcgccgcctttgtcgagcacgtgctggccaccgccggcggcgccgccgcgctagaggcaggggagggggagacgtcggcgcctggcgcggcccccgccgccacactggccatcgccggggtcacatgccccggcatgcgcatggtgtgacaacgagggcctgcggcacgaacgctgacgcacgcatttgacgcccggctcgtcgccacaacctttggggccctgactgcatgccatgcgcacccagacaaatactcttcccctgacgtggaggccttccctgactccatctacctctgaacacccacgcactgcactctgtaccaaatgacttgatcgcgggcagaaggcagggtagcagcggcccacggtgcgccagactgcgtccatggagggcgctgggttaccaataccaagggcatgcccctgtgtgtcgtctacttacatctggagggtcagcttgggaaccactcagaggcatgcgcggggagcagtccctcgcagtcaaggtgaatccgggcaccggagactgggtgtgtgcctgagagacgcagggcctggagccacccaggatcctgctggcagtccgggatggcatgtcctccccagacagtcagagcgcccttgcctcctccagcgctcgcggcaagtcgcccccccttcgcagtcttcatggcgacatgggcttcgggtcggccagggcgaggggcggcacctgacctaggggtaccaccagcacctggggtgcgccctcggccatgcacatggacagcgtctcgccgtccggcgcccaggacaggtcgtgaatgagggcggggcactgggaggggtatgcaagggagggggtggggcggggtgagcgaatgagaggctggctttgactggatggcgatcgaccaagcaaggtcaacagtctgcaacagtcccnnnnnnnnnnccccacctccaaatgagaatccccccaggcccgcatcgccgcccacctgcaggctgcgnnnnnnnnnncgacgcggcattcacgctgcggctccctttcgttgcttcccccagcctcagcactcagccagttgcatccctcccnnnnnnnnnntgacgcgccattgacgctgcggctcccttccgttgcttcccccaacctcagcactcagccagttgcatccctcccaagtcccacctccagatgagaccccccccaagcccgcatcgccgcccacctgcaggctgcgcaccacagcccccgacttggtggaccagaccaggacctggcccagttcatccccggtggccagatactcgcccgcggggctccagcgcaggtgcggcacgttggcgccgtggcggtccaggcggtgcaccaccgtgccggtgtcggggtcgaagatctggaccaggccgtcggcgccggcgctggccagcaggtggcggctgtcccaggggccccaccgcaggctgttcacctcggcgctgtgccctgcggggcaaaggtgaccaggggtggaaggtttgggggtgtgattcgtcactggagccgcacaggaggcaggctccaggaagcggtggacagtctcctcttcattgcagcagccgtacacacaggaggaggcagggtgggggggggccactgctcaccacacccctttgaaatcctgccacactgcacagcaccccgaccccatgccccacctgtcagagtgtgtagtggcgcatcagannnnnnnnnnactcctcttcattgcagcagccgtacacccaggaggaggcagggtgggggggggcactgctcaccacaccctttgaaatcctgccacactccacacaaccccgaccccatgcccgacctgtcagagtgtgtagtggcgcatcagaggtgagggaccagatgcggacggtgccgtcgtccgaggccgaggccagaagcttgccgctgccatcccaccgcacgccgttgatgtccccggagtgcccctgtggggagtgcggggtgcggtatgtgcgagggatgcgcgacctctgactcggtcccttgaagggcaaagccctggttgcatgagacctgctgatgcgatgcaagcgctgcctgcgccagctcagcccatcgactgtctgctcgggagcctggccccacagggcccctgccgcagtgacacaacaacggacagccatctccagggttgcgcaaggcagggtaccgggccggggcggtgctcggattctctaccttccccccccccattcgttcccagacccatgaggatgccccggcgcctannnnnnnnnnagatacaacaaaggacagccatgtccagggttgcgcaaggcggtgtacagggccggggcggtgctcggactctctacctcccacccccccttcatccccagacccatgaggatgccccggcgcctaccttccagactttgaggggtcggtcctcgcctaccctgaagacggcgatggtgcggtcggcgctggcggtggcgtagatggcgttggtgcgccagtcgccgtccagcagcggcgcggcgtggtgcacgcagcggctgcgcagggcgccggaccgcgcatcccagacgatggcggcgcagtccacggagcaggagagcaggaggtcgccgcgccggttccagcgcagcgcgaagatggaccgcgtgtggccctccagcgtgaacttgcgcgtgccttttgttttggtgtgatcgggggagtgggggaatggcatgggcaggaataccttgcgagctgggaggcgctcacggggacgtgagcattccgacgatggggcatgtggggtgccactcggatggcaacaaggcacggggtgcctgcctggtgccctccacacatggcacgaccagcgggtcaagccaccagccctgcgaccttggcaaccgtgggagccccacactgaacagtacaaacgcaccgtcggcctcccagatctggatgcnnnnnnnnnnggaggcacggggtgcctgcctggtgccgtacacacatggcacgaccagcgaggcaagccaccagcccctgcgaccttggcaagcgtgggagccccacactgtacagcacacacgcaccgtcggcctcccagatctggatgctgccgtccatgagtgccacggccagcaggctcgaccccggcgaccactctatcgcggtgatctctccccccgtggcgcagacacggggcgtgggcggtggctccctagtgccctcgggaaagtcccacaggcgcaggctgccgtccgcgaaccccgccgcgaggcgaggggggccggccggggcccaggggcaggcatacacgggcccctccgcgccccccagccccaggcaggcaccagggtccagctcctccggccccgaggccagcacgtccagcgcggcggcgtcacgcttctcgtgccactcgcgaacggtggcgcgcagctcctccacatccccggtcatgatggcctccgccgacagcggcgtgaactcgccaaagacgtcggtggactcctccgtcaggttggcctccagctcggcaaactggaagcccttctgcaggatgctgaccagcgtgcccacgggcacgtcggcgccgggcaggccggagttcaggatggagctctccgcgccaaaggtgaaggcggtgtgggcgaagcctgcaatggggagggatgaggtaggcacaaaggtggctttgaaagtcccagccctgtggagtcacacaagagtatggcgacgatgtcaatgtgcgcctgtgcagggacggcacaaacacattccaccacgtcctaaactcgcgctcaccagcctccaaaaggtagcggtacaccaggaaattgacatggtcggaggtgagggccatgtagcctccctcacgacgctagaggagggggacacagctcgagtctaggatctcgtattcctcgttcacatatttagtaacatttttggcttctcattggacgtccagcacccgcgagatggacggcaggtaggcaccgctccctggtgggaggccttcgccttcagtgtttcacgactgggcacgagccccgggctatcactgacccaaagcgatctatcggtaggcaaaagctattctgacccggcgggaagactttaaagtctcagctgctgggctcatgcctcagcttgctatacgaaaaatgcgagatgccaggtaggcataaggaaagctcggaatgcgaggtaggcggccaagtattcccggaggcctcagagcctgcctctttcgaagcaaaacgggagcaccatgccgccgaaattcgaccccaactcgattatcgaggtgcggggcggggcggggatgccagggggcggaggggccatcctccgagcgctcgcagggggctggggcggtcgtgaaccttgtggcgcccagtataatcaggtatgtccatcccaccgtgcaggtctacgtccgggcaaccggcggcgnnnnnnnnnncaacctcgtggcgcccagtataatcaggcatgtctatcccaccatgcaggtctacgtccgggcaaccggcggcgaagtcggtgcggcctcgtccctggccccgaagattggacccctgggcctgtcccccaagaaggtgcgaggggggggtggggtctgaggagcgttcgacagggtgtggcgccaagccatccacatgatcctcaagcatcgttgccgacccagcatccgctttcccgcccccagattggtgaggacatcgctaaggagaccgccaaggaatggaagggcttgcgtgtgaccgtcaagctgaccgtgcagaaccggcaggctaaggtgtccgtcatcccgtccgccgcctccctggtcatcaaggccctgaaggagcccgtgcgcgacaggaagaaggagaagaacatcgtgcactccggcaacctggcgctcgaggatgtgtacgagatcgcccgcatcatgcgcgaccgctcctgcgcggccggcttcgcggggaccgtcaaggagatcctgggcacgtgcgtgtcggttggctgccaggtggacaacgaggacccccgcgacatccagcaaaaggtgcggtagcggcggtggagcagggtggcatgattgcgtgggaggggggggggggggggggggccggggnnnnnnnnnngaggtgctgcgagttgagcgcagaggttctctgtgccacaccagattgaggattgccgtttctgagccgcaacatattactacagcnnnnnnnnnnggcggcggtggagcagggtggcatgattgtgtgagacggggggtgggcgcctgctggggagcagaggtgccgcgagttgagcgcagtggctctctgtgccataccagattgaggattggcgtttctgagccgcaacatattactacagcccttcttaccggcaagtattcccgttactcccttctcagatcgacgatggcgagctcgaggtgccaagtgcatagacttgacgcgatggctctggccttgtaacactcttctgctcacgcactatcatacaagtggtgtcagaacagggtacacagagcaaatcgtgggatcaaattaggtggaggaccctgctgatgatctccagctgtaccgacaccgcaacccgaaatcaggctcgtcgtcagcgcaagcgggcgggaatgggtgctcgtgcctcagccctgcataacagcagcgctgacatcctgcccctgtgtgaaacagaatttaacttcaaggattaccaggggcatcgcaacattagcaagcgttgtttgcaccgggtcgcgagccagcaccatgcagagcctgcaggcgggtgtcacagggcgcatgccagtctccttccaatgcacacgaccaaagcatggggtaaggggtggtacacccatctgctctggagcggagggcacgggggcctcccgcccccgaaccactccagtgagccgggccacacctgcccagaagaaccgtggcggggcggatcccaagccatgggaaacggatcagctgccacagggccgccgtgtacttcaggtgaaccatgggagggaggcctggcaatcgggtttgccggcatctctcgagagcaggacccgagtgctctccttgcacctcttcccgctcgcagcctgcggaaccgctgatggccagcatcgacgaccccagttttggaaggtatggtaatattcattgtggcggtcatggtgcagggttggtcgtcagagagaggcttcactcttgaaagctgggttctgtggcagacagggctcaaaccaagacccgactcccaagcccatcccaaatgtgccctttccccccttcagacccatcaacccctcgatcgaccgggannnnnnnnnnagcctcaaaccaggacctgactcccaagcccatcccaaccgtgccctttcccccctgcagacccatcaacccctcgatcgaccgggaggagctgtcgaggactgtgcgcgccgtcatcctcgccggcggtgaggcgaagaacccgctgacccgctcccgcgctatgcccgctgtgccgttgggcagcagcttgatgatgatcgacgtgcccatcagcaactgcatgagtgcgggcatcaacaaaatgtgggctgaagtaggacttggcgatggggtgggaggggctgtgggctcgcacatgttgcgcatgatgcatggggaaaggaggtgcctcattgtggacagtgaagctggcatcacagtggtgattctgtagacaatcatgaaggggcacaaggcgcagatgctgcagctttttgcattgccctctctgtcccccccaatgctgctcccccagcggcttgctgctgcgttgcgcagcactgccagccaagcccctcaaccccctcctcccacccctccctgcagctatgtgctgacccagttccagannnnnnnnnnacgcatgttgcgcacaatgcatggggaaaggaggtgccacattgtgaacagtgaagctggcattacagtggtaattctgtagacatccatgagggggcacaaggcgcagatgctgcagctttttgcatcgacctctctgtctccccaatgctgctcccccaagggcttgctgctgcctcgcgcagcactgccagccgagcccctcacccccctcctcccacccctgcctgcagctatgtgctgacccagttccagagccacaccctgaacagccatctgacctccgcctacccccccgtccgctttggtggccccgaccaccaggcatgggtggacgtcctggcggcccagcaaactgtcaccgaaaaggactggtgcgatggatccgaggggtttgtggggttgttgtttggaggggtgacatctgagatctgcttgctccagccctctggaatcgcgtcctcaagcagggcgcaccgcccggccctggtgcctccccgcatgtgcctggtcccctttcacccacccacccgccccacgcccactgccgcaggtaccagggctctgcagacgccgtgcggcgcaacatcaatgagctgatggacgaggcgcggggcgtcacccccgccaccgagtacgtcatcctctccggcgcggcggtgtacaccatggacgtagcgcagctggtggcggagcaccgggccaagggcgccgacatcaccatcgccatgcaccccgtgtcggaggccgacgcatctggaaagggcgtcgccaaggtccacaacnnnnnnnnnngattgccatgcacccggtttcggaggccgacgcctctggaaagggcgtcgccaaggtccacaacagctccagtgagactattgaggaggagagggttgggtaatcgatcatgcgaaaggtttggggtcgggagtgcggggctgcgcagatgggtgccacccgcggcggtgtgggggttcctgctgctggtgctgtgcatggtgggcctgtgagagtcgcgggcgtgtaccgaaccctcaactggcatgcaagaaaaggactgccctccacccctcccacccgcccaccatcccatcaccgccagaccgcgtgnnnnnnnnnntctgctggtgctgtgcatggttggcctgtgagattcacgggcgtgtaccgaaccctcaactggcttgcaagaaaaggattgccctccacccctcccacccacccaccatcccatcaccgccagaccgcgtgctcaagttcgaggagaagccgagcaaggcgtcgctggagggcatgcggcgcgagggcgtcgacgacgactcgcgctacctcgccaacatgggcgtctacgtcttccggcgggaggccctgttccgcctgctcagccccgccaagaagcaggccatcacgcacatcgggcaccatgtggtcccgaatgccctggcccaggagatgaaggtgtacgcctacctccacgacggtgggtgggtggttgaggggctggtgggagggaggaggagcgggaggaaggagtcaaagatgtcatcgagtatggtggggagtttgacgggcgggtgctgtgttgttggcaagctcaagctacaggccaggcaggtagcgtgtgtcctgggagccaggggaaataagggtgcacatgcacgaatgcacaggatagtgctgaggccgggggagtggcatatctggctctccactactatgcgattcacatttgtttgttaggctaccgcccgaatccgcccccttgcgcatgtccgaccctctccacatctccacaccgcaggttactggcacgacgtgagcagcctgaaagacttttacgagaccaacctggacctgtctgacgaggactcgcccatcaagtccgacatgtcggtggcggcgcgggggtccatgctcccccccgcccagctgcacgacgccgacatcacacgcacaatcgtcggcgacggcgccgtcctggtggtgaggggatgggaggcatggcgctgggtttgatgggagcaggaagaggggttgagggggtggtacttcagggaacaggtgagcgaggagattcagcacacgggtccgcccgctacttgcnnnnnnnnnnctgagggggtagtacttcaggggaaaaggtgagcgaggacattcagcacacgggtccgcccgctacttgcgtcgtgctcaggcccttgaacccttggcagtccaccttccccgccttgagctcccctcctccccggccatctcaaagggctgcacggtgagcaacagcgtggtgggcgagtctgtgtacatcgggcgcgggtccgtggtggaggactcgctcctcctgcgcaactcctactgggccagcgacaagctgcgcggcgaggcgcagcgccgcggcgagcgcgtttacggcgtgggcgagaactgccacctgcgcaaggtggtggtggacgagaacaccaccatcggcaacaacgtgaagatcctgaacaaggacaacgtccaggagtgcgaccgtgccgattcgggtgtggacggtttttttctttctgggggggggaaggaggagggggttgcactggcgtggggggccagggtgaaggattttggctgaggcttcctgcttggtgtgcgagacgggatttgtgggacaacaaagctaggtggccatgtcgaagggggctgggcttggggagcatccgggttctattccgagaatagttttgatgaggcagagccatgtgagttccctacccctctcctctgtggcccatcatcccgcatccnnnnnnnnnncggaggctttttttcttttttgggggggaggaggagggggttgcactggcgtgggggcccagggtgaaggattttggctgaggcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctattccgagaatagctttgaaggggcatagccatatgagttccccaacactctcctctgtggcccatcatcccgcatcccaaccccactcttcctcaacccatccttccattgtgcatcgcagacgggtacatgatccaggacggcattgttgttgtcatgcgcaacgcctccattccagacaacaccgtcatctgagggcgcggcgagggtcatggtttgtgcagcgaagacccaggagggagtggcagcgctgcggctcaggctgatgtgcgcccctactgccgcaatgtgggcagctttccaggcgtcgaccggaagatctcggcgcccagaagcctgagacctggcctcccacagcacctcggggacctcgtgcagctgctgaccgaccccacccctcaacatttttgcaaacgacgcccttctctgcatgagcttgggggagcacactgctgcagcaccccactccttgagcccctgcttgttacaccctttgtcagcttgcaagcgtgcgcgnnnnnnnnnnaacatcgtgcagctgctgaatgaccccacccctcaacatttttgcaaacgannnnnnnnnngggaagggacggtgccgtcgcagggagggaggccggtgccgtcgcagggagggagggaggtgcgcgcggggcagaggagccgcggggccaggacatgggttcagcgcagcacatagagaacccgccaggcgccagggaaggggccggggtcatcgactccccggcgctcccggggcaccgtcgccgtcggctgtcaccgccccgcccacctccgatccaccgccctcgccctcgcccggcgcccccagcgctgcgcgcaggaccggcgcgacctgcagcagcgccgcccactgcgcggggtgtgcggccgccagcgcgcgcgccacgtcgggc

SEQ ID NO: 39371 - DNA, 66 bp, Chlorella protothecoides
ctcctaccagcccctctcctccacccagcctctctcctcctaccagcccctctcctccacccagcc

SEQ ID NO: 39372 - DNA, 61 bp, Chlorella protothecoides
tccccttcgctgcaagtaaacagttgcagggcgcataagtcccctggcatgcctctgctca

SEQ ID NO: 39373 - DNA, 77 bp, Chlorella protothecoides
cctccccccaacccccattgctcaaccatttgagtacggccccctttcccctcccacaggacttcaagcccgactac

SEQ ID NO: 39374 - DNA, 62 bp, Chlorella protothecoides
gcgacgggcaaccgcagcgatcgtgccccgaaactccgtgtcgagcgccacgttatagatgc

SEQ ID NO: 39375 - DNA, 61 bp, Chlorella protothecoides
acccgttactacccccccccccccccccccatgccctgcatctttgctttgtttctgccag

SEQ ID NO: 39376 - DNA, 149 bp, Chlorella protothecoides
agggggtgtcgactctgatgcgtgtcccacaccacaccatcggtccaagcccccccgcatgcgccgcaagtggtctcacgtctgctccatttgctctcgcatctggcttgatgctctccccccacatctccctgcacccttggctgcct

SEQ ID NO: 39377 - DNA, 151 bp, Chlorella protothecoides
ggactcggagcggcagggtgcgcaggtgctgcacggccctcgccccctggagcacgcgatcagaccaacatgcagagtgatttcgttgtgttgtttacgccttcacattgccgagtgtgtgtggaggcatcagtgaggcccttccgctcac

SEQ ID NO: 39378 - DNA, 88 bp, Chlorella protothecoides
gcatctcatgagcatgcttggtgaccagttatcctgcctggcatttaatcacggccttcccagctcagaagcggtgcctcggcgaggc

SEQ ID NO: 39379 - DNA, 61 bp, Chlorella protothecoides
aaccggcatcaccaacacctacattggcggtgtgggctcatccgtcaacgtgggcctgtcg

SEQ ID NO: 39380 - DNA, 174 bp, Chlorella protothecoides
gccgagtgcgggcgccgggcggcaaggggacggcgacgagcagccctgaggcctggcgggcttccccccgcactcgccaacaggccccagagggcattcgtgagcatgcatgtgcggggcgcagaaaccctcgccaaggccacaccagggcaccacctgcggatgtgcgcggcc

SEQ ID NO: 39381 - DNA, 61 bp, Chlorella protothecoides
tggggatgggcttgccgtctgcaggcggggtagggggcgggacaggggcatgggcgagggt

SEQ ID NO: 39382 - DNA, 5849 bp, Chlorella protothecoides
  modified_base (1980)..(1989): a, c, t, g, unknown or other
  modified_base (2754)..(2763): a, c, t, g, unknown or other
  modified_base (3429)..(3438): a, c, t, g, unknown or other
  modified_base (4564)..(4573): a, c, t, g, unknown or other
  modified_base (4750)..(4759): a, c, t, g, unknown or other
  modified_base (4831)..(5007): a, c, t, g, unknown or other
ccgaccggctccggttcgccgcccacacggcgcgccgggcacgggcgtgcccgcggcggcgagccaggcggcctccgcctcattcacgccctcgggggcactcgacgcggggtcgggtcccgccgccggcgtgtcgctgggcgcgctgtcctcttcgccggcctttctttctgcgtgtgcggcggggccgacggcaggagaggggtggcaggagccgggcctgcttgagagccccgcgcagcgtgtcgacgggcacgatgccgacctggcacaagaaggcgcggatcattcagagcccaggacccttgttgcggcgggggacgcggcgttggcggcggccaagtcgccgccggtgatcctggaagggcgggacgaagcgtcctctggaggcagcgaagcgctgccggcagtggtggaggatgctcggccggcaggcgacggggcagtcatgctcgcgcctggcaacgacagcgagctcggtgagggggggctggatgctggcgtgtctgaggaggctgcgtcggaggaggccgcgcctgagggagttacgcctgagggggccgcgccagatctgggcgaccaggacgctgagtctgagcctgccaatgatgccccatctgagaacgtccccgagaccgccgtggcggctgtcgaggaaattcccatcagccctatcgaggccaacctgaaggatgctgccacagacgtccctgccactgcccctcctgccgagactgcagaggatgcccctgaggcagtgggcgagtacgcacagctcgagcccagcggcaccgtcccactcaaggctaccccgcagcccgcttccgagcaggagcgtgagcaaagcgcagtgcctgcgactgaggccgccgtggcttcatcagaggccgccgtggcttcatcagaggccgccttggaaccctcgctcgctcccactgtgacgctcgaggccgacagtacctcagccgaggctcgcgaggggcccgccctttcagcagcagatgctgggaaagtccctgtgcccatgccccccgccagagagcagccagcgatggagccggtgcatgatgagggcagcgacgtggaaggcatcgaggcagcgacatcgagcgaagaggatgagcaggctgcggcgcgggacggagctggcagcgtcgcatgacggagctggcagcgtcgcatgacgggctcggttcccatcatgcaagccgtgtgtggggtccctgcccctccctctgcgcaccagtgtgctgtaccacccccaaccccttgtaccctcgagtctgtatgctgctgaatcgcgccggtctgcagaccccggccttgcgcctcagttgggaggtgtccagggaagggcgtgcaagcgcctcctctcctggcaccctaccctgtgtgtggctgccttgccccactcccaccaaggctttgtaccaatgtgtgtttttaggtgacgcccacagccttcttgttgggtgaacgctggaattcagggcgggggactccagccagggaggcaagacgggcggcgcacgcacgctctacaccgtccgctctttgagctgccgggcgatgatctggtccttcgtgctgaggggggttggaatgatggaaggggaatggtgggattctgaactggataaagtgtcagcagagagcaggagggcactctcggtcactcttacctcccacatcaagtgccctggacccaagcagccagcaactcacatgacatacaccactgcgccccagccggcaaggcagtcccggccctggcccgacagcagggcctcggcggtgacctcgaacagctcctctggaccctgcgacgtttcaggccggacgttgggggcatgggcacttggggcagacacagctagtcatcttgtaccccaccaacaggtggcagcacagcgaagccctcggtcctcgccccggcagatcccaccaaaagctcaccatgtctggccgccagagggactnnnnnnnnnngggtccttgccctggcggatcccaccgacagctcaccatgtctggccgccagagggactcgcagatgcccagcagggcgtcagacgccgtccctgcgatcatgaagtccttggccgtctcaatggccccaatggagtccatgccgcacaggtagggcgtgccgtcgggctccagtcccgcgatgaccggctggcagaagtaggggccgaagcgcttctcgtagagcgtggcggagaccagctgcgcaaaggcagagggcttgatgtcccgctcctcccgcagcttgtacagggtgtgcttgaacttaaagcgctgtgatctgggatacgggcgagggggcggggggaaattgtttgaggcacagaatgtaacagcgggattgggcggctcactcatacccccctcgtccagctctttcaagcaacacgatatccactgtcagcctccagagcactctcaaaaagagtacgcgctgattctacttgagtcatactgcccctagaacaaggcagcctcaaactcacagtgtttcagcgtcgcttgccagcccggagagtcccaggaacagctgatcatggatcttgtacaccttcttgtggtcggtcgccagcgtttgtagctggacaccaaatctgagatcgctggctatggccacacactccttgccggccatggcaactggtggaaggaggtggtggaaggagggggggttaaaacaccacatccaagcatgtttggggaagcaaccatcccagccctgattgnnnnnnnnnnggtaaaacaccacatccaagtatgattggggaagcaaccatcccagccctgattgctagagagacatccgccccttcctctagcctactcactgattgcactgccattgtactcaaagatctacgaggcgaggagggggggagagatggtcgacttgtgttgcgatcaccgagacgggcgatcacgggaagggggccacgccctcgacttaccgacatgattccagggttcctggcttattgatcagatgtttccagccaaatctggtcaattcgcctcaggatctgggacagcaatgctgctgtgctccaggtgaagtgatgaggttctcacacttgctttgattgcccagtagctactcctcttgttaaaggctgaacacgaactgataccgaaggtgcaagaccagctcactactcttggttgcagggtgaggtggtccggagtgacgaccattgcatctggtgcctggaacccggtatgagcccaggcgcaggcgcgcccgtcggagtgcatgtctcggggagttggcgtgtatcatggcagtgaagcaaccatgtcggccaaaacgtgattgagcatgacaagttagtggtttctcttgcaaaaggaagcaccagtgggcgattcgttttgcccggctcctgtcgcaatggcggcagaggnnnnnnnnnntttagtgatttttcttgcaaaaggaagcactagtgggcgattcggtttgcccggctgctgtcgcaatggcggcagaggtccccgtgcctccacagtacattccgcagcccgtgacagactttcgcgggttcccggatggtccccgaggctttaaagtcggagtgacgaagaagggcgtgctaggccagaagaggaggctggaggagtacgaagaacaggtgcatgctcacccgggtcgcgacccgcctacaatgtgtttggcgtccgcagcatccagacgcactcatatcggcttgcaggtggagaaggagcaggaggagcaggccatggcgggcgaggtgcagccattcggacccaggaaaaaagtgaagcacaacacccatggcctggccaaggtgtgtgctgggcctcgagttgagtttcaagggctccgggtcctacaaactcctccagatgaccaagcactcaaccaaccttggcctgcaggtgtctgggcgtagctggaagcaggcaggcgagcgtgcaggcacactccgcaaccccaaactgtccaccagctgggatgagaaaatgaggataaaagcggagaaggcttcctttttggaacagaagcgggagtcgcaggccgcttggaaggcaaagaagggggtgagtccctgggtcctggggtgggtggccccttgaggttgcttggcctgcagcatggactcgtcggtctggccagtggtcacacatctaagagccctcacccccccccaaaaactctccccgccctcgccagatgctcaagtcccagcgcgaggaggtgctgcgcaagaaggaggagaaccgcaagaagagcgaggtgacggtgtgggtgtccagcgccacggccaagaagatgcagaagagcaagaaggcgcggaaggcgctgaggacgggggagtaaggcctcgcgcaaacggtagccgtgccggggcgccgccgaatttgacacatcctgtaccaaaactgctccgccccctcctgggccattctccttctgtacgtgtacacgtttgcccacacaagcagaggggcggggcagaaacgggactgggtgtcgtgcacgcatctgcatgctgagtctgagggctggtgaggcatnnnnnnnnnntgggactgggtgtcatgcacgtctccgcatgctgagtctgagggctggtgaggcatcatgtgccagcagagggttgggcatggctgccttgaaggtggcagagggatatgaacggtaatatgatgatcaagcagatgcagtcaactgtgggacgaaccgcggcccaacaccggtgcnnnnnnnnnngggcctcgcgtggacggtagccgtgccggggcgccgccgagtttgacacatcctgtaccaaaactgctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagcagagggttgggcatggctgcctctgaaggtggccaagggatacgaagggtgatatgacgatcaagcagatgcagtcaaccgtgggacgaaccgcggcccaacaccggtgctggcgatggccggcgtcatcaggcctaggcccccccagccagtgtcaggggcctggcgtccgctgtgtccccgccggccccgcctcccactcctcgtgggccagcaggttggagtctgcccccacgggctgcggcgtcagcgcccggtagtcgtctgggtactcgaactggagcttgcgggaggggatgtagcgccccgtccccgcatcgtgcccgtcaaagtagttgtccagggctcggtgcatgacgcgggcccccgccagcgggaccacgttgtcctgcgccacgtacttgctgacgcgcacaccgccaaagaggcgcacgcagtcgccctcgtcgggcagcacatggtagaagggctggcgcgggcgcacccccatggctgccgcccactccgcatcgcgctcgcactcgcgatcccagccgaagacgacgccgcggtagccgtgctgcgcgtgcgcgaagaccgtgcccagcggccaggccacgccggagcggtcggcgcggtcgccgcgcagggcgcgcatgcgcgcaatagcgccgccgtagtcgtcgtgcaggaggcgcagcgcgtccagagcgcggtccacggcctcgccggcctcctctggctgggggttgttagttttgacatgtgtggggaggggggaggggggagggcgtgaggtggggttgcctgcgcgcaggctcaggtgtgtgtgtgtgaagagggggggggggggggg

SEQ ID NO: 39383 - DNA, 61 bp, Chlorella protothecoides
ctgcgcagccttatgcgtctccgcagcagtccgcgtccgcgcagcagtacgcccccgcccc

SEQ ID NO: 39384 - DNA, 104 bp, Chlorella protothecoides
cctcggtgcacacatctggcagtgcagggggaaatcaaactgcactgtgcctccggccatccccgcttaccccgccccacccctcaaccgtgccagggcgattg

SEQ ID NO: 39385 - DNA, 64 bp, Chlorella protothecoides
cccggggtgcgccagggtcaccggctggggggggccccccccccccccccgccgtcgttcgtgt

SEQ ID NO: 39386 - DNA, 87 bp, Chlorella protothecoides
caggtacagggggtcacacaggttggagtgcacacgtgactggggatgggagatggaaaccatacgtgcagacactggtctgagcct

SEQ ID NO: 39387 - DNA, 61 bp, Chlorella protothecoides
catcgcacacactcctcaagtgcacaggggacaggaggcgagctgctgcgaggcagactga

SEQ ID NO: 39388 - DNA, 77 bp, Chlorella protothecoides
tttcataaaagtgcacacaaccctgccacagcgggcaatggggttggcaggcagggagtcgggatgtgaagccagcc

SEQ ID NO: 39389 - DNA, 67 bp, Chlorella protothecoides
ccttgcacaagcacctcatgtcgaggctcaaccgggtatactccgctggcagtcacggagcagggcg

SEQ ID NO: 39390 - DNA, 8625 bp, Chlorella protothecoides
  modified_base (215)..(224): a, c, t, g, unknown or other
  modified_base (901)..(910): a, c, t, g, unknown or other
  modified_base (1205)..(1214): a, c, t, g, unknown or other
  modified_base (1662)..(1671): a, c, t, g, unknown or other
  modified_base (2132)..(2141): a, c, t, g, unknown or other
  modified_base (2898)..(2907): a, c, t, g, unknown or other
  modified_base (3258)..(3267): a, c, t, g, unknown or other
  modified_base (3473)..(3482): a, c, t, g, unknown or other
  modified_base (3929)..(3938): a, c, t, g, unknown or other
  modified_base (4215)..(4371): a, c, t, g, unknown or other
  modified_base (6802)..(6811): a, c, t, g, unknown or other
accccgcgtccatccccccccctccactggtcattgcctgttacagggcctttgacctcagaatatggcgttcagctccgcgtcctgcctggccagctcgagaagcatgggatcgtcaaagtacttgttcaccgacacgtcgtcgctcatgcccttgcgtcgccgcgtcttcaccataaagtcccgtgccagggcctgcactggcgccggctccnnnnnnnnnnccgccgcgttttcaccatgaagtcgcgtgccagggcctgcactggcgccggctccagcgggcgcagcaccacgctacggtccagggggtcgccgggaacgatctgccagtggtcgaaggcggagaggcagaaggcctggccctgggtgtggtagcgcaggtcggtctcgaacccaaaggactctatgaccgggaggaaggcgcggaccaggaagacgggcgtgccggggcgcggcacgtcggcggtcacgtggccccgccgcttggccagcacgttgtagatggcagcgatgcagtctgcgggggtctggatctccaccgcgtacactggctccatcaggcgcggcgtggccatgaggaaggcggagtagcaggcgcggcgcgcggtggggatgacctggccgccgccgcggtgtagcggctcgggcgccaccaccgcgtccatgatcttgaacttgcagttgcgcagcggctcgtcgcacagcgggccctcccgcgccccccactggaagccctgtgtgtgttggggggagggaagggagggagatcttggggggttggacgtccaggatggagagtggggtgagcctaggggcggcaatgcacagacgacatggagaggctgccaagaggtgcaggtagcaaccgagggcggattgctggctctgtggttgttcnnnnnnnnnnaagggagatcttggggggttggacgtcaaggatggagagtgggggtgagccgaggggcggcaatgcacagacgttatggagaggctgccaagaggtgcatgtagcaacagagggcggattgctggctctgtggttgttcctcggccgcccattcgcatgttgcagacacccagaccttccctgggccagttgcagcaagaccgagctccctccccagctccggttccctcaaaccccccaccgcatcgtacctggacaatgctttctcgcactgcgttcagcagggtcttgtccnnnnnnnnnnggcatgttgcagacacccaggccttccctgggccagtcgcagcaagacccagctccctccccagctccggttccctcaacccccccaccgcatcatacctggacaatgctctctcgcactgcgttcagcagggtcttgtccacttccgagggtagcgtgtcatccatcaggatgttggggcccgagttgtctggtccaaaggcccagatggagcctgcgagggggacaggatgtggtggagggcgtgcgagcagaaaacgctggggatgggacatccggagagttgtctgcagaatcggggaaagcactcggccgcggtcgcagcagaaagggtgccggcgaggcatcggcaggggcccgctgtcgcccagccactttcgctcaatcggggtcatccaaacctcctggcacagccccttctcacgtgcagccaggatgtcccagtcgnnnnnnnnnnccgctgaatcggggtcatccaaacctcctcgcacagcccgttctcacgtgcagccaggatgtcccagtcgtattttgactggaaaaaggtgctgatctccttgcgcgtccagtccatggagacggcgccccgctcgatgtcctccgccagacctgtccacaggtgcgaggagggtgggggccttgagcgaaacagagcgcttgaatgcagggaagaatagtggtagctgccagacagcgtctccatcggtggccccaacgtcatcagacaagcccatgccaggtcagctgtaatgcagagcatgctcataaccctctgtgcctcgtagccatgcccatgacatgcccaaatccatgccgtcgcaagcacacagtgcctagggtatgcactcggtgcactgctcctcctgcaccatcgctggtgccgccacccccagccgccatccccagatacccccaccnnnnnnnnnnccatcatcagacaattccatgccaggtcagctgcaatgcagagcatgctcatgaccctctgtgcctcgtcgccatgcccatgacatgcccaaatccatgccattgcaaccacccagcgcctagggtatgcactcagtgcactacccctcctgcaccatcgctggtgccgccatccccagccgccatccccagatacccccaccccacacccacgcctaacacgcacccttctccaatggctcagcgatcattgtgatcttgttcttcttgtttggcgtctccgcgaagcacttgagggaggaggtctccaccacggtctcgcagaaggccaccaccgggtccgcaaccttcacctccacctctgcgtacatctcccgcaggtcctgtaggggtgagagcggtggtgttgcaggttgttgtgtcaggcaggttgcggtgtgcatactttgccggaagccctgaggaccgattggtgaccgcacggagtccgctttcccagtgtttgtgcatgcagggcttttacaggcgcggcaagcgggtcgcatgtggccagaggctccgatgatctcacagcaaaacaggctgggtcggcctggaagtcctcctcaggcgcaaagagtcgtgaagacaaccgctgacaccttcaacatctccagttccacaccctcccagagccccctcagacctaccttcatgacggagtccaggtagagctcccccgtcccgaagatggtgtgctccccgctctcctccaccnnnnnnnnnncgagcccccccaggcctaccttcatgacggagtccaggtaaagctcccccgtcccaaagatggtgtgctccccgctctcctccaccttggtaaccagcatcgggtagctcttgttcagcttcctgaggccctccacctgggcatattggtgaggttgggttggaaagaaggaatccactcgacacccatgcgccaggcatgcaccagcacctccagggtgccagaatcggaggggtcgcatgtgcaccctcacaagatggcgtctccgtacacatgcattcacacaatcgtgctgttgcacaggcagccttcagccccttcacacacacacacacacacacacagacacannnnnnnnnnggcggaaggcggcctgtgcgacagcacgattgtgtgaatgcatgtgtgcggaggcgccatcttgtgagggtgcccttgcgacccctccgattccggcgccctggaggtgctggtgcatgcctggcgcatgggtgtcaaatggattccttctttccaaccccaacctcaccaatacgcccaggtggagggcctcaggaagctgaacnnnnnnnnnnaccatctttgggagctcggaggggttcagcggctcggtggcaattttcaccacggcctgggcgccaaaagtcagtggtgcgaagatgtacgcctcctcggcgccaaactccgggaccagggtggcggtcttggccaccgtggcgtccagcccccccagcagcacccagttcccagccacggcgcgggccaggggctggcgggcacgaccctgggccgcccacactcccgtcaccgtggccgtggcggcgtcctcctcgtcctcgggcgtgtacgcctcgcccagcacccgcacctgggtgtgtggtgaagggttggggtgtgagtgtttgtgcatgtgttgaagggttcagttgggtgggatgcatgcacgcggaggaggttccaggatcatggctgggctggtggtcaggtgagtgggcctccaccgccccaccatgaccaactcnnnnnnnnnncggagaaggcttggggtgtgagcgtttgtgtgtgtgttgaaggattcggttgggtgggatgcatgcacgcgcaggaggttccaggatcgcggctgggctggtggtcaggtgagcgggcctccaccgccccaccatgaccaactcctccccccatccccgccccctctccaccttgtcccccggcttgacggtgccgctcaggacccgaccgaagaggtcaaaggcggtggcatcggcggtggggaacagcttggtgacgtagacggccagaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaccagccccgccgcggagccgaacaccgcggtgcaggcctctttcaagagcgggcggacgttggcgccgtaggcggcggggcgcagggccacgcccagctccgccatcagctccctcaccgccgcgtcgtcctcgcccagcacggtggcgtagatcttgtacagcggctccagcacgaactgcacaaaggagcggtcgccgccgccggcgggcggcgcgcggcggaaggcgcgcacgtccgcgtggtaccacaggtcgccccagagacggcgcgccagctcgcgcgggtccaaggccaggcgctggacctcggactgcagcacggcaaaggactccagggtgaaggaccagccgtagagcggcgcggcaaaggcgacgttgccgcggcgtgggtccaggacgcggtccgcggcgccctcggcggggtagtgcgcgcggaccagcgcgttcacctcctccacgacgtggcgcagcttgtggtaggcgtctgcggggggcagcttcagctccgtgatcaggcggtccaccttggtgaccaccagcgcgatggcgaggccctcggccgccgcggcgcgcaccgcgcgctccgtccccgccgccgcgccctccgccgcgtccaccgccagcagcatgccgtccgacaggcgcagcgagaccgacagctcgtcgccaaagtcgaggtggccgggcgcgtccaggatgctggccacgtaggacttcccgctcaggccctgcaccaccaggctcaccggcgcggccttgatggagatgccgcgccgctgctcgtcggcgcgcgtgtcggtgtaccgcatcggcgcgtcggccagcgccgccgcgtcgggcaccacgtgcgtctgctccaccagcatgtccatcagcagcgtcttgccagcgtggatgtgccccgccagcgtcacgttccgacacagctccggcgtggccagcaggctgcccaggaactcgggggtgaagcggggggccagcgccgggccgccggcctcgtgccgggcgcggcgcacgggcgccacgatgggcacctccagcggctgtgcgtcctcctcctgcaccagggtctcggtgcccgcgccgtacagctcctcggcgctggggtagtacttcttgtcctcgtgcaggaccagggcgccggagggggcgccgtcgtcctcctcctccccatcctcctccacctcagaccctgcctgggcatccatgtcctccgccccgggctgctgctgcacctgctcctcctcctcctcctcctgcacgggagggcaagacaacgtcaggcggccccgatgctgaagtattccctctgatcacccggcacccctgccctgccaccccaaccccctgctcgcctcgctgccggacagctcggggcccacgtagttgccaaactcgtcgtagagcgactcgtccatggcgcccgcggtgatgcacccttccacgctcagcacagtgccacgaactcaacaacgggcgtggtctgcggagggagcgtgaggcaggcgttcggggccaccgccagctctgctgcggggtgggtgatggtcgagcctgcgtgcccccttccccaagaccactcccaggaactggaaggaacaacaatgaacgcactgggggaccagaattctgcacatcgcgctgcatggtgctagcccgtgggcagggactccctgacgagatcctgtgtcaggtgccagcctggcgctcgggccgtggcgcactgagagtcgcgccctcgactccagtcctccaaagcccgcctggtcgacccatacgtgactctcacccacattccaaagagacatcttctctgcctcgcgtgcagccaggcacttggtggacacacctcgggtagaagttgagagggggatgggtgacgacttctacgtccggtactatgttgggcacaagggcaagttcggacacgagttcctagaatttgagttccatcccgatggcaaggtgaagggatgcgtgtgtggatggatgctgcgtgaatccccagcaggcgtgtgatggtggccggccacgtcgaggagcgatgccctttgcaagctgaggagggcaggctggcttgatcatggctaaatccattttcaggcaacccttcaccgcgccgatctccctcatcacccacagctgcggtatgcgaacaactccaactacaagaacgacaccatgatcaggaaggaggtgtacgtcacagatgcagtgcttgcagagctcaagcgcatcatctcggagagcgaggtgcgtgttgtagatgctgtgctggggaagggaggacagtgatcttggttgtgtcgctgatcgcctgagtgttccaggatgctgtgcgggaagtagaagaggaaccaggcgcgactggccttgccggccaatattagcattgcagcacactcatacccgtgtttccaacacnnnnnnnnnnggatgctgcgctgggaaagggagggcagtgatcttggttgtgtcgctgatcgcctgagcgttccaggatgctgtgctggaagtggaagaggaaccaagcgcgactggccttgccgggccaatattagcatcgcagcacactcatacccgtgtttccaacactctagccactatgctgatgttttcaacgtgcaagtatggatcagaccgtcaccctgccctggttcccctcctgtttgccccagatcctgaaggaggatgacgaaaactggcccgtcccagacagggtggggcggcaggagctggaggtggtcctgggtggggagcacatctcctttgccaccaccaagctggggtctctcctccaggtccagtccagcaaggacccagagggcctcagggtcttctactacctgatccaggtgggcggggaggggtgctcgggacttgcatgaatagacctgcagaattgtggcacctgctgattgaaagtcccggccgagtatcgcatcgcgaaagcctagctctcagcacccatcccaccctgtgcaggacctcaaagcactcgtcttctcactggtgtcatcgcatttcaagatccagcccatccagcggtgactgtgagcaagctgaccttcccctgtgccctttcttcagctgtaacagtgattcccgtcatgaactatggtggggacgatgggtagtgcggaggaattttgagctcgagcaaggggtccagcgcgcgcgattcggatctcacacaccatggcattgagtgggaagatcgactgaacctgctcgagcgatggcactcaggcgtgccctgtgagccagtctacaaccgatctcatgccagggttttagtatttgtattgttcccaaagagaatcctggtaagccgctacgcatcagaagtccgtgcccaggagtcgcgctcgacctctcaaggaggaggccggcttcctgcactgcaatggatggggaggacgccatcgacacgttcatggccctcaccaatgctcccaggtgagtcgatccctcatccgatgtgcgcgcaggtcatggcatgtgtgattcttgaaagcccctgtccactgcaggacacatgtgtgtatctcgatttctgccgtcccatgacataggcacgtggcccagcatgtacttgacgcccatgctggcgacctggaggctggcgtcagcttctacctggagggaggcggcgtgggccacggcgtgaccggcccgagcggcagcctggatcccgttctgtataccgccgcactgtctgcgcaggaacagccgaggagcagccctctcacagtgaggagctgggtggatgtactctcgagggagcagctgacggtggcgaggggttatccgagcagccctcgagcacatggtagacgtggtgatcacgtcacttttgtgtaacgaaccgcagcatgcgcacagctcgtgtaaaggcatccacccccagagccccaacccccgcgcccctcaggcatttgggagcgacgaatgggacatgattcctgcttccccacgaggccctgaggagtcgggtgctctccatggggagggggaggaggaggaggtggaggaggaggacgacgagcttcaggtcctcagcagcaacctgccacacacgcgcgctgccacgtcagcacgggcccaggcggcacgtggcgcgccgcccagggtcccctcccccgacgagggccggcgccggctgcgcaggaacaggccgggtcgggccgccgcggccgcgtcctgggcgccagagggcgggtccacggaggaggagggcgaggggcc

SEQ ID NO: 39391 - DNA, 80 bp, Chlorella protothecoides
gatcagaacacgcgcagcatgatcttcgtcgtttatggtggcgagggttccaaacagagcagtgctgaggaggacaaagg

SEQ ID NO: 39392 - DNA, 395 bp, Chlorella protothecoides
  modified_base (96)..(330): a, c, t, g, unknown or other
tctgccccatcctcgatcgcgtgttcaaacggacgccccacctccttcacaggtgcactcaaaatacccgtggccctgcgccgccccacccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttcactctcaccaggggcgaagaagggtcgcccggcgtaggatccaacataccactccgcg

SEQ ID NO: 39393 - DNA, 102 bp, Chlorella protothecoides
gggcttcaccgccggcaccgccgaggtgtcttaaggcggtggcggagtggttgggggagcggccgcgggttgtgcgggggagcggtgggagctgccccgagg

SEQ ID NO: 39394 - DNA, 73 bp, Chlorella protothecoides
cttgacctgcggagaggcaggggacaggcgaaatgagaggggcctggggagaggcgtgacaacggggaagagc

SEQ ID NO: 39395 - DNA, 209 bp, Chlorella protothecoides
gtgatggggaggggggtgtttacgggaggggttggagctttgtggtggtttgggaggcggacgtggaatggcaccatacgaacctgccgctttcgattatggggggatgcggtggccgctgcctgctgcccgctcgaccgaccccgcccgaccccaccgtgttcaccttttccaatcttccccccctgccagctgtcggagatcgcgcg

SEQ ID NO: 39396 - DNA, 62 bp, Chlorella protothecoides
ccgtggcgccggccccagcgctcatgtctcttttccccccttgctctcccgtctaccaggcc

SEQ ID NO: 39397 - DNA, 69 bp, Chlorella protothecoides
cgagcacatggtcatgtgagcggctggaccaggggggtgcctgatcccagcttcagactcagcgcatgg

SEQ ID NO: 39398 - DNA, 99 bp, Chlorella protothecoides
aggatcgaggtcccatggagggtgtgaaagtgtcccgctgtccatcgagcctgtggccagggagtgggtcgccatgcaggcgggctgtgcctgccacgt

SEQ ID NO: 39399 - DNA, 116 bp, Chlorella protothecoides
ccacaagtattccatgttggaggggtctgctgcgtccagacctgggtgtgggcagaggaggcttgggataccaggtgccagccgccgaggcgggagcaacgaggggctggagtctg

SEQ ID NO: 39400 - DNA, 64 bp, Chlorella protothecoides
ggaccacatgcgcggcatggggcggcgggccgctgcggccgccttgctcaagcacggcaaggtg

SEQ ID NO: 39401 - DNA, 61 bp, Chlorella protothecoides
tacccggacggccatgcagcggaggcagggtgcggcccgagggagcagtccatgtccctga

SEQ ID NO: 39402 - DNA, 7776 bp, Chlorella protothecoides
  modified_base (843)..(852): a, c, t, g, unknown or other
  modified_base (917)..(926): a, c, t, g, unknown or other
  modified_base (1278)..(1287): a, c, t, g, unknown or other
  modified_base (1686)..(1695): a, c, t, g, unknown or other
  modified_base (2291)..(2300): a, c, t, g, unknown or other
  modified_base (2686)..(2802): a, c, t, g, unknown or other
  modified_base (3021)..(3030): a, c, t, g, unknown or other
  modified_base (3840)..(3849): a, c, t, g, unknown or other
  modified_base (4810)..(4819): a, c, t, g, unknown or other
  modified_base (5020)..(5029): a, c, t, g, unknown or other
  modified_base (5301)..(5310): a, c, t, g, unknown or other
  modified_base (5428)..(5437): a, c, t, g, unknown or other
  modified_base (5766)..(5775): a, c, t, g, unknown or other
  modified_base (6066)..(6075): a, c, t, g, unknown or other
  modified_base (6205)..(6258): a, c, t, g, unknown or other
  modified_base (6449)..(6458): a, c, t, g, unknown or other
  modified_base (6539)..(6548): a, c, t, g, unknown or other
  modified_base (6629)..(6778): a, c, t, g, unknown or other
  modified_base (7590)..(7599): a, c, t, g, unknown or other
gcatcgcgcgcctgcgcgcggcggccggcgaggcgccgcccgctgcctccgcggccagcgtggcctggccgagcgctgccgtctagggggagctcacgcgcgcggcccccgggcccactaggcctcgcagccagcaatgcgcctgaaggcaaagctccgcacaccgcggcggtgaggacgccctcgatggggtcggcgcggccgtggatcggcatgcgccgccggcccatcgcgtgggcaccggggtggaggccgacgctgagactgtcccggacgccgccgtgcttgcgtcggtgctcagcctgtttgtgcggctcgcgtgcatgcgctggacgtggccgccaaagcttctgacgtcggggtcgggctcgaagcccgcgggccaaccgcccggaacgggggcctgctcgccgccggcatgttgttgacccgcatcagcaccaagtcggcctcgttcgtgacgtggctgccagtgcgctcgccactccttgtcgtctgtgcacacaaggttcagtcggatcctggcgaggtcatgaagagggtcgggctgaggcccacagcccgacgtcaaaaggtgactgtctccggccctgtcgcaacgtcgtcataatcgcatgtcgtggcctacagcaccaacatattgggtgtcattcagtgcatcactgcatcacctcctacgcgcgccgaggagtgctaaatgtttgcgcagcggcggccccaccacgaatcgtacggcatgggttcggcggcgacaagtcggcggcggcggcaaggcgcccgccgccgaactcaatggccttgttgcgcgcgtaaagcgctgcacagacgctgccgcgatgcgcnnnnnnnnnnagccgccgaacccaatggccttattgcgcgcgttaagcgctgcacagacgctgccgcgatgcgcnnnnnnnnnncgggtggttggatggtcgcggggtgtggcgcccgggacaagcgcacgccgtcgccccttgcagccgctgcatgacgctgccgccaagaagtctcatgacggacagtcgccgatcgtcgatggtgcattcacggagagcggcatgctggccagagttgccgtcaaacgcagcggtatccatccgaaatgaggtagcgaaatccctccaccggctcccctcgcaattgtacactcactccagtataaaaaggctatccagcttgggaacaatgcggtacgtgacaaacatttgtccctcaagaaaccaccaaatcctctgtctagtcttgcgagaggaacctcaagacatccannnnnnnnnncgccgtcaaacgcagcggtccccatccgaaatgaagtagcgaaatccctccaccggcttccctcgcaattgtacactcactccagtatatacaggctattcagcctcgggaacaatgcggtacgtgatacatattcgtccctcaagaaaccaccaaatcctctgtccagtcttgcgagaggaacctcaagacatccatgcttgtgctgtacatctttgattgggtatagaggcaaactgagaccacaacagcaagcattgctcaattgatctagcccaacagagcagtccttcacttcatacacaagttgtatcaggcaaataccatcgtgcaggagtattggagtctgtaggactgtatagaacttcgaatcgggaagtgaggttggagttgcccacnnnnnnnnnnatgtatcagtcaaataccatcgtgcaggagtactggagtctgtaggactgtatagtactttgaatcgggaagtgaggttggagttgcccacgagtgtcagctttatgtgcccatgtaatcggtgattattgcacttcccaacagtcttagaatgcggcctgggaacacatccgacagtccctgcaccccatgtcttatagtctgggagggaaagaaataaatcatccttgatgaccggcggtacagcccgatattcatccgaagcccgatctccttccccaacctgacggagaattgacgacatgatggcgggaagtccatgcagaattgttgagctcgtcgcacatccaagcattgcgcaatgccatggagggcgctccctgcaccacccacccctggtaacatcacttcttaaatgccgcactgtacaataatcccccatgccatgcacgctgtgagcccgatgcggggcatgtggctgacaagcgccaccctggtcagggctagacatgtgccacatgcagtcgggaagccggcccttcagaggcctggaggagaccccgttgtcataattggggctggactggccggactcnnnnnnnnnngaggcctagacacgtgccacatgcagtcgggaagcaggcccttcagaggcctggaggagaccccgtcgtcataattggggctggactggccggactcaacgctgctttgacccttgaggctgcaggtggggtcccagagatatcttgacagctagagtggctgagtcgagccttcaatgagtcatggctatccctgccccatcccccctgtcacctacccaggaagagaatgcgtggtcctggaggcacaggatggagtgggcgggcgtgtgaggacagacaggcacgaagggttcctgctggatcgcggcttccagatcttcctgacttcctatccggaagctcaggtgggtctgggcaatggggctgagagtcgtgatccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgaactccacccctttttcaatggggcggtcgtgaggacggcagatggggcgatgcataccgtggctgatcctttcaggtgagagttgggggtcttttggggacaaggagtggtcagagagggtgcacgccagcggcagcggctttaagattttgcgctgcccttggcagggggtaggacttgatggatattaccacctcaggctccaaggatgannnnnnnnnncctgcctttggcaggaggtgggacttgacggatattaccacctcaggctccaaggatgaaggcacattggccatgtcgacaaacagagccctgccccggtgggctggaccccccccccctcccagctgtctggaatgaatcacagtcgtacctgggagttatgccgcaagcaggaccggccctgcctcagattcccccgacccctcacgatatgtcctctccccccaaaatcatgacaggcatccggttccggggctcctctccctgctcaaccctgtgggatccccgctcgacaagctgcgggtcggcctccttcgcctgcggacccagctgacaggagcccagagcctgctggctaccagtcaggagaccaccaccttggagaggctgcaggcaaggcgcaggatggacagacgaagcctgattgtctgattgactcatgggcggctgccaaggatcatggtagtctgtggcggggtttgcactcgttcacccacctttatcggggggcgcgccgtcggtctcttccacacccacccttttctctctaatcttctcccaggcggagggcttcagcgacgtcatgatcgacgccttcttccgccccttcctgggcggcatcttcttcgatgctgggctccagacatccagccgtctcctcctctacgtgctgtgcatgctggcatccggtgagaggggggcttctgtgttggcatgtaccgaggatcaccgggagcttttaacggaatgtctagcactacaatgcactggatgcgggggaggcagcactgcgcggcggctgtgcgcatnnnnnnnnnnttgaggatcaccgggagcttttaatggaatgtccagcactactatgcactggatgcgggcgaggcagcactgcgcggcggctgtgcgcatgctccgaggccctccccccatgaatgcactccagggtcaaactgcctacctgccggcggcatcggcgccatcccagagcagctggcggccaggctgcgggcgcccgccctccgcctcaacacgcgggtgctgggcctgacacctggctccggcggctgggaggtgaagctgggggatggggagacgctgcacgcccccgccgccatcgtggccaccgaggggccagctgcgcggcagcttctgggagcccggctggcgccaaatcccagcgcggagggtccgggggtgggcagcatctgcctctacttcgccatggacggcggcccacccaggtaggcggggagggggggaaagggcaaccagggaggggtgtcaggagaggttcacctcatccggcggcgctgaagagatgggtagaggcgcgtctgcgcggatcaagctgcgctcgaccggggcggcagctgcgggtgcagtgtgtgagtgcccgccaatgacagcctcaacacgcccggccccaggtctggcccgtacctctttctcaacggcgacacccgcaccggcctggtgaacaacctgtgcttcccctcggaggtggtgccagggtatgcccccgagggccagtccctggcatctgtgtccgtgatcggagaccacgctgacctggacgacgctgcgctggagaaaagggtgcgcggccagctgtcctcctggttcggaggtgctgaggtggacaggtggcgccacctccgcacctatcgcatccccttctcccagcccggacaggtatctatggcatgtgtgttctctgctcgcaggttgtctgtgttgggggaccgggtatcgtggcgaaggagcagtgtctgccatttgnnnnnnnnnngctctgctcgtaggttgtctgcgtttggggggaccggatttcgtggcgaaggagcagtgtctgccatttgatgaacccacacgggtgggcagcgtatgcgggagaaggtgccaccctgtctgcttgatgttcatcaggcctcacaatcacctccttgaaacccttggaataaatcctgctctgccaataccccacccattnnnnnnnnnncatcacctccttgaaacccttggagcaaatcctgctctgccaataccccacccattctccattgtccaacccccaacctacctctgcagaggccaccatctgatttttcccgtcctgtgaaacttggggaaggcctgttcgtgtgtggagatcaccgcagccatgcaacttttgacggtgccctgacttctgggagactagccgccgaagctctgctccacgaaacctcgtgattgaaagtatgaccgcatgctaaggtggtgtaggcattnnnnnnnnnngctgctccacgaaacctcgtgattgaaaggatgaccgcatgctaaggtggtgtaggcatttgccgatgacatgatagatgtgatcagtcaatctctggagatggtggatgtagacgannnnnnnnnnaatgacatgatagatgtgatcaatcaatctctggagatggtggatgtagacgagagatttgaaagacctgacactgtactgtgcaagatgtgttccacgatcaccataatcacccaacagcttaggcggtgcacgttcattgcgcgccacattccggagagtggagcgagcccgcgccttggcctgttggcataattcaggtatgcgtgtctgtggaacgctatgttgatcaataggagacccttattgcatctgtttggctaattggcctacgagagggcaacgatcgacttttaccaatagagcgggttgtcggagtcttcggtgannnnnnnnnnagagacccttattgcatctgtttggataacttgcctccgagagggcaacgatcgacttttacgaatagagcgggttgtcggagtcttcggtgattgtgggcgcctcgacctctggctcaaatccaaagccttacccatctatcatccgctcttgagcttcagaagtgggtcggatgagtgcaggaggttcagggaccgtgtggatggaggcttctcctgtgccgaccgtgaaggtgcttcacccgtgctccacatcttggcccgcagtgcccttgacggacaacgcgtgcnnnnnnnnnnatgaaggtgcttcacccgtgctacacctcttgaccccgcagtgcccttgacggacaacgcgtgcttcaatagagtcaccaccggggccgccctgggcggcgcactgggggcctccatcggtgagaggccnnnnnnnnnnnnnnnnnnnnnnnnnnnnnnnnnnnnnnnnnnnnnnnnnnnnnnaattccaggctcattgtacggcacctttgaggcctttcggtatcggatcccaggcatgcagaagatccggtacattggcaagaccaccaccagcagtgccgcggtgagcaatgcagcagcgattggatgtcgtgtggtttgtgagcgacttggtccatgcgcgcctgtgagactcgtgcatctgcacccgnnnnnnnnnngtggtgtgtggatcaagcggcatggaggtttctggtgtttagccagttcacccagacgtcatgctgccatccaacctcccnnnnnnnnnnatggtgtgtggatcaagaggcatggcggtttctggtgtttagctgtttcgcccagacgtcatgctgccatccaacctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggtgtgagcgactcggtccctgtgcgcctgtgagactcgtgcatctgcacccgtggcactgattccctggtgcaaactccccgccacaggtgtttggtttgttcctgggtgctgggtctctcctgcactgcggccgttgaagcgaggggctcagatcagcagccgagcctgccggcctccagcacgaggcactctggccctgctgcagcccagctttcgcgcctgcctcttgctcagggtgctgggaatgcccatgcaggacctgctcccatgtggataggatcccgtgcaggacttgtggcggtttaaatcaagcttctagcaggagggtgccctgggtgggcagtgccaatagattcgggcaggtgcccgagcatgggatgggcattacgcggtgcgcaggagaagagggggaacaaaatgctcagagaaaggagaagcaagatcaacgatttcgtgggcggatggtcatggtatcaacgggggccgccccctcctgcacacggccgcccctgcccagacggtgcggcgtggcccccctgtgaccccgggggcgcccccagctttgggtgcagggactctacaggggatgcgagtaaacgcgccgcaggggcctgggggcatacgccggcggcgcccccgccccgcccccccgcgcctcctgctcgtgcccgtgcggcggctggaacgcagcccggtcccgctgctgctgctgctgctgctgccactccaacattgggcctggcggctggaaggggtgctgctggggcccggccgtatgggggaaggcctgtgcaaagggctctgcnnnnnnnnnnagtcccgctgctgctgctgctgctgctgctgccactccggcattgggcctggcggctggaagggatgctgctggggcccggccgcatgggggaaggcctgtgcaaagggctctgcctcccagccgtgcccctgcggcaggcggacagaccccagaggggcctgcgccgcaccctgcc

SEQ ID NO: 39403 - DNA, 61 bp, Chlorella protothecoides
ggaagccaatcgatgcgctgcccctgcaaacctgtgcctcctgacttacaccattacgcca

SEQ ID NO: 39404 - DNA, 70 bp, Chlorella protothecoides
tctcataacaaggacaaaaagccatgtgccgaccctgaaacccacctcctcggaacccgttcccactcac

SEQ ID NO: 39405 - DNA, 61 bp, Chlorella protothecoides
gaagagacagttggaccggctgccgcgggggattgggtactggctttccctggccctccga

SEQ ID NO: 39406 - DNA, 78 bp, Chlorella protothecoides
actgccacagcccgggcgatgggtgcgcaagctaggccacgggtgcccgggtcgccaggagacagtggctcctcggcc

SEQ ID NO: 39407 - DNA, 61 bp, Chlorella protothecoides
ttgaacccgcatcgggcggcgcaaccttgccatttcagccttcgccatggttccaggccct

SEQ ID NO: 39408 - DNA, 61 bp, Chlorella protothecoides
gccatcacctaaaattcatacatcacgcctgccctggatgcgcaggcaggggcctgcggtg

SEQ ID NO: 39409 - DNA, 125 bp, Chlorella protothecoides
ctgtgtgcactcacgcacaggggggctgggtatgcttaacccctcattcgacgtcatgcatttggagcctcctaggtctcccgcccaccgcttctctcccagccactttacacattctaatcata

SEQ ID NO: 39410 - DNA, 61 bp, Chlorella protothecoides
tgcataccttcacgtaggacactgaggggggggtgcagacgacagacttgtccttgtaatc

SEQ ID NO: 39411 - DNA, 61 bp, Chlorella protothecoides
cgaccccaggcgactgcgctggaccaatggaggggctcagctctcccttgcaatccattgt

SEQ ID NO: 39412 - DNA, 70 bp, Chlorella protothecoides
aatgccaggcacccgctacttggcccccccatcacatatgcccaccctgcgcatgttgttcttgggcagc

SEQ ID NO: 39413 - DNA, 61 bp, Chlorella protothecoides
ccgcgacctgcctgcccgacccagcggcggggatcatcgggaccactcccgtcacggggag

SEQ ID NO: 39414 - DNA, 61 bp, Chlorella protothecoides
atacatgctatatggctggttcgacccaggtcaccaagctggagtgctctcgactggcaca

SEQ ID NO: 39415 - DNA, 6002 bp, Chlorella protothecoides
  modified_base (2345)..(2354): a, c, t, g, unknown or other
  modified_base (3226)..(3235): a, c, t, g, unknown or other
  modified_base (3744)..(3753): a, c, t, g, unknown or other
  modified_base (3964)..(3973): a, c, t, g, unknown or other
  modified_base (4338)..(4347): a, c, t, g, unknown or other
  modified_base (4405)..(4441): a, c, t, g, unknown or other
  modified_base (5551)..(5560): a, c, t, g, unknown or other
ccgcgctgctggccggcgccgacggcggcctgggccccccggccgccatgctgagcctggcgcgcgaggccctggacaacctcaaggtcatctgaggtgatggagggcgccaaagctgctggaacaaggccggatgggccgtgcttttccacgtggccgcacccaaacctgccccattgccggcgcgacccctcccatccgaggagcaggcccccggccaaccccgtacgcgcattgcgttgcatgtgaaactccctgtgcattgaaacccagcgaccccccggcgatgtatgttctcacccttccattcgccgccccgcctcattgaagcccgccccgcgcatgcccctccccccccccgaaaagtatttgctggaatgtttgtcgccccgaggccagccactcgtcgccctcggtcccgctggcaggcctccctttgccgcttgcgcgtgctttcttggcatgcacgcctgtgttattctgacgccctgctgctggggcgccactgtaatatctccttgctgttggttggagggttcaagctgtgacgtcgaggtggtgacgggtaggacggaagggtgggacacagcgcgagctgggtgaggtgagcagagttgcagatgaccaagggtcctgggacacggcccggtgctccttcgagcagggcacacttgagtgcagcctcctttgttgtgacgcaggcttgtttccgctagggaaaaccaaggggactcgtctcaacaatggcctgcgcatgcccccgcctcacgacagctgctcgccggcttccagggcctgcgcctgctccaggatcctggcgacgtccatgggcgggtagtgctgcagcagcttcatgttggctgagaagtcgccctgtgcaggacacgggtgctagctgtcttcggtcgaggacatggtctgctttatatttccttccgcaagttacggtcccagggtgcgcttcgcttgcatgagggcacgtcgagacgtcacatatgccaaactctgatgccaaactccgctcttcaggctgtgctcacgctgtccctgctgcgccatcttcccctcatcattcccatggccctccccatcgcctagtcacctgcaggatgtcctgccgcacgatcacgagcatggcgaggcaaaagcgcaacaggtcctcgccgccgcgcgacccgcccgcgagcagcccgtcccagaggcgcaggctgtccgggaaggggaactcctgcgtcagcatcagcgtgatccagcggaaggcaaagtagtggggggccacgccgttgcggtccagcaggtgctccgccagctcagcgtccagcgcgcgtaggcggtcggccaggcgggccagcgttgccttaatcccggcggccgagtcgtccagctgctggcagaagtggtcccggcaccccgacaccagctccatgaagcagaagaaggcgtccgcctcggcgcggccccgctcctcctcatcggcagcacctgtgagggcgtcacgcaagaggtgggtcggaggggggccatgcattgcaacaccatggaagcaaacaacagcagttcctccatgaagaggagaatccaaacagcgagccacacctacagcatctacaccctgccaccggtgcccacccggtgcccacctgtgtaaaagacgtagtacaggggggccaggagctcgttcatgccttgcacatacttgatgccggggttgagctttgcataaatgaagagtgcgcgagacatggcctgcggatagtgcttggcttgctttattgttggcatgagatcatggtcctgctgcagctcagacaggggtcgcctgcctctgcatcccgcagaatcagcctcgcagcccttgcctgcctccaatcccaatccccctacaccctacaacctcaaacccaccctgcgatgctgcgtggcggcctctccctcgccgctgaagaagtggaggtcggggtgggtgcgcaagacatcgcgatctatctgagccagcatctcttcgtcctggaaacgctgccgccactggctgtcgggggcggcggacagcgggtgatcgccgtgtgggagggaggaccggctcagcgtgtcgggcgaggcggggaggggtgcggagccgagaggggtgggagagctggcgtgggacctgccaaactcctgccatggatttgtgtgatcgagggaaaggaggatgcttgtggaggggctcgtggggtgcatttgaatgatcggagacaagcaacgtcattgaaacgcaacctgcgccgcgaacatggctgacgtagagctagccgtcgtgctgaagtttgggttttccagcttgccattccacatctttctcgttnnnnnnnnnngtgacgtagagctagccgtcatgctgaaatttgggttctccagcttgccattccacatctttcccgttgcctcgcaccgctaccttgatgaagtgttcgtactccgcccgtttccgatccagatgccgcgctctagcagctttgacgactggaaggtaccccaggcacagctgggtagtggagtaggaatgagaaaggtgacactcccaaagatgtagaaggagcatgggtatcagatgcgaccccgttcaagatggagaagcaatcgagtgcaacgacaagttctttgtgagctggcgatgttactgtccgacaaggatctctaccttccagactgtagatcgtaggcccttgacttccggaactccctgggctgccaaggccctcagccgtgccatatccactcgaggctcagcaaggacatcggtaaatgcttggacacccgctcttgctgattgagctccagcttcgagcgctggctcagacatcggagctctcggctggtgctacaagagatcagtcacccccccggacagagcaccatcgcttcactgagcatccagcagctgcaatgccaatttatgaagaacctgttccgatgtttgaggagactcacatcgatctgtgacagcgggcacaggactgtgtcttcaagcatatatgtatcacacacggcagcgcgcccgcgcgttcccccggtgatatgacatagggctggaggctgctgtaaagttgacttacacataggtcatggagatgtgttggcgttgaaagggtctgaagtgctggcgctaccaatgagagaagtgaaatattatgctcctgcagatcgtggaggtcccctaccgcatcaaggttgcatcgtgcacaannnnnnnnnnaagaagtgaaatattatgctcctgcaaatcttggaggtcctaccgcatcaaggttgcatcgtgcacaaaacgattggtgtggagcatgcagcacgctcccatacacaacagcgcggttcaaagtgacaaacagttcatggagtgtaaaatttgtaagcagtgccatggtagtgtgaccaggccataatgtccctgcacctgtcgagcctatttcttcccgccacacttccgatcgtgttttggcaatcgaactcctttcgaacaaagggcgacggcctccgacagactccctcgatagacatccggaacacagcgcagatacaccagccacgcggtgcatgtctaggatccactgagagaaacagaagaggcagttactcggcctcacgccaccctggcatgatggtgcgcccaggcagagccacagtccgtaaaggaaagggcttgccggtcccgaggcaaccagctgcggaggacgtcatccaggacagccagccagaggatgaggnnnnnnnnnngggaaagggtttgccggtcccgaggcaactagctgcggaggacatcatccaggacagccagccagaggatgaggtgagtgattctaatgtgcaaatcgtgcagggcttcgccaggagtagacgtagatttccacatgggaaccccccaccccccctttgcacaggctgtggcaagcgtgttcccctcaccaccagccaagcgcgcaagagnnnnnnnnnncaatgtgtaaatcgtgcagggctttgccaggagtagacatagctttccacatgggaaccccccaccccccttttgcacaggctgtggcaagcgtgctcccctcaccaccagccaagcgcgcaagagtccgtcgcggcctcgaggcagcccagggggacgcggaaccccctgctggcaacaccagagccacacgaggcagggctgcacggtctgcagcccccgctgtgtcacctgctcgccacacacccgggccggttggggagcaggcagcgcagacgtcgggcctggtgaccctcagccccccgccgcagtcccccgtcacgactgccacctgcccgccgccgcccagtcccggcctgctcacnnnnnnnnnngcctgctggccgcacacctgagcgggctggggagcaggcagcgcagacgtcgggcctnnnnnnnnnnnnnnnnnnnnnnnnnnnnnnnnnnnnncattgaggagggttggtttgaactcccgtcgatgccaccaagggtgctttcaatgtcgcaatcgagctggagacgtttggcatacgctgggggcccttagaaatactatacatcgaagctgaacagagcccctcctgatcaaaaccaaaacccttgcagatggaccccctggaagccagcacaagcttcctgaccacacgcctgcagcggccgcgcagcccggaggccgccaccctggccctccgccccgcgctccaggccgtggtggcagacctggctgcctgcctggagggcaccgcctcacttggccacgcggcctccctcctgctggtcggaccgcggcagagcggcaagaccctggcggtggagcgcgcgctgcgcacgctgtgcgcccggcacaaccggggtgagggcgctgagcccagcgtgggggtggtgcgcctggcgggctgggcccacgccgaggaaagaacggctttccgagacacggcgcggcagctctgcgagtgagctgtagggaatggggggaggggggatgacagggttgaagttgagtgacaggaaggacgtcgtgctactggggtcaaggtaccttgagagtgcttgaggatacatgccagcaagggcgtgccagcaggattggagagcgatgctgagcatgaacttgagccagcacagcgcggtgcttgtgcgcagaccagagactgtgtacagcccgcccatggacacagcaaccacccatctcatacacccttgatgcacactctccatcgctacatgtgccacacgtatcctcatctccccacctaacccacgcagggccttcgactgcgtcttcaagcgctcggcctctgtcggagagaacatcgagttcctgcgggagatgctgcagtgcatctccaggtgggcgggtggctgggtgaggcgaggaagatgcctgctccccatgctattattttggactcgctccaccctcaccagctcaacccctcgtcctccatcgcccggccttaaagctcaatcacatcgtcgagagaaccaaccattccgtctcacacccgcccttccctccctccccctcatccctcaagggcccagaagacggtggtnnnnnnnnnncacactcaatcacatcatcgagagaaccaaccattccatttcacacccgccctttccctcctccccttcatccctcaagggcccagaagacggtggtctttgtgctcgacgagtttgacgcctgggcgcgccgcccgcgccagaccctgctctacggcctgctggacgccatctcctgcagcggcgtgcgcgcggcggtggtaggcaccactgtgcgcggcgacgcggtttccttgttggagaagcgcgtgcgcagccgcttcagccaccgcgtactgaccgtgccgcgcgtgggcgccaacgaggcgccgggcgtgctgcgcgcctggctggagccgccgcccggctggccgcatgcctgcacaactcgctgcgacccggccgccgcgctggccgcgccaggggtcagtgcggcgctgagacgcgccgcggcgcggcgcgg

SEQ ID NO: 39416 - DNA, 74 bp, Chlorella protothecoides
cagggcagcttgcagacccctttgcaccctagtgatgattgttgtggccattgtggcacctcaacatccccctt

SEQ ID NO: 39417 - DNA, 74 bp, Chlorella protothecoides
tgacctggagcaagcaggctcactcatctctgagtcgtggctgtgtcaccaaggtccacctgccctacctgtgc

SEQ ID NO: 39418 - DNA, 74 bp, Chlorella protothecoides
gggcatgcgcgaggcatgcgtgttcccatgaggggggccataccggcatgttgggagtgtttgtgtggctgctg

SEQ ID NO: 39419 - DNA, 61 bp, Chlorella protothecoides
ctgaggccctcctgcggctggctaccaggggctccctcattgcagtgaagggagtgcagga

SEQ ID NO: 39420 - DNA, 68 bp, Chlorella protothecoides
tgaagttgccctccttgctgcgccgcttcatactccagcacctctactcaccgccggcgcctgcgccc

SEQ ID NO: 39421 - DNA, 61 bp, Chlorella protothecoides
tcgcccgaactctgacccgactgcctcatcactggccaacctccccttcaagcctgccacc

SEQ ID NO: 39422 - DNA, 61 bp, Chlorella protothecoides
cgtctccgtcatgattgtggtccagggcatcctctcggtcctcctcggcgccatggtcgtt

SEQ ID NO: 39423 - DNA, 61 bp, Chlorella protothecoides
gcccaagcacgagcatgcagctgaagctttacctcccaattgcacctctatagcatatgac

SEQ ID NO: 39424 - DNA, 76 bp, Chlorella protothecoides
gctgcgtggcatgccgcccgaggtgctggctgccaagcaggctgcgctggcgcgggaggcctacaagcagtactgg

SEQ ID NO: 39425 - DNA, 61 bp, Chlorella protothecoides
ccccggccgccgcgcccgaccagccgcccctagcctcggtcactgacagcggcgcagcacc

SEQ ID NO: 39426 - DNA, 90 bp, Chlorella protothecoides
gaacgggctcgacccagcgggcatggatgtcgatttatcatttcccaacagggcagcattgactcgctggtcaactacaattccccttcc

SEQ ID NO: 39427 - DNA, 180 bp, Chlorella protothecoides
ggggggtgaaatgacatgagctctggagcttggaaccccctgactcatacaagactggccccgaaccctcaagacctgggacccagccagccagcactattgtctgcgaggccgttccacgaatgaatgctgcagggaagtacacataacccatgcccagcaatgcactaccacacacct

SEQ ID NO: 39428 - DNA, 97 bp, Chlorella protothecoides
cccctggcgtcaacggagcctgccatcaagaatctgcacatccctctgcctctgcgccaccgtgatcaatggagttcaagtccccatccccctcaat

SEQ ID NO: 39429 - DNA, 156 bp, Chlorella protothecoides
gccaggaagagcgtggccctggcctcctgcgacgatgtgggtgtgtgtgtggcacggagattcaggtttgaggggtcgaggccggctgtgccgcacctcaggtggaaggacaagggcactcgcggatggtcgcgaggtgcggcccgccgaatggag

SEQ ID NO: 39430 - DNA, 74 bp, Chlorella protothecoides
acaatgatgaggagcctcccccccacccacaccccaccacaccccacacacaggctaccaaacctaccagcagg

SEQ ID NO: 39431 - DNA, 65 bp, Chlorella protothecoides
gccttctccacgctgctggtggagagcgtgcgccacgcagacgccagctggcgcgaggcctggcc

SEQ ID NO: 39432 - DNA, 61 bp, Chlorella protothecoides
ggccaccgcggcgcgctgcaccgggtcggcgattcgatccaggtccaccatatcctcgtag

SEQ ID NO: 39433 - DNA, 78 bp, Chlorella protothecoides
tcagcggcctgctaagatcgagcgtcagatgggcatggtcccaccttaacgccgcccgccccccggctggagggccgg

SEQ ID NO: 39434 - DNA, 61 bp, Chlorella protothecoides
cccagccctgctcccacctatcttcttgccgaaccccaggtccagcaggcggtctgcctcg

SEQ ID NO: 39435 - DNA, 78 bp, Chlorella protothecoides
cttcaggtccatggggaagaagccggcctcatgcctgggtgtccaggtgggtgggatgcgtggttaagggatgcgagt

SEQ ID NO: 39436 - DNA, 68 bp, Chlorella protothecoides
tccccatcacaggcaccactcccgtgcacgaggagctggaacgggaacttgccagcttcctgggcaag

SEQ ID NO: 39437 - DNA, 65 bp, Chlorella protothecoides
tccccagctccagcttggcgttctgtcggatgtgacggaggagctccctcttgtagtaggtggcc

SEQ ID NO: 39438 - DNA, 63 bp, Chlorella protothecoides
catgcaagaggtttgtcctgcatggcgcacgactgagctcaatgccttgctgcaccctgcccg

SEQ ID NO: 39439 - DNA, 90 bp, Chlorella protothecoides
ctggataacttatcagcctgtcatgcttgcggtcgcggcagggacgtcgcaacctctgttatgcatgggcagcgaaggtctgctcagacc

SEQ ID NO: 39440 - DNA, 428 bp, Chlorella protothecoides
  modified_base (141)..(306): a, c, t, g, unknown or other
cggggcctggcgacgccgcggccgtgggcgcgcgcctcggctccgcgcccgggtcgctgcggctgagccgcgcgggcaccgccagccccatggacatgctgcgcgcggggagcctggagtcggacacctccttcctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcacgcgcagcgccggccctccgccgcgctggaccgcgcctactcccgctcctcggagcgcgacgccgcggggcggtggggcgggagcggcagcgacccggaggccatcgccgccgcc

SEQ ID NO: 39441 - DNA, 110 bp, Chlorella protothecoides
cccttggccaccatgtccttaccacccccctccccccccggggggccccgccgtcctaaaatcctcacctctgaggaaggcaaggtagtgcaggacgtaccccggctccg

SEQ ID NO: 39442 - DNA, 111 bp, Chlorella protothecoides
caggcaccgtgccctgaactcgttccccgccgcacgctcccacacacacacacacacacaccctcaatctccaaaatgtcagtgtagttcaggttctggccacccgcggcc

SEQ ID NO: 39443 - DNA, 131 bp, Chlorella protothecoides
cgccagcgtgtcaggcaagccgctggtgtacgctgtggggctggtcaccgcatgccgcacggcgctccgtgccgaccaggttctggggtcgcgagggtgaactcagaaggcatggccatgctcgcaacggg

SEQ ID NO: 39444 - DNA, 75 bp, Chlorella protothecoides
ggtcgcacgagcgtttgatacccggcctcctcccgagatttttaatctccgcaataagtgacacaatggggaagg

SEQ ID NO: 39445 - DNA, 73 bp, Chlorella protothecoides
catgcccctgcccaccaaactggggcgcaaccctgtgcatgtgcacacctcctcacctcgcctcctcacctcc

SEQ ID NO: 39446 - DNA, 74 bp, Chlorella protothecoides
cgtgtgccacgcagcttggagggcctcaacataaattgagggacccccccccccttcccccttcccaggttcgg

SEQ ID NO: 39447 - DNA, 13349 bp, Chlorella protothecoides
  modified_base (744)..(753): a, c, t, g, unknown or other
  modified_base (1285)..(1294): a, c, t, g, unknown or other
  modified_base (1516)..(1525): a, c, t, g, unknown or other
  modified_base (1947)..(1956): a, c, t, g, unknown or other
  modified_base (2270)..(2407): a, c, t, g, unknown or other
  modified_base (2487)..(2496): a, c, t, g, unknown or other
  modified_base (3708)..(3717): a, c, t, g, unknown or other
  modified_base (4492)..(4501): a, c, t, g, unknown or other
  modified_base (4840)..(4849): a, c, t, g, unknown or other
  modified_base (5315)..(5324): a, c, t, g, unknown or other
  modified_base (5700)..(5709): a, c, t, g, unknown or other
  modified_base (5925)..(5934): a, c, t, g, unknown or other
  modified_base (6367)..(6376): a, c, t, g, unknown or other
  modified_base (6791)..(6800): a, c, t, g, unknown or other
  modified_base (7131)..(7140): a, c, t, g, unknown or other
  modified_base (7195)..(7204): a, c, t, g, unknown or other
  modified_base (7282)..(7291): a, c, t, g, unknown or other
  modified_base (7474)..(7483): a, c, t, g, unknown or other
  modified_base (7734)..(7772): a, c, t, g, unknown or other
  modified_base (8307)..(8316): a, c, t, g, unknown or other
  modified_base (9466)..(9475): a, c, t, g, unknown or other
  modified_base (10312)..(10321): a, c, t, g, unknown or other
  modified_base (10699)..(10708): a, c, t, g, unknown or other
  modified_base (10929)..(10938): a, c, t, g, unknown or other
  modified_base (11543)..(11552): a, c, t, g, unknown or other
  modified_base (11980)..(11989): a, c, t, g, unknown or other
  modified_base (12715)..(12724): a, c, t, g, unknown or other
  modified_base (13050)..(13059): a, c, t, g, unknown or other
ggccagcgcgccgccggagcccgacgtcgcgccgccctcggcgtcgtaccacgcgcccgcggcgtccgcgccgggcgcgtcccccctcacgcgcaccgggtccaccgccacctcgtagctgacgcgggggtcggccaggctcagcacgtcgcctgggtgcagcacggtctcggtccaggggcgcaggcgcgcgccgttgatgtaggtgccattggtggaggacaggtcggccaccaccagctgcgcctccgcgtccgggccagcgcctcgcgtcagcacctccagccgcgcgtggctgccggagacggtggggtccaggaccaccacgtcggcgtcgccgtcgatcaccgcgcccagcacaaaggggccgggcgtggcggggagggggatggagtgggagggcaggggctgccccgccgcgcccagcagcgtgaccgggggggcggcggggatgtgggccagccgccagcggctgcccacggggacgctgccggggaaggactggagggagtcggggcggcgcgggagcgggcgctggggcttgctggacagcgtcacgcgctgggaggtgtcgggggcctcaccctggtcggaacgccgggcggaggggagggcgcgggggcgccggcgggggcgggtggggcgcgtgagcgccggcgcccccaagcaccacgccctggacccggggggtcctgtgtgacacgggacggcgtgaggcaagtcagggtccacggggcagtggtnnnnnnnnnncgagcgccggcgccccccagcaccacgccctggacccggggggtcctatgtgacacgggacggcgcgaggcaagtcagggtccacggggcagtggtaatgattgtgatcgtcaaattgagcagactatgggcctcgcctcacggccatcccactgcatcccgcctccttgcacgaggacgacctccacagggtgtcacccaccaccacaaccccatcgaccacgcgctcagcctcccgagacgcccgcttacctggccggaatgagggcacagcacagggctgaaaagcctgcacgtgtctagtcacggccatggatcacaggaggctgacactcgcgcacgggagccggtgcatggtgccgggagtcgggtagggtaggggggtgggttcacccggaatgcgcgccatgcgagaccccatctggtgctggcgaggaggtacacatcgcatggcagggattcgaggccctgcgagaatgctgcacgtgcagtgctgctggtcgggcatcgaaatcgtgaggactggagaccnnnnnnnnnnccatgccagggattcgagaccctgcgagtatgctgcacgtgcagtgctgctggccgggcatcgaaatcgtgaggactggagacccgattgtttgaggatggggagtttgatggatgagcgcgctggcgggagggcagcgtgtcgatcgtcaggcaactagaaacccctgcatgctcatcaagcatcgtcaacacggtcgtcaccacaatcggatgtggcctnnnnnnnnnnttcagagacccctgcatgctcatcaagcatcgtcatcacggtcgtcaccacaatcggatgtggccttcatggcagatggagggtttctgagagagtcctccccccccactggcggagcgctgccgctgtcggggcagggaggtcgggaaaaccccaccctcactgcccctcccccacgcccaccgccaccagactcagtggcagcctctggctgttccaggtgtacgagcctgagcttcaaccaggaatggctcgcagcattccatgtcgcgctgtgcaacacctgcaggcagaacgagaaactcgtcagcaaggtatttgtttgggagggaatcgcacacgtctggcccttttctacgcacgattcgacaacagaattgctatcgcttttttgcagagcacggccaggatccggtacaccnnnnnnnnnnctggttgggagggaatcgcaaacgtctactgtggcccttttctacgcacgattcgacaacataattgttttcgtttattgcagagcacggccaggatccggtacaccctgacagacagtgatctgaaaccgctggggagcctccgcaaggccaatccccaccgcaaggactggcagcccatgcacctatacatgcagtctcaggtgggggaggagcggtagtctgggatccaggcatgagttcctgatcacgaaggggaggatggttcaggatcccaacgatttgtatgtttcagttttcttcctcccccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccgggatagagaatagtgctgactgtctgcaagctggttgtgcacatgatgcatgctggcgtgccaccctctcacannnnnnnnnngcgaaggggaggttggttcaggatcccaacgacgtgtatgtttcagttttcttcctcccccaggtggaggaggtcgcgcgctccaagcacggtgatctggaccagatgctggacggtcatgccgccctggcggctgcaaagctcacagatgccatccgggtgggccagggaagatggtctccgggatagagattactgctgactgtctgcaagctggttgtgcacctgatgcatgctggcgtgccaccctctcacactttcaacacatgcgcattgcagaaacgtgaggaatccaagcatgcttcccagaggaaggctgctcgcatcttgagaattagggcagaaattcaggtgcagcggtggcctgcatcgtttggctggtgcatgaatgttgaggagatgatcgcccacctctggttgcgatgcctctgaatcgcccactcttttgctctgttccttcctgcccaggacaaggcacatgcccagaccgtgttccagcctggtgaggaggacgttgaggacctgtgatcgctcttgtcgtcaatgccatagtgtgtgggaatacggtcacctgactgagcgcatgatggtacatggtctggagaagccaggctggagaccaagcggtacccggtagcttccactgaacttgacacttcggaatgacaggtctggaagatggcggatgggcccatgcttggcttgcttgacgtgcagccaaaccgggtgcatggtggaataacatgcatggaaattggtttgcaacctggtttgggaattctttgtcgccatgtcacaggacgtccccccagaagagctcccaccacgaaacaagaccttggagagatgcatcctacgcctgcctgctggagctcaggcttctttgaaaagcatcaagacctgaagctgatgtggcaaggttggggagctgcacacatacgcgctagacctccttcatgctcgtgatccgtggctcctcagagtccctgctgtgaccatgcccctcccctgagcagtagccatcactgcgggtaagatccacagtcattctcaggcatcaagtgcccaccagacattatgctcctcctcgtctacacacggacggatacccatctctccctctggcggtagacagtgctgcagcctggagggccaacacatactcgtgcctcttgtccgttgtacttacgcaaggccattcagcattctgcnnnnnnnnnnacgtctacacacggacggatagccatctctccctctggcggtagacggcgctgcagcctggagggccagcagatactcatgcatcttgtccgttctacttgtgcaaggccattcagcattctgcaccctgccgctctggccccaggaagaaggtgctgcgcagttgacaaagaccagcacctcgcccatgtatgcacactgcgagggcagagcgtggagtgcgcaatccacatgtcaggcatccgtacccacacatcaggcatccgcgacttcggcctttgccgtcttcgagtcccagtccggcagactcctcgccgcctcgccgatgctagagatgagccgcctgacggccgtgttgttgcagcccttgggtggctgtgggaagtctgagggcggataatacgccatctgcaggttggcagtgaggaggaggggggggcgggatacttgagtgctcgtttgcgtacttgatttgcagtccccccatggcaaggacaagtctatagggcccctcctggccgggtcagcaccgcaggggcacgccgtcaatatgcgctgctttgagagcagcagggttgccaggccaccctgggcccgtgtcctctgctcccgcatcattgctgcgtcagcctcgtgtagacaagcccctgcccccctcggcccctgtgctcacataatcgcgcttgtcaaagtgccaggccccgatctttccgggggtgaacgcccccttctccgagaagtcgctgccataggtgaagtggatgatgtatatgtnnnnnnnnnncacgcatcattgctgcgtcagcctcatgtagacaagcccctgccctcctcggcccctgtgctcacatagtcgcgcttgtcaaagtgccaggccccgatcttcccgggggtgaacgcccccttttccgagaaatcgttgccataggtgaagtggatgatgtatatgtgcgtgccatcctgaggggtgtggagaggggccagagcagaggtggcgcaggtcgtctgggtgcggggttcttgcagaggtgatcgccggggtggatgcctctttccaggggttcgacaccggcatggggagccagcccgcaggccaccctcatcacagccccggcccttcctnnnnnnnnnncgagaggggccagagcagaggtggcgcaggacgtctgggtgcggggttcttgcagaggcgatcgccggggtggatgcctcttcccaggggtccgacgccggcatgccgagcaagcccgcatgccaccctcatcacagccccggcccttcctgcgcacctcaaaggagagccggtcgtcccaggggggctgaatcatgagctccttgtgcagatcgtagcggatgggccctccatccgccgtggccgaagcgatgctgtatgcatacctgcagggatggtgcggcaccgggaggggaggggggaagggcttgtgtgggacagcccacctggacctgcggccgtgggtgaagatggcagggcaggggcctggccctgggagggcgcgtgcccagaaagatatcagtggtacaggttttgctggggcgcattggtcagggggacgcacgggctcagatgggagtgcagnnnnnnnnnnacatctggacctgtggccgtgggtgaagatggcagaggaggggcctggctttaggagggcgcgtgcccagaagatatcagtggtacaggttttgctggagcgcattggtcacggggacgcacgggctcagatgggagtgcagtcccctgcctcctcgagagcacgggtatagcaccagatctccccctcgccatgtgcgggatggtcatccgagcggcacaggccggcacacaagcagggcagacacgcagcgatcatcagcttaaagctcgtgggcgtcaggcatggtcagcagggatgccaatggggcatgccacgccaaggagcagcaggcgtctcgcccatggaccgacacccggcgcaggcatgcgcctcnnnnnnnnnntacacaaacagggcagacacgcagcgatcatcagcttgaagctggtgggcgtcaggcacggtcagcagggatgccaatggggcacgccacgcccaggagcagcaggcgtctcgcccacggaccgacacccggcgcaggcatgcgcctcccccgggttccccgccctcgtagcccggccacccgagagctgccccccttccttgtctcacatctccnnnnnnnnnngggttccccgccctcgtaacccagccacccgacagctgccccccttccttgtctcacatctcctggacccagccaaactccttgtcggcctcgtggtctgccttgatggccaggctcgtgttcacccacaggtccacaatggacgcaaactggtccttgtggatcatgaccggcgagttccctgggggtgggcgagcggggggccgggagtgaggggaggagtgggtcccaggcatctgaatgctgaccctccgcatggcaccagtcccacacacccctttgaccccggaaatgccagatgatgtcgccatccagccagtcgtgtgcggcaccgcgcgaatgcaggcagactgggacggtgcctgggtccgagcagaccggccctggcgcacgggtccgagaggaacctggagcacccatctgcccccagctnnnnnnnnnnccgcagctccgccgccaggccggcagcgggggcctggcgcccgcgccgcgcgcgcacggcgtgcacggggtaggggtgggcggccatgatgaccaggcccgccgcgtcgtcgcgatggctgcgcagcagcgtgaggatgccgtactgcgcgtcggtcagcaccacgttgccctgggcaaagaactccaggatgaggtggtgcgcggcctcgcccgtgccaaaggtgagctgcaccatgcggtcgatgcccagctgccggattgaagccacgcgccgcgtgcgcatgtgcttgcgcagcttcagggtgaagttggagggggtgtcgcccttcacgggcatgccctggaagataaggaggaagggcgggggggggcagggaggatatgagaccaggagtcggggggcaggaggatgnnnnnnnnnncaccgatgggctcaaactggtcgatggggacgttcttggggttgaacttgttgatgatgctcgcaaaacgcgtgggttcgatgtagaagaaggcgaaggcggcgggcctgtgtgcgaggaaggggggggggggggggggggcaagggaggatgtgagaccaggagtcggggggcaggaggatggcgagggagattgtctgccacgagcagcacaccagatgaagatgagcggaggtgcccgtgcaactccctctcgctgcccagggggctgccgcgtcatccagacccgatacaccgctccaagccgcaccatccgccccagcccgcaccnnnnnnnnnngcatcccgacctgatacaccgctgcaagccgcaccatccgccccagcccgcaccnnnnnnnnnnaccggccatgagttccttgcgagcgggacctggcccgtcagcatgcgagacgcctgcccggaaaagggcagcaggcgnnnnnnnnnncccggccatgaattcccttgcgtgcgggacctggcccgtcagcatgccagacgcctgcccggaaaagggcagcaggcggacgccagggcgaggggcagaccatgccccgaaggagccgtctcaccccgagcagcccttgtcatcctccacaccgctcctcggcacctggtgggcgtcgcccannnnnnnnnnagaagtagccgtctcgccccgagcacccctggccatcctccaccacgctcctcggcacctggtgggcgtcgcccagagcgggggcggcagcacgaagacatggtctggctcggacatgaggatgtagggctccgggatctgggcggcgtagcgccgcacccactgctggaaggccaggggacgttccagcaccacgtagccctggcgtggggtgagggggggggaaggggcgggtgcaatggattgcatgnnnnnnnnnnnnnnnnnnnnnnnnnnnnnnnnnnnnnnncccttgcggccagggccaccagctgccagggacagagcgtcgatgggatggcgcgcctgtccttggcaacaaggagcggctcatgcagcgaggaagccgctgcacgcccccggagcgactgatatgcatcgttttgccccaggacagacacagcctcttgcacgacaggggaatgacgcaggcgcactgacctgtgccagcttggcgatgtcctctggcatggggtccacgacgacagaggggatctcctccatgtactcatcggcgacgccactggggtgggtcaggtggaaaattgacaacgagcaggcgccggtcatgggcagcataggctggcacagtcgccccgccggcgcagcagtggatgccgtgtcgctgtgttgtgctcttcctctcccttagcacagcagggaaagtcccccaacagccccgcctccagctctggcgccccgttttgttcctatatttaaacccctccccttcctctcccccccatttccaactaaacctacccgtggatgatgcgggtgaagcnnnnnnnnnnactgtgttgtactcttcctctcccttagcacagcaggaaaagtcccccaccagccccgcctccagctgtggcgccccgttttgttcctatcttcaaccccctccccttcctctccccccctttccaactaaaacctacccgtggatgatgcgggtgaagccacccatagcgctgtccgggtacagcgccttcatgcgcttgtaccagtagtagcacacgcggctctgccatgtgacgtagatcccgccgttcatcgtcaccaggacatggtacttgtcagaccctgagggggccaccagccccgggatcccggagtcggcggcagggttctccatccacggctccggcgggcggtcgcccgccgccgcacgctcgcggcgcgcggccgccgcggccgccgcagcccgttccaaagcggcgtccacctccttctgctgggcctcctcgtccacctcggccccctcggtcggctcgaccacctcggccccctcagtcgcagcctgctgatccgcctggtcaccggctgtgctgacggcctgaaaagcaagacaggacagggtcgtggtcagcatgccgtgacgcccacatccacctgctccatgcactgctaatatatttgctacatatgacgctgacgtgcatctgcagggcctgcactgtgcacaggctatgacccttgaccgtcagccagccacgcacacctctggagcgccggtgacgaagctgtgctccacaaactccggattcaagccatgatctaccgggagacacagggtgctgcttggctcggaacatatcacatatacggatcatgacaaaggcatcaccccgaaggacaccacacccccgcctcacctcctccgacagccttcatctgtaggccgtgtggtgcgaagctgagagccgccagaccaattcccaacagcaccgtgcatagaatgatgtgtcgataggccccacctctgtggcgtgggccgaccgacctgaattttgccatcgcctggggcgggtccaagggtgtcactgccgggtctctggattatgctggactccgtacagaaaactccaataaataagatgtattcggatgtgagagattcaaagtattggaagtgagccgaggtatggtcggccaagccgtcgagagatnnnnnnnnnntagaaaactccaataaatgaggtgtattcggatgtgagagattcaaagtatcggaagtgagctgaggtatggtcggccaagccgtcgagagatcctgtggcctgggtctcaggagtgctcagaccggcccaggcgtagtggtcaatctgtcaagagggtgtaggaattgatgtgcgtatgctcaattcacatgcccccgtaaaaccgcgccagtcggagaatggtctgcaatgtggagacccccggacgctaacaaaactgaaaatagggcgcgcgtcaaactgttggtcggcccttcccctggatccacgagatgtaggtgtagtgtgcagtttacaaccggcgatgtatgatgcagttcgagggtctcgtcaaggaccgctacagaaggggggagtgaaaggctgcgagctgggtatcaaaacctcgcattgatatgccagcatgtgagaagtgggtcttcatttttgttcgtggaggtggtatcactctccagaaggattggttctcttctattcttcgtattgagtcgatgctctcaaggttgtggcgtactgtgggggctttttttcgcccctccacacctcacaagggtcgcagcaccaccaccttggtccgaggttggggctggtcttcagcgtggactggtgggctgtggccagcagtgctggagctggccatcacttccgacagtgtcagggaccgtctcaccacagggggctcttccatgtcacctgcaccaggagagtacactgctggctgagaaaaggctgagaaatttctagtgagcacttccacctcccaccacacactcgtgacccctgcatgttctgtccnnnnnnnnnncgtcacctgcaccaggagagtacaatgctggctgagaaacggcttggaagattcaggtaagcacttccaccttccattacacactcgtgacccctgcatgttctgtccgccctacctcttgatgcgagggggctggggaggggcgctctctgcgcgatcctcaggtggggctgccatgccatttgagactcggccgacccagcccaccacttgtcgggccccgaggaggccggctgcttcccgagggctgcagtctccgaggcgttcgcggcaactcgtgggaagaaaccatcagcctccccgtatcctggtgatccgttgctttggagacttgaggtggcaactttgtgatggctgccgaccttcagtgctggaagnnnnnnnnnntgagggctgcagtctccgaggcattcatggcaactcgtgggaagaaaccatcagcctccccgcatcctggtgatgcattgctttggagacttgaggtggcgacttcgtgatggctgccgaccttcagtgctggaagagcctgctgctgcgcgtcaaagccgacggtggtggggaaagaagatggggtggtagctgaggaagtacgtcccccacctgctgcnnnnnnnnnntatcaaagccgacggtggtggggaaagaaggtggggtggaagctgaggaagtacgtcccccacctgctgcccagttccagtcccccgaagccccgctgctgaagctaaaggaagaggtgctggtggccgtgctcttgctccgccacgctcgcgggctgcgcgtgtgcaaggggaaagacgggaggggtgttgacatttcggaggctgcgaagaggccagcccgggacgggtccggtggcggtatttgatgaatttgttccacgttataaagctttcggacctggagatgggcggtcgggacagggacccgcccagcgaagccaagtcactgcttttgaatggtggtttcggagcactccgggtcgttccgcgcatggtgtggaggagtccctcgaccgcaacacagtcactactcagcgatctgagcatgttcggcaacgtggttccgtcttactggcctgtactcgcagaggatgtgtacggagacatgaaacatgggctcccaagcttatgaactcaatctaacttgtatacaaatgtattgatttgtatggcaatgtctcacggtatgccaaatgtaggggctgctgcgagttcaacaactnnnnnnnnnnacaacgtagctccgtctcactggcctgtactcgcagaggatgggtacggaaacatgaaacataggctcccaagcgtatgaactcaatctaacttgtgtacacatgtattgatttgcatggcaatgtctcacggtatggccaatgtaggggctgctgcgagttcaacaactccccaggttccgcggaggtgtttggtgggtggccgagctcgccactaggctcgccctgccgcgtcagcagcgagcgaccacgcacgagttacccaaggggggcagacaacttgcccatgcctacctcaaaaattcaagctgactctccacccacagcaatagatctcccagccgtttggactggagccctccagtggaaaccaacaggattctgttggctcgcacccgagctcgtccgggcctcgggcctgaagggannnnnnnnnncttggcactggagccctccagtggaaacctacaggattctgttggctcgcacctgagctcgtccgggcctcgggcctgaagggaacgaagctcagttgcctggaatttcagcactctccaacgttatttggaatggtttgcggaagcgtctgacaccgtcgagcctgttccccgctcgacgtcgggatggccacgacagcctcgctcccagccctgctccagcgacgacgccgggagctgctcctggcggccggcgtggcggtcatcggctatgccggctaccgagcataccactctgacacggtagcggcctggcggcgtgccctggggaggctgggttccctgctggactccgcctccgacaccgtggcctccggctccgacctcaccggctgcctggtgagggatgtgcgggactacctgggttcggaggacgacgccgccctgccgccccgcctgaggcagctggcagccctgctccagtcaccggaggtgggggcggccacgtcgcacaccatcgccgccatctgggcaggcgtgcaggacggtgcgtacctatggctggggcttgttcggggtcctttaacttacaggggttgttgggccacgagcatgcgccctctgaggactggcccgcgcctggcgggcaggtgtaaaacaaccctccaaacctgcacctctcctcctcatctttcccccccgcacaaaaccctgtcaccgcaccgnnnnnnnnnncaataaccctccacacttgcacctctcctcgtcatcttttccccccgcacaaaaccctgtcaccgcaccgcaggttcctcctctggcaaagagtccatgggcccagacctgttggaccgcatcctggccgccgtgatgagcgagaaggggcagtccctcgtgtccctggccgtggccctgggcgcccgcaacctggcggctggagcctgcgaggcccggcgcgccgcgccgggcgcttcccccgccgacccctgcgccgctcccgccgaccctgacgcactggaccgcgtgctgagctggctgggctcggccgggggccagcgcgnnnnnnnnnncgccgaccccggcgccgctcccgccgaccccgacgcgctggaccgcgtgctgggctggctgggctcggccgggggccagcgcgcggcacggcgcatgctgggcacgctggccgccgccagcgtcggcgtgtactgcgaccgcacgctggacatcaacgtcttcgaccagctgctcgccgcactggcctcgcgcgcggagcacatgggcgtggcgcgcgcctgcatcagcacgatggcccgcgagacggtgcgcgccgcggtgttcccgccgctgcacgcccatgcgggcc

SEQ ID NO: 39448 - DNA, 113 bp, Chlorella protothecoides
ggtgtcgttgaaggaggcgaagatgtgggcgacgccccacaccagctcgccctccctgcggattggtagaatgaggtgagggggtgatgaccaggggagcatcgcattggcgt

SEQ ID NO: 39449 - DNA, 61 bp, Chlorella protothecoides
ccctatggcctcgccgaggggtgagtggcgcggcagggggaggtcgtggtgggtacccgac

SEQ ID NO: 39450 - DNA, 63 bp, Chlorella protothecoides
ggggccaagcggcgggagggggtcattgcggattggcagccccacaggggcgggcactgtgtc

SEQ ID NO: 39451 - DNA, 114 bp, Chlorella protothecoides
aactcaaagtgtgcagctcctcgctcagatgacatggttacatccccacgtcgatcttcccttccctctcaaaggtgatttggcgtccctgtgagggcaatgagctgcggcttg

SEQ ID NO: 39452 - DNA, 68 bp, Chlorella protothecoides
ctgagcgcttcctgcgccccgccgaaccctacacccagcccgtaaaaaccaaggagtgatggccaggg

SEQ ID NO: 39453 - DNA, 61 bp, Chlorella protothecoides
agaagaggggtggatgcaggagggtctggggggggctgcccatgcaccttgtcagccagca

SEQ ID NO: 39454 - DNA, 14354 bp, Chlorella protothecoides
  modified_base (148)..(157): a, c, t, g, unknown or other
  modified_base (2481)..(2490): a, c, t, g, unknown or other
  modified_base (2742)..(2751): a, c, t, g, unknown or other
  modified_base (2853)..(2862): a, c, t, g, unknown or other
  modified_base (4451)..(4460): a, c, t, g, unknown or other
  modified_base (4566)..(4575): a, c, t, g, unknown or other
  modified_base (4646)..(4655): a, c, t, g, unknown or other
  modified_base (5675)..(5684): a, c, t, g, unknown or other
  modified_base (6191)..(6200): a, c, t, g, unknown or other
  modified_base (7183)..(7192): a, c, t, g, unknown or other
  modified_base (7639)..(7648): a, c, t, g, unknown or other
  modified_base (7745)..(7754): a, c, t, g, unknown or other
  modified_base (7846)..(7855): a, c, t, g, unknown or other
  modified_base (8490)..(8499): a, c, t, g, unknown or other
  modified_base (8958)..(8967): a, c, t, g, unknown or other
  modified_base (9494)..(9503): a, c, t, g, unknown or other
  modified_base (9594)..(9603): a, c, t, g, unknown or other
  modified_base (10230)..(10239): a, c, t, g, unknown or other
  modified_base (10749)..(10758): a, c, t, g, unknown or other
  modified_base (11192)..(11201): a, c, t, g, unknown or other
  modified_base (11675)..(11684): a, c, t, g, unknown or other
  modified_base (12147)..(12156): a, c, t, g, unknown or other
  modified_base (12739)..(12748): a, c, t, g, unknown or other
  modified_base (13624)..(13633): a, c, t, g, unknown or other
gggaggggggggagggggcgcggtggggaatggtatagaaggatggtccgatgttgcgtggcaagatggggtggcgtgcaccgacttggcccacggcgagaccaccgacattcagtactccccacacaccgcgatcccccgcaacacnnnnnnnnnncacagcgagaccaccgacatccagtcctccccacacaccgcgatcccccgcaacaccatgccatccacggctcgcctgcttccacagcgcaccccgcggtggcccctgcggccagcaggcccagggagacccgccactggggcacccctgggggcagggacggcgcgggagactccaggctgctggcaatggtgaacactgggggtggcagggggtgcctccgccggccggcaccctcgcccgcgccggaggccatggacgcgctggcgaagggctgtacgcgccctgccttcccccgtgagcgaggcgcgaccctgcggaggaggggccggctcacatccaccagctcgaaggcatgcggctcgaggctgaccctccccgctctcctccgatcactggggatgagcatggacatggcgcgtcctggaaactctgcacaatgtcaatgggcgtggcgcgggcctgaagcgcggtgtggcgcccagagcattgcactgcccgatcgcgtcgaccaggggatcgcagcacgcgcagctgcgcagcacacgggagcgctcgcatgccggagatctttttgtgacgaaccgaaaccagtgtaggaatatttggaacccttcagaagctcaaccttgtttcttttcggttcaagtgaattgctaggtgcatccactgccaccagaacgtgtgagaggcgccgacacggcaggaacctggagcttcgtgcttgctcgacaggggcgatgtgattgaagcccttggattttcgatccccaccaaagtcctgttgggacgctgaactcgcccgtcccatcctccagcaagctgctggggctcacgggctgcctgctggctgccggtgcgaggcgttgagccgggccgaaagggcgcgggacctgcaccatggtcctcataggcaccgccaccctcaccgggtctcggtacggcaacctgaaccaggactttgtggtgagtgcctgggagcggcgggtcgggggcacgggccgcggccggaatatacccgcaatgggagttggcgcgtgggaggcgaacagcatgagcatgaactgttttttaccgggcaggtgcagatccgggctgcctgagatgtcgcccgcccccattacttctcatggattggtgcatgtcagggtgcactcgggcattcgagcatcctggagcacatgtgctccacaccccggcttagattccatcccaccccgccccgatcccgccagtcacccccttccgttctcccccctctccaaccctcctccttcccctttgcaggtggtggagcagctgctgaccgcgcggcagatgaaggccctgaagctgccgcagtgctacgtggcggccgtgctggacgggcacgggatgctgggcgaggacgcctcgcgcgaggcggggcgcgccatcgccgcctcgctccgcgccgcgcccgcgctgcacacgcgcggtctggcggcgctgtccgacgcggaggtggaggcgctgctgggcgcggccttccaggcggggcacaaggccgcgctgggcattgccgcacacgcgccgggggtgtacacctacccgcgcggcgcgcgcggcgcgcagacctacgtgctcaagtccctggacggcggggacaaggcgtacatcgacccccacctcggcgcgcgcatcctggagtacggcaccaccgccacggtggcgctggtgcagggccgcgcgctggcgctggccaacgtgggcgacagcctggcggtcgtggggcgcgaggagggcggcgcctaccacgtggacctggtgtccacgcgccactacggcgccgacccgggggagcgcgcgcggctggcggccgaggtgggcgacgccgtggcggtggagagcgaggacgggtacatcagcgtgcgggaggggcgcatgcgcggctaccagctggccatgacgcgcgcgctggggcaccgcctgctcagcaagctcggcgtgtcgcaggccccctccgtggtgcggcgcacgctggggccggacgacctctgcctcatcctggcctccgacggcgtgtgggaggtgttctccccctccgaggccgtcctcacgctgtgcgaccacctggccgcggggcactccgcgccggaggccgcgctggacctcgtacgcaccgcggtggaggtcagcgacggcaccaacgtggacatcggggcggacaacaccaccgccgccgtgtttgtcttcgacgacctcctggactgaggagactgtgcgtgtcgcgcgccggcgcaccgccccgcgaggggcgcagggcgggacccgtcgcgctcctcagccaccacgacgatgtcggnnnnnnnnnntgacgacctcctggactgaggagactgtgtgtgtcgcgcgccggcgcaccgccccgcaaggggcgcagggcgggacccggcgcgctcctcagccaccacgacgatgtcggtcccgccgccggcgtgcgcgggagtcgttgcacgggagcgccaggccccgagccgctgactttaaacaggaggagacgttgtggcgggtcccgaacgcctgggcgccgggacgcgcgatcccctgggttccccccacccccnnnnnnnnnntggaatcctcgcatcaaaccacaaccccagctggcgcgaaataaattcacaggcatggtgaaccttctcaccacgtccccagtcagaccttgtacaagtatnnnnnnnnnncccattggaccttcgttggtacgtaccagacattcctgcatgctgccccacttcttcgccccggaatcctcgcatcaaatcacaaccccagcttgcgcgaaataaaatcacaggcatggtgaaccttctcatcacgtccccagtcagaccttgtacaagtattcttcatgcactggtcgatatgagcgagagaaactcagctgggaaaagagggtcggtaaacccagccagcctgctgtagcgtgtaggggctcagtgccctgccccgcagcaactcccgccgtttcctcctggagggcgacgttcccacgcacgatcgaggtcccgatgcacccacaccatgaacacgctgagcggaattgcacgccgtatttatactgcataccgctccaaagaccagatccatacaagagcagcgatgcagagctccgtccgtccgacccagattgccgctccgacaccggcgtgtcggagccggcgggtggggtgtgtcgggcccatgcacccggccttcagcagcgcagctggtactgtgcattcgcagcgacgtcctaatgggcttcacatgcgagtgcacagcagcaagcatgcctcgaagtctacagcggtggagaaggtaagcgtggtcgccgggcgctgctcactgccagctcccaattcgcgatctcagcccaccccgtcccccgaacccaatgtgaagatggaggccatggttcatgagtacttccaaagagtgctcacgcgagccgatggggacaccgccagccggatcctgcatcccagcgtggagcatcgagacatggtccgagacatcggctaccaggggtgagcagggaaggttgcgccccgagggacactgatcgcatgcatgcggccttcggtggagccattgcagttattaacaacaaaatggttgtttgtgatggttcacatcatgtctgccaggaaccactcttgagtacacagtcccatccggcggtgcagctgccaacgactcgccatccgccagctcgtatttcaatcatgagtgcaccagcccatcattctgatcggcaacagcacccttaaaaactcatacttgcagggtgagggaagtcttggagtacgttcaccaagtgaagaagtcctaccccgacctttgggtggaagccacggaatttgggcctgccgaaggcggccaggcaatctttgcagcttttgagggactggccaccgagaagacgccccttttcaaagggatcgatctcttccgattcaatgatgacatcacccgcatcacagaagtggagggtgagagcacgccccttacattgctgtttattacaaacccctaactgtttgggatcacgagcaactgggtagctcctgctactccttgagatggcgccaagtagcagtccatggtcctgtctgggatccctgtctgtatgcatccttccaatgtctgcacctcaagcaccttgcgcacgcctccccttcacacagtgtaccggagcaactggcagggagccaagggtcaccaagaaaggaagaaagctgttgccaacgggtccaacggcaaccccgctcccaactgaatgcacatcctnnnnnnnnnnaggtgagagcacgccccatgcattggtgtttattacaaacccctagctgtttgggatcacgagcaattgggtagttcctgctactccttgagatggcgccaagtannnnnnnnnnggggaggtttcagagaccacctggaatacttgaatgatctgtgcgctgctgatatgacagctgcaccactnnnnnnnnnnagggaggtttcagagaccacctggaatacttaaatgatcggtgcgctgctgatatgacagctgcaccactagcgctcactaggtctgaccagtgcatatgaatggcttgtttgacatgtgcggttttcaagggccgtgggagatgtaagatggaatacgcttgctgaccagctgtggggtgatgtagcagcaatcggagccggtcaggtgtcgcatctcggcgacatcgcattcgataccgacaccaatggtcatgcaaaggcacgcctgtcggagctccagtcacaattctcacacccatggcgacattcaagcgcatcgtacctccttccacgttgtactctggtctctcggcatggggagcactgtccgcccccagagcgtgcagcgtcaggagcgtgcactggaacgggggcgtgccccttcggaggtccagagggtgcgatcaacccaaaccacataaacagggtgtttcagttagggcctacaagccaactgacaagctgcaggactggcgagtgcagcaggtacggtcggggtgggacaactcggggctcctcctggagaagttggggcttcacctcccctttcgcctgtgcgagtggttgacagatgaagttctaagggcacatcaaccccgtttacccctccaccgatgccgcattgcagatggtggaccacgtgaagaagtattacaatgatttcctcacgcgggggaaggaggcactggcatcccagctctttgatgacgacgtcgtgcataaggatctcgtctgggtgcgcagggatggcaagggctcagcctgggtgggatggtgatcggccgcagcgctgcccccattcccccatcgcacccccacaaatcccctggaattgcttggcaggatccagcacaccctactgtgggagtgcatgggatgcagcactaccttcacgacctcaggacagccttccctgacttcacaatagaggtagcgactaaaaatacgagatggggagcaggaggggcttcactggcannnnnnnnnncatagaggtgccgactgaaaatactagatggggagcaggaggggcttcactggcagtacaccctggcaggaggcccctgtgcgctgtcacccgctcatctttgcacgtgggcctctagtatggcaacataccctgctcaccaatctcgtctccctcgtgcacacagatcgaccagattgccacctgcgacatgaactccctgatggtgcagtacagcgggactgcgacggggctgggcgaataccattcgcacaagccctcccaccatgtctcggccttctccgggatcaatttggttcgcttcaatcacgaccgatccaagatagtggagatccagggtaagagcgtctgttgatgcgcgaacggggcacatcgggaatgtcgatgcctgctcatgtggtacgcaggcatgtgtggccattgcattgtgaacacttccccggcctccctgggcaccttctgctcctccgctcacaagtccaaaccccacccacggctgagacagtnnnnnnnnnnggtgttgccattgcattgtgaacagttccccggcctctctgggcaccttctgctcctccgctcacgagtccaaaccccacccacggctgagacagtgtatcggagtgcctttgctgaggaccgactggagctgggggagagggagctgcatggggagggaggcttccgggagctccgcctcaggcgcctcgtctgacactgtttctagcatggttgagtgcagaagatagtctgtttggccattcccagggcacctccccctgtgccgccctgggcagtggtgttgaaccttggccaaggtcccaaaacaagcgtccggcggggcaggccaacaggatactcacagccaagagcacgggacaggtgcctgtgggtgcagcccatcttgtggttcctcaacgtcacctaaggtccggccccggtctgccgccccgggccctggccacgcccccgcccccgcccccggcccaggctgtgcatggactgctggggctgctgctggcgaggcacatgcggcccgcgctgaccaggcgacccgccgtgctcgtggccggggcctcgcttgactccttgaggggttccgcccctcccgccaccatagttccggggcggcgtgggggcatacggcgcggtcggtccctgcggccggccggcgccgccgccgcgatgagcggcgtgtgccgaccgtgcgccggccagcatgcccgccaccgtcctcaccgcatctgtgcagaggagagggggagggagggaaggtgagacgcggcgatcgttccaccccctctgactcacgaccagcgccggccccccctcagccacccgctcccagacgcctctccctccggaccgcccagccccctcacgcccctaaacccctgtgctcgcacccgtgtgctcggggctcaggctacccctcgcatcctccaccgtgcactgaaaggcgccggccagccgcgcgcggagcctggccagcggcgccaccnnnnnnnnnngcccctcgcatcctgcaccgtgcactgaaaagcgccggccagtcgcgcgcggagcctggccagcggcgccaccaggccggggtcgacgcggaatctgagccactcgtccatcaccaggcaggccgccgtggggcgcgtggcccggcgaccaaccccgtcgtcaggctcgccctcgctgtcctcgtcctcgctttcctcctgcttcgccagctgcaccgaggcggccaccagcagcagggccagggccggcacctcggagcacgccttgacgtctgcaagggagcaaggatgggaggtgtggcgagggcaggcaggggccgggctgggacccaagcgctgcgctgcagcacaagggcactgcagtcgagggggagtcccgcctttgccgctgccttgggcatatgacagagaccgattgaattaccatcgagaggtcatgcacatcgnnnnnnnnnngagggcactgcaggcgagagggagtcccgcctttgccgctgcctcaggcatgtgacagagaccgactgaattaccatcgagaggtcatgcacatcgnnnnnnnnnngagtctcctttgattgatcctcgacgcaagcatatctgtatcccaatcttgtgggacaccaccggaccccccaacctcacttggcattgacnnnnnnnnnnaccttcgacatgcaatgaatggtggccgagggtggcctagcaacaaggtcacctgcaccctccctcgcaatcatcactcacagagggaggcatcgccccgggtcaagtcgtcgatgaccagcagtctgttctcctggacatcggtgcctcggctgtctgctacgcgatccttcaaccccatcctggatgggggttgggtgacagcaatgaatgagggagtttgacgagggcatcccgaaagtctcctttgattgatcctcgacgcaagcgtatctgtatcccgatcttgtaggacacctccggaccccccaacctcacttggcattgacggagctagggtggatgcggaccttttcgcctcgtctcgtcatcaccatggcacggccggaggtgggcggcaggagccgccccaccatggggtacaggcccgctgcctgcggaacagggaggaatgaaggaaccaagtcatacaggtagccgtatgctggtcagcatgtgctgagctgggagaagacgtgctgtttcaagacagaagatgccctgaggtcctccttccccttattaataccagagcgaccggcatcccatgccaacaagggcacctacagccggccctcagttccatgccaggtctnnnnnnnnnngataccagcgcgaccgacatcccatgccaacaagggcaacaacagccggccctcagttccatgccaggtctcatcatttggccctggacactcaccaggacggcacggaccagcccgaggtcggcggcggagctggacgcctcccccacgtccctgatgaatccaaggcgctggagctccgaggccagctggcccctcatcccatccaccatggccatggtggagggcgagatgaagttctgggcgcagaacccacgctcccttccgttctggagaggaatgggtgggagagttggccagtgacgtgtggtgcacaggggatcggcaggctggcggatcgcaacctcatcttgccagcgaaagacgctcgaccagaagctttgcgtcctcggacacctcggtcccgggcaccccacccaccctctgccccctacccttctggcatccttgtagcactgnnnnnnnnnngcgctccctcccgttctggagaagaatgggagggagagttggccagtgacttgtggtgcacaggggatcggcagaccagcagatcgcaacctcatcgtgccagcaaaagacgctcgaccagaagctttgcatcctcggacacctcggtcccaggcaccccccccaccctctgcaccctacccttctggcatccttgtagcactggaaagcatggaggcaggccatgtggtccgacgcgcccccgatggcctctgccatctggcagcgcaggttccaggcagccgccctggcgtcaaacgcggtgggcagcacccaaggctccctgcatggagcggggttgaagggttgcgagtgaagggttgcgagtgaggagtctacgagggctccaagcttttagaccatggcagcataggtagctcgatacggaccggcaagcgtggcaggggcagatccaaagggtgtcactccctgtgcaccgagggggccatgcgggaaagggtcacctgtaggccttgaagcaggccagnnnnnnnnnntgggttgcgagtgaagagtctaggctccaatcttttagaccatggcagcataggtagcttgatacggaccggcaagcgtggcaggggcagnnnnnnnnnnggtcaggatggggtccaggcacttgaacatcgcgccatacagcagcagcttgcccagggccgggggcagcgggatgttggccaggtggcgccccagcggcgtgaggtgctcggcctcgtccagcgcgcctgcgtggtcggcatgaatgagaaggtggcacttggtggaggacagaggagaagctcatggactgctcagttcccacggagctagaaatggcgagaacaggcggcacctccaagccgctcccaacggcaccgccagccgaccatcgccattcactcgcgcgatagcacccacgatgccccacagcgatcagccccaccacccaccaatgtcttcaaggagctggcgggcagccttgatggcctggggcacaggagggtcgatggccttggccaggaactcggcaatgggcaggctctccccctcgacctccagcagcttgatctgtagaggtgatgagggaggggggtgttctctttcagggcactgctccgcggcggtgggcccaagagtggactgatgccttgaggcaaacacatcgcagcaagcgggtgtgtcgctggtccttccatacggtggcctgtcacagtttaccacgcccccacatcatcttcccgcttnnnnnnnnnnctcagggcactgatgcgcggcggtgggcccaagaatggagtgatgccttgaggcaaatacatcgcaccaagcgggtgtgtcgcgggtccttccatacggtggcctgtcacagattaccacgcccccacatcatcttcccgctttccagatcgccctcctgcactttccacctgcagcgccagctcctccaaggggctccgtcgcagctcgggcacctggaactccgccagcgcctccgaccgtgtgcgggtgtacaggtggaaagcggtgccgggctggcaccgccccgcccgaccgcgccgttgccgctccgaggcgcggctgatccacgccgactgcggtgtggaaagggggcatagtggctgtgcctgtcgtctgagacacgtgcagccgcctcgtcctccagtgcaccaaggatggagcctttgccctggtgccccttgccgccacggaacagcaccccgaaaatgctcctctcgacacagccgctcgcctgcagggttgagactnnnnnnnnnntggtgtgaaaagggggcatgttggctgtggctgtcgcctgagacacgtgcagccgcctcgccctccagtgcaccaaggatggagcctctgtcctggtgccccttgccgccacgaaacagcaccctggaaatgctcctctcaacacagccgctcgcctgcagggttgagactccggtgaaggggtcataccccttttcacgaagccggccagcgttgataaccaccaccacatcgtcgatggtgatggcggtttctgtgacagttgggcggggtgaggagggggagggggttggtggggaggagcgtggatcagtgaagcatggacagtgcgtcagcctgcaatgtccacggagcacagtccatgcccatgtgggcctgcaccgtgaagatactgggccactcacagcaccatcccacctgcgatattggtggcnnnnnnnnnncgacagttggtcggggtgaggagggtgaggagggggttggtggggagcagtgtggacctgcgaagcatggatggtgcttcagcctgcaatgtccacggagcacagtccatgcccatgtagtcctgcaccgtgaagatactgggccaccctcagcaccatcccacctgcgatattggtggccaggacaagcttgcggacgccgcggggggggcgctgaaacacgcggcgctgctccgccggcgccaccatggagtgcagtggcaggatgaggtagctgtggggtgcagggcatggtggagacctgtttagacctctacgatggcactcagctgtcgcctttgaaggatggggctgggcggcactctgaatccaccccacctgcgcccgccagctaggccaaccttcgcatgcagccacaccccccaaaccctcaagtcacccgttgtgggtccggcggaaggcctgatcgcgctnnnnnnnnnntcaacatttgcatgcagccacacccccaaaccctcaagtcacccgctgtgggtccggcggaaggcctgatcgcgctccaggagttccttgagccgtgagatctcgtcccagccaggaagaaagatgagcacggccccgggctgggcatccttttgggcttgtgggttgctgaacggcccttccccacagatgtactggagcagccgcaggatgaggtcgaggtccacctgcacgaggagtgtattgtgagttgggatggttgagagttggggggttgatgtcagaccggcaaaatacatgcaccacgatccagatggaattatgacctggctttcacacggctgccaacacccaatacgcccaccagcaagccttcacgcaagcgtatgttgcagccacccaatccctaccaccctcacctcgtcgatgtcagtctcggactggtactgggcgacggcgagcnnnnnnnnnnagtatgttgcagccacccaatccctaccccccttacctcatcgatgtcggtctcggactggtactgggcgacggcgagcgccgtctgactgatggctgccgcggcggctgcctggcagcgtgaagtgagacgagacgcggggtgattacctgtgtctagcgggaatcgcgtcgccagaggactgccttcccccatgcaccagcttcacaccccaacagggctaggtgctgggattgctgcagtcccgcactggttcagatgtgatctccctcgttcacctgctgctcgtgctgctccagctcggccgccacgtcggcgtggccaaacatcctggcccagcccgccgccgaggagccgtcctgggagcgcgcagtcacgtcggcgccatgcgccagcagcaggcgcagggtctccaggcgccccctccccgccgccgccatcagcgccgtggcacctgcgaacatatgttggagcgggtggcgcggagagtttggtttctgatgcgtacgttgagggcgctgagccctcggagtgccgttgcatgagccctcgttgcccctcggccgcaaaactgtgcctctgnnnnnnnnnnaggtggcgcggagagattggtttccgatgcgtacgttgagggcgctgcgccctcggagtgccgttgcatgagccctcattgcccctcggccgcaaaactgtgcctctgttcaccctgccctcccacctgtggcctcgtgctggacgtccagaacatgagcggacacggcgccatccccgtccatgcccaggcccagcgtgctcagcaggtgctcgaaggcggcgtcgctgtcgtccttgaacgcagcctccaccgccgcctgcacagcagcgcgctgcgccctggagacctgctgaggtgggacgaagagtggatgattgattcgatgcgaggatgaacatccctgcggatggggtgtggcctcgtgacagacactgacgacgcacaggaggcagaggccctggacaaagcaccgcacagggagcagatccatcctcttgccgccacgagccgtccagggatcctgcgcgtgcgcggtgcccagccccagacccctgccgggcctcgccttgtgccaggcgtgctgctggcccccgcgctggccctgtgcctcgcgggggacctggtactgcaccaggcgcagtacctcctccaggtaaaagtcctccaccggatgtgtgaagcctggcacgcgcaccatggggcagcccccaaagtagtctgtggaagtggattgatggcaaggcgaggtggctgatgtccgggacgcgcaggcccgaaaggtccccccctcacaagcccacccgacacaggcaggcctggccctgggtgggggacagggacctctcgcacaaacattcctgaaaccgggaccaaacccagaaccctcccagcatcacgacacacgcctgagaagaggtcggcgtgcagggtggnnnnnnnnnngggttgatgtccggggcgtgcaggcccgaaaggtgcccccctcacaagcccacccgtcacaggcaggcctggccctgggtgggggacaggggcccctcgcggacacattcctgaaaccgggaccaaacccagacccctcccagcatcacgacacgcgcctgagaagaggtcggcgtgcagggtggcggacatgaggacgacgcggaggttgggattggcgggcagcacgtcgcggacgaggatgagcgcaaagtctgcgaagcggtcgcgctcgtggatctcgtccatgaccaggtgcgtgacgtgggccagggcgtcggcgccggaggacagcatgcgcagcaggacgccgttggtggcgaagaggagcgaggcgtcgcgcccgccgcagctctccagccggatgttgtacccgacgttgaccccgggggcctcgccgcgctccgcggcgatgcgctccgcgcaggacacggcggagatgcggcggggctgggtgcagagcacgtggcagccgcgccccgccgcccacgcgtcctccagcaggtactgcggcacctgcgtggtcttgccacaccccgtctcgccgctgaccaggaccacgcggtgtgcggccaccgccgccagcagctccgcgcgatgcgcggccatgggcagcgctgcgcgcgccgactgcagcgcggcggcctcggggcgggcgaccgcggcgcgccacgccgccagg

SEQ ID NO: 39455 - DNA, 65 bp, Chlorella protothecoides
cccgaacattgcatgccgacgcagcattccgctcgttacttcacttcagccctccggtatcagcc

SEQ ID NO: 39456 - DNA, 66 bp, Chlorella protothecoides
gccccgcctccacgcccgggaaggcggcggagacgccgccgccgccctcctcgcccgcgtcggccc

SEQ ID NO: 39457 - DNA, 75 bp, Chlorella protothecoides
cacacattcattcaccaaccccccctttccgcacaaaattgaaaccctccaggtggacgcgcgcggcctggtgca

SEQ ID NO: 39458 - DNA, 100 bp, Chlorella protothecoides
tgggagtgagaggggggttgggagtttgacggtgtggtacaggggctcatcctggctggccgtggacttcgcactcttgggatgctcttgccatgcccca

SEQ ID NO: 39459 - DNA, 70 bp, Chlorella protothecoides
tgctgcatgttgtgcggctctccaaaaggtctggaatgaatagcaggcttgcgccttaaccactcggcca

SEQ ID NO: 39460 - DNA, 61 bp, Chlorella protothecoides
tcgttgccggttaggcttatctgtggcagggtgattggcactgcacagacccaactcatgg

SEQ ID NO: 39461 - DNA, 85 bp, Chlorella protothecoides
gcatgccatgcacccgtgctttcttctggggctgcgacccagcctcgccagggggccgcgcggtttgcgaggcgggacccgcccg

SEQ ID NO: 39462 - DNA, 75 bp, Chlorella protothecoides
ggagcaagaaggagaagtacaagggcagcgacagtgcagaggtgcgcctcggggtgatggggctgggttcgggca

SEQ ID NO: 39463 - DNA, 75 bp, Chlorella protothecoides
cccctccctctcatcgaccagcagccacccaaatcctgccccccccgcccaccatgtagcaccggatctcctccg

SEQ ID NO: 39464 - DNA, 61 bp, Chlorella protothecoides
gcacaggaagaccatcgcacacacgtacacacccaccaaccacgctcaccgtccgaagatg

SEQ ID NO: 39465 - DNA, 61 bp, Chlorella protothecoides
tgggatgggaaggcaaagttggggggggggggaaaacattcaggagcaggggagcgtcagg

SEQ ID NO: 39466 - DNA, 61 bp, Chlorella protothecoides
gcttgtcgaggattgttgggtaatggctgggccgcgctctgatgatcatcctgcgggaggc

SEQ ID NO: 39467 - DNA, 92 bp, Chlorella protothecoides
caggcccatgcgggccagggcatcacggaactcttttcgcttttcttggagcagcctgcccccctcccggatccgctccagcttgaggggct

SEQ ID NO: 39468 - DNA, 61 bp, Chlorella protothecoides
caagaaggcatccctgcctcccaaggaataagacgcccttgccaccgcacccccaacagac

SEQ ID NO: 39469 - DNA, 61 bp, Chlorella protothecoides
tctttgtaaagtctggagatggatgagaaggggggctgggtgagggagagggctgggttgg

SEQ ID NO: 39470 - DNA, 123 bp, Chlorella protothecoides
gcagctcctccgcaccggcgatgcactgcacctcctctgtgcaccttcccgctctccccgatcagcactcggcaatgaacgcatccccccccgtcaaagctcaccgccgcatcctgcgcatcc

SEQ ID NO: 39471 - DNA, 120 bp, Chlorella protothecoides
agtcatggcatgtcctgccaagctggccggctgacaggaagagcgctggcgaggtcccaacccacagcccaggctcctgggtccgactgcccccaagcgcagccaggccccactgcaggg

SEQ ID NO: 39472 - DNA, 61 bp, Chlorella protothecoides
acagccggccgcgccagctcccgcgcagacgcccggggatgcgccacaagggcaggcgggc

SEQ ID NO: 39473 - DNA, 61 bp, Chlorella protothecoides
gtggggggatgtggcagaggaggcacgtgcggcgcttccctgctcggtgttgtcctatgcc

SEQ ID NO: 39474 - DNA, 77 bp, Chlorella protothecoides
gaggtcaggggaagcactaaaccatctagactttgaccattttatctccggtggatacaatagctgatgtggggtgc

SEQ ID NO: 39475 - DNA, 6746 bp, Chlorella protothecoides
  modified_base (162)..(209): a, c, t, g, unknown or other
  modified_base (1035)..(1089): a, c, t, g, unknown or other
ggccagacgccgcgcgcgcgaggccagcacgcccgccagcgcggcgcgcgcctcggcttccggcacgccgggcgcggggcgcgccaccagcgacagccccgccaccaccgagatggtgcaggggcagacgatggcgaagcggcgggcctgggacaccgctgnnnnnnnnnnnnnnnnnnnnnnnnnnnnnnnnnnnnnnnnnnnnnnnngctgccgccgtggccgacaccgacccgtccgaggtcacccgggacgaggggggggcagcgggggccggggggggcgcagcagggtcctgggatgtcgcgccgacgcacgacgcacaggtcgcactgccacgccaggctggggtgacggatggcacccgccacggccggccgcaggctgcgcggtcggggacgccataggcgtagcccgcggcgtcggggggcggtgggaggggcatgaccgccgcgctgcgcgccagcagcaggctgtgcggcacgcccccggccagcggcggggcagggcccccgccgacgtcgcagtcgaggggtacaagcccgccacccgcgccgacgtcggccaccgccgcggcctggacacggggcgccgcggcgccatgctgcaacgccacatcggcgcgcgcgatccagctgccgatctgcgccagctggtcgtcgggcatgcccgcacggcgcgccagcgtgggcgaccgcttgagcagcgacttgagccggcccagggacagcaccgccgtctccaggtcgggctcggtcagccagaagtacatgcggctgctggcctgcggcgccgcctgctgctgccccgcgccagcctgctgcagggcgggcaggcgctgctgcgccgcctcggcggccgcggccacggcctcgggggcctgcggcgcgggcgccgcatcgggcccgatggccgaggcggtggtcgcgacgttgcgcgccgcgatgtcgtcgcgcaggcgcaggtagaaggcgcggccgccggcgtcgccacggagcatgtggatggtcatcagcggctccccccccccggggnnnnnnnnnnnnnnnnnnnnnnnnnnnnnnnnnnnnnnnnnnnnnnnnnnnnnnnggggaagtgggccagctcctcccacaccgccaggcggcaggaggactcagtgacctcgcgcaggagcgggctgtcgcatgctggatcggccatggtgtcgcccaggccctggccgcagcccacgctccggctgctgtgccacatcagggacaggttgtcgttggggagcagccagaggctcagcaccccgcgagcctccgtgggctgcagcttgacgggggaggccagctggcgcgtcatccggcccacgctgatctggaccaggggctcggagatggcgctcagcagcgcgctcgcctgagatggagggagagaggtgcggggtgaaggcagagaacttgggacggggcgtgactcagacacgcgtgatcttgacagtcgacccaactccatccacaggatggggggaatcatcccctgccacccgttctggtggttgcccgccgcacccaccacccggcatgcctgcccgcagttccgccgtcctcgcgcattcttgtgccatggcgcacctgcttcgcggtgaccacgggcgccttgtgcgccgggagcccgggtgcagccagcatcacggtcatctgctggcgggcacacgtgtactcgttgaccagccgcgtctccagcctacaatctggaactgccggtcgcggcatgatttcgggcatgcgaccgaggctcatgccctggccggggtgccctacggggagctccgacagcgccacggggtccccgaacgcgctgtcgctgtccgagctcgactccacgcgctcgtggctcacgccacggtgctgtgccagccagtgttgaaaagagagccagggcgcagaggagccgggttccatggcgccctgtggaggagggcgcaatacaagttttcaagtgcgtatggggttgtgcgtggggcttccaccggagccgtgttaacgcctcgagacaccctcacccggcgttacctgatcaggtggggggcaattccggtgacaggtccggcgtcgatggtgagcgccctgcccaggggttgtgcgtccggaaggtatcgcgtttccagcgagaccagcgggaagacccggctatctgctcagttcagggggttgtgttcaaaacgtttggggagagaaagcgctgtgcctggaaccccgcggtcagcgggcatatccccaacctctgggtgcgtgagagcttctcggcgggagagcgggagcggtggcgtgatccaccgtaccaaatatctttacgtaatccgcggaccccctgactcggcgattatcaatgttataccactggcatctccgccggtccttacactgctgggcaggcacgaggtcactctccagggtcaccccctcccccggtggggctcgtgcgctgcgcctgcatgcaggcgcgccgaggcgcacccctggcacgcttcaggccttggcctcggcggcgggggtcaggtccaccaccttctcccaggtgaagacgtcgggcttgtcgtcgcggccaaagtggccgtacgcggcggtgtggatgtagcggtccccaccccgcttcaggtccagggccttgccgatcatgcccgggcggaagtcgaacttggccagcaccagggccaggatctcgcggtcggggatggtgcccgtgccgtaggagtccacaaacacggacagcggctccggcacgccgatggcgtaggacacctggaccagcgcgcggcgcgccagcttccccgccacgatggacttggccgcctggcgcgcgatgtaggcgccggagcggtccaccttggtggggtccttgccggagaaggcgccgccgccgtgcgcaccccagccgccgtaggtgtcgatgatgatcttgcggccggtgagcccggcgtcgccgtgcgggccgccgatgacaaagcggccggaggggttcaggtggaagatggtgcggtcgtccaggtacttggcgggcaccaccggcttgatcacgtgctccagcaggtcggcgtggatcttctcgttggacacatcgggcgagtgctgggtggagatcaggatggtgtgcacgcggatgggcacaactgcgccgccgtccttgcggtactctaccgtcacctgtggatgtagggtgtgggggtggatatcaggatgtaaggtgtgtgtctcttgtgtatgaatgtgggagggtgatcaaaggggagggtgggcgcacagcggggagacagggcagtaccctttggagtcgagatcaagatacctgtcccaaagaagatgctaagagagcggcctgggagcggaatttgcatgcggagagaacagggcggagcaacagcggggacaccttccccagcatccttcaatccccccccccctgaacagcctccctacctgggtcttgccgtcggggcgcagccagggcagggtgccgtccttgcgtgcctcggtcagccggtagcccagcttggtggccaggacgtgggtcaggggcatcagctcctcggtctcgtcggtggcgtagccaaacatgtggccctggtcgcccgcccccgtctcctccagggtcttggtgcccatgccgtgcacgccctggccgatgtcggggctctgctcctccaggtgcaccagcaccttgcacttgtcggcgtccaggccgacgtcgtcggaggtgaagccgatgttgcgcaccgtgtcgcgcaccaccttctcgtagtccaccttggcggaggtggtgatctcgccgaacaccatcaccatgttggtcttggtggcggtttcgcaggcaaccttggactcggggtcctgggccaggcaggcgtccaggatcgcgtcggacacctggtccgccagcttgtcggggtgaccctcattcaccgactctgcagtgggtgagggggtgatcggttggggggagcaaggaggtgcacggccaccgatcgtggacacacctgcttcaaaaagataccctgcacgtgctactccgcacgccctgcaccagcaaagcccagaggcccaaggctgatcccgatcaccacgtaccggaggtgaacaggaaggtgtcggtcgtcatggtgagggggaaggctggggggtgggggaggtgggtggctagggggtagtggccgacggaaagatcgcgttggttggcaagcttgaagctcagctgcgggacggcgatgctcggcagcaatgaccgagattccaagagggattgagggagtggctggcccggggctggaacttgaatcccagcggagcagggagcacgggcgaatcgaatcaggcgctgatggacgccggcaggtgggagagtgtaccttctttctaccctgacgaggcacctccttgaaaagtctgccctttcaaggaaatccaatgcaaccctcagccggcatgcaaacttccaattagcgcagcactggtttctgcaattcatatttgcaccttctggcattgatccatgtcgtgcgcgagctgctgaaccaccccaccccaaacctcatgccggcgcagcaggatgtataccctgcctgggcccacagcccggaggatgtggccgcacatttcaacgtagatttagatcacggtctctccgatgaacttgtggcgaagcagcgcgccctgcacgggttcaacgagcttgatcacgctccggccacccccctttggaaactggtcctccagcagtttgacgacaccctggtcaaggtgggatactgaagcataggatgcggtggaatatcggcgcatactgcgcctaggtacattcccttggctcacggggctgggaaagtgttgctggaagggacggggacgccctgagggtatgctccaacatgatcccttgttaccggtgcgcctgatcagaggcccgccatacatcccgctgacgagtgtcacgctgttgttcccaagggtaaacccttccctccccccatctccctcccccgccagatcctactcctggcagcgggcatctccttcgccctggcctggttcgacgagggcgagggcgctggcgcgggcgtgcgcgccttcctggagcccgccgtcatcatcctgatcctggtgctgaacgcggtggtgggcgtctggcaggaaggcaacgccgagtcagcgctggaggcgctcaaggagatgtcagcagagacagccaaggtcttccgcgcgggccacctggtgcccgacctgccctgccgcgacctggtccccggcgacgtggtggaggtgcacacgggcgacctggtccccgccgatgtgcgcgtagtgcgcctgggcaccgccctcttccgcgtggagcaggcggcgctgaccggcgagtcggccgcggtgtccaagcacgcggcgcgcctggcccccgccgcctgcgagctgcacgccaaggacaacgtgctgtttgccgggaccggggtggccgcggggacgtgccgtgcagtggtgtatgccacgggcatgcgcaccgagatcggccgaatccaggcccagatccaggcggccgccgaggaggagggcgacaccccgctcaagaagcggctggacgaattcggcgaggccctggcccgcatcatcctctacgtctgcgtcgccgtctggctcatcaactaccgccacttcatctcctggaagacgctgcccgggtcggccttcctccccgaccccgcctccgtggagttctccctggccaaggccaccttctacttcaaggtggccgtggccctggcggtggccgccatccccgagggcctccccgccgtcatcaccacctgcctggccctgggcacgcgcaagatggcgcggcgcaacgccatcgtgcgcaagctgccctcggtggagacgctgggctgcaccaccgtcatctgctccgacaagacgggcacgctgaccaccaaccagatggcggtgtcccacgtcgtcaccctggccggcgccggcggggagctcaggacgctggacgtcacggggaccagctacaaccccgccgacggcgaggtgcggggtctgggcgccgccgccagcggcgcgggcctggacgccggcctggccgcgctggcggccaccgcggcgctgtgcaacggcgcgcgcatcgcgaccaagcacggacacgcggtggcggtgggccagtccacggaggcggcgctcctggtgctggccgagaagctgggcgcgccggacgcgtcggagcgcgacgacgccgcggcgcgggccccgctgccggaggacggcgaggtggagctcagggcctgcgacgcctacgccgccaggtgcgcggatgccgtgctcgtcgctgcacggccgggggggtgttgcgtgacgctggaggcctcggtagagggcccgctgggggggcgagggggggggccctgctaagtgcgtgcggtgaccagcgggcgggctggcctgccgggccgggcaggtgtgcctgctgcaggcctcctgcaatgggcatggcatgagagggggcgcccatcgtccaactctgttcacagcgctggcacccccctgatcgccgatgcccccacccaccggaacccccccctcccaggttccggacgctggcgacgctggagttcgaccgcgaccgcaagtccatgagcgtggtgtgcgcgcccaccagccccgacgcctggccgcctgcgggcgcgcgcgcggacggcggcgtgcgccgcagctcgcgcctgtcccggcgcggcg

SEQ ID NO: 39476 - DNA, 75 bp, Chlorella protothecoides
caccgggggccgcgcgcgtgccgcggagcgggtgacctttgcccccgaacgggggctgtggcgctggatccctct

SEQ ID NO: 39477 - DNA, 6897 bp, Chlorella protothecoides
  modified_base (106)..(331): a, c, t, g, unknown or other
  modified_base (573)..(652): a, c, t, g, unknown or other
  modified_base (2478)..(2487): a, c, t, g, unknown or other
  modified_base (4362)..(4371): a, c, t, g, unknown or other
  modified_base (4724)..(4733): a, c, t, g, unknown or other
  modified_base (5050)..(5059): a, c, t, g, unknown or other
  modified_base (5363)..(5372): a, c, t, g, unknown or other
  modified_base (5859)..(5868): a, c, t, g, unknown or other
  modified_base (5942)..(5951): a, c, t, g, unknown or other
  modified_base (6098)..(6107): a, c, t, g, unknown or other
actgcggccgccgccgcgccgtcgcagcaggtgccgctgatgccgccgccgcccgaggccgtggcgctggcggcgggggacgtcagccttcgcgccacggaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggcggctgcagcctcgaccggcggcgcgcgccccgcgcccgccccggcgagcgtcaccccgactcggcgccgctcggcgcgcggcctgtttgccgacaccgccgacatggactgctgcgtgtgcgcctgcgacctgtggctgtcggccgcgctgtgcaccctgtgccccgacctggccgcctgccccgaacacgtggcggcgctgctggagcgggcgccggggggagcgccaccgggcnnnnnnnnnnnnnnnnnnnnnnnnnnnnnnnnnnnnnnnnnnnnnnnnnnnnnnnnnnnnnnnnnnnnnnnnnnnnnnnncgggcctgcctggtgctgctgcagcgccacacccccgaggagctggaggccatggtcgccgcggccggcgagggcgagccgggggtgtgggaggcggtgcgcgccgcgcgcagccggcggggagtcagggaggccacccgcgtccgtcaccgcagcctgggtgggtctggggggcgggaggggggttgagaggggggttgcggtggatgacagctgggagctggagtgcctcgagcccggagagggtcctggcaggtgactgctgctgctccagcgtggggcagcttgtgggtctgtcgggagaagtcatacctggggctggggagccgctctgtcgctgaagatgacgaactggctggcctcaagcccactcggtaatcactccaccgcaaccccacccgcctacagggccctttgatcccacgggcaagagctactcgagctgcggcggtgctgcagcggagtcggatgcacgcctcatccctgaactcaagcccacatcaggcctgtcggaaccgggagcgtgcctgattgcagcggcgcatcagtgcgcgattcctgcctgacgcgcaaggggtcgtctctgcattgacgcggtgtgcagactgccgacctccgctcattgttgcgagaccatggtgcattgcattgcattgaagctggccggccatgatcatcaacccgccccgagcctgccatttgaggactgcgcacatgtgctgttgacgataaggaacgtctaggagagtgaaggaaacggggtgctcttgtgctggtatcagagactttgagtgcgagaccctgtgtcatccccactgggacatacccttcaccaaggcatcccgtggagccatgtcacggcatgcgggagcacggccccggtcccaatcccggtgcgcgagtgctcgcagcgatggggcatccgagcccacacataatgaatcattttccagtctcgggtgccagataatacaccctgttggatggtggtggtaaaggcgcccagcaccgctgcaggagctgggggagcggtgtgctcgggccattacccaccatgccgggggccaagccggccattcacgccctccatgctccctccgaggcgtcccaggagccacggcagctttgcagtgcgacacagcgtggatgaggaggactgggaggcggagatgggggtgttccgacagcgcaccctggcgccaaaccagctggagacgctgcgcaagtacgaggctggagcggtggagctcggaaaggtgcgtcctggaatggaaaatgtggtcttctagggtgtaatgggtgccgagtgtggccccgcatcggagcctcggcaccgagggttgcatctcaatgaaggacaaagtataccttgcatgggaggcagcgctcctgatctctgttcccggatgcaacgactccctgagctgcacgcatgctagactctgcagtagtggcctcgtgggacacaggacatcttttcctttcccccgcacaggtgctcttctgtcaagagggcaccgcgctcgtgacggggctcaacaatgatgccgagcccggcacggctctggacttttcatccggagcccaggggtacggtgcaggggtctgggtgtgcgctgggtggtgtatatatgtatgagagaattgtgtgcacacatacactgctgcaagtgtgttgcacctcggccgtcagaccactcctcccaaagatcgaagttcattctcgattccgcattgcagggtgctgctgtggcggactagcgccggtgcgatttttgcgctggtgctcagggaatcctcccctggggtcaaggccggggatgggnnnnnnnnnnccgattccgccttgcagggtgctgctctggcggactagcgccggtgcgatttttgtgctggtgctcagggactcctcccctggggtcaaggccggggatggggtggtgtgcaggctccgcgccatcctgcaagtcgtggatgatgccgtaggcgccacgaccaagcgcgactacgacgtggtcgacgtgcctggtgaggcgggggctgggagggagggtgtgttctgggagcaacatgtaaaagccgctgacatgtcacgcctggactgggtgaagggaccagggcaggtggtcacctccacctcgcccctgtttgtcaacatgcctgcatctcaatgccgctgcccgtcccctcacccttccccttgcccacacactccccccgatcactgcagttggcaagtgcttggagggacgcacctggtcccccgaccagcttctggactggaggggccagagcggtcaggccgctgctctcccctccatcaccccgggcccccgggctcccctgctcgcggcccagattcccatggctgaccgggaacagatcgcggaggccctgtacaccggcgtgccctgcgtcgacgtcctgacccccctgggcctgggccagtcggtccagctcagcgggcgtgacgcgggcgagcgcgccgcgctgtgccaggccgtcgcccacggcgcggtggcctccggcctccgcacgctgtatgccgcgaccggccccgccgacggcgccggggtcgggccggccacggtcgaccccggtgtgacgcgcttcgtcgcctcgccggggacaaacgtggcgcagcgcctgtacctcctctgcgcggcggtggcggcgggggaggcagtgcgcgcggcggggggccacgcgctcgtgatcctggacagcctcgcccccatggtaggttggcgcgggggtgggaagagtggggaatggccccattcctgtgtgtggcttggcagtgtgcttgtctcgctggcgcctggttcactcagtgatttgaattctctgatggcccaccctcctcctctaaaaccacaccctctcacaaacacacacaccttcacacacacaactgcattcctaggttcgggcgtggggcatcctgagcgcggccgccgcccagaccccgggggccgcgctttcctcccccgacccggcctcgcgcgtggaggtggagggcatgctggtgtcagtgggcgaggcggagcgccgcgccttcctttccagcctggtccagcgcgccgccaagatggaccacaggctgggcggcggctccttgtccctggtgctggtagtgccggggcttccagccacaggcacccgcttctccccctccccccagctcctggcgtccctgtccccagagcggcggcagcgcctggaggcggcggcccggcagcggagcgccgaggcggcggggggaggggctgagggaggtggtgctgccggcccgctgctgcccacgctgatcgtggaggagctcatgtccctggccgacggccagatggtggtggtgcggggggagggcggcgatgcagaggaggggccaggctcgcgcttgaccctggaccccgcgctgtcggtgtctcgcctgggcgcccgcgttttcccacccttgctgaggcccttggccggccaggtgagcgtggtttgggttgcttgttgcatggggaaaaggagtgcaggaacgtggtggggctaaagggtttggatttagaaggagcctcctcagggaggccgaccagcgtcccagggtgcgagcgcctggactgcgattgattagcgcagctcctacaccaccgccgtccctgtgcaatgccccgccttccccctttcttcccgcgcaggtgcggctggagctggcgcannnnnnnnnngtggtcagcgcagctcctacaccaccgccgtccctgcgcaaggccccgccttccccctttcctcccgcgcaggtgcggctggagctggcgcaggcccgcgacgccgctcgcttcgccagcgacgcggagggcctgccggggtcgcggggcgccgcgcgtgtcgaggcgctgacgcgcacgctgagccaccgccgtggcgcggcgcccgtgccgctgacgcggctggcgctgcggctgacgctaatcgagctgctgcacgacgacccggccctggccccgggggtcagcgtggagggcgtgctgcgccggtgcgagggggccaacgcgctggcgccggacctgctgcggcgcannnnnnnnnngatcgagctgctgcacgacgacccggcgctggcccccggggtcagcgtggagggcgtgctgcgccgctgcgaggggcccgacgcgctggcgccggacctgctgcggcgcatggatcgctgcggctccgggcccgaggcagaggccttgctggccgagctgcgcgaggcgctgcgggcgctcgttgcgcaggagcccggccatctttcaccctgacccctgcttcatgctgccatgtgtggggaacgatactgggatgtatcctttcaagggatttggaagttggaaatgcgagggcttgggcgaggtctggccaaannnnnnnnnngtgtgtgggaacgatactgggatgtatccttccaagggatttggaagttggagatgcgagggcttgggcgaggtctggccaaacagggcagtgcattgagcgacgaggcaatcgtccgcatgtatctgccaagcgccatgtccgcaggcatgagcgtttgccgggaacacatgctgctgcctccgcgctggatagaagtgcctcgaatggagtttcgtcttgccgtcctgttcccaaaacaagcaaaccattcatgtcggtgcgaaaatcatgcttcccatctctgaggatatagaaaacccgnnnnnnnnnntgactggagtctcgtctcgccgtcctgttcccaaaacaagcaaaccatgtatgtctgtgcgaaaatcgtacttcccatctctgaggatatagaaaacccgtgggaccggggttcgagtccccgtatgcgaatgttccaaacgatacgatcgcatatcgtataggtggttagtatacacggctctcacgcctcgaaaccctcgcttttgcgatatttttgggctcttcgatgacgaagggtgcctgctggggcagcagcgtgtattctaatctcccagttcccgggttttccacgtccccacatgttgccttgtggggacgatggcactttccttctcccccgctttcttgccgactgctgccagcacccgcatcgctccaacattgttacacagcaacggtccaggcagcttctcgaggtacagcagaccctgggttgttttgcgctcaggagagacgcctcggggtcgcccggcatgggcgctcannnnnnnnnngttcctcctcccccgctctcttgccgactgctgccagcacccacatcgctccaacattgttacacagcaacggnnnnnnnnnncgcgccaggcacagctcgccgcttcgctctccgcgccctgtcccctgtttcatccatcagcaagaggtgccgtgcacctcccctagcaccccccccatctactcagcgccgtacccctcagttgtcctccgcgccgtgccagccctnnnnnnnnnntgcgcccggcacagcttgccgcttccctctccgcgccctgtcccctgtttcatccatcagcaagtggtgccttgcacctcccctggcacaccccctatctactcagcgccgtaccactcagttgtcctccgcgccgtgccagccctggtctgggttccgctgcaccctctcgtcgaacttggcgcgcagcgtctggccttccagctcggtgccgttgagcgcgcggatggcagcctcggcctcgcccgcgtccttgaagcgcaccatgccccagccgcggctggtgccgtcggcgtgggtgcgcagctccacgcggcccagctcgccgtagggctcgcacagcgccttcatgtcctgccaggtgaaggccaggggcaggcccaggaggaccaccgccacgtcggggtcggcggcgtagccgccctgccgcgcctggccgccgcgcagggcgttggagccggcgtcggggcgcaccgagatggtctggccgcgcagctcggtctggcttagcgtatcgacggcgtgctgcacgtcgtcctcgctggcgaagcgcacgaggccaaagccgcgggagaggccgtcctggcccatgaccacacgcgcaaactccacctgccccgcgggcttgaagtggtccttcagatcctgccacgccacgtccggtgccaggccggtgacgaagacggtgcgcacgcgctgcgcctcgagctcctcgggcgtcaggcgcgggcgcggcgggcggtcgtcaccacgctcgaagctgcgcggcgcgcggtcgtagccgccgcgg

SEQ ID NO: 39478 - DNA, 74 bp, Chlorella protothecoides
agcacgcccacaattgatattatctatcctgtattgtactggggaaatactgaacgagtgtgcgttcggagagc

SEQ ID NO: 39479 - DNA, 77 bp, Chlorella protothecoides
tgtggcaacgtgttacagacagctgcaagcattcatgatccaaccagcacaccacatgcagacatgggaccctatca

SEQ ID NO: 39480 - DNA, 174 bp, Chlorella protothecoides
ggggggggatgatccttgcccgagaggagcccaccggcagccattgacaggacaggacctcgcaacggcctggccaatgaccgtcttgcaaggtagccctcgtcctcccccgcacagaaagccacatgcaccaacacacgcagagaacaactcaccctccgtaccccccccccc

SEQ ID NO: 39481 - DNA, 69 bp, Chlorella protothecoides
aagcccacacagcctactgaggcagacgggtggattgaactccagaccatgcccagggtgccacgccgg

SEQ ID NO: 39482 - DNA, 61 bp, Chlorella protothecoides
ctgacccaacagaagggcaatgccggcatgtcaagcaccagggtgttgatggcagcccgga

SEQ ID NO: 39483 - DNA, 97 bp, Chlorella protothecoides
gaaagggatgctggctcgaggccggccggccggcaggtgcccatgctgggaaccatgtgtaaagcgggagcactcacaccactgcatggcctcacct

SEQ ID NO: 39484 - DNA, 153 bp, Chlorella protothecoides
ggcagaggagggcgtcgtggacgtggaggctgccgaggtgaagactcccggtgatgagccggagaaggcagccgaggccggcaaggaggaggcggcggcagcggagaaggccgagcccgtcgcggccgaggcaaccgaatccaccgccgacgg

SEQ ID NO: 39485 - DNA, 193 bp, Chlorella protothecoides
gccaaagacaacaggagggcttggtggggcaggcacctcctctggggtcggaatctcgactcccgctggcggaatggggcccggcagcggcgatgtgacccctttgggactgggcgcaggtgtcttcctggaggcatcagcagagggaggcagggacggattgggttcttggctcggtgagctcggggtcatc

SEQ ID NO: 39486 - DNA, 70 bp, Chlorella protothecoides
ccaccatgcgcggtgatcacacggcgcaagcggccatggagtgcgcgcctgcagcatccctcagggcaat

SEQ ID NO: 39487 - DNA, 139 bp, Chlorella protothecoides
ggcctccgcatcccctgccggcgccggcccggcgcccggccccgccccgtccacggtcggcccctccgggtctcgcagctccggctccgcccactcctccggcccgtaaaccagatccagccccgggcagctgctgtcc

SEQ ID NO: 39488 - DNA, 162 bp, Chlorella protothecoides
agcttattcacgcccagcctgtgccgccgcccagcctgtgcctcgcgacaacatctgcttgtgcgctagggcatccaaacctgcctcgtgaccaaaattttgagtagagcttttttacacgccgcctgccccaagccccgcttccacaccccaactcacctc

SEQ ID NO: 39489 - DNA, 61 bp, Chlorella protothecoides
taggaaatcgagtccattgagtgactggcgcttcccttccgccaaggccccgcttccaatg

SEQ ID NO: 39490 - DNA, 459 bp, Chlorella protothecoides
  modified_base (142)..(354): a, c, t, g, unknown or other
agggggtcaaagacgacagggtggaatggggtcgaggagaacagggacgggagagggactctgtggcccgctcgttgcagcagtcgcccatcgcaggcccaggaggctgggaccagggctgacgaggaggagcaccatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacactctacgctcgtggaaaggaggaggggtgtccagggccgcaggggcgggaaggctgcgccccactccgcgcagtgcccctcgcagcgcgccagccaggc

SEQ ID NO: 39491 - DNA, 79 bp, Chlorella protothecoides
tggaaagggggacaggcccggctgggtgtcacggcgtggctgtgtgtcagccaccggcgcgagggcggctggggccggg

SEQ ID NO: 39492 - DNA, 85 bp, Chlorella protothecoides
tctcactgggcaggggagtgggagcattgtatgccagcgtcgctggttgtaagtgtgtacccttcaaacgaagctcgacgctggc

SEQ ID NO: 39493 - DNA, 89 bp, Chlorella protothecoides
atgctgagcgcctggcgcgcctgatagtgagcgttgcacctgtcgaccatgcctctggtcagggattcggattccacaccctcacgtcc

SEQ ID NO: 39494 - DNA, 1301 bp, Chlorella protothecoides
  modified_base (507)..(516): a, c, t, g, unknown or other
  modified_base (835)..(930): a, c, t, g, unknown or other
  modified_base (1031)..(1230): a, c, t, g, unknown or other
cggctggcggtacagggcgtgtccctggacctgcacacctggcctgccacctggcgcgcgtggggcgcgggggcgctgcccggcgacgtgggcgccagcggcgcgggcgtggaggcggccctggcctcgctggtgccggagacccaccgcgtcttccagcagtgggagctggcggtgggcgtggagctgcgcccgcacggcggcgccggccacgagacggtgactggcctccaggctccctcccccgcccagcgctcgcccgccagcgccaccgagtccagccggtttgggcgccaggcctccgacaccctggacaaggaactcgaggaggaagacgcgcccgcggggcccgaggagctggcgcagggcctgttcgccacgcagggcggcggcgaaccgcccgagggtgggggggcggggggggccacgccgacctgggagggctccggcgcggcggcgcagcgcctggcgcgcgactcggcgctgccggagccggtgaccctggtnnnnnnnnnnatgggggggcggggggggccacgccggcctgggagggctctggcgcggcggcgcagcacctggcgcgcggctcggcgctgccggagccggtgaccctggtcttcgactccgaccgcaagcccgccgcgaggcgggagaatggcaatgggatatcctcggccgcagacccgtcggggaccagccctgtggccgagttcccgggccgcgcctcgccctttgccgccgtggccgacgctgagacggcggcgcgggggcaggaaggcgcggggggaggcgagagcgacccagatggccccccaccgcgcccgccgtacgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccggcgcgcgccgcgtccccgcccccgccgccccccgcgtggaggtgcgcgtgacgctcaaggcctttgtccccgagttcgacgccgcctccatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgccggcgacctgctcgtcgccggctgcgcggagctcagccggcgccaggccccgctggccgacgtcgcc

SEQ ID NO: 39495 - DNA, 76 bp, Chlorella protothecoides
tacgaatgatgcaacacagtgtgggatgggtcattacaaaccggacccctgtgagcaccgctccgcttcaccccac

SEQ ID NO: 39496 - DNA, 123 bp, Chlorella protothecoides
cgagaatgagggggtgttgggtgaggcaggcctggcaggtgggcccacgctcctccacccttgcccaccccccacccctcagccaccagtgtgtgtcaatgggcgctcacccaaagacaatgg

SEQ ID NO: 39497 - DNA, 80 bp, Chlorella protothecoides
ctttgcgtgaccccgcaacctcaccctacacctctccacaacccaactccatgcagctgctccccctggcacccactccc

SEQ ID NO: 39498 - DNA, 73 bp, Chlorella protothecoides
taggctcatggtcatgtgtttcgagcatcccaccttccgaggtagattagggtttcaggccagccccgcggca

SEQ ID NO: 39499 - DNA, 61 bp, Chlorella protothecoides
atggagtgccgttcttgaggctggcgagggtgacggtttgatccaaacattctgtctcaga

SEQ ID NO: 39500 - DNA, 98 bp, Chlorella protothecoides
ggtgggcagaagagctttgcaggcacagagtagctctggacatgcatgcaacagatgtgctcgtggcgcccctggagtacaagcttctgtcctcaaat

SEQ ID NO: 39501 - DNA, 61 bp, Chlorella protothecoides
ttgggcaagggttccgggggcagggggggtgcaccacatgtcgccagggagtgcaatcgtg

SEQ ID NO: 39502 - DNA, 70 bp, Chlorella protothecoides
cgctccgaacccaaatctgctccgcaggcatccgcggcaagtgcccccacggcctcaagtgctggctcta

SEQ ID NO: 39503 - DNA, 70 bp, Chlorella protothecoides
gaccggggtgcgccccgtggtcgtctacggcggcgcgccgcaggtccagcagctgcgcgagctggaacgt

SEQ ID NO: 39504 - DNA, 5578 bp, Chlorella protothecoides
  modified_base (408)..(417): a, c, t, g, unknown or other
  modified_base (744)..(753): a, c, t, g, unknown or other
  modified_base (1176)..(1185): a, c, t, g, unknown or other
  modified_base (2245)..(2254): a, c, t, g, unknown or other
  modified_base (2982)..(2991): a, c, t, g, unknown or other
  modified_base (3387)..(3396): a, c, t, g, unknown or other
ggcgccaggcgggcgccgcagccctggcctccatctccggcaccggcggagcgggggcgcaggcgggggagggcgccgcggcgcgcgaccccggcgaggccgccccgtcgcatgacgcgggtgccgcgtacctggccagcggtgcgctgctcctgctcctgggttacgccgtgctgctgcgccggcgccaggtggcggcgggggcgcagggcgcgctgcgcgcgctgggcgacgtcctgcgcatgggcctgcagctgtcgccagggtccatcccgcgctgaacagtctgggttcgacatgcaggggcgcgggcgtgtgactgtgtgtgtgtaagtgtgcaagttggtgatgggcctgccgcccaggccagccagattttggcggccgcatggccttgctctgccaatnnnnnnnnnnataactgtgtgtgtgtaagtgtgcaagttggtagtgggcctgccgcccaggccagccagatgttggcggccgcatggccttgctctgccaatccaaaacaatctcgattagcgtgccccctccctcgttgtagctcatactgccagagaagaggggtgtagctgaggtgcgcgtccaagttgcaggggcttggatgtagaaactgtcgtgatttattcgtgagctgagccacacaggaagatgcccgcgtgaggagcgcccaaccagcctagataaaccctgaacaagaccttgatatacccctaagaatgctactgtggtctaccnnnnnnnnnnagatttaattgtgagctgagccacacaggaagatgcccttgtgaggagcgcccaaccagcctaggtcaaccctgaacaagaccttgacatacccctaagaatgctactgtggtctacccattgcaagcatcagattttaagagttattggggtttgtcggctgttgtggggttgagaaccgcccaccagtgacaaatgtagaagcatcacgctcatgagaagcaggacacttgggtgactacagataacacgccacacgcggtaactgccagccaaagcatcacatcgacagctttacagagcttcactgctgccattcagtcattgagttgcgattttagtcagctcagcgctaaagttctgacgggccaaagacaacaagggcggcgggccgtcacagatcatttcccgcatgatcaatgnnnnnnnnnngacgccacacgcgccaactgccagccaatgtatcacatcgacaggtttacagagcttcactgctgccattcagttatcgagttgcgattttagtcagctcagcgctgaagttctgacgggccagagacaacaagggcggcgggcgtcacagatcatttcccgcatgatcaatgtcgggaggggcatcctgtatgccatcttaacattatcatctacacgtaggaccaggtgaggatgctctcaacccgaaaaagggccgatcttgcacgaccgggctgtcgtgccaacatcgacattgcccggcaagccaatctcggatgaaagatcttgccggcatgcgcagcacccacggaacgctccgctgggctcaaacttgcaatatcgaggggatgatgctcctctttgcggtgctgaatgatccagcctctgatgtgatatccagatggctggacgatgacccttcgtctgcacgcctcgacagtacacaggccccaggcagtaaaatccgacagcccccagccagcgcgaccccttggatgccatgcacggcaagcaccctgctccttcagcctgagaagtcatggcgccgttgttccagggcccgagactgggaatgccagagcaagcacgcgccacccgctcccggtgctggcagcccggagtgaggacctttggtccattgccgacatgcatgcctccgtattccacacccagaagcgtctgtggtggcccctcctgaagctagagatggtcctgggtctccacatatgtaggtctagcactagggaagggggagcgcaaggagtgggtgggcctgcctggccgctggtggttgtgcctgcagccatcgtgataccaggagcacaaggcatcctcaccccaggctgtgcgccctgcgctgcctttatcgacatctgacccctgctagttacgtcatgcccttcttctgcgcagcctgcctgccagaggcccaggagcagtttggacggtactgctgcctcttcatgaccgagcccagtccccggtcgaggtcgcacaccttgacgcccctgctcagccnnnnnnnnnngcggtactgctgtctcttcatgaccgagcccagtccccagtcgcggtcgcacaccttgacgcccctgctcagccggctcctgccggcgcccgtccgtgaggacagtgccgtcagccaggaagtcctcggcgtcgtggtgatcgacgccaccggcgtcaacctcccgccgcgcagaccccgcccgggggcgcagaggtgcggtatcttggggggggccacaccgagcataattacagcattaagcacctgacctcattccatcagcgttgcccacacaaccattgcaggaaggtggcccgcaagcacatggcctacctctccaacctggcggtgatgaaggaccgccggcggtcaggcctgggcatgctgctggtggccgccggagaggaacgggcccgcgcctggggctgccgcagcatggcgctgcatgtggaggcgggcaacctgcaggccctggccctgtacacgcgcgcagggtaccgcagggtgggcacccagccgcggtggcaggcgctgctggagctgcgacgggaaccgctggtcctgctcatgaagaggctgccgccccaggacaggccatgaggagctgcgctgggggttcgcatccccggccacaacgagatgggacgccgcgggttatggactgatactaaatgctttacgtggacaattttgtagcagtccccagatgtatcacttcacggcctcccgcctctaggcggtaatgnnnnnnnnnnagacaggccatgaggagctgcgctggggggttcgcatccccggccacaatgagctgggacgtcgcaggttatggactgatactaggtgatttacgtggacattttgtagcagtccccagatgtatcatttcacggcctcccgcctctaggcggtaatgttacttgaggccagatttctggcaccttgggcgccgtcgaggcgagcaaggaattaaaagacctcatcctgatagtcttgtacactacacaacaacatgccgaacgcaactatttcaaagtccttgtggtgtggcggtatttcgcccgtactgatggtgcggctcgttggacaggttcggccgaggcatccgggtcaaggtttaaggaatacagtcatgccaaatcgggactttccannnnnnnnnnctcgaggcgagcaaggaatttaaaagacctcatcttgatagacttgtacactacaaaacaaaatgccgaacgcaactacttcaaagtccttgtggtgtggcggtattccgcccttactgatggtgcggctcgttggacagattcggccgaggcatccaggtcaaggttgtagcaatacagtcatgccaaatcgggactttccaatatgtaacattcagagaaaatatggatgggagggggggtcagaatggacttcgctaggttggtgaattgtaacaagatagtcttgaggccaccagcccttcaaccacgaggttgattgtcctactcatcataagttgaacccctggcgagcaagctcgcgcagagtggaaggatggtgcgccaggcccggcgccgcttcttgtgggttgctcgactacccccacttccttgctttccagcgcagcagcaacacaatgcacgtcggggcgcgacacacatccaaggatcccagaagaaagtatcttccaaaaccaccagtaccacggtccccacaaacgaaccatgcactgcacctctggaaggaaccagggttgaagtgagcattctggaccgtctggtgtttgcgacacccggagtccgtgtcggtaaggcgggtggtgtggcacatgttgtcactccgtgcgcttccggtgcatgcgggctgtgcatgtcgcttgctgggctgtgagaagtgttctagatccctgatctggaccagcgaggccctccccctgtcccatgacccccagataacagcgcccgctgctgtcgtcgggcagacccggcccgggccctgcccagtacaggagcgtaaatttggacgccttaaaggccagccactgtttggagagctgcggccccgagcgtcggtcatgccgggtgtgagactcaagaaccccaccgtgggcaacccgcctgcaagtcctccccgaacccgcacctgccgccatgcccgcgtggtccgggcgtgccacgccgcccccgacagcggtgggaggcaccgcgacccgttcccacgcacgagcatcccaggcagcacccatgccccgccccagaaggcgcgggaggtcggcgccggggtggacaattctgtcgaccaggcccctgccgctgcgcaggctgcgctgacgccggccactgcgtcggatctggaggaggatgcggactggcaggactggaaggcagtcatggcccgcacgcactccctggtgaggagcatggggatggggtgtggtggtgccagggtctgtatgattggctggtccctcccccctattctcgcccgcaaccccccgccctggttcccgcatcatcacccaccctctcacagctcccctcatcaaccctaccaacgccaccacaggccgaggcacacgaggaggcgtgcgccgcgctggacagctcggtggccctggacgcctacgcggcagccgccgcgctgcgcgaccgcctggccggcatccgcgcgcaggactgcctgggcgaggcgctggccgagctggaccgcgcggtggcggcggagcggtacgccgccgccgcctcgctgcgcgacatggcctgggcgggcctgcccggctggtggtcagggcgcggcgaccgcggcgacgtggcggggcacctcatccgcgtcagccggcggtacgggcactatgccgcgcacgccttctcgggccgcgacctggccgccgcgctgggctgggccccggacgcggtgttcgagtacgtgagcctgggcggcggggacgaggatgctggcgcgggcgaggccgacccggccgcgcaggcggtgctggagatgcacttccgccgcggggcgggcggcgcactggaggcgcaggccgtggcggtgctggggcccgcggaggccgaggaggtggaaagcgcggacggcgacgagctggccgaggtggtggtggcggtgcagggcgtggaggtgctggacagcgacgacgagacggaggaggtggagagcgaggaggacgacgaggaggaggagggcctggaggtgggcggcctgctgcgccgcaccgacgacggctcgcgcgcgctgcacgcgggcggcgacgacggggccgaggacggagccggggacgacgacgacgaggaggaggcggcggcgctgggcttcgcggcgcccggctcgcgcgcgcagctggtg

SEQ ID NO: 39505 - DNA, 43069 bp, Chlorella protothecoides
  modified_base (552)..(561): a, c, t, g, unknown or other
  modified_base (1078)..(1087): a, c, t, g, unknown or other
  modified_base (1591)..(1600): a, c, t, g, unknown or other
  modified_base (3782)..(3791): a, c, t, g, unknown or other
  modified_base (4105)..(4114): a, c, t, g, unknown or other
  modified_base (4312)..(4321): a, c, t, g, unknown or other
  modified_base (6167)..(6176): a, c, t, g, unknown or other
  modified_base (6597)..(6606): a, c, t, g, unknown or other
  modified_base (6946)..(6955): a, c, t, g, unknown or other
  modified_base (7782)..(7791): a, c, t, g, unknown or other
  modified_base (8088)..(8117): a, c, t, g, unknown or other
  modified_base (8316)..(8325): a, c, t, g, unknown or other
  modified_base (8949)..(8958): a, c, t, g, unknown or other
  modified_base (9733)..(9742): a, c, t, g, unknown or other
  modified_base (10643)..(10652): a, c, t, g, unknown or other
  modified_base (11010)..(11019): a, c, t, g, unknown or other
  modified_base (11808)..(11817): a, c, t, g, unknown or other
  modified_base (12248)..(12257): a, c, t, g, unknown or other
  modified_base (12322)..(12331): a, c, t, g, unknown or other
  modified_base (12396)..(12405): a, c, t, g, unknown or other
  modified_base (12615)..(12632): a, c, t, g, unknown or other
  modified_base (13550)..(13559): a, c, t, g, unknown or other
  modified_base (15773)..(15782): a, c, t, g, unknown or other
  modified_base (16018)..(16027): a, c, t, g, unknown or other
  modified_base (17336)..(17345): a, c, t, g, unknown or other
  modified_base (17747)..(17756): a, c, t, g, unknown or other
  modified_base (18234)..(18243): a, c, t, g, unknown or other
  modified_base (18355)..(18364): a, c, t, g, unknown or other
  modified_base (22144)..(22153): a, c, t, g, unknown or other
  modified_base (23074)..(23083): a, c, t, g, unknown or other
  modified_base (24261)..(24270): a, c, t, g, unknown or other
  modified_base (24642)..(24651): a, c, t, g, unknown or other
  modified_base (25081)..(25090): a, c, t, g, unknown or other
  modified_base (25516)..(25525): a, c, t, g, unknown or other
  modified_base (26416)..(26425): a, c, t, g, unknown or other
  modified_base (27011)..(27020): a, c, t, g, unknown or other
  modified_base (27256)..(27265): a, c, t, g, unknown or other
  modified_base (28543)..(28552): a, c, t, g, unknown or other
  modified_base (29648)..(29657): a, c, t, g, unknown or other
  modified_base (29753)..(29762): a, c, t, g, unknown or other
  modified_base (30789)..(30798): a, c, t, g, unknown or other
  modified_base (31322)..(31331): a, c, t, g, unknown or other
  modified_base (31893)..(31902): a, c, t, g, unknown or other
  modified_base (32455)..(32545): a, c, t, g, unknown or other
  modified_base (35058)..(35067): a, c, t, g, unknown or other
  modified_base (35380)..(35389): a, c, t, g, unknown or other
  modified_base (35464)..(35473): a, c, t, g, unknown or other
  modified_base (37660)..(37669): a, c, t, g, unknown or other
  modified_base (38337)..(38346): a, c, t, g, unknown or other
  modified_base (38872)..(38881): a, c, t, g, unknown or other
  modified_base (39397)..(39406): a, c, t, g, unknown or other
  modified_base (39795)..(39804): a, c, t, g, unknown or other
  modified_base (40716)..(40725): a, c, t, g, unknown or other
cggccgccgcctgcagctgcagcagcttgtccgtggccaccagcacctcgcgccgcgcctcggccgccgcggcgcccagcgactgcagctgcgcggcggccagcgcctgggccgcggggtcggaaatcatggccatctgcgccccgccggcgtgcagcgcggcggtcagccgctgctgggaggcggaggcctgggacagcgcggcctgcgccccggcgatgggggctatgtactcgccggggacgggctgggagaggcctggggcgtgacctgcggaggttgtagggcggtgggcaggtgaggttgggcgagcaaggccctgtatgctgctggggggaggacaagagagggagaggcgagaggggggcggggcaatcagtgcggcggtgtgcggcaggcaaagcccaggtgggctgaaagctgccgacatcatgggcgggcgggggcgggacattggacctgcagcgatggcaggaagtggcagtctcaaagcatggcccccacccttctccccctcccaaaagagagcatacaccgctggggctcccaacnnnnnnnnnntgttggacctgtagcgattgcaggaagtggcagtctcaaaccatggcccccaccctcctccccctcccagaagagagcatacaccgctggggctcccaacaaatccttgtcgtcggtgcgagggggcaaaaaatcaccctgccctccccacaccactcaccccaccacccccacacacttgcaggccccagcgcctgaggcatcggcggagctgccgggtgctgcgccgccgcgtcgccgaatgcttgcacctgtggcaccgcaaacagcggggtcatggacccgtacacgccgctccccaggcctgcggtgtggtctgagcgagggtgtgccgccatttggtgctcgcgacaacgaaacaaagcacacagacgggcggcgagcacgccgggcagggcacagggtcgccggcgcttcgccctcatgctgacccccaaaaaccccaagcaccccccctctgagaaccttggaagctggcggaggtgcgggggctgctcgcgaggggggcaggcagatnnnnnnnnnngtggtgctcgcgacgacgaaacaaagtacacagacgggcggcgagcacgccgggcggggcacagggtccgccggcgcttcaccctcaagctgaccccaccaaaccccaagcacacccccccctgagaaccttggaagctggcggaggtgggggggctgctcgcgaggggggcaggcagatcagagcgcagcgaggccacggaggggttggagtgggccgaggccctcgagatgtccaggtcgcgcgcggccagcccgccgacgctcgtgcttggctccgcgtgggtggacagcgcgacggagccggaggggaggccctgcatcgtggcgtaggtggggtggcccggtgggagcgcggccgctgcatgcggggccaggggcggccgcgccagcccggctgccgcagggtatgcggcgggggcggggaacccggggtaggcgtgggtggggacgcccggccagccgcccaagcctgaggggaagccggggaaggggggctgcgccnnnnnnnnnncgccgcggggtatgcggcgtgggcggggaacccggggtaggcgtgggcggggacgcccggccagccgcccaagcccgaggggaagccggggaaggggggctgcgccggcaggcccgggaacgcgcccaggccgggctgcaggtacgccgcggccgtcggtggcgccgagaccccgccgtaggccgccgccacgcccgggtgcaggcccgtgtggagggcgccggcatggaacatggcggggccggcgccaagctgcgccgccgccgtcgggcccggggcgggggccgtggcgacgtaaggcgcggggaagccctgccaggcggccgctggcacgggctgcccgcccgagggccaaccgcccgtggcatggtgggggacgcccagccccggcaccgcggccgggtcggggcccagccctggcacggcgcccatgccaaagggggacggctggggctggggcacgcccacataccccgactgggtgctggtcatggtggaccaggggctggcacccacggacacgctggagccgcccgaagggtggcccgaggtggccatgcctgcagcagtggggtggtaggtcggcgcgaggcccgtgccggggtcggggggcagtgcccctgtctggccctccatggggctcatgtccaacgggtggaagggggggtcgtcggtggacgcgcgagcgaggcgcggtccgctcgcgggaatgacgcgcggggatggggtatcagggggccgtcatggcgtcctggtgatgatggcggagatcggtgagctcgttgcgcaggaccggacgtgagaggacacgcctcgctccgcacgcaagtccatgacacgccggatttccgcaagtcgagcgggctgcatggcagggccagatccctcattcactcacagcgttcagtcagcagggtcgcgcccaccaggagacgaggctgtgccagaaacaagggcgcgcctcctatccagggttccagcctgcgttcggcgttctctggggccgctctgtacggttctggcgaaatttcagggtgcaaacgttgtaattctatcgtggagtcttgggaagacgtcctccgcagcgggttgctccagggaagctgttcagaatcgcgcgcaactccgttaaggaaggacgtcgccttcgaagctttggcggcaatacatggcgtgggggcaatacgggtggttttacagctcccgaaggtgaccggaatgcatcaatgttccgcggattgcaaacaggacagcattacagagcacttcatactgctatagggcagcgggggaaggtagtgacggaagcggtctgccctgcaataggctcaggccttgccgcacatggccacaagggtgcccagcatcagcccctgctggcaagcagtgtggccctgggccctgtcagcgacaccttcacagcccaggagaaggcgttcttcacccccatggggtcattcgtggcagtccctgccacatggcaaaggcgcccctccccaccagcatgcactcccagggctgcagccacctcctcggggctgcaagccccattggcatcctgcttgtgcacaagcagtaggaggggggcatcgaagagttcctgggtgcctgcagggagatggggctatgcgtgaagcagggccgagattcatgctataccccaagttgcgagagggaaagggtgtttttttgctgcctgtggaaaacagagttcatgcagagaggggcccacctcgttgcacacaccccttgccccaacctgctcaccgagtgcgctgtcgagcgcgtgcttggactcctggaatcgcgatggggtgctggcatccacgaccatgactacggcatgtgcctccccgtagtactcggtccagatcctgcgcagccccggtgcgcctcccagatcccacactgtaaccggggaccccgccaggtccaggctcccgatgttgaggcccacagtgggctgaatggctgcaggcgccactgacccggcgctggggtcgcatgccgccttcagggcctccagcacgctggtcttgcccgcctaggaagagggtgggcgagacttgaaggtgaaaatgggccatgaccgagctggagatgagagcatgagtcgggtaaaatggcagcacgctgccacaccagccagtgcacggtcccatcttctgtgggcaactcacgnnnnnnnnnnaaaggtgaaaatggaccatgaacgagctggagatgagagcatgagtcaagtgaaaatggtagcacgctgccacaccagccagtacacggtcccatcttctgtgggcaactcacgtcatcgatgccgatgaggagcaggcgcacgggctctcggtgggtccaccagtcatagaatccactgatgaggctgtacgccatacgcactcagattatgtatgacggagcggcggagcgcgagggttcctgaaggactcgcataagatcacttctgtgtagtgcccacctcgtcgatcatcgcacccactcagagccagnnnnnnnnnnatgtgtctggttcgcctccgtgtagtgatgcttgcctcccgctgattgcgcccatgccccgcgctctgagaacgcctcagcagtatctaccggaaccacactccggagcgcattggcccgcctgtctcaaacactgtggcttcgtatgctccctcggacattctggagcgtggtattgcatcccctgccccaagcacnnnnnnnnnncagcgcattggcccgcctgtctcgaacactgtagcttcgtgtgctccctcggacattctggtgcgtggtattgcatcccctgccccaagcaccggccctaccagccatgtacatacccccaactgccccccagcatggcttcggtggtccaacctaccggccagcccagccgatggcgccccacgcagcctaccaggcggacgataaacatgctggaaagtcgaaggacccggtactgacaatctccaggtgcagcgaacctcctcgaggcagcgtgttggtgggatgcgcgtagtgtgatcgctgtggcttgtcgtcgatgaccacccccacccgctccgcagatggtttaagacgcggagttctaaggagaagctgtacctgggcattggcgctgccgtggttgtgagtggcgcgcccatggcccctgcgagtgctcccctggctggtgtgggagtcccacctccttgtccagctgcatgcccccgatgctatgggtggcctgcagtctatgcgaggttgtgtcatgcactcgagtgcatgcattgcagcgacattcacccagtgctacccatgcacagtacaaccccaccccaatccaacacacaggtcctgctcctcatgtggtttgtgatcgaggaccacgactcgctgtttgtcatgtcggagggcgtgcacttcctgggcatcggtgtgctggcctacaagatcatccgcaagcgcaactgcggcgggctgtcgctgcgctcgcaggagctgaccgcgctgttcctggccacccgcctcttctgctccttcatgatggagtacgacatccacaccctgctggacctgctcaccctcctggccacgggctgggtggtgtacacgctgcgcggcccgctgcgcgagtcgtaccagcgcgaactggatggcctgaacccgctgatcatcctggtgccctgcctgctcttggccgtggtggcgcacccgggcacgcgccacgcctacgccttcaaggtacagggagtgtttttgagtgtgtgtgtgttttggaggggtgtgttttggaggggggggggggcgattgtgtcggtggcggtgaaccgtgggaggggggatcgagcagcgtgaggggctcttcagcccacaaacaggcagagcgccggcccgaacggtccagccttggcaccccggcgagaggccaggggaggggttctgctttgtgtgagctcgaccgagagaagactgtgcgcagcgccgactgtactgcggcaagccatggccccgcatcacgcctcaggccgttttagaaccctggtttatctcccttttcctgaatctcgcgcgagacggcccgcctcaacccaatccccacacccgctcctcctgtccctccccactactttcccagatcctgtgggccttctgcgtgtacctggaggcggtgtcggtgctgccccagctgcgcatgatgcagaaggccaaggtggtggagaagttcaccgcgcactacgtcttcgcgctgggcctgtcgcgcttcatctcctgcgcccactgggtgctccagatcctggacggcgacaagtacctctggcaggcgctgggctccggcatctggcccatcatggtcctggtctccgaggtggtccagaccttcatcctcgccgacttctggtgagtgggtgtgggtgaaggggcgggtgggaggggtccagggctgaagcagtcgctgcgcatgccggggcagtggggtctgaggggttgcgtccttgggcgagccagccgctgtctggcagtttggttgcgcagggcaaggccttgggcccagcttttcatgaagagatgtcgctgcatcccacccaannnnnnnnnncggggtctgaggggttgcgtcctagagcgagccagcctctgtctggcagtttggtcgcgcggggcaaggccttggacccagcattgcatgaagagatgtcgctgcatcccacccaagccatgccctggcctgaccccttcccccccccacctgaccttcacgcgccgcagttactactacgtgaagagttatgcggagggcacgggcattatccacctccccgcaggcatcgtgtagggcaccccagcaggcatgccgcagcccttggatgctgctggggtgggcggcaccgcggaggaacatggtggggtgtgcagcgggctctgcctcccagaggcggcatgtggatgcatcttggagtcctgcagtgcatggcccgtgcacacgttgttaaaaacaatgataagcaaggcaggaccannnnnnnnnnggcagcccttggatgctgccggggacggcaacaccgtggaggaacgtggtggggtgtgcagcgggctctgcctcccagaggtggcatgtggatgcatcatggagtcctgcagcgcatggctcgtgcacacgttgtttaaaaacaatgataagcaaggcaggaccagatgtgagggtcaggttcaagagggcaagggtgttgtctgaacttctacgggggaggcatcggatgttgaatgagccgcgcctcgatggccactcggttttcaatcgcgccatctcggcaaaatacgacccactcgctgatcatgttaccctcgccaatgtattgtgccgttttnnnnnnnnnnaggggaggcatcggatggtgaatgagccgcgccttggccactcgctttcaatcgcgccatctcggcaacatacgacccactcgctgatcacgttaccctcgccaatgtattgtgccgttttcatctgagctagtctggcagttaatttgatcaatagcaagggagtcgcccaccaggcgagcctaaagtacttctgtccccgtcacttcactagccagccacaccctccacagtctttctgaggggcgaggattcaaggaggtatacctctccgctctagagtacgatacaggtggtatgtccaatctgggaacccccctaccagatccgccaggtgacggcatcacctccctcaactttgtggactccggcaacctcctgctcgcctcctcctgggattctgtgagttgttgacggcttgatgcgggttacagcgatagactgttggggatcgtactacctcgaactcgccggactggtgactccatatccgtgttcgctgtgaaacccacagctgcacacaaccagcctctcttccggtccccaacagaccctgcggctctatgccgcggaccaaggcgagctccgaggcacacatgagcgcggcgcccccatccttgacgcctgtccagcctcggagtctgtgtcttacagtgcaggcctagacggccggatcctgcggtaagcatgcgtcgccatacgcgcagatcttttcttgctgcatgacatgagattgatttctagctataacatgcgagcccaacgcatgttactacctatttgcaaccttcaatcccttgcgcctcctgctcaattctcaacaccgnnnnnnnnnntgagcccaacgcatataactacctatgtgcaaccttcaatcacttgcgcctcctgctcaattctcaacaccgtagacatgactgggagagccaggctcagacgctgctgggttcgcacagcgaacctgtgcggtgcctgacctggctgcccgacctccagctgctggcctcggccggctgggactccaggctgaagatctgggacccccgaatccccgggtcagatgaccctgtcgccgagatgcagctgcctgacaaggccttcagcatgactgcgggccgggagaggctggtggnnnnnnnnnnnnnnnnnnnnnnnnnnnnnngtttgacctcaccaagtgagcctgcggtgctgcgccggcggcagcgagggctgtgggtgtggacatctgacatgctctttggtccgccctgatcagaggagtctggcgtggttggtgtggactcttgcttccatgaccctggtggcaaaacgtgagctgctcacctgatcacttcatgcccatccaaaacctgcctacnnnnnnnnnnaaaaacgtgagctgcccacctggtcacttcatgcccatccaaaacctgcctacacaccctttccctctctccacacccggagcgcaggctcaccaacggcgtggagccagagcaggcccgggagtcctcgctcaagcaccagacgcggtgcgtgcgcatgtaccccgacgggtctggcttcgccaccgcctcgatagagggccgggtggccatggagtacttcgacctgggcgacgcgcaggtgggtaggagagcgcaggcgggtaggagggcccgggccgctgccatggctctcagcatgcgcagaccagtgccctgcccagctggctgatccctgcatgctgacgtctcacatcccgtgccttccatcctgtgcggcaggccaagcggtatgccttcaagtgtcaccgtgccagcgaagggggccgggacgtggtgttcccggtcaacaccctggccttccaccagacacacggcacctttgccacggggggtgagcgggcgaacgctgtgcatggggtagctgctgtcgtcgcatgtgcacagcatgtgcttatgaacaagacaagccgcctgtgtgggcgtccacgggtttcagagggcaatgggacggggaaatgcctnnnnnnnnnncatgaacaagacgagccgtctgcgtgggcgtccacgggcttcagagggcaatgggacggggaaatgcctcagtcgatgtcgctctgccactccggggtcaattcaccatacctctgggcccccgttctgactgcagggtgcgacggtgtggtgagcatctgggacggcgagcacaagaagcggctggcccagttcacggggtacccgacctccatcgccgccctggcgttcaacctcgccggcaacctcctggccgtggcctccagttacacctttgagaaggtgcgacgagcgtgcggctttgggggctggatacgagatgaatggggggttggggtttaggagcttgatgttaagcctggggactcctacgttcaatcttagcagcgggcagactgatagatgtgtacaggtctgcgaactctcctctcaggggtggcctgatgattgccagcagctgcccccccagtacctgcccccccccccagccctctgatgcttcctccctgccgcagggtgacattgaacacccggcagattccatatacatccgtccggtggaggatgcagaggtgctgccgcgcgtcaaagtgaatgctgggccctgacatcttgggacggccgcaggatgcttgcacaccctcaccagccggcgcacgccgccatggatgcttatcggaggtttgcgaatcatgtgggtattgcccattgctggacacacacagcacacagccttgctcgacagaggacaaaggaatgtgggagactgggcgannnnnnnnnnaaatcatgtgggtgttgcccattgctggccacacacagcacacagccttgctcgactgaggacaaaggaatgtgggagactgggcgaccagaactccaccaggcattctcaaagctggagctgccagatgtcgacgtactccagctgcaggggctcggggatgtcgcggagggggaccatgctcacgcgagagaagagccgcctgctctcctccaggaagcatcgccggacctggagtccaaaaagggagggacgaggagagtggcagcgaggctctggaggcatgtgatctggccactggctgtccaggaggggtgccgcagtgtttcaaagcgggaacatcatttcccccaaaaccagatccctctggcatggtggaggtgggcgtcaccgccccctgccctttgttacttaaatgagctcaatgatgagccgatggccctcctgtccctgccccccccgcctctgtaccccacctctggcgaccgccgctcaaaggagaccaggaccagggtgtcaggcccacacaggcccgcgcaggtttccacgaatgcgggcgtggagggcgactcgccgtcctggtcgatgtagcagcagtccgccgccagcaccaggtcgacccccgggggggccgccaggaggcggaccccatccatccaccccggggcgccccagtgcaggatgccggcctcggcccaggcctggccctcatgtgacggcctgtgtgtgtgggaggggggcctccagggttgagtgtgctgggaatgtgacgggcatgagcagggcgggctctcagggcggcaggatgggggacgagcggtctgcaaacccaatgtacaagcgcctgctccccaagggacaactttgcagcaatcccagcactccattctcttgccacacnnnnnnnnnnagatgtgggacgagcggtctccaaacccaatgtacaagcgcctcctccccaagggacaactttgcaacaatcccagcactccattctcttgccacacaccgtgcctccgggccaaacccattggcggccaggttgtccttgagcagcgggaggaccttggcaatgtcggtgatggtcacctgggatgaggagggaagtgggggtcacattcggcagaggagtggcgcctcgaggggatgggaaggtgcacactcccgccccagaccccctgttgagaccgggggaccccatccagagaacacgttccctctccaaggtctggcatgtgcccgactgcggccttccccacccatgaccnnnnnnnnnngtgaggagggaagtggggggcacattcggcagaggagtggcgccttgaggggatgggaaggtgcacactcccaccccagaccccctgttgagaccgggggaccttgtccagagagcacgttccctctccaaggtctggcatgcgcccgactgcggccttccccacccatgaccctcgcgcgctgacctgtgcgcccagcccggcggccacgaggcccagcgtgcccactccggcgcccagctccacgcagcgcatgccgtggaagcggtgcctggggagggtgaggaggtaggcggccaggaccagggctccgtcccagaggcaggcccccacgccgaccttgcgcgccgtcagcgcccatggctgcggggtgtaggtgcaggggttgggttggtgtgaggggcgatgcaggtgttacgggagaggaatcaggtgctggaagaggatgttaaggaagtacttcttactggcacgcggcccatggcctggagcagcaaggcctgcaccgctccagccctttccgagctcctccacatcgacctgctgaatgacgcggaggcgcatctcgcccagggtcagagccacctcatccgcgctgtggacctcccaccgatcagcggctgtcaaacgctttgaggtcctgaccccatcctcccacctgacgcatgattggagggtgtggcacgatgctccactcagagggccaggccacaataatactgctgcacaaggagcaccacctcctcacatgcaggcgagacatcggcatacagtgcactcacttggtannnnnnnnnngtgctccactcagagggccaggccacaaaaacactgctgcacagggagcaccaccacctcacatgcaggcgggacatcggcatacagtgcactcacttggtaaattccagtgaaaagggtatgcgcatggtgctgaggacaaccttcttattgctccagcaacgatgccggcatgtggaccctcgtacagccgtctaggctcggccacaccatgctcaatgccaccccctcgaacgatgccacgacaacttcaaaacagccgagtatgaatatggtaatcaaccaggccttgcatgcatggtcaaccgtactttgaggtctccccttgcaaaatacacagtcgcgcgccccaagcgggactcgatagtggttgcactgcttgtcgacgagggtgtgagtggttgttacaggtgattatgctgttacatacnnnnnnnnnntagcatgcatacctaaagatggccaatgaatacttagtgatggaggggcaggacaatggggcccnnnnnnnnnncagcatgcatacccaatgatggccaaggaatacctagtgatggaggggcaggacaatggggcccnnnnnnnnnngctttgaggtctccccttgcaaaatacactgtcgcgcgccccaagcggactcgatagtggatgcactgcttgtcgacgagggtgtgagttgttgttacaggtgattatgctgttacatacctggactgccaatccatgctacaattagatacagggcttattgatcagtgtggaggaaaatggggggtaatgagatgagcaggcgccaannnnnnnnnnnnnnnnnncgaaagaatcccagcgatgtctctttgggtgaggaatcgagtaccttcttgagcagcttgcgattgaacctgtacagggggtgcgatgaagctgtggtgagttgcacaaggttgcaacaggcatccataatgttgagggggtgccagctccagccagatcctcctggcacatcctccacatgctccatcacctgtacagttccttccagctcgagggtgaaatgttcaaggggacgttgaagtctctgacgcagagcctcctccacaggtgcttgtcattggccagaaccctgggtcgtgaccagggacagagactcgagtcgaacgaacagcgggccgctctacactcagggatgaaaggcgtctacacccagcccacctgcaggaggaattaacgagctccagcctcgccagatcccgaggcgagtcgaggaacgacaggatgttgaggagcacctccaagggcagcttgccccaccgcgtctgcatgccactcgagtccacagggcgcagctggagcgtgtggacataagccgggtgaaccaccaaagccctggttagcgactccaaatcctcaaagtaggactcgttgttaccccggaaggccgagtggtaccctcggctcgatccggagtagcgacccatggtgatgctccaagatacagaacagtgttgagtacggtgctcctggggcagccgttgggaacgggggcccccatcgggagtcccgacaccctcacccttcggacgtgtacgcgggaaatctcccgagactttctaattttgaaaccctcctcatgaaaccggcaaacaggacatcctgcgaaactttctcccttcacattgacacatcatttgtacagatgcgcactggcatctcattttcaaactgcgaatcatgcttcacgaggatgcccnnnnnnnnnncacagatgcgcactgacatttcattttcgaactgcgaatcatgcttcacgaggatgccccctgcccgagcatcgtgtcgcctggggtagattcccactcagatccgagctctccaaaatcatgccagacagacatggaacgcgacgtcgtgctggagatgacagaaacgtgtctcaacggcatggcaaaggtgcacatggaaaccgcctccttgttagccgagattgaggccatgtcgagtcatacatgccacgtgctggacgagctcaaggcccgcttcctggaacgaatggatgggtaaggaaccacgctcccgcacctatgtgactttcggagtgccgtgagaggggaactgtcgacgatcctctcagaaatctacaggggggggtggcatggcgtgcataccaatacaagtgattcctcattccccacgccaacagcatgcggtcccaggtcatggagtttgtggaacagcacgagtctgagtgggtacagatctcggcccagactctgacggcccagaggaagctggccaaggtgcaaggcatggtgcgatgcctgggtctcggtgccgagtccttccaaatggacatggagggtacttcacacgccctggcctgatgaaccatggcggcatgagtgcccagagcatgcgagccttgcaacagtttcacctcattccctgtgcaccacacgcatgccatggaacgtcgacctcagcaggtttcagaatggtaacaatgcactcctttccacttcactgcggctttgcccccctttgagatcctcgagcaccacatgagcaagcggccacacacagccagcgcatgctcacaaggtgtggctgggggggggggcatgcttgccgcagcagtagcgtgttctgggctgcgcacgtgcgtcggggatcttcgactcctgggagaggaacgtcctcgggccaggggccaggggcgcggcgggggtgtgagcttgggtcggcagcagcacttccaggacgctgaaggcctcaccctgccctggatggggttccacaaggagaatgagacccgtcagcatgatgatgctctgtcctgccgggagtaccgcgaccgcagggcccactgggcgatgcagggcgtgctgctttgtcaactgtcagcatacatgcgtggcctcctcggacatcactcacccacgctgccgccgggcggggatgcaaggggcggggaggccccctgcataccgggtaagggcgggcccagcgacgctggcggctgcgactgctgggaaggcatcttcgacaacggctgggagtgcgttggcatagccggctgatgctgcctctgcgtcagcacccgggagtctggacgtgcaccggatgggggcgacgtctgcaccggcgaacgctgcgacgcatgcgtccctgctctggagagcgtcttcgtcggcgtctgcgaccgcgcccgcatcgccggtggcgacagcggctgcgttgccagctgcgccggcgtggatgcctgcgacgcagcctgcggctgcgacgcggcctgcgtccccagcggcgcctgtgccagcgcccgcagctgtgactgctcctgcgccgccagctgggatggcgcctgcgtctgcgcctgcgtcgacctcggcgcctgtgtccgggagtgcagctgcatcgtcggctgggatggcgagtgcgccaggcactgcggcgaggaatgcctcaccaacggcgccggcgagggctgccctactgccaccggggctgcagcgccccgggcgatgggcggcccctgggtggcctgcgggctccacggtggctgtcctgccacagagtgccccccaggcgcagccgggaggcccgcctcagagcgcacaccagccgatgctgcaggctctgaggatgcagtcctcggcccattccccatgctagcggcgccagggcttcccctgggcttcagcggcgatggctggggggttgtgcccggcatgggcatatcggggaccgaggggaggttgctgcttgggccgactgccccgaccttgccctggatgaggtccggaatggcccgcaagccctccagcagatcggccgtggcagccagcgagctctggaccccctcatgcgcctgggaagagggtgccgggggacactggggtgagtccctgcacaggaaggcgcggcgcacacatgtgtgccaacccccccaaactgcggccgcttcttccccatcnnnnnnnnnntgaagggggtgcggggggacaggtgggtgagtccctgcacaggaagacgcggcgcacacatgtgtgccaatgcccccaaactgcggccgcttcttccccatccacgcgccgggtgcatgccaccagccccccagcgcacctgcaggcacgctgtgcgcgcttcggccagacgcgctagggccgcgggggtctgcaaaaggctctcggcgatgtcggcgacccagtactccattgtnnnnnnnnnntccagacgtgccagggccgcgggggtctgcaagaggctcttggcgatgtcggcgacccagtactccattgtcgtgtgcctctgcgccagcgccgccgcactgtccatcagggcgcgatgctgagccttggcctcagcgaggtcgtgcactgcctgctccgcacgcccctgccacgcttcggcctccgcctttaccttctgtcggtggaccagggaggatcggaggggtgcggcatggcatgtacagcccatgatgcagcatggactccactgagggaggcacccacctccacactccatgcagcaggtggtagagggtgagcggcgacgcagcgtcatggaaactcacgggctcatcagcgtggacgctaggcacatcacacgactccatccccacccccctcacctcctctagtgccacagcagcggcgagatctgcctccagggcgcaaaccttttcgtcagcagcggcacgagcttccgtttctcgccgcagctgcacatgtaatcggcccgtcttggtgtcggagttgcgtgactgtggggacaggggtggtgtgaggggactggctaccagactgcccctggcagggatgcgtcgcaagcgaccaccaacaggaatctcgcagcgacgacggaggcacgggagccattaccagggaacctacacgaccccagccatccgtggccgaccacatggaccccccccccccccctgatccacatcatcagcaaaacgtcgggccagggtggcggttcgggcacccagcacctgcttcacacctcctcaccatttctagcgccgtgtcggatgccaactgcagctgctgcttcaagcgctccacctcggctgtggccgccttcgttccctcctcagccttggcggccttgcccacggcggcatcggtctcgctcctcgcctgcccagccaggtgctccgccgtctgagccttgatggagaaggccgacgcctgggcctcagcctcctctgtggtcctcttaaactcagcagcagcctcctttgcagcctctgcagccgccaacgcactccttcggtcctcctccgcctccgccgcctgcgcgcgtgcagctgctgcgtcggcgttggccgtctgtgcggcctcccgggcttgtgccacctctgccttcaggacctccacctcccgcatcagggcctgcacctcagcggtgtggcggtcgggttctatgtcgccgtcttgctggcgcgccagaccctgcacagccttggcaggcgtcgccccggcggccacgagcgccgtcttggctgcctgcaggtaggaatgggccannnnnnnnnntaggccctgcacagccttagcaggcatcgccccggcggccacgagcgccatcttggctgcctgcaggtaggaatgggccaggatggaagggaggatgagtagggaggcccagctgcctaccagctgaacaatgccccgccggtgttctcagtggattactccggtccgttctctttcttggcatccagaatgcaaatcaagttcatggcatgatgcgaggtgcagacagttggtatggccggccgcctgcgcccgcatacaaacaccaccggcgcaccctttcctgcgtgacctgggcggccagccgtgcctctgccagccttgcctgctgcagctgctcgttggagtgcctcagctccttgcgtgcatttgccagggaagctgccagctcctgtcatgcannnnnnnnnngctctttcttggtgtccagaatgcagaacaagttcatggcatgatgcgaggtgcagacaattggtatgaccggccgcctgcgcccgcatacaaaccccaccggcgcacccttaactgcgtgacctgggcggccagccgagcctctgccagccttgcctgctgcagctgctcgttggactgcctcagctccttgcgtgcattcgccagggaagctgccagctcctgtcatgcggagcggtgatgggcaccaaaggtgactgtaagcagacacattgccaaaccattgcctggcggcacaggcgctttcctgtctgattgccaggccagccgcacgggtgctgcatgccagctgaggggtgcaggaatgccacatgacacctcatcctccccatcatttcgacaaacggtggacatggtgtgcccatcgaagactgacctccttctcaataggcccggcagacaaaggagatgcgccctnnnnnnnnnnctgtggcgatgaagacaaagcatctgtatcaccttcaccgtcggcacccgcactcactccaagattggatcatgcatcccgatgttgctcagccgcagccgtgcacccagtnnnnnnnnnngtggcctgcgagagtgaatggcgtttcataccgctgccacccggcaaggctttcacgctgccagcttctggctctggctgcgcctcctcaaaacgcttcagctcaaacctgttattgggttcgagaggggatactgcatggagtgattgcagccagtgccatggtccccttgtgtggcaggacatgggttgtggccatgaagacaagaatctgtatcaccttcaccgtctgcacccgcacttactccaagattgggtcatgcagcccaatgttgctcagccgcagccgtgcacccagtggaagggggagactgccgtttttggggacgcggacatcattcacataggtgccatttgtggaggtatcctccacatgccaatgggttccctgggggaagggccagtggaatggatggatctcagcagagtgaacgaaaaggcacaaagcatgcacatccaccatgcacgccagatttgactcagaatgcgccatcagctcacatcggcgctgtatacacggcaatgccgtgagctgaactgcagccagtcaacgggtagcgtgaaggtctggggccccgcaacccctctgccaatccgagtgtcgccatacagcactatatcgcagccgtgcgggccgatcaaggctttggcgcgatcattggtggcgatcaagcggtactggggcattgcgtgacatgcggtaattgcttcccgagcttcctgactcgatcttacagcagagtctgccccgggcactcggtaataaattctctcctcagagattcgattgtctcagcatcgctcagccctcctcacaacgtgcacccgtcctgcaaaggcggattgcttccctcccacctcccacgtggtcgcgccgcatggcgtgctgcatctagtattcaaattttggcgcccaggagccacccgatactcacatgatgatgacttccgcccctacctacgagacgctgctaaaccgactgtgggggcgggcttgtctggccttgcatttgtccggatgagcatcgtcacttcacgcagtgtcaacgccgcctgcagctcttcttccatttccatatcggccatgaaaatcaacaacggcctctggattgccgtgacagtggccatgatcattacacgaccaagtttgcatgggccatttgactcacttcttcccgcgccctcccctcccagagaccgccttgccagagcttcgacctccactccccctccctctgccgcccttcccgctgcttctcgctgccgtggacccatctttgagggtcaggctcatgcccttgtgcttcatggccatcaactgcaatgacatgagggcgtattggtgcgtggggaagaaagaggaaaagagccataatcctttgaccattaaggagagggacaaggaggatccttgcgacatcaggccacactatgcagcgttcccaaggctggtaagatgctgtatggaggtggaaaccattatttgaatgctgatgcaccgcccttgtattccattccctatcaacttccatggcccaccttttgctgtatcactacggggtcaagctcctcctcctcctcctcctccgctccagcttgtgtctcctcgccctcctcacctggcacaattcaagttggagagaggtaagccagaagttgtccacgatagtcaaaagccactcatgctcgtgcatgctctcttctcccattcaaccattgagccgtcgagatgtatcccatgaagcctggtagacgaggagacaggggcgggccccccctctcgagaccccggcgcaccaaactcatccgctccgccctccagggaggcgccgccgccccgtcccttcttcttcacccccccttccatcttgaagccggtcttggggcgtaggtgctgcgcattgaaggccctggtaaaggcagacttcacctgcacgcgggaaaaagaatgggagttcagccgtcaaggcgccaggcaagctgctctgccaggggcagacgccaaagcatgcagcgcagcacgcccagcctgcatggcgcccccgctgcagatgcattgtgtgattgaggaagaccagggccctcatacagctggctggcagcatcctctcccccaccttccctgccaccccgacctcacctgtgtctcgatgggcttcatggggtcctcgccccacgtccccttggtcttccactttgtgacatctgggttatgatcggtatgggggtgtgactttggcagcacgtgcttccctggcactgcggcccagcgcaggatcatgtcgaccataggcctctgcaagtctgccagtctctgagcggagcaagcactccactccctcctccgaaccaccacctccctgatgcagccacccctgaacacactgcacctgtgatgaagtcaatgtcttcccgcgccagggagtagtctgccatctggtgtagcacttcctcgatgccctcctttcctttccttgccaggggctggaccagggtgttccgcagcacgggcaggtagcccaggcgcagcgcggtgcggtcgcactccagcgacccggatgacgtcatccgggtgtgcagctcgcccagcaggcgccgctgcttgttggaactggagaagttgcccagccaggcagtgaacctggttttgatgggggtgggtgggttgtcagggacggctgaggcatgggctgcatgagagtagcccggccagcctacgcctcaggctcctcagcatgctaccagcgttgctggacgggagcctggagtgcaggaatggaactctcccatgtgaacctcctctgacaccctgtccccaggtgtcaaagcagatggggctcgcagagccagggcactgccagcccatcacatgcccggctggccattgctgagccctgggggtcacgccatgaactgaccccacctcgggaagttgggctccatggggtacaggcccagcacctcccgcccaccgcgcatgtaggtggctgggaaaatcgtgcccatgaccactgcaaagggggacagtgcccagttctgggtctgccgcaccctgcggttcaccaggtcgcccgcggagaaggcgtctgctgccttggcgatgatctgtgggggcatggcagggggggtgagggagcgaggagacccttgggtgacagtgctttgtgacagtggcggctgcgaccccttcagggcacgtaatcacacacacacacacaccctccgacctgcatgcgcatcgtgtcgttctgggcaatcttggggcggtggtttatgtagttctcctggaccaggaggggtaccaggtcagcgtcctggaagaccaggtccatttgatccctgcagcaggttggagggtgttggaagaagggtgtgttgagatgcatgcacatacggcacaccaggtcatgtgaggggcaagcgatgcagttgccgctgccggcagttgacatgcatctggggtcatgtccaagccaccatcacacaaacagctggaaaggaaggccaatgggagaggcaaggccctgcagccatgttgtgatcatgacaggtggccaaattgaccctgatacaatcccaaacatccccacgacgcacgagagcgacaggccttcgccctcgtatcccagcaagcggcgcccggcttcgaagggggacatctccaggtccttggacgcccccatgcctcccgtcttgacctgggggcgggtgcatatcgaggttgcatgggacagtgggtacagtttggcggtggtgatggtgtgagtttctctgagccttnnnnnnnnnntgtcttgacctgggggcgggtgcatgtcgaggttgcatggggcagtgggtacagtttggcagtggtgatggtgtgagtttctctgagccttcccctgatgctgtcccccgatgcaggagacaccatcaagtctgcagggcgacgctccttcccagccaagagctggacttcaccggtgcacagcactgaacctccgcccagatcgcacagtcagagaccccgagccggcatcccacctggtcgtaggagaggctggcggagcgccgtcgcaccatctgcagctggcccacgatcagtcggatgtcgccgccgtttgccgattgaattagggcggccagcgtagcatcgttcacggccagtccctcggccctgcagatctcctgcgcacgcttggtgatctgctgcacggtcggcctgcaagcaggttttgtcaaggaaagggggaatgggcccggcagtggcaagggctggtgaggcgagcgatcacaggatggagtacgcccatgcgtcgcaagtccccgccccatggccagcctgagtgacactgatttgcacaagcacacccacttgcggaactccagctccaggcagtggttgcgcagtgacctcagcttggggtggtacttgtcgttgcagatggcgatgatgggtgtccgcgtcttgtggatggtctgtgcaaagcgggcagtggcgggacagggatgggcttcaagggtgtacgggagggttgctgctggtcagcatctcaggggagtgcggggcaacgggcccactgatgagagagctccttgtcaccctatgtgctcccagtgggcacctcatcccttccaacggtacagccaggcacccaggaaccatcgcatggatgcacacggggcagagcaaccccagcaaaccaagcccaacagccagactggaccnnnnnnnnnnggggcaacgggccgctgatgagagagctccttggcatcctatgtgctcccagtgggcacctcatctcttccaacggtgcagccaggcacccagaaaccatcgcatggatgcacacggggcagggcaaccccggcaaaccaagcccaacagccagactggacctggatgaagtcggccaccccaccgcggtcccccgccgacatgccatccacctcatccatgatcaggcacagctacgcaggtggcagggagtttgggggggattggtctggagcagcgtggaggcgcatgcaagcgctggtgcgtaggggcatgcttgaatggcatgctgccggcttatccctgccacccaaagaagcacacagcatgatctccctgaatgaatgcggccgcagcgacccgccttgcttcgcctccaccaccccaactctatcccagaaccttccccgcaccttgtcccgagtgccggtggtggagtaggaaaccgcggcattggtggtcagctccttgatggcgttggccaactttccccccacgcccttgagcgccgaggcgtcggccttggagcgggtgtcgctggcgttcacctccactgcccgcaggcctagctcgcggcagaggcagagtgcggccgtggttttgccgatgccgggggggccgctgatcagcaccgcccgcttcttcaggtcggcagcccccttgcccctgcacgtggtgcagtccaggatggcatgtgcggacaggcatgcccgacgctggggtagccttacgccatggaaccctggtgggtgcagaggcatcccgatggccccacttcgcacgaccagtgctccctgcagccagcgcatggcaaccccactgcgctgacctggcgccagcagcgccggagggctcccggccgtgcaggtggacggcctcccactcccgcagccattggcggagggtggccaccagcccgttgttgcccacgagctccgccgtggtcttgggccgccacttctccacccacagcgactggtcggcggcgggggcggggagcgccacggcggcgcgtggggtggtggcagggggcgccagtccacgaggcgcaggcgcgggggcagacccaggggccgaagcggccgcagcagcggccggggccgcgccagacacggcgccgcgcgccgtgtccggtgacnnnnnnnnnncgcagcgttcggggccgcgccggacacggcgccgcgcgccgtgtccggtgaccgggagactaggtgcacggtggcttccaccagggacagcagcccaccctcgtcaatgacaggggtgcccttggcctgggcagccgcgtgcttggaccgcccagcatactgaccgatcaccaggaaggaggtgcggccgctgacgttgccggtaacctggcaggcgagagggtggggatgaagggactgtgaatggggttcctttggagacggggtatggcgaacagcacaggccctctctcgggcagaacaccattctcagggcaccgtctgcaaagtagatgcatgcgctcagtccaaggcgcacgcatccctcttccnnnnnnnnnnaggcagaacaccactctcagggcaccgtctgcaacgtagatgcatgccctcagtccaaggcgcacgcatccctcttccttcccaatgcccagagccaccatggctccacagcacgtcacatccccacacaccttgccgccatgcctccggatgagatcctctgcctcctcacgtttcagcgagtccagcacgccactgatcacaaacgtcttgcccgtcaggcagtccgggtggcccttggggatggcctggagggcggggcatcgggcagatgggattccaaatcaagcacagggtaagctggctgatccttgatgcgcagcaggcctgaccaccgcattctctgcagcccgagggctggagaacctgcatggcgcccagaaccaagcaattgttggaatatcctcaccttggtcccggcattgggggnnnnnnnnnnaagggctggagaacctccatggcgcccagcaccaagcaattgttgggatatcctcaccttggtcccggcattggggggctcgtcgggagctcgagccgcatacgaggtctccgacatgaagctcagcttcagggcctcctctggaggcagcttcttggcggcggcgtcaacggcctccacggcctccacagccacagggtccaagcctgccaggggacctgggattttggcccgggcggtgggcgttctggccttgggagaggcgacctgggcggggcaggccattggcggtgggcgagcggcgacgaggtaagacatgatgacaggtatccacaggggggagagccggcgcaggagtagccgagcaggtgcgccagatcagcctcatgctcctttccgcaaccctcacctctggagcagacggtnnnnnnnnnngaaggtaagacatgatgacaggtacccacaggggggagagccggggcaggagtagccgggcaggtgcgccagatcagcctcctgctcctctccgcaaccctcacctctggagcagacggtgaggccttctgtttcttgggtggggtagcatgcacagcaggctttgagggtggagtcctagatgcggccctcatcttcttctgcttcccagccacctcagaatcactgtcactcgcgagcgacagctcgaagtcgtcgtcgccatccgattcgctcaacaccacctgagtcttttttgcgggtggcccccgcttctgcaaattgagcgaggagcggacagggtcaagtgagaggaagaagtgcatgagaccacaggaagcaaagataggtacccctgtgcgcctcgccaggccctggccaacgattgagtaatcaagtcactgtcaggttgtcctcacattggttgcaggggctttacgtttcctcccaggggacggcccgggagaggaggtgaggtcgagggagacgggctgccctgacttaccaggggttgcagactcggcgtctggtacagccttgatctcctctgcagggagaagaatacacaaacgtgtgaccaactgcttgagcgagcccacagcagtgtctgcatccataaattcaggatactcatacattcagccacccttgttgacgcacccgactcctttgaggcggctttggcaccaccacgcatgaatgcgcggatgtcctgcatctctgtcaccgtctgtgctgtcgctcactgctgctgctttgaaaacttgatctggaggtccagtacagccgcccaggagacacgccaagcctcggatgagaagctcttgcccgaatataggtcctggattgtannnnnnnnnncgttctggaggtccagcacagccgcccaggagccacgctaagcctcggatgagaatctcttgcccgaatataggtcctggattgtaagtatggagttttggccgtgctttgcagtgcgatcgcttcgcgttgggggtgcagccttccagctcgacacccacgagtgtgcgaagtctattcagccccgatcgcgggacacatggtgatgtcgattcttctcgtcattggggaattgatacaatgcatcccgctctggaggcttggcccgggttcaggtatctacgatctcaggcaaggggccgctctgcgtgctgcgcgcgccactcaaattttcagatccggttcatccagcagggtggggatttgctcgacatgcccgaatcgccatcgcgggccgcgagcatgagtacacgaagaatttgacgaagtactcgaataagagtgtgtgggaaacgctctggtgtgaatcggcccaggcggcaatcctcctctggctagcatcacccctgaaatcctgcaagctgaccgagctgctcgtgcgtaagaagcagcgccagaagcgcaggcatactcctgtacaacacannnnnnnnnncggctagcatcaccctgaaatcctgcaagctgaccaagctgctcgtgcgtaagaagcagcgcgagaagcgcaggcatactcctgtacaacacattataaactcaagagccggcttactaggagactgctgggctgcacgatgcagcacggtgggagcatggggcattcttcgtcagggggcccacttcgcagggccatcgctctaggttcccacctataccagcgccatcccctcnnnnnnnnnnccttcgcagggcccttgctctgggttcccacctataccagcgccatcccctcctgatcaagtgcgtgacttcaggcatcggttttgcgttcggtgatgtcctcacgcacctggctgcggcgagggcgaggcccatgactcggtacagccctaggcgcaccgccctcatggctgcggcgggtctctgtgttgccgggccggcagggcatgtcttcctgggttggatggagcagcacgtcatggcagccactccgatgaggtaagttgagtcttgcacaaccctgcaaagggctgatgagtaggagcaagctgttaagagatgggacatgtaggtggccagtatagggcggcatcctttcacacagacatgctctccactgcgccgccatgcagccggacagctgtggccctcaagttcactctggatcaggtccttggcctggtgctctggcaagcggctttcctcacaataaaccccagctaccgtgcagcggctcgaaacctgttgcgcggccgggagacggcagtggtgtagtgaccatgcctccctggattttacaagttttctagtaataatttacaatcgatgcagagcatccttgtcctagtatggggacgatctgctctgcacacccctgcactgatgtcacctaattgcaactctacttgctgatagctacatggcatcgcccttgttatcgggtataataagtcacagctcaagtctgcaagagggatacagagtatcatccagattggtgtgtaaattcttcagtgcagtatcacagaaatgtgtgcctgggcagcattctaccacagaggacggggtaaatctcggcatccttgtatcatcatatcatgcgcagtgcatccttgaaacaggagttgcaccccaccattcgtggtgaaagtagacaaagtgttgagaagcaggtaccgcattcgtcactcctgcttcgcaaaaggtgcactggtggcgagatggacggctacgccgagcccagcccccaaggcggccccaccaagcgcgagtcggggatcaccatgctgcagagcagctgcagccgcaccaccgaccagagctcccacctgaagagttggtgattgttggggagcagggaggggtctttcagaaaggctggactggcatgaacattagcccagcaattttctaggcagggacattgccatccagccgggaaaacagttctgaaaatggattccggtgcgacaatgagacaatccatgcaccacaggctcaccctgcagaactggtcgnnnnnnnnnngtgaacatcagcccggcaatcttctaggcaggaacattgccatccagccgggagaacagttctgaaaatggaatctggtgcgacaatgagacaatccattcaccacaggctcaccctgcagaactggtcggtgcgattctgtagcttgttgtagtgcagccggtacgccctatcctcgagagcaaccttgaggtcttcgtaagtggcaacacgcgccgcgcccgcgatgactgcaggcgtgaagagtctcgacgttcaagcctcgtgaagcggaaagaatcatgatgtgtgcgaccgccctccggttccgtggcctccgaaaccctcaagcacccacctgtcaggagggtcgtgatggctgccgatcgggcaccagtctccagcgccttcgccccgagaaccgcccatgtgcccgtcgctctgtagccgcggatggctgcgatgggcacaaagagggtcaaggccaggaagccacctgtttgaaaccctttctcgacgatatgcagccccaatgtactgccattgcgaagtgtggtgcgggtggtcggatcaaattccacctccaccatggctcaagtttctctgttacgatgtgagcgcgtacacacacaagggactgcatgtatttccgagaggagtgaaaatattatgacgtaatggagggtcaggccccctttcttgtcctccaaagtctgcatgcgtccggaaagccacagtgcgaccccatgatggcgattcagcgcacggcacgtggaggggtctccttcctgatccctgtccgtcaccctgcatctacacgccattctggctgtcggagagatcgggtggagagggacgcacctgtcacaggtgcgactgtggccccggacctggaccgtcgcacagccgtgcaggccgcgatgcgccagggaagcaggtccccatcatcaagtaaaggttccagggtttttgatgatcacacactgctgtcggccctccgggcgcgacagtcgcgggcttgaaacgctgtgtcgtgcccaaggacggctacttggctccaggactacccagggatgcagagggggaccagacccacctcccattccgtgggtatccnnnnnnnnnnaaccacccagatcccagccgcacgcgcctggattacctgggtgaccgcggcgggggtggcgtgcactttgggtcgactcgcgcgactcacgtttgnnnnnnnnnncaggacggctacctggctccaggacgacccagggatgcagagggggcccagacccacctcccattccgtgggtatccgccgcaggctggccctcgggtcacccacgcacacccccgcccctgattgcagggaccccaggcctccacaacaccgcggctctccacacggcactcagcgcagctcgaagcgcctctcgtcggcgcgccgccacagcacctgcgagcactccagccagccctgggtgaccacccagatcccggccgcacgcgcctggatcacctgggtgaccgcggcgggggtggcgtgcgctttgggtcgactcgcgcgactcacgtttggcatcgggaagcgtcgagcctcgtcgtcgcgattctctcgcccagactgtgagcttgagggtggctccacagcgagacccccctctctcccacccatacacacgccaatcaccatgcacataccttctccgtgccggggttgccggccaagaggtgcgtggtgctgccggtctccagggccagggagcactgcgccccaaagcgctcggcgcccacccagagcgggtgggagggggcgggggcgcccaacgggatgacgtggctgaacaccaggcgcacgccggccaacacagcgcggcgtcgctccgccagcacgggccgcacgtctggggccgcgggcggcgcacggggcggcgcgcacagcgccgcccagaacgcggcatgcacatcgcgcaggacgcccagggtcacgtccagcatgcccccggccaccgactcatccctgcgtgcggtgtgtggcagggggacggtgggggggcagaggagcgctccggcagcggcctctgtccgctaacccccagagaatgcacatgggaaccctggcgcgcagccgctcgtcccacccggtcctcccatgccactccattcctcgcggaccccccctcccccaaaaaggaaaacacacacgacaacaacaagggcacctcgcgaggtccaacagcgcgggtccgtgcagtccctgccgcgtnnnnnnnnnntgtcctcccatgccacgccattcctcgcgggcccccctcccccaaaaaagaaagcacacacgacagcaacaagggcacctcgcgaggtccagcagcgcgggtccgtgcagtccctgccgcgtgcggctggaggggaagtagtggtactgctccaccgccaccaggttggcggcgttcctgggccacaccgtgtggttgtcgtccacgatgactgccacggcgtccagccccgccaagcccttttggaggggggaggggaggttgggagaagaggggggttggttagggggtatgtgagctggcaggatcactgggcacccggctggcggcgtcgcaatcccttcccgacacccagccagggcacacgattgcatgtgagtgcgcatcagagcacagggagctcttgaaggccctgaaactccacccacgtcgccacaacgccagccctcacggctgcctcgctggagcccccgtcaggccctaaccccagaaggccccacctcctcctccagcgtcttgaggcnnnnnnnnnngaggccctgaaagcccacccacgccgccacaacgccagccctcccggctgcctcgctggaccccccgtcgggccccaccccagaaagccccacctcctcctccagcgtcttgaggcagtcgccgccctgagccaccacccgcgacccaaagtacttgccatccgggtccaggacgtgcatcacggcggccgcatagtctggccgccctgcaaatgcgtggggaagaaaggggggacagggatcgtgtcggccatgccgctgtgccagcgccaggtgatgcatgccacgccaccacgtcccttccgcaatccgccgcccgagtgaatccccgaccgcaccattggtgtgcactgtcatctcaaacagctcggcagcaccggcaaggaaagcgcggacgccggggcgcagcttggtccatacctgggtggaaggggagtcgtggcgggggtgtcccgagggcggaggggtcgaggcatgacacaccctacctgcctgcgcgggcatggaagctgaagcggccaaaagcttgaacaatccctccaaaaagtcaattgccaacctnnnnnnnnnngggggagtggtgccgggggtgtcccaaggggcggaggggtcgaggcatgacacaccctgcctgcctgcccgggcatggaagctgaagcggccaaaagtttgaccaatccctccaaaaagtcaattgccaacctgcacgtcgtccaggcggaagagctggcggtcctccgcccccagcgccgccgcctcgcagcgtaggtgggccagcaggcggctcgggaggtcgcggtcgctctgctggtccacgtcggcaaaggtgcagctgttgagcagggtgtggtccaggtccagcactagcgacaacttgccgcgcctggttgttggggggtgttgggggcgtacactgcagcgcgggggaggaacaagggtccacgaggagagggcgcgtcgatgcaccccagcctctgacttcccctccctcctgcgcgatgcgggtaccttgtacctccacacccaagcccatgatcctccttggccaagccggcacccccaactccccttcccacagtcgagctcctcctgcacgcacgcaccgcagcaggttctgggccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgacgcgcgggcatggccgccgcaccgaacccctccatccccacgggcctcttctcaggcacagaacccgcttcccgtgccgccaaggcgggcgtgcccgcgccctgccctgcaccgctctgcggcgcctgggccatggtcgccgggggttccctcgagttcaccctggtctgtctggggtcggccccggtaccggatgcgaccctgtcgggaatgtgaggggcactcgcgactgcactcgggccccgggccccctttcggcctgccgccggcgcccggcgcggatcgatgggcagcacgaagctgggccccggctggcctgcagcctccgccaggtccgcgtccctctccctgccggacgcagcgcaggaggcaagcggtgcctgcccctgcatccgccaccgctcctgctgcgggggcaggggcggcctgccgcccgacccccgcccgacgcctggctggtcctgtgcgggagctccctggtcggcatcggcgggcctccctgcggtctctgctgggcccgagttccccttcccggaccccttgactgcggatgccgccggccccgggtcggggctggtcgtgctgtccggctccagccccccctggccggcctcgccctcccagagcggcagcaggatgcgcgcctggccctgggtgaagaagttctggcgcaggagtgagaccgcgagggcggcgcacgcccgcagggcgggcgggaagggcgagggcagcttgttggccaccgcgcgcaggcggtgcatgttgcggtacagcctctcccgcacgtcatctggcacggccaagagggggttggggacgccgccggggacggtggcggccttgccctgcagcgggaacgcctgcagcccctgggaagggggacaagggggggaggggaggaagcagcgtgagcaagcggggccggggccggcgctggtgcggggaccgtatgcggacctgggtcgccgggcgccgtgatcatcatgcccgccactgcacaccagtgcatgcgcctcgcaccctacacccacatggcgtgccaggatgcgcgacatggccccgtccacggccagcagtgccttgtgcacagacgggcacaagttctccacgttcctggaatggggacagggtgtggcgggggtgtgggggggggaaacgggcggcatgctgctcccaggcggccgccacggcccctcgcgggctcctccctcacccggctcacctcaccaaccccttgcaaaacttgtcatgcaacaaggcacggacaaagttggtggccgcctcaaagtcggccatgtcctccgggctgatcgaagcggtgccattgtccctggggaccggcaacacgagggcatggccactggcactgggcgagagaggggccggggccctaggctgcccgctgaccatggggttgtaccgggcgaccggggcgatgggcctgctggcaacctgcatgggtgggaggtcgacgcgatgcagcatccatcacaggcttgccggggggacagcgctccacgggcgcacggcacggaagctcggcagccctggtcagcctgttcggagcagcacgccatcgcagccacggacgggcatcaccttgccgaactttggactcattggagacacgcgcatgtcgtgagtgcaccgggcctgagcaggcgattacatcaccacagccccgtccattgccgtggtacacatggcaacaagggtgactgtgctggggtcagcgggaccagggcatctcttccttgcagtggtgactgatccatgccgtgtgtgttttgttcccgacaggttctcgatgggatgtgtgtgtgccacgctgggagccctccgaaagtagcttgtcagctggggaagcccacatgctctctgagatgctgactcaccaccattcccctcgtgctctaccgatgagatccacaagatggtaatccaatccagcagactcaattcatcgcacatttggttcctcaaccaggggtctgcataactgcagcctcaaaggctgcctgcaagagtgaaaaactgctccatgatggcaaaggagacctctgggtactggagaattgcagagtgccctgcctctggaagaacaatggaccaggccctcggggcccgtgctgcgatgagcctctgggactggatgggcatgaccaggtcctcctcgcctcccagcagaagcaggctgttcgtgacggagggcaagccatcccaaacgcgtgtctccatcaagaactgatcgcaagttgggaatgtatgcgcaaggggctcgatgagcgtgagtgaagtatatgcctcgtatgtgaacatcggagccctctaaccacccaatctttgacagtggatcaggtctccaagtatgctcacttccagcctgtccatgcaatatactcccactttcttactgtcatccatccccggccttacatattcaaccagggcgtaggaatgtcgcgagccagtggtgaagttgtagggtccaggtcccaggggtgccgnnnnnnnnnncacatattcaatcagggcgtaggaatggcgcgagccagtggttgagttgtagggtccaggtcccaggggtgccgaatgaaagtacccgtcacatgccgccttggcagctgtgcagtaggggtgggaaacaacaattagctcatgtaaaacaactggccactttcctctatgctgccctgctgctcggagcacgaggaccttgggtgacttcggcgccccccccgccacgctgacccaccccttgagtattccagaggatagttgatggccagctgatccatgggccttgcctctgggtccaggagcacagacnnnnnnnnnncaggggtggggaacaacaattagctcgtgcaaaacaaccggccgctttcctctatgctgccctgctgctcggagnnnnnnnnnnggcggtggccgctggggagctggggctgccagcacttgctgcaatcatgacaaagctggcgaaggaggagccatgcagcacggcggctgccagggcaacgcaggatcccatggagatgctcaacacattgggcttggtgctcagcttcaacgcctgtgggcgtgcatatcctgagagcgtgtcatggccactggatttcgtggaatgcaacgattcgagctaccagcacgctgtacagccgccacgctaggccccgagccctcccccgctgaccttcacaagctccaacgcatcattcgccatcccaacgatgctgagagcctcagaagaaaagtcctgcaacatggatggaggagcccaccagatcttgatgttgttggtgggacagtgcaaccgaggcatcaagtgggaattgcttttcatgaattgaaaatcgtggccctaaactatgaaaattctttcatacaggcacccacaacgagtagccgacaccagcaaaccagaacacccccatgtatcaattctcgcaacttgccagagaatggccctggcctcgatggtcgaacaagatgacctcctgcctggctgcaagagccagcatggctggtgtcggcatgtcccccatggtgaacccaaacggagcaaaaaccaaaaggggaggacgagtggtgttccgattgccgaaccggaagtaggccatgcgtgcgttggttatttctgcatgcatcaggggcccatggaagtctgaagaggatgctaccctcacaggtgctatctcctccgtcacattacagaagtccaggacctcagggtcgggacccctgaggccataagtgtctgcaaggagggaaacgggttgagtgaggcaagaatatgcaggtagttctgttggtgtgctctggtgcgtaatgtgcctgggatgacagcaagaccgctacatgtacggaaagaattacgctacggtggctggatggccccaccacgggggcttgggcaacagaggccgagttgaaagttgggaatgcaagagcgcggtctctttgtcattaaggtaagtttagtccctaccagcgtgcgctccggtgtgaagtatcaaccctaccgccatgaatattcggcaggtatggcgaaagagacagggacacatgctgggcctccgctgccaggtctgagggccaaacacgaattgggttcagcgagggatgcaccgaggagtaaacgtcttcattcggaccaaaatcgatgcgagtacgtcgattcggcaagggcgattccgccaacacgtgaccggagatctgcctggcctcgataaatctgctgcacatcgagaccatcaatcacatgcagtgttcaggctctcaccttcgatcacatgctagtggctgaactcggtcagtcatgaggtgtgattcgggatatcttttggcgacaattctgcgcctcctttcgatatgtccacaaaagtttgaatcgcacattacaatcaaacggaacctgaactcctttcgcatggatgcaaacagacactgaagattaattgtcagttttagctaagcctctagccaagactgctctcaaaagtgagaaattgttccatgatggcaaaggccacctctgggaactggaggaccgctgtgtgccccgcctccttgaaaacgatggaccaggctctcgcagcccttgctgcgacgagcttctgggagtcgacgggcatgacgacatcctcctcgcctcccatcagcaggaggctgttcttcacgcctgggaggccgtcccataccctggtctccgacaggaactgtgcggagggggggggagtgcctggcatgatcaatgggcacgaccgcaggcattgtggctggccaaggcaaatcctgaaagctagcgtcatgtccccatcgcaggggtacagctgccttctaaaggtgaggcaattcccctatagtgaggttaccctgcccagtttcctcacaaattcaaccaatgcaaatgcttggcgagatgcagtggtgaagttgtaggggtctggggccaggggatctgcgttcaggtaccagtcgcatgcagcccgagcggctgcgcacggaaattgggtatgagtaaaatcagggcgattcgtggttgaggggtgtggaagggcccacactgtgcatattgatgcctccaagagacagctactgggccatnnnnnnnnnntgagcggctgcgcacggaaattgggtatgagcataatcagggcgattcgtggttgagggggtgtggaaggcccatactgtgcatatcgatgcctccaagagacagctactgggccatcatgggggtgcaaagccgctcatactcctcctacaagcacctcaccagactggtactgcagcggatacacgatggccagctgctcgagcggccttgcctctgggtccaggagcacagactgcgcccaagccgtggcaggtggggagttggggctgcctgcgctccccgaggctatgacgaagctggcaaaggatggaccatgcagcacagcaaccgccagcgccacacaggaacccaaagagaagctgagcacgttgggcttggtgctcagatgcaacgcctgcggttgggcagcgttgggaacggccccttagcggtggggtgttggtataatacgaggatggcaaacaacaggctgcaagcagcaaaggactttcatatcatcgggctcacctccacaagctccatggcgtcatttgccatgcttactatgctgggtgggtcattggagtagtcctgtcaacatgagggatggaaggtgagactaaggaccgtggcaagagtatggcaaccagcggcatatcacaggcaaagtattgctactcttggcnnnnnnnnnncaaggaccatggcaagagcatggcaaccaacggcgtatcacaggcaaagtattgctactcttggcactggagactgttggctcctcaatcaactgtttaaacagcagcccgacatacagccgtacactgcacccccttcccttctggtataatactcgccgtggaaaaaccctggcctcgatgatcgaacaggatgacttcctgatgggcagcaagagaccgcatggcaggtctgggcatgtcccccatcgtgtatccaaagggagcaaacaccaggaggggtggccgccctgtggtctgatcaccaaatcggaagtagccgatggtagcgttggatatttccgcgatcatcaaggggccatgaaagtctgattcggcctccaccctcacggcctgatcatcctcggttgcattgcagaaatccagaacctcagggtcagggcctttgaatccaccgatctctgcgggaattttgggggtgaatgaggtgaaaacttggcagtcaggcatggtggggttgctgaannnnnnnnnnaggatttttgggggtgaatgaggcaaaaagttggcagtcaggcatggtggggttgctgaagcggttcatttgccacagaaaattacatgggcatgctagcttcgatagacacggaagccgaaggaatccaccacagtcgagtttgcgaaggcaccggcatagcgctcttcagaagctaagtatctgcaagaagctgatcaagaatgattcccattctcaccggcatgcgcgctacggtggaggagaaaccctagcgccaggaatattcggaggccatggccagagcgacagggacgcatacgccggcgtctctgtcaggttcatcagcagaggcaggacattagagaaataagaggatgattggttccgtagaatgggagctctcgcatggacttcggcttgctacggtccgtcatagtattcgatttactcgcgctgcgccaaacgcgcggagaatccgtcttttctttgagggaggcatggaggtgtaaacagctcaaaacttagcagcccaannnnnnnnnngcggtccgtcatagtattcgattcactcgcgctgcgcaaaacgcgcggagaatcccgtcttttctttgagggaggcatgaagtgtaaacagctcaaaacttagcagcccaacacatcggcacctgcttcctaattgtctggagatgacagactacagtaccataactgtttgggcaaaatagagcaagccagtagggagggaagcgaggcaagggtggacaatggcaacctagagcagagcacagcactgagccgtcgggtggtgtgcttcaaccagtggcgaggagagcatgagtgcaagtgcaatctagtgcaaaacagaatctatacaaagcaggtagaggggcagtgctcccattcgatgattagtcagtgcaaggtctgcaaannnnnnnnnnatgcaaaacagaatctatacaaaacaggtggaggggcagtgctcccagtcgatgattagtcagtgcaaggtctgcaaatagaggttcgtgctcgaggtctgtcaatgacacgagaagaactacctacagtcctgaatgcaagtgtagggatgtggtaagaatggaccagagacaaggcccactccctcatatttgcatggaggaaggtccaacctgagaataaaaagcggtgccatgtggggcgccgttgcccgccacccctcttgcaccctggcctacagatcaggggagcccaggaaggcatccacgaggtccagcacagtgtccctgcactgggacgccaccccatgccctgcttccggtatgacgaccagccagggggcagggaggcgtgcagccatggcccgcgatgactgcaccggcaccaggatgtcgtactgccccgcaatcagcagaacggggttcctcacaagcggcagggcatcccacaccgccgtctccacattgaactgtggaccaggagggcgcaagtgtagagaaggggtgggtggggaatgtcctggcacgatgggcgattgtatatcaccatcggattgctagggtcatgcgagtcccaggcccctcacacagccttcatgactttacccaagcacaccccaggcctacatagtgcaggatggccagggcctggcgcccataggcctccgtgatggtggcctccgccagcatgtacaggctctgaaaggcgaaatcacatgctgcctttgcacctgagcaggagtgttggtgtgggtgacggggtgctgggatgggaaggggggatgatttcaatcgcctgggtcccaaggctgggcatctcccatgaggaaatggcagcgcccaccagcgctgaccctttagagtccaccccannnnnnnnnncggtttcaatcgcctgcatccccaggctgggcatctcccatgaggagatggcagcgcctaccagcgctgaccctttagagtccaccccagcctcagcctcaccccgtgtcgtgttcagggggtagaacaggctgagcatgtccaggggcctcctctccggctgggcgacaatgctgaggcccttgtcggtggggggctccgaacccagactcccagcgctggccgatatggggatggctctgtggatggcgtcaccgtgcagcgctgccacggcgatggcgatgaagccgcccatcgacacacccatcaggttggggggtaggggcagctgtaacgcctggaaggggtcatgttggggaggaaggtgggggttggcgggcctcggggtttggactggctgcgctgatgggccagggagatctgtcaccagaattgccagccaaagggatcaaggtctggcgttcacagcaatgagacatacctgtataaactccacggtgtcctctgccatgctttgaatggtcagcggactgctaatgttgaggtcctgcacaatgtagcgagggaaagggggactgtgtggtatttgaggcatttcttccagggagatctgtgaccaggcagggtcacagccgacattcttcccccagggacagatgcgccagaccctcggtgcccggattaaatgaccccaaagtcctccacttgcctcggtcgcgccgacgccccgggtgtcaaagatgatgaccctctgctctcgggccagaggctccagcagcctcacatcccacatgtccagtgactggccaaagccgtggatgaggaggagggtggggcggccagaatcggcccagccaaaactgtggtaccccacgatggaggtggagatggcgacatggagcagcggcccgatcaggtcctgcttggagctggtggaggcgaggagggggggtgccgtggtgttgcaaaactgcagcacctcgccctcctcggatactggggccgcctgccccaccactgcgcctgggaggcgagcgtggaacgatgggagggcagggagggatgaaaacgacgattcgatcaggaagagcacctccgcgggcctcggaacaggcacataagcggcctcgcgcgcggcagctcgccccttacccccgcccgacaggtatgtccgagtctttctaatgcacaggagaccatacctgtggcgggtctgaggcacaggaggaccattgccaggcagacggccgttgggttggccgagccacgtcggagcatggacctacgtgcctcgccgatcctcgcagacttttgtcgagccaaacgcgtcaacaaaacattacaatcatatccctctagacgcaattccatgaccgcctcactccggtaagctcgttacggctgtacagggacgtatgtgtacgagggggtcggggtccgagcgcaccccagctctccctttcctagtttttcaggtacgcaacggtggtcttcagatttcagacatctgccagtcgtcgtcgaggcctttggcacgaccgaaggatgcacacgggatgtgctgcacaatagctgcatgtcggagggactgttaggcgagcacaagactgaatcttagactagccatgctggaataattagtactatttgtacaacaaaaccacagctccagtacgctcagcaaattgcatcaagcgaggtaagtagaagctctcactatatattatacacagagaacaactctttccagtaagagagggttgcttgggcaaatgctccacattgtcctcacaggcgatccaacttccgatgtaggtaactccaagattgcattcatcgggtcacagcaataaagcaacactgactctggcagggagaagagcaacagtgtttgtgtcagccgggcaagataaataaagaggttgttgatgtaagagcatcaccagagtcccagcctaatgggaggtctgggtcggcccgtgccccatgaggccttataagttagttttagtcgaaattgatgtaccattgaagggagattggatgtcatatgcgctcctgtgatgattgaccaagtcatcgaggttgaggattgtccctcttggaagttgtaggtggagggacccgaacacttgcacacaacaatgtcaatccttcatgagctgctcgcactctaatcaggcgattaaagactagttagtaacggctcgtggctcctcttcatgtcctgtgcagcgtgtgtgctgctttcccagaaggacgattagttgcatctgggtggggacttcggtgtcatcacatgctgcgcgatcagcagagtaccgttctttcaccacattatcgc

SEQ ID NO: 39506 - DNA, 64 bp, Chlorella protothecoides
ggaggggctgcaacagccatccgcatcaggccacatacatgaaccttcaagccagatcctgcct

SEQ ID NO: 39507 - DNA, 61 bp, Chlorella protothecoides
gaggtgtcctggagtggcagccttgttggggttagatgagtaggcggatggtacttgtgag

SEQ ID NO: 39508 - DNA, 80 bp, Chlorella protothecoides
aggccagggtgaggtggtgcaatggagcacgcggggaatgtatatacctcttgcccgcagcaggtgcccctaccaagggt

SEQ ID NO: 39509 - DNA, 387 bp, Chlorella protothecoides
  modified_base (179)..(293): a, c, t, g, unknown or other
cgccagcgccggcgccgacgccgacgcggcaaccaagccgggcagcgcctcccccagcacacccccccgcgccggcggcctgtccgccgacccggagtcggggtccgaggacacgggcttcctggtctccctcgccgccagcatcggcctgcgcagcctgggcgcggggaccgggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctcctccgcggtcttccgctccgcgctggcctccgcgccctcgctggtctcccgccccactgccagcctgcgcctggcggggtcgctgggc

SEQ ID NO: 39510 - DNA, 2259 bp, Chlorella protothecoides
  modified_base (111)..(292): a, c, t, g, unknown or other
  modified_base (856)..(865): a, c, t, g, unknown or other
  modified_base (1105)..(1114): a, c, t, g, unknown or other
  modified_base (1702)..(1711): a, c, t, g, unknown or other
gccgcggcgcggcctcggggggcaggggcgcagagtagccgccgccgaacagcgcggcgtcctcgtcgccgccgcccggcggggtgccgaaggagtgcgcgcgggcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcgggccgcccggcccctccccagggtccgggcgacccgggcccgctcaccgtgcgcgacagcgagcgcgagcggcgcgtcacgccgcccgcgtccccgaaggacccgtcggggcgggccgcgccgccgttggcgccgccggcagaggggaatgccaggtaggacagcggcaccaggccctgcgcaccggaggggtccttgaccagggcccagccctccgactcctccagcacctccacctttgtgtgtcgggtgtgtgtgtgtgtcatgggtcgaggggggaggctggggtcggcgagatggagtggtccgcatgggctgtcgtacccaccgccctctcctcctcctccatcgacactaccagcaccccaagaaccccgtccctgcaccctcccccaggatcccacgcccctcaccgcgtcgccctcgaacaccgacagctcgtcgggctggctgtagtctgcgatgaacatgtgcgccacggtggcgatgcgcgggccgtgcggcgcgccggcgggcgggccggcggcggcccaccctccctcccccgcctccgtctcnnnnnnnnnnagggtggccgcacgtggttccacatagctgagcttgtggggcgccggggcaccatgaacctcccccccctggacactgccacaaaccctctcctgttcgccccaccacactccagtgtgcatccacacaagtacccgaccctgctccgcctcgccctccgaccccaaaaaagaaagacaatgagctgctcatccacatacacccacacacgcacctccagaggcccgcgtggtgccaaannnnnnnnnngggggtgggctccagcggggggaaggtccccgtcccgaacctcggcgtggcatccggcgagcctgtgaaggggggccgggggagggctgggtggccgcacctggttccacacagctgagcttgtggggcgctggggcaccatgaacctttccccccccttggacactgccgcaaacccctctcctgcttgccccaccacactccagtgtgcatgcacacaaatacccgaccttgctccgcctcgccctccggaccccccaaaggaagacaatgggctgcccatacacttacacacacacacacgcacgcgcacctccagaggcccgcgtggtgccaaaggtctcgaacacggcgacgtcgctgccggcgcccgccgacgcgccgttgccccaggggctggcctccggcgcagttctccccgccagcaggtcctccacctcctggaggacaagtgggagaaacaagggtgtgagcaggctttgcagggggaagatcctgggcagctcgggatgcgtgggctggggccgcctaccagcaggctccaggaggatgcccgaggacaggctggctcagattcctcccaggccnnnnnnnnnnaacaagtgggagaaataagggtgtgagcaggctttgcaagggggaagatcctgggcagctcgggatgtgtgggctagggccgcctacgagcaggctccaggtggatgcccggggacaggctggctcagattcctcccaggcccagcctcgacgattgctcgcacagggccatcagaacacccccccctcacaacacacacacacacacacgcccaacgacgatactccatcgacggcccgccccacgcccagaacagccccccccgcaaaacacaccctgttcttgtcggccaggaccggggagaactgggaggccaggcccaggctgacatcctcgctgcctcccgacaggatggcgtccacctccgaggccttggcccgcgccagctcgctgcccgcggtgtcggaggggtggctggagggcgcgcccagggccgagccgtcgttgaccccgggttcgcgccgcgccaggagctcggcggccgccccgtcggcggtggcggggtgctcggccagcaggcgcgcggcggcgtgccccagcacgcccg

SEQ ID NO: 39511 - DNA, 61 bp, Chlorella protothecoides
gaccgtgacgggcaggaccttccagctggattttgctcccgagacacaggtacgcagtgca

SEQ ID NO: 39512 - DNA, 90 bp, Chlorella protothecoides
gctggcaacaatggaggggatctatgaatgaacgatggaagcaggacgcagcgagtcgccgcatgacaatgaatctttcggtgggaagca

SEQ ID NO: 39513 - DNA, 62 bp, Chlorella protothecoides
tgacccaggatctcccctcctgcgatgtcaaccataggtatgcagcattataaggggcatga

SEQ ID NO: 39514 - DNA, 73 bp, Chlorella protothecoides
cgacatggtcctcggccatgcggtgcgtgccagagtgccgcgcaagtgcaggtggagagggcgcttgttcctt

SEQ ID NO: 39515 - DNA, 168 bp, Chlorella protothecoides
catgcctacctgtccgctgacaaccctcctttcttgcaccacctgactcccccccccctttgccgatcgctgcaggaccacttccagagcctggtgatggccagggacgaggcagagggcgccaatgccgacctgcacgccgcactggacgagctcaggaggacggcc

SEQ ID NO: 39516 - DNA, 73 bp, Chlorella protothecoides
aggtagtgccgcgccagcgctgttgcgtcttgcgcgagtctccggcgcaagaaggcatgcccctccacggttt

SEQ ID NO: 39517 - DNA, 79 bp, Chlorella protothecoides
cgtgtcctgcattgcactccaccctgcgctcaggcagtcaaccccccaccccccctctttccccaggcctccaagcgca

SEQ ID NO: 39518 - DNA, 75 bp, Chlorella protothecoides
cctgccaccagcccggccaagggccgcgccgtgcctggcggggggtggtggggccgcagcaacagcctcgagccc

SEQ ID NO: 39519 - DNA, 86 bp, Chlorella protothecoides
accacccagtcacccagcccggtattaacaccttctcccccccccctaccccaccgcccgtccgcaccttcctggcggcctcaatg

SEQ ID NO: 39520 - DNA, 61 bp, Chlorella protothecoides
ccggaccttttgagacacactattgtgatgtttatgctaattgcatacagtatagggaccg

SEQ ID NO: 39521 - DNA, 96 bp, Chlorella protothecoides
gcatgctttgatacattcgatggacgacctgcgggtgaaagcccctcaaccacgagtttccccttggacatattcccaggtctgccatctccctgc

SEQ ID NO: 39522 - DNA, 61 bp, Chlorella protothecoides
attgtcaactgattacttggcaagtaggagtccctgccataagaaggtcagggggagtctc

SEQ ID NO: 39523 - DNA, 22584 bp, Chlorella protothecoides
  modified_base (169)..(219): a, c, t, g, unknown or other
  modified_base (396)..(405): a, c, t, g, unknown or other
  modified_base (813)..(822): a, c, t, g, unknown or other
  modified_base (949)..(974): a, c, t, g, unknown or other
  modified_base (1260)..(1269): a, c, t, g, unknown or other
  modified_base (1437)..(1446): a, c, t, g, unknown or other
  modified_base (1997)..(2006): a, c, t, g, unknown or other
  modified_base (2676)..(2685): a, c, t, g, unknown or other
  modified_base (2808)..(2817): a, c, t, g, unknown or other
  modified_base (2996)..(3005): a, c, t, g, unknown or other
  modified_base (3380)..(3389): a, c, t, g, unknown or other
  modified_base (4068)..(4077): a, c, t, g, unknown or other
  modified_base (4368)..(4377): a, c, t, g, unknown or other
  modified_base (4714)..(4723): a, c, t, g, unknown or other
  modified_base (4815)..(4824): a, c, t, g, unknown or other
  modified_base (5668)..(5677): a, c, t, g, unknown or other
  modified_base (6455)..(6464): a, c, t, g, unknown or other
  modified_base (6753)..(6762): a, c, t, g, unknown or other
  modified_base (7285)..(7294): a, c, t, g, unknown or other
  modified_base (9009)..(9018): a, c, t, g, unknown or other
  modified_base (9711)..(9720): a, c, t, g, unknown or other
  modified_base (10054)..(10063): a, c, t, g, unknown or other
  modified_base (10331)..(10340): a, c, t, g, unknown or other
  modified_base (10910)..(10941): a, c, t, g, unknown or other
  modified_base (11216)..(11225): a, c, t, g, unknown or other
  modified_base (11476)..(11485): a, c, t, g, unknown or other
  modified_base (11865)..(11874): a, c, t, g, unknown or other
  modified_base (12315)..(12324): a, c, t, g, unknown or other
  modified_base (12386)..(12395): a, c, t, g, unknown or other
  modified_base (12478)..(12487): a, c, t, g, unknown or other
  modified_base (12881)..(12890): a, c, t, g, unknown or other
  modified_base (13357)..(13366): a, c, t, g, unknown or other
  modified_base (13888)..(13897): a, c, t, g, unknown or other
  modified_base (14293)..(14302): a, c, t, g, unknown or other
  modified_base (14552)..(14561): a, c, t, g, unknown or other
  modified_base (15191)..(15200): a, c, t, g, unknown or other
  modified_base (15360)..(15369): a, c, t, g, unknown or other
  modified_base (15772)..(15781): a, c, t, g, unknown or other
  modified_base (16079)..(16088): a, c, t, g, unknown or other
  modified_base (16192)..(16201): a, c, t, g, unknown or other
  modified_base (16292)..(16301): a, c, t, g, unknown or other
  modified_base (16726)..(16735): a, c, t, g, unknown or other
  modified_base (17223)..(17232): a, c, t, g, unknown or other
  modified_base (17627)..(17636): a, c, t, g, unknown or other
  modified_base (18296)..(18305): a, c, t, g, unknown or other
  modified_base (19484)..(19493): a, c, t, g, unknown or other
  modified_base (19742)..(19751): a, c, t, g, unknown or other
  modified_base (19823)..(19832): a, c, t, g, unknown or other
  modified_base (20677)..(20686): a, c, t, g, unknown or other
  modified_base (21880)..(21936): a, c, t, g, unknown or other
  modified_base (22148)..(22157): a, c, t, g, unknown or other
  modified_base (22229)..(22277): a, c, t, g, unknown or other
ccgccggcctgcgcgccgagatcgacgccgagcgcgcccagcatgccgcggaggccgaccgcgccgcgctcgagctggcgaccgcgcagcgagagcacgaggcctcgctggcggaggccgccgccgcgcgctccagcgcggcggccctggagcggctggggggggggannnnnnnnnnnnnnnnnnnnnnnnnnnnnnnnnnnnnnnnnnnnnnnnnnnttcctgggagggaaagcggcagggtctagaagctgaggaagatgggagcggacacccgggcgcccggtgcaccttgcggtcagtgacatgctctcacgcgccgaccgcccaccccctcctacccaccacccccgcgcaggtgtccgagctggaggcccgggcggggagcctggacgnnnnnnnnnnttcagtgtcatgctctcacgcgccaaccgcccaccccatcctacccaccaaccccgcgcaggtgtccaagctggaggcccgggcggggagcctggacgaggagcgggcagcgctggagtcccggctgggcgagaccgaggggcggctggccgaggcacgtgcccagggcacgccggcgggcgagggagccaagacggtttcgcgcctggccctgcagcgcgtccgcgacctgcaggaggtggaggctggcctgcgcgcggagctggcaaccaaggccgcggcgctggagcagctggagggcgagctggcgcgcctgcgtggcgacacgcaggcgctgcaggaggccgtggccggcctggaggcgggcgtcgccgaggtgtgttgggggtgctttgggaggctgggacnnnnnnnnnnatccgcgacctgcaggaggtggaggctggcttgcgcgcggagctggcagccaaggccgcggcgcttgagcagctggagggcgagctggcgcgcctacgtggcgacacgcaggcgctgcaggaggccnnnnnnnnnnnnnnnnnnnnnnnnnntgggggtgcttcggtgtgtaaagaaaggtttgcggtccgagctgtggtgggcgtggaggggcgcgcgctcgctggccggagtgcatggctcggggatgcttcagaggcgcaatcctgaactgcggccccagtctgcatggcacggtgccccatggcacgagcctgctgcgcgcgggtggacgaacgggagccgaaacatcctgccgatgtacactggactggctgtactcccccatccatgcgctcctccacaccaaaaccatgccgtccccccctcaaccccccnnnnnnnnnngggggggttgcttcgctgtgtacagaaaggtttgcggtccgagctgtggcgggcatggaggggcgcgcgctcgccggccggagtgcacggttctgggatgcttccgaggcgcaatcctgaactgcggccccaggctgcatggcacgagcctgctgcgcgcgggtggannnnnnnnnnggcgctggccgccgcgcgcgccatggcgacgggcgagggccgtcgtgccgacgccgcggcggccgagatcgtggcgctgcggtccgagctggccggcgcaggtggggccctggaggccgcccgcgcggcgcacgcacgcgaccaggaggaaagcgcggcacggtgcgaggagctggccgcccgcctggccgaggtacgggaggccgggcggcagctggccgagctgaagagcggggccgaggcgcgcgccgcggccctggagtcggagctggaggagctcaaggtgattggggggtgtcggaggggatgccgtatgaggggttgggggcgtctctttgtaggcgctgacatgctcggtatgtatgcggagagggcgttctgggtggtcccgcactggtcacatggtggcctggggttgaagatcaaagcaatgagtgaacgtgctcgtgcgggacctggtggtgagattcgccccacccagacccggcacaagctcatacgtgccccgcatttgccttcatacctgcagcaagctccccctgcgggcacgnnnnnnnnnnccccggcacaagctcctacgtgccccgcatctgccttcctacctgcagcaagctccccctgcgggcacgccggtgggcaatgccagcaagcaggtggtgcgcctcagcttcgccaagattcaggagatgcgggagcgcgaggcggagcagggggagcgcgtggccgcgctcgaggtgggaaacgctggtggtgatctggccccatatccccgacgacgcatcccaaactcagttgctgactcaagagctaccattcccgccgaccaccctccacacccattgcacccgtcccctcaaaacatctcgacccctcgcgacaggcttcgctggaggaggcgcgggccaagctggcggaggcgcaggccgcgctgcaggccagggagacggcgctgcaggcgcagctggagggcaaggaccaggagctggccgcggcgcggacctcggccgccgcggccgccgcggcgctgcatgcccggctggacgaggcgctagccggggcgcgcgcggcgcaggaggcgcacgccgcggttcaggccgagccggaggcccccctgcagtccaaggccgcgctgcaggccgaaatagagagcctgaatgacacggtggcgcacctgggcaccctgtttcacactgccgacgcggcgctggcggccccgaccgccgcccaggnnnnnnnnnnttgggggggtggggggggtccggaggggtgttggagtggggtagaggaggttcagctgtacggccaagtgcggagtcctcactgtcgcaaccaggaatgacgccgaggagtccgagagcttgnnnnnnnnnngagctctgcggccaaatgccgagtcctcactgtcgcaacgaggaatgacgccgaggagtccgagagcttggggcggtgctccgctttagccgtgacgaccctgaccctctcgctctcccacgccaacccgcaggggagcgagaaggaatgggtggcgcagctatgcgcagcacggtcgnnnnnnnnnncagccgtgacgaccctgaccctctcgttctcccacgcaaacctgcaggggagcgagacggagtgggtggcgcagctatgcgcagcacggtcggaccgcgacgccgccgagctggagcgcgcggggctggagcgcgacctgcaggccgcactggagcgcctggcagccaaggaggccgaggtggaggaggcgcgggtgagtgggtgaatgagaggtcgggggagggggatgaatcaaggagggaaggctgtcggggtgcatctggaagaagtttgggctctgatgagggctggtctggcaggcgacgacggcccatgagcgcaggcatgcggaaggaacgagtgccctgtcgcgcgacccaggtgccaccagcgannnnnnnnnngtgaatccaggagtggaggctgttagggtgcatctggacgaagtctgggctctgatgagggctggtctggcaggcgacggcggcccatgagcgcaagcatggggaagagacgagtgacctgtcgcgcgacccaggtgccaccagcgacccagacacccggggcctgtgcatccctgatgcccacgcacaacgcccctctcccaccacccacccacccacagggcgcccccacgcccaagggcgaggccgccaagcaggtggcctccctgtccatgcgtcgcatcgccgagctgcagagcgagctggcagcgcacgaggccgcggtcgccgccgctggcgagcgctcggcggcgctggccgccgagctggaggctacccgcgccgagctggccgccgcccaggccgccgcccaggccgaatctgggtgagggcggctgagggttgggattcggtgacggaggaggaggatggtgcccgaccgcagtgatggctgccaagtcagcgaccttcctcgagctttgcagtcccagagctggcaaggtgccatggacgctggcactttgcttagtgtcggatccctcccaatgaggccccagaccaacacatacccacacatcaccattcccacaaaactcaccataggagccaggcagaggagctggcagcgctgcgcgccagnnnnnnnnnnctgtcaaatccctcccaatgaggccccagaccaacaaacacccacacatcaccatccccacgaacctcaccataggagcctggcagaggagctggcagcgctgcgcgccagggtggcggccgacagcgagaacgccgctgtggccaagacccaaatggaggtgagggggggcttcttttgagttgtcgatggtgtctgctagaggagggtgcagagagtggcgacacgaaacgaccccctgtgcgtctgggcctgctgctcccgtctccatgcactgggcatcgccacccnnnnnnnnnntgtccccctgtgcgtctgcgcctgctgcacccgtctccatgcactgggcatcgccaccccaccaaacccaacacccagaccctggaggctgcgctcgccgcagcgcggttggaggccgcctcgctctcggcggcgcgggccggcgccacgggcgacagcgcgccgcgctcgccaaacaccgccgccgtggcccccctgcaggcaagcccggcggcgccggtggccctgctcccaaacctgctcatgacctgcctgctgggggcgctgtcctttgtgcgcaagctgttcacctggagcagctgagaggaggcgccccccccccccccccccccccccnnnnnnnnnnccccccccagagatcctgcctgtgcgatttttctgcatgccctcccttgcaccctgtcacacccaaggagtcgtagcagacctgggcaggcnnnnnnnnnntgcctgtgcgatctatttctgcatgccgctctcccttgcaccctgtcactcccaaggagtcgtagcagacctgggcaggctcagagtgttttgtgggggaagaagccaacccagcgcccaccccgttttctctgctcccgccggcaggcccggatcgctgagctggaggagcagctggcagaccagatgcgccagggggaggcggcgcaggagggcacggagcaagccaggcaggagcttgcgagcgcccaggccgctcgccgcgccgcggctgagagctccgccgaggtcgcgcgcctggagcacgaggtgggtggaaagggcggcagggtttggggtttgaggaggggagatgggtttggtggatggccttgggtgtaggcttcaaggtggcgggcccaccatgcttgctgaagaaacaatcgatgggacgacagcttgttcttggtgctgcatgcgatggccctgtgctaggaacctggagcgccttggtagcatgcgccgactcaagcccttacacacacgcgcacacaatctgcagctggcgatttcgagccggcaggtggaggagcagcgggcgctgctgacccaggtgaccgaggccctggcgctgcagcgcgaggccacctcgctaactcagcgtctgggcgacgagagggcggtcgagctgtccaagcagctggaaacggtgaggcgccagtgggggtgggtgttttgggagggtgggtggaggggggctgcaagccgtgtgccgatgaagggactgagtgttgaccgtctgagtcacggccgagtgtctgtgcactcgcctaagccgcccggccccacctcccccaccatactnnnnnnnnnngtgagtcaccgccgagtgtctgcactcgcctacgccgcccggccccacctcccccaccatactccctgcccaccatccaataggcgcggcgggccgccgccgagtcggggctcaggctgcagcaggcggagcgggagctggcgggcgcggcccgcaccatgcgccagcatgcggagctgagcgccaccttctccgccgcccgcgccaaggctgaggcgctggcggtggagctgaacgcgctcaaggcggagaaggcgctgcgctcttcttcgacggcgcaggcgactgcggaggtcgaaagggccaggcggcgcgagcaggccggggagcgtcgggccgaggcggaggcggcgcggcgcaccgagctggaggccgccctgcgtgccagccgggtcgaggcccagcgcgcggggcgcgccgccgaggcggccgaggcggaagctgcacggaagctgcaggctctggcctctgagcactcccagcgcgagcgcgtgctgcgcctggtcgcctcgctggcctgcggcgccctgttggcgctggggtcggcatggatggtccagcaggggaagtgcgagtgagcaggagagcatgatgcaggcatgcatgcacatttgtgagcggacggagattgggtggatactttgagcggcacccgactcgcaactttggtgaagcctggttctaattttaacaacctctacgtcagcactctcgctctctccggaaatgcgcgaatctcaaagtggctcatcactatttctcactgctgtgagcaccnnnnnnnnnntactttggtaaagcctggttaaaattttaacaacccctacgtcagcactctccctctctccggaaatgcgcgaatctcacattggttcatcactatttctcactgctgtgagcaccttgcagggatttctttacattaagaaaactctctctgcattcgatctagcatgtacactgtccaaagacactcacctgtttcgggaggattggttccagcatgcccacgcacccgacccatgtacatgaggacgacacgtcgtgctcctggtgaggctttcacgggacataannnnnnnnnngccatgtacatgaggacaacacgtcatgctcctggtgaggctttcacaggacataagacatgtaatgggctcaggagacatctggaaagctgggatgcgggaatctggatcttgacgggctgcagagagtgcgtggaacccccagtggtcgggtgactatcgaccacgacctgcaggcattgctgcgtgtcaaactcaacagcaggactggggagccatcgttggtgacacccttgcagacgttggaaagttcctggccgagtttcgacaagcatcaaggtagatggtggtgtttggatggtaggttgcggtctgctcccctgcatgcagggtcttggtaggagttgtgctctctgactctttccacaccacaacccctgccgccccagggagatagatgcaaggaagaaatcaggagccgccgccggacgttcaacaggagggcaggccccctcagctccagtcacttccgtcgttgctcggcgagcccggtcccctgcaccacccagcgcaatagcaactnnnnnnnnnngggagccgccgcgggacgttccacaggagggcagcccccctcagctccagtcacttctgtcgttgctcggcgagcccgctcccctgcaccacccagcgcaatagcaactgacccgcagcagctttacaactccagccccaggccagccctggcgcatgtcctccgcactgctgtggcagacgcgcgcgccatagtcaggtccttgaaaggacaaccctagatctcttctatacgtagtataatgtcttattgttcacaagaacataagaattatggaccctgccgctcgtacacttgcatgtacgtctctgagagtgcaaccatctgaggcagcacatccgtcaccctcaaatcctgaaggggaacgggagaggtagggacggcgggatgggtacatgagcacagtcccactcgcagggacgcttcagccatcccccttcagaacgttgacgctgcacacaacacatccctaccagtttttcctccctgcctacctggacctcataccaggtattctccaccttcctgtggatgtggaccctgacagagccctcccctgccttgccctcgtgcactatgttggccaacaggtcatacttgacgatgcttcgaccctcgcttcctgtgagggcgactgggcggacagagtggcaatcctgacaggcactgatggttgggaatgggggtaggtgggtgtctcagggtgctgggctcacaagcgcatcagtccggtccggtcgggtcagttgcccgagaaccacccacgaaccggcccacaatgcctcagtataaatcccacacagggcaccgcaccaggcgcagacacgggaacctccaggttcttcacggggaagttcacgatggtcgggttcttctccaggaagaactggttcttcacgaagcgcttcacgtgtagcgcgaggaagcgcggaggcttggtgagccggaatttccgccgccccgccttgatgtcgtcgacgatcaggctccccccatacttcctcagcaggtcgtacatgggtatctgcggtggcacaggccggatgaaggttggggatgaggtgatgccgcgagaggaggtaggtggagggccagcacctcgtcagcagtctcccggccacatagccgacgccctttggttcgcagctcaaccacctccagttctcacttgagggatgatgaccgtctccagggcatccttgaacagcggggcagccggcaggtccagacccagcatgaggaaggacaccttgtccacgacatcctgcaggcggggacaagggaggctgcgtctcgatgggcgcaggttggagagaggttcctgccgcacacctccaccgcacctccttgcccctgcatgggcgctcacctccgaggttcccttggccttccccgtccccgcaagtgtggtcacctccaagtcgccctgaaatcaggggtggaggggggtgtcagaggttcagcgcgccctctgctcagcaggagaccaggccgtgcggggggtggggctctgattttgatgtccggcttgggagccgccgcctcgcagccatcgcctgtcgatccattcccgttagcaacatacgctgcaagggcaactgggacccgagggatttcttgccagctggtgtggcccgcattcaggatcagttcccctctccgacaagctccatgacacatcacgcagcagaccccacacccaggtccctcgcctnnnnnnnnnngtcctgtcgatccattcccgtcagcaacatacgctgcgagggcaactgggacccgaggaaattcttgccagctgatgtggcccgcattcaggatcagttcccctctccgaaaggctccacgacacaccacccagcagaccccacacccaggtccctcgcctgcaggcattctgtgatgatggacgccttcttccgcttgccccccgtcagctccaggtgtagacggttgacgagccactggaaaaagtcaatggcgtccgcctgggcgtcgatggtgaaccgcttctcgctggcggcaatgaccgactgcatgaactcgtggggtgacacgtggcccttgaaggcccgtgtgatccacattttgcgcaccagcgacccaaactcccggaccagcggcgagcggcaggcctcgtagttctgggtgcgcaggaaatagtccctgcggcgtgagttgggggtggctgtagggtgtgaggtgcggggagagcagcggggttcaccgctgaggcttgtgggagggagaatgggagcaatggttgaggtgggaccttggaggcaaccaaccaaacccctctcagcacctgatgggcacgatgcggacgagcgtctggatgaccacattggcatagtcgttgcgcttcatgttattcagccccaccagccctggcatgaactcggtgccgtccagggcgnnnnnnnnnnaagcgtctggatgaccacattggcgtagtcgttacgcttcatgttattcagccccaccagtcctggcatgaactcggtgccgtccagggcgcgtgcccaggtgaccgccgtgtccagccttgccacctcagcatctgcgagaattttgtgagcagtgagtgggttgggtcgacgtggatgtgagaagcttggtgcagacggaacccatggtggcttgggcaactcctgcaggacaggacacatctcgtagcggccggcagcctgatgcatatgtccagggtccatacgaggcatggcatgctataggccctcggcctaaaaacagcagcatccnnnnnnnnnngggggtgggtcgacgtgcatgtgagaagccggatgcagatggaacccgtggtggcttgggcaactcctgcaggacggggcacatctcgtagcggccggcagcctgatgcacaggtccagggggcatttgaggcatggcaagctgtaggccctcggcctaaaaacagcagcatcccaaacaggcatgcagcagccagtcagcaggcccatccacaccagccgagtgccctcacacccgtgaaggtaggggacagcacatactggatgtnnnnnnnnnnggcaggaccgtccacaccagccgagtgcactcgcacccatgaaggtaggggacagcacatactggatgtccgcgagcgagcgatcgaccacctggtacatgtctggcaggcagtagacctgcggtggacgatcagcgtgcaggggtgttgagaggagggcgatggcctgtggtgtggagaatcactgcaaggaggcctgtcctcctggcgctgtcctgatgcaaaccattatcctgtgctgggcaaaagtgacccaccttgccatccgtgaccttcatgaacatgtggtgaccggcgtccaaggagtgcgtgtaggcatgcgtgtttggcccacggccctgagatgctcgggaggtagtgggagggaactcagtggcgggcaaaagcagaacagtcgcgcttgcatggcacctggacgcacagccctgcccatcacgtctgggcaacgacgcacctggaagtacttgccacatacgaggcaagcatatacgttgaccgggctaagggagacggagcagcacttttcaaagtcaaaatcgaggttctgagggggggggggggggggggggnnnnnnnnnnnnnnnnnnnnnnnnnnnnnnnntaaattctccgcaaaacagcctaaagcagagcctggcgttaccttaccccccaaacaccttcctggcactgaatctcatccgacctggcgtgatatggtgtccaagtaggggcagtctgctccagtgcgaactgcactgctcattcgaaagttcttgtgcaggggctggtcatccgcctcatcctcgggtgtggacgccggcccttcaccagtctgagctggttcatctggtacacttcctgccgcagggacttcttctggcgatggtgcctcgnnnnnnnnnntgttcatttggtatacttcctgctgcagggacttcttctggcgatggtgcctcgtcgtccccttcccgtgcacgcttctccatcgggcgctgtccaacaggcccacgcagaagggcctcagcgaagatgaataggccgcgagggatgtgatataacaaagatttagtcacctatggcatgagtacgatgtctccaaagtctgttcgaggaacatgtcgacgatcttctgactgtgctggtcatgcatgtcnnnnnnnnnnccgaagataaataggccacgagggatgtgatataacaaagcttaagtcactcatggcatgagtacgatgtctccgaagtctgttcgaggaacatgtcgatgatcttctgactgtgctggtcatgcatgtcatggagcgccacaacgacgggactcgacgcaactgagaaagacaagtcctacaacacacatacgatcgtggcgacatgcttgtgttcttaatgacttgattccttatggtagcttgatatatataagaggaagggtcagtgtggcaagtgttgtcctcatgcactcacatctaggacaacaagcctcagactattcaagcttgtatggttattcacctcaaccttcacaacacaataatgaacaccgagnnnnnnnnnnttacaacacacatacgatcgtggctacatgcttgtgttctcaatgacttgattccttatcgcagcttgatatatatataaggaagggtcagtgatgcaaatgttgtcctcatgcactcgcatctaggactgtaagcctcagactattcaagcttgtatgcttattcatctaaaccttcacaacacaataatgaacaccgaggtaacctctggcatggctctagttgtgagaagaatcgagagacacccctcagtccagcccgctgcatggtgatccgtctccgggcgcgcgcgctgaatactttagggagataacaggcaggacgtcactcaaatacgacgcttcgggaacaaaaaagtgtcaattcaacccatttcttaaagtgggtgctgcagtgccgtgatgcagcttgtggcgtggtggagtgtcgcaacacacccnnnnnnnnnntcatggctttagttgtgagaggaattgagacacacccctcagtccagcccgctgcatggtgnnnnnnnnnntctcccaagcggcaaccctccagctagcacgctggagcagtcttctctggatatcccaccctacattcttaatccggccgagnnnnnnnnnnatggctgatgatggtcagaggccggacccattagaacctaatacaacaatgtgcagtgaactctccacttcccacgacctcccaagcggcaaccctccggctggcacgctggagcactctcctctggaaatcccaccctacattcttaatccggccgaggagggcccacaatacgctctcctcctgcgagactggattgcagaagagctgcaggcagatgcacccagcccgctgcgtgtatcgcttgcactgggtgcggtggaggcggcattcacagctgcagacggtgccctgttgcctgccagggatctgcctgccctggtggccaccagggcaaaaatctttcaggcctgggtgagcgacgtgctgttgcccaggctggagagcgcacaannnnnnnnnncttcacagctacagacggtgccctgttgactgccagcgatctgcctgccctggtggctaccagggccaaaatctttcaggcctgggtgagcgatgtgctgttgcccaggctggagagcgcacaaactgcgcgggagaaggtgcaggctgctgctgccgccgtgtggaccatgctggcggctgggagctacagcaaggacgtcctgcatgcccaggttgtgtagggggccgagggttattgcctgggctatgaatccaccgtgagtctgtcgacacccagcatggggtggtcctaggcaccggtttgagtctgcctctctcttcattcctcccgagtctccacatcaggctggagattgtcacccactcaccccctcacgcagcatcttcacagcttcgtggcgctcttgacttcttccggaggagtaaagtccgcagccaagcgtcagctggactgcgcgggggtgnnnnnnnnnnggtgttaggggccgagggttattgcctgggctatcaatccaccgtgactctgtcgacacccagcatggggtgttcctaggaactggtttgagtctgcctctctcttcattcctcccgagtctccgcatcaggctgaagatggtcacccactcaccccctcatgcagcatctgcacagcttcgtggcgctcttgacttcgtgcggaggagtaaaatccgcggccaagcgtcagctggactgcgcgggggtggtgatcaccgtgtatgccgcgtgcgaggtcctggccgcccgccacggccatgccgacctgtgcggcgtcagggtccaggtgggcctggagggtggtccactcagccatgcactgcgcccgaggtgggtctgcagggtccagcgctcgacgccagcccctgccccatcacccactcggcgctggaatgccgactgtgcgcaaggaatcacccgccgccctcgcccgccaggtgtccgaggaccactgctggctgtcactggacggcagcggcnnnnnnnnnntgccatgcactgagcccgaggtggtctgcagggtccagcgctcaacggcagcccctgcctcatcacccactcggcgctggaatgcggactgtgcgcaaggaaccacccgccaccctcgcccgccaggtgtccgaggatcactgctggctgtcactggacggcagcggccggcgggacgccgcggtggagctcacaactagcaacgccgcgctacgtggcctggcgcccggcgccgaggcttggagcggctggctgtacgccgggggccgggcccacacgctgacgcagcgccaggtcatcgcttcgctggtcgtctccgtggaccccacggttgtgaacgggcgggcgaagaaggtgagcgggcagctggcgggcctgcagctcctcctgctgcgnnnnnnnnnntcagcaggcatggatgaacgggggttggcatggggagttggaggtggcgccagccgctcctcaggcctgtgggcaggcttggccctggccgtggcaccttgtctccgaaggagggacaacattggatcgagagctttgtgagctgtcgcgggcggaatgcatgccgcaaccgcgccgagggaacaatccaaccatttgtttgcatccccctccccacaaacaggagaggctggacagcgcacttgagaannnnnnnnnngaccgcgctgagggaacaatccaaccattgcatccccctcctcacacacaggagaggctggacagcgcacttgagaaggcgctcgagcggggccagggcgtggctgctttctgcgcccagttcgagcgggagattgctatggcccaatcgagcctggaaggtgccatctatgcctgtgccggggcccctcccagttctgggcttggtaagatgcgcgtggctgatcagagcgcggagctgcaagcaagtgactggatcctggaagcaggagatgccagctggaactggtaccccttcagctgctatgcagaggccagcctgggctacgtggaagccatggcaggcgctgacggcagtgcgctgcaagaaaacgtgccgtcgcacttccagctggggctgtgcgccctggctgcgggggggcgggtgctggccaagtaccgccatgcgcccacaggtcagcctgaggtggtgggcgcattctggaaagtcatgtggaaggaggggcatggtgccattcaagatggtgtgtcctggccaccggcagacctgaccgtgggtacgaggggcgcagcacggtttaacatgcgtgcaaggccctatccactctcccctccgtgtcagacgaccagnnnnnnnnnngccggcagacctgaccgtgggtatgagggacccagcacggttcaacatgcgtgcaaggccctctccactctcccctccgtgtcagacgaccagctctacaaggacattgacgagctgctgcgcaccgtcaagtccgccgccgatgcggctgtcctgcatnnnnnnnnnnatgcgtcggccctgctgacgcccttggctgtcgagcacctgctccgcttcctggatggcctgtgcctctactactcgggcaagcccaagcccgccacatgggttgccaccttgctgaaggtcctggcctcggcgactccagagacaaggcagaccggcgcgtcacgggccgctgccgccatgcagagcccgaccatgcgcgccagcatgggcatgtggtgggagctcaagccccggctgctgaaacccttgtttgaggccggggagtcggagggagagggcgcgcggagagtcaagcgagccagggtagtggactgagttttgcctgtcccccgtgataaccagagggacatccagcacaggggtccaagtgctgcccatggcgcggcatgccccatgcttgnnnnnnnnnnggtggactgagttttgcctgtcccccgtgatcaccagagggacatccagcacaggggtcgaaggcctgcccatggcgcggcatgccccatgcttggggatggactgggcggcgcggttgcgaaccagtgttccatttgaatggcctctgcagcagaacatagctgacacttgctgacatgttgcatcacgcacgtgactcctcacctcataccggaagcgtctgtgcgatcaagcagggcagttatacgtgctgccgtgcctcttccgcttcctgacctcacacatatggcaggcctnnnnnnnnnnatgactcctcacctcataccggaagcatctgtgcgatcaagcaggcagttatacgtgctgccgtgcctcttatgcttcctgacctcacacatatggcaggcgtnnnnnnnnnncacatacacttgcttacgtcaatcggtttcaaggggaaggcgaggggccgacaagccctgacgcatcagttcttcttcttctcacgccttnnnnnnnnnntacatacacttgcttacgtcaattggtttcaaggggaaggcgagtggccgacaagccccaacgcatcagttcttcttcttctcacgcctttgcggtgtgcttggcccgcctgtaggggccgcttgaaggtcactggggtggatggcaggggccaacttggcccctgggggaggcagcctcacgcagagcacgagcagggtctcgttgagcagccggaggagcgtgtaggttgccacatcggcgtacagccagtacacggcaatgagcgccatgttgaccatctgcagttggggtgtgggcgtgcatcggtgatgacttgaagctaatggccatggaagggcgggccaagctggcacccgcaaatgaagcaggcaactctcctttgcccctggacaccagttggccgcaatctgcacggagcaaannnnnnnnnnctgaaactaatggccatggaagggcgggccaagccggcacccgcaaatgcagcaggcaactcccttttgcccctggataccagttggccgcaatctgcacggagcaaaacccagcgtcctcagcccccacagccccctgtcagcagctcaccaccatcgcccgtacaaacttgttcggggtttccaggtcgaggtgagctggcaggatgtgctcctcccacacgcaggcgtacattgctgtcatgcgagtaagaaagaaaggaggagggtggatgagggtctgatgccagcggggcaccatcagaccgacagcacggccccaaacgtgtcgcttggcgagcatggctctcttcatcaccatgtggcgttgaagtgcacaagcccactcaccaacgtagccgacggtgtatggggcaaatccaaacagaaactcgcgccacacccgccggtcctcggatgggagctctgtgagcgccgcaaaccctacnnnnnnnnnnaagtaggaaaggaaggaggacggtggatgagagtctgatgccagcggggcaccatcaggcccacagcacggccccaaacgtgtcgcttggcaggcatggctctcttcgccaccatgtggcgttgaagcgcacaagcccactcaccaacgtagccgacggtgtatggggcgaatccaaacagaaactcccgccacacccgcctgtcctcgggtgggagctctgtgagcgccgcaaaccctaccgtcccaggcttcacttgccaactttcctcagacaggatccacctgcatgaataccgagcaggaacaccatctcacaagctaaagccgtggcacagagctggagcaccaaagcttccgctgcacactgagaatggggatggtgcacccgagcannnnnnnnnntccgagcaggaataacatctcacaagctgaaaccttggcacagagctcgagcaccaaagctttcgctgcgcactgagaatggggatggtgcacccgagcatgccccatcagccatgcacacccaggcagccaccggcgccgcctacctgccggcatcaaacatgaagaggagggagaagccttccagaacggcattggctaggggaaacaggatgagagacagggagctgagggggcgtcccatgcggaaagctcccaggtagagggggatgcgaaggaaggcaatggccccgacggcgaagacgaccgcatacccccccgaggagacatgcagcgcgggcagcgttagggcggtttcctggagcagcttccagtatcctagggacccagctgcagctcccacggcccagtacgcggccaggagaagccatgcatagggtcgcccaccggcatacaccgctgccatcctgtcgcaggtagcccttgttcgcccgagctgctgtactgcaaaatttctcaggctcgggacattatttgagagttccgggaatactcatatatcatctgccttcaatgcactgcccgaaatgcgcgcgagtaagtggttctccgaggaatctttcgttcgctgtgcctgctttgctcatgctgtacaagccnnnnnnnnnnctgtttgcccgacctgctgtactgcaaaatttctcaggcttgggacattacttgagagttccgggaatactcatatatcatctgccttcaatgcattgtccgaaatgcgcgcgagtaagcggctatccgaggaatctttcgttcggtgtgcctgctttgctcatgctgtacaagccacagatctgtgcgcatgggcaacgagcccatgcgctgcggctcatgtatcgggccgcagcgatgattgaaacattgaatatgttctcttgatatacatcgtaatgcattgaaacccttgaggcacagcatgcagcctgcgatgagaaatgcgtctgcggtccatggcacctcccatgcctgccctcgccgacatggctggggagtgcagggtccaaggcagggaatcggattccatgcattgctgcgtgggcgctgtacgagcccaagacggcgccaaggtgttcagggcacatctgctgctcaaggaccgccaccaaccacccccagcgggatgatgtcggaggcggagaggttcgcacaggaggttgaccagatgaccgagggcgaagatgttcttcccagcactcggtctacattagaggcccaagtagcatccttgaactcccaggtgggccaaatttccaagcacctctgatgtgcagcatgaatgtgcgttatgcgcctctcatgggcattctagcttgtatggggggtagctgatttccagagcatttctgcatccatgtccgtttacagatggagaatatccaggcacagctggacaaacattaccgtgagacctttgctggagtctcgatggaatttgatccaggattgggggaaagcagcagtcaggaagggacggcgggcggtgtcacgaccgacttccagaccccgaccagtgagcaagagcttctcgacttttgccacacacacccagaggtgcagtttagtcgacctgctgtttgcatgagctggtgatgggatgaggactgacatgcgcctttcaaggcatgctggaaagaatgcaggaatgctccaggtacccctgtcggccgcataatttgtgctgctctcagcaggcctgaatccccctatccttctagtacaagcaagcgctgctggacagggcaaaggcatctttgggcccccaggcatggacgaccttccaggcccgggttnnnnnnnnnngtgcttctctcagcaggcctgaatccccccatccttctagtacaagcaagcactgctggacaaggcaaaggaatctttgggggcacaggcatggacgaccttccaggcccgggttggttccttgcgtctgcagcggggcagggtcggggaggagctggcggaggcccaggcccagctggaggaccggggtcggcaggacgactcgctcaacccggaagcccgtcccatgccaccctccggcgcggtgcnnnnnnnnnngagtgcaggcatacttgaggccagggactcacttcagattgcttgagcttgaagtagaagcctgtgagactnnnnnnnnnnttggaggaccggggtcggcaggaagactcgctcacccgggaatcccgtcccatgccaccctccggcgcggtgcgtgcggtgctggtcgtcggcttcgaatcattcaacgccgccctgtatcgcgcggcgggggagcgtctgcttcacctccaaccgccagttcagctgtcggtctttagcgaccgcgatctgggtgagtggccgggcagagctgtgtgtgggcatgtgtgagggaggcgcatagtcgagatggaggggtagtggagaagtgcgggcgtacttgaggccagggactcacttcagactacttgagcttgaagtagaagcctgtgagactgcctaatagcagcgcgactacccagcagatgctgggaaggccgagctcgctgccgccctgaaggacgcggacgtcttctttgggtccctgctctttgactttgaccaggtgggcttgacattcctggacggtaggggttcttgacgctgcctgaacacacctacccaccctcacagctggcatctggatggcgacgcgccacctggcctcatctcgaactcattcccaaccgactgtgcccaggtggagtggctgaaggcacgcattgagcacatccccattagactggtctttgagtctgccctggagctcatgtccagcacccaagtgggcagcttcacggcaagtctgtgaacattctcggactggagtcctggtttgaacgggttcatgcatgccgcgtgttgtatgtgagcacctgtcacctccaagtaatgaatgacatggtctgtgctctggaacccccacacccggggtactcccattccttctgcagatggggggcgannnnnnnnnncgtatatgagcacctgtcgcctccaggtaatgaatgacatggactgtgctctggagcccccacaccccgggcactcccattccttctgcagatggggggcgagtccaagtccaagggacccccccctgccgtccaaaaggtcctcaaactctttgggagcaagcgggaggaggacaagttggtggggtacctgagtttcctgaaaatcggacccaagctcctcaagttcctaccaggcaagaggggggtcaaggaaggggtccaggggagtgcttccagacgctagggtgcaacccttaaggaggagaagcatagcattgcatgcacttggtactgcacgttgtgccaccagcagtctgtcacaagcatggccagagccaggaagcccaatcgggccaagagatcctggcactccccactccatcatgccgtaccacaccagccatcctcccctgcacacacaaacaccatctcagggaagaaagcgcgggacctgcgcacctggctgaccacctactcctactggaaccagggcggggagggcaacgtggtgtccatgttctccttcctggcgcaggcctgcttcgccacgagcggcggggtggccgccacgccccccccgcccccctccgagaccccacccaccggctgcatccaccccgagggcggcatgttcccggacgcggcgcggtacatggcgtggtaccgccgcacgcaccccggtgcggccgccgccccggtggtggcggtgctgctgtaccgcaagcacgtcgtcacgcgccagccctacctctgggacctggtgacggccctggaggcggggggcctgctccccctccccatcttcatcaacggggtggaggcccacgtcatcgtgcgcgacgccctcacctcggcgcacgaggccgcgctggtggcggcgcacgggcgcggcgcggccagccccactctggcgcgggacgcggtggcagtggacgccatcgtcaacacggtggggttcccactggtgggcgggccggcggggaccatggagggcgggcgccaggcggaggtggcgcgctccatcctggccaccaagaatgtgccctacctcgtggccgcgcccctgctcatccaggtggactggttgtcgctgggaaaggggggatctgatgcgggatttgcaaaaaggggggggggggggggggggggggnnnnnnnnnnnnnnnnnnnnnnnnnnnnnnnnnnnnnnnnnnnnnnnnnnnnnnnnnggtaggaggaggagtgaagagagctggtctgtgtgcctatgaaggtgaggtgctgctccccgcatcatccagcaccctccgcccctggacatcatcagtgcacagaccccgggcacatatgcagcactacgctggcccctcgtatgtcatggccccaccctcctggatacacccagcgcatgctcacccccccccccccccccccccccccnnnnnnnnnngctgcacactcgtatgtcacgcccccaccctcctggatacacccagcgcatggtcaaccccccccccccccnnnnnnnnnnnnnnnnnnnnnnnnnnnnnnnnnnnnnnnnnnnnnnnnncccctcatctcctcaccgcacctccaggacctggccggctggagccgggacggcgtggcgggcctccagtccgtggtcctttactccctgccggaactggacggcgcgatcgaggcgctgccgctgggcggcctcgtacgcgacgacatccacctgctgccggagcgcgtagcgcgcctggccggcagggtccggggctgggcgcggctgcgccggctgaaagcacaggagcggcaactagccgtggtcctgtacggcttcccgcccggcgtgggtgccgccggcaccgcggccctcctcaacgtgc

SEQ ID NO: 39524 - DNA, 10567 bp, Chlorella protothecoides
  modified_base (217)..(285): a, c, t, g, unknown or other
  modified_base (688)..(697): a, c, t, g, unknown or other
  modified_base (1492)..(1501): a, c, t, g, unknown or other
  modified_base (1822)..(1831): a, c, t, g, unknown or other
  modified_base (2806)..(2815): a, c, t, g, unknown or other
  modified_base (2893)..(3134): a, c, t, g, unknown or other
  modified_base (3212)..(3221): a, c, t, g, unknown or other
  modified_base (3625)..(3634): a, c, t, g, unknown or other
  modified_base (4105)..(4114): a, c, t, g, unknown or other
  modified_base (4669)..(4678): a, c, t, g, unknown or other
  modified_base (5905)..(5914): a, c, t, g, unknown or other
  modified_base (6377)..(6386): a, c, t, g, unknown or other
  modified_base (6547)..(6556): a, c, t, g, unknown or other
  modified_base (7007)..(7016): a, c, t, g, unknown or other
  modified_base (7295)..(7304): a, c, t, g, unknown or other
  modified_base (8000)..(8009): a, c, t, g, unknown or other
  modified_base (8326)..(8335): a, c, t, g, unknown or other
  modified_base (8576)..(8585): a, c, t, g, unknown or other
  modified_base (9154)..(9163): a, c, t, g, unknown or other
  modified_base (10503)..(10512): a, c, t, g, unknown or other
accgcgcgccggccctgcgcaggcgccggcgcagtctcgcgccgcgcgcgctccagctcgccgcgtagctcctccagctggcggtcgcgggccgccagctcggcgcgcagcgtcacggggctctcgccgtcgctggcctcgctggacacggagcggctgagcgggccctggggggtgaggcggggcagggaggggccggaggcctccacgccgccgnnnnnnnnnnnnnnnnnnnnnnnnnnnnnnnnnnnnnnnnnnnnnnnnnnnnnnnnnnnnnnnnnnnnncgctgggaggaaagcatgtccagggccaggccgcgctggcgggccgcccggctgagcgcctcatgctgagtctgcaaggaggtcagggccgcctccttggccctcagcgtctgtgtgtgtgtgtgttggagtggggtgggaggggtggggggagggtaagcatttagggctggggatgaggggcgaggtggggcggggggaatacactatgctctgccatcgcaacgtttttgtgttgcgtccagggccacgagcaagggcacccttgctgcacgggccgtaggcaaggccccagcacccccgtccctgaaagagcaaggggctgcctcgcctctgaagaaccactgggaggcgcactccgtagctgtactggcctccaaaacccctacctttagggtttcgnnnnnnnnnnacccagcacccctgtccctgaaagagcaaggggctgcctggcctctgaagaaccactgggaggcgcaccccgtagctgtactagcctccaaaacccctacctttagggtttcggcatgattctccttgagcttcttcagttccgagctcgtggtgaggaggctgttctccaggttgtccagctgccgactcctcttttgaagctccgccgtgagctgcggcgggtcgcgagaggggggcgcagtgatgtactccacgccacaaacctagcgctgtgctgccgcgcgacagatcacggtctcaccttctccactccggtagaggggccgaagcgggccattgcacgtcctcaactgccacctcggctaccgattgcaagtcgaaagccgtacggctagtgtctgggaggctcaaacgaatgcaaatgttcgtacacacgtttaaatgcgagagatccgagcccttctgcccctgcagagaattacctgacaatccgtacccagaatctttcttccccctgcccgccagtgacacctgtttgtggccgggcgcatgcatccgggtgacctccatgcacggggttgacgcccgtgagcattgaaacattgctttaaccgcgtaggatttataaattggccagcatatgccacgagctgtgatggatgtcgcccacagtggggagtcgtgtgtacggtagaacactgaacgaattagtgggactctcagggtcgcagaggtggctcagagacacttattcacgccgtagaacaagacacatacatatgggagggtggannnnnnnnnnttggtagaccactgaacgactcagtgggactctcagggtagcagagctggctccgagacacttattcatgccgtggaacaagacacatacatatgggagggtggagatatcagatcaccggggtggtgggcccccttgcgaggggccaccgggttgcttgtaacaccggtaatcactctgtcagaccacggtggttgatgcagcgtacccaaggatcccaaattcgcatatgatccatgtatactttcgtccttggccgaattctgatcacttcggcacacggcggcgaggggaccgcatgcgtgatgcgttgccagctgnnnnnnnnnngttggccgaattatgctcacttcggaacgccgcggcgagggaccgcatgcgtgatgcgttgccagctggtgaacctctgaaccaatcaatcaggtggcccacatcaaactcgcctcacaggacaatgtgttgttgtgttgtcctccaaggatattgtcgcagtccatctcgagatttcctgctctaggggctcgggcccatccgcatgagaggagcgtgtgtggcacaggccggtcctccccctcgaccagatagccgcacccacccacccatgcgccgcagcatggccatgctccgcacactacgtccagggccggagtccacggccgtgaggggcatcgtgtttggtgcgtaccgcgagatcgcccaatgtgcatggggtgctgtcggtgtgccgagccacaaggcgaccgactcccgctccatgtgacccaccatgcagacagtgcgtggggcgtgaggaagagcgacgaagtcattggggtgtatacggtgttggtatcggcacgctcacgtgctgcgatgcacgggtgcatggggtgctccctgggcacagtgcttcagagtcccagggcagccattctcgcgcccttaccccctccgtaccctgaatacatccctgttcaaagtggacggcaccctcaccgtccccgtcctggacttccccaagatgcggcgggtggtgggtgtgcccgagggacaggacgtgctggacttcctggccgggctggagccggcggagcgtgcgcagcgtgaggcggcgctgcacgccgtggaggaggagggcatggctgccatgcaggtcatgcctggggtcaaggagctggccaagcacctggacgagcgagctgtgcccaggtgggccgggtggggtgggggacggccacgctcggcggctgggcgggaagaggtgaccgacccattgcgtgctggacggcggaattcggcagctgctcatggcggtgtgcagggcannnnnnnnnnaggcgtgaggaagagcgacgaactcattggggtgtatacggtgtcgttatcggcacgctcacgtgctgcgatgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggaggaggagggcatggcggccatgcaggtcatgcccggggtcgaggagctggccaagcacctggacgagcgagnnnnnnnnnnacgctcggcggctgggcgggaaagggtgaccgacccattgcgggctggacggcggaacccggcagctgctcatggcggtgtgcagggcacacttaccgtctcgcacgcacaaggcctttggtgatgaagcggcccctcttaccaccaacacacagggcactcgtgacgaggaatttgaaacgtgccgtggacctgttccatgccacgcactttgacctgccccccttcgagcccgtgctcacgcgggagttcctgccatacaaggtgcagaccgacatggcaggggagcggaggtgacccggcagcaagctactgctcccattccacgtcggcagcagcggttgtggggtcgatcatgcatgctgtgaccgtggtgctgcgctcgtgctccagccattgcctcnnnnnnnnnnttgctcccagtccacgtcggcagcagcggttgtggggttgatcatgcatgctgtgaccgcagtgctgcgctcgtgctccagccattgcctcccggggccaccttcccatgcatgtgattgttccccagccacactcattctcccccctttccaacatcgtgcagcctcacccggcggcgctgctgcacattgcagagcactggggcatcacgccgcaggagctggtcatggtgggagacagcgccaaggatgacgtgcgcggtggagctctgttgacggtcatcctgtctgccaaagggggttgcatgtcatgggggaggggaccaggatcctacactgcagggcccggcacctggccccacaccatcgtgcaccaccctgcacgtccccacccgctcctcatgcaggtcgtgagtgggaatcgtgcgggcgcgtggactatcctcctggacaccgaggggacgcacaggnnnnnnnnnngcgacggtcatcctgtgtgccaaaggggttttgcatgtcatgggggagggtaccaggatcctacactgcaaggcccggcacctggcctcgcaccatggtgcatcaccctgcacgtccccacctgctcctcatgcaggttgtgagtgggaatcgtgcgggcgcgtggaccatcctcctggacaccgaggggacgcacagggagcgcggccagggcctggaaggggacctgcggccccacttctatgcggcctccatgcaggaggtgcagcagatcctgaccaccgagctgcagctgcccagtccccgggtgacttgaagggtaatcggcaccaggaaggggtggaagcgggcagggcgccggcaggccattgcatgcccgcctttgttggggagaccccgcagctccaagctggttgggagtatagcaggacttgcagtgcctgccggcgcaggttctcagtgttgaaaagcaatccctcctgggcctgttccctttgcagcagctggataccgttcaattattacagacatccccttgtccgcaccatgccatgnnnnnnnnnntgcctgattgctttgcagcagctggatactgttgaattatttcagacatccccttgtccgcaccatgccatggatgacaagcacccccatagatattggctgaatccgtcagggcagggcactcggggcagagaatgcgaggggcaactaccagggagcacctgctgcgacaacaaaacttcccagccaccagggtcctcgcccccagccagccctgcctggacaccgcagatctgcatgcctggtaccacgccgccagctcagtactgcacaccgacgtccgacaccttgagcaggaccttggtgttcttccccctttccagcgcgtgctccagcgcctcaccaaactcggtggcgagctcgtacctgcgattgcgatgtgggaggcagggccagagcgtgggctcgggagcgccaggcgaggcccaggagccatgccttggcacccagcgcagcgcaggtctgcggcgcccaggtcctggatgcgacgcctgcggcccctgccctccccctccacgcccttccaaactcactcggtgtaggcggctgtgagtttgccggcgttcaccagcttggcgatgctttccagcaagacagggacccgcttgcggtgctcctgcacccagcgccggatgttgaagccccgcacctggttgcgtttgaagagcgggggtttgtggccagtgagaggggacatgcgatgatgtgcttgggcgcgcctcggtcagaggagcttggagccaagctgcctgttcctccgcgtgaaacgctatgatgagctgtgtgccgatcctctcacaacatcctctgcctcggacaagccacgagcaattgccgtgcagcagccagtcgccctttccagatactccacccagcccttgccagtcacctggatgccctggaacacccaggagtgccaggtccaggtgggagacttgccggacatgcagccgtacaccaccagctggcccccctccgccagcatgtctgagaggcgggtggagctcagtccccccaccgcatccagggccagctttggcttggcgaagaacttgagcttgtccagctcggcctggtgtggattcatgggtggggggtgttgagcttcatacaacttgtgtacagcaacaccagaggtggaaagctccgggcagcatggtgcacagtgcaatgactgtacccaaatggtgacgtgcgcgtctgccagatgtcgaaggctgccaaggnnnnnnnnnngcatgggtggggggtgttgagcttcatactgcttgtgcacagcaacaccagaggtggaaagctccgggcagcatggtgcgcagtgcaatgactgtccccaacgggtgaagtgtgcgtctgccagatgtcgaaggctgccaagggtcgcggcacaccttctcaggcagcccaccgcctgggccgtgtgcagccagacacagtgctgcaggcagcggcgatcgctgcgacccgcgtcacggccgccggcatgcacccgccccaccttcaggttgccgcggtcgggcaggaccaccgaggcgcccagggacttcagccagtccgcggtcttgtcaaagtcgccgcccgcgtcgtcggagacgacggccaccgtcctgaggcggagcaggctcgccagctggagcaccatctggcccacggcggagttggccgcgttcagggccacgcagtcgccgggctgcggggnnnnnnnnnnacactgcgcgggattggaaaggaactggaaatcatgcctgcggcaaagtgcacacttcatggaccaattgagtgccagcctgacgcacgactagggccccagccaaagggcaggccccttcacctccacgcccagccccagccatcttccatccccaccannnnnnnnnngcactgcgcggaatcggaacggaactgggaatcatgcctacggcaaagtgcacgcttcatggaccaatggagtgccagcctgacgcacgaatggggttccagccaaagggcaggcccctccacctccacacccagccccagccatcttccatccccaccagcgtcccccgcccaccttgagacccggcgcatcctccagcaggcggtacgcggtcagcgtctcccgcagcaccgcgcactgctccatgggcatggcgtcgggcgccaggcggagcagatccttctccgccgccaccagcagcgagcgccaggtgcccaggaagggcttcagggggaccacccagtcgttctcgtgcaggcccttcacgccaggtccggtctggaagaaaggggggaggaggggggggaagggggtgagcgggcgggcacaagacactcgtgcacctgcgannnnnnnnnntgggtgaaggagagggaggaagggggtgagcaggcgggcacaagacactcgtgcacctgcgaggccgcctgggtagccaagacggaggctcttagcccatgcatgcatggaagtgagggttctgccaaggccactagggatgcagaggttcccttgggaggcagccccgtgcacggtgaaagcctccagacaattggatcccggcgccactcaatcccctgccgcctgcaggatccccccaaaacgctcccaccccctctcttgccttgacgatgaccnnnnnnnnnntttgggaggcagccccctgcacggtgaaagcctccagacgattgaatcccggcgccactcaaacccctgccgcccgcaggatccccccaaaacacccccaccccctctcttgccttgacgatgaccccgacggcgtcgtgcccgggtacaaaggggacggacacgtgctcctggccgtaggtcccgcccgtggccacagtgtagaggtcggccgggttaaccgccgcgtagcgtatgctgacgaggacctggccccactccagctcggcaggcagctcctcggcctccacgcccagcacctcgcgcggcctgccggcgccggagcagcgcacagcgtgggccttgatcctgggcaggggcaccgcgtcgtacgaacccttcaccacgccaaactggtcgatgacgtcgtcggcggtgaagacctgcaccccgccgctgccgcgcccgcgcatccaggcctcgaagccggcgccgtggctgccggcctccttggactggcgcaccgtgatctgctccgagatgttgctggcctccgaggtctcggcggcacgcaccttgtcccgatagttgcctgaccgtggggaggggggaagtgtgtttgaggcatgtggctgctgcgcagtgggtacaaggtgcgtggccactcctgtggaggccgccgagcgttgaacagggaaaagggcagcctcagtcaannnnnnnnnnagtatttgaggcatgtggctgctgcgcagttggtacatggtgcgtggctactcctgtggaggccaccgagcattgaacagggaaaagggcagcctcagtcaagggagccaagccccagggtggtccagggagttggggtattgggctcttggggtatgcacgtatgccacgaggagaccccaggagcgcaagacaggtctaggaaccctgcccacggcaagcgatttccatgacgaaaaacatgtgctctgcccctaccaccggggccacccccgcaccccccgcgaagctgtccatgaactcctcctcggccgtcnnnnnnnnnntacggcaagcgatttccatgacgaaaaacaagtgctctgcccctacgaccagagccacccccgcaccccccgcaaagctgtccatgaactcctcctcggccgtcttgatgatcttgccagtctgatcatagtgggaccgctgcacatggtgggatgacagaggaatatgtgagtaacggagcaggctggcaggtctgcgtacgaccgtcggggttgcggaatgagttgacctgcagggtgnnnnnnnnnntatggtgggataacagagggagatgtgagtaacggagcaggctggcaggtttgcgtacgaccgtcgggttgcggaatgagttgacctgcagggtgcccagctgctggctggcctgctcggtcgcaccttgtttgggtcagaaaggacctcgtaagcctgctgaatcagcctgaaacgcgcagcatctccccccttgtcaggatgggcccttgtgaccaggtttcggaaggcccgacggatctgcaagggttgacgtggtgcagcatgtttgaacgccgagggtgggtagagttgtcccaccgagggaggttcactcgtcacagagacgcaaggattccaatgttagcataagcaacatcaatgatcccacctcggtatcctttgccttgggtcccagaccgagaaggttgtacaggttgtgatcggactcctccatcactgcacccggcatggccactggcaagcccacaaggtttcagattcttgcaaggcaaggaggtcggatagcgctacggcaggcacttgactccctggcgatcgggggacccggtcaaaatctgcccctgcannnnnnnnnnaggacagcgctgcggcaggcacttgactccctggcgagcgggggacccggtcaaaatctgcccctgcatctcgtcctcgacctggaccgggcggaagtttgctgcggtgcgtgctgcgagctcctgcatttgaacccaaccaccgggacgtcgctgacttgggaacaggtagcacgtaccgtcaccgtcaggatgccggatggagtgcgccctcttcatacttggccgatatcggtgcttcatgactgcgatactcgctccgtggggtcccggctgggacctgtgactcgctcgctgcggacaaccgcttgcagccggcacagacccgacaaactgggacgagcgttggaaacaagacggcgaggatcctgggatggaatccgcgtccaaatacgccacgcctggaagcactctgcgcagcctctctcgccagctcgaggtactgggagtgtggtcgaggactggggaatggggtgtgcgacggcatgccgcaattcatcctgatcgccgcgccttgcatcaagatcccatcaattcacaccgccacaacaggctgagaagcggacgccggctttcggactctctgccttcagagtgcgttgtgcactgttcgtcagtgtcgtgggtggtagcatccttaatggatggctcgttcttggcattgtctgcaggttccgatagtgtgtgccatctagcctgaggcaagatgagaaatgtctgcctgtgtctggatctgactcacctgatcccccctccccaccctcctcacactatgtcgccatgcagccgtcagccccatcgatgagcaccgtgcctgaccccgaggctcagctgctccgacagcagatggaccagatcacgagcgacttcaagtacaacctgaaggtatgcatgcgtgggtgacgtgatgtgggcgcgcatggggtctgctgtgggggggcctagttttgcatgtgcgcctgcctgggtcgcagtgaccctctggacaccacaccccctacagctcttgcacgatcgggacgctgagctggcgaagctggagtcccaggtggccacgctgcgcagcgaggcctccagcagcgcctcggtgggtggcaggacgcttccagcacgaggctgggaatgggggcgagcgcctcggctgcgccacccaaatccgccagccaccccctaccttcactcccaatccccccgcacacacatcccaggcgctggcggaggcgcggcgcgcgctggccgagcgcgacgcgcaggcccgggcccaggcctccaacctggcggctgccgaggcgcgcgcgcgcgaggccgaggacctgcgcgcccgcctgcgcgccagcgannnnnnnnnnacctccccctgccttcacccccaaaccccccgcacacacatcccaggcgctggcg

SEQ ID NO: 39525 - DNA, 61 bp, Chlorella protothecoides
cagcggcgtgaacatcatcgtgctggcgggggacgaggacggcggcaaggaggcggagggg

SEQ ID NO: 39526 - DNA, 75 bp, Chlorella protothecoides
gggggacgacagccggaccaaaggctcctcctctgtagccagatcaagcccctggctagctgcagcgtggacaag

SEQ ID NO: 39527 - DNA, 123 bp, Chlorella protothecoides
ggggcggaggggatggtggaggaagcacggcgtcgagggagcgggcaggcgggggaggtggcgagggcacactgggctgtgcagcctcagcagttgccgggcgaggtagatctacagtcagtc

SEQ ID NO: 39528 - DNA, 179 bp, Chlorella protothecoides
ggtggcggtgtcaaagcaggtgtccaggctatcgtagctgtccacctgtggcgtgggacgagggggcttgggaacagggcatccctgcacacgtcataccagcagcaccgggtccttgtgagactcagccacctacaccatgcggcaggcccacccagggtcaatcctgctggtccctg

SEQ ID NO: 39529 - DNA, 83 bp, Chlorella protothecoides
cggggcggcggcgccgcggcgccgggcacctccgcgaacttccccttgccgcctgtgcacctaccttccccaggaggcaggct

SEQ ID NO: 39530 - DNA, 122 bp, Chlorella protothecoides
ggcagcgctggcgggtggagccccgtaggcgggggcggcaccagccggtggggggggcccataggcagaagcacttccggtaggaggggggcctccgtacgcgggagccgggccagtggcgg

SEQ ID NO: 39531 - DNA, 72 bp, Chlorella protothecoides
catctggcatggcacccaccaaatcggagtctaccatggctgggcgctggagctggtggctgtgttcggcct

SEQ ID NO: 39532 - DNA, 61 bp, Chlorella protothecoides
gctccttttggatgaagatacaggccatcacctgaacgggagggtgcactgagttggatga

SEQ ID NO: 39533 - DNA, 82 bp, Chlorella protothecoides
gcgaccttcaagatcttccccctccgccgagcttgcgaaggatgcgcgtagtgtgcacaccaggacctcaaccaaggcctac

SEQ ID NO: 39534 - DNA, 4561 bp, Chlorella protothecoides
  modified_base (669)..(678): a, c, t, g, unknown or other
  modified_base (1070)..(1079): a, c, t, g, unknown or other
  modified_base (1318)..(1327): a, c, t, g, unknown or other
  modified_base (1834)..(1843): a, c, t, g, unknown or other
  modified_base (2143)..(2152): a, c, t, g, unknown or other
  modified_base (3156)..(3165): a, c, t, g, unknown or other
  modified_base (3271)..(3280): a, c, t, g, unknown or other
  modified_base (3837)..(3846): a, c, t, g, unknown or other
  modified_base (4389)..(4398): a, c, t, g, unknown or other
gtggctcaggacaaggggaccagacatgctgtccagccagaggattgtgcaagctctcaacacgtgaggtcacgtgagctttggcctcacatcctacagcaccaatcacagcagggcgcggaaacaagctacaactacatccataggtcgcaagcagcctccagcaacccacgccactcacttcgccatcgttcctccctccccctgcctgcagcttctcgtaccggggcgctgccagcccttgggactggcagtaccttgccagcgcctgcttgggtgtctggaccgggggaccgacggatgcagccagcgctttggcacccctcttggcgggcgcagctcgcgctctggcaccccccttggcaccacgttgggggactgggggaggaggaaggcttgccagcagccgggaagggggctgaccctgtcgcctgggcatcggttccttgccggcctcgtcgccgacctcaccaaacagatcaaacaccggctcatcctggggaggccgcgactcaggcgctgcctgtggcgcagcctggaaggggcccttgggtccaggctccaccttgtcctcagcgccagacgcctcgctgccactgtcctctcccaggacgacccagtcgtcttcaggaggaacagctgggtgctgtgccgagggaggcgtgccgnnnnnnnnnncatggatgtagttgtagcttgtttctgggccctgttgtgattgttgctgtaggatgtgaggccaaagctcatgtgacctcacgtgttgagagcttgcacaatgctctggctggaaagcatgtctggtccccttgtcctgagccacgaatgcctcgttcccagggcggaattcgttactctgtcaccctggagcagctcctccctggcaagcccactcccaagaaagtcaccactcggtgccagctggcggtgttcgaagacgggtgggacaccatcgaggtgcgatgactccattgcatgaggctggtggtgatggatctcaaggtttcggacatgaatatgtgggcaagtgggtgcacattttgcttcctccttgttctgctctgcaccannnnnnnnnntgaggtgcgatgactccattgcatgaggctgatggtgatggatctcaaggtatcggacatggatatgtgggcaagtgggtgcacgatttgcttcctccttgttctgctctgcaccagagggcaaagccaatcactctaaaatttggcttataaggaatgctacgcaagttctggttgcatcattcctcttctttttttcaagttcggttcagagtctgatccaacgatagcctccaagnnnnnnnnnnatctaaagtttggcttataaggaatgctacgcaaattctggttgcatcattcctcttccttttttcaagttcgggtcagagtctgatccaacgatagcctccaagcctccccatcttcacctcctgaaaatgtccaggaagcccagcacgctgttgccaccagggccctgtacctcaccacacccgagagcctggggctgtggcagaagctgcctcccgatcatcgtgaaatgtggtttcaatgggtagatggggccgacgcggggctggacacactgaagctagggcgagttgtttttgggggggggagtgggggggcggccgggggtatgcagaatgattgtatgggacattgcggtctgtgcctctgcaaagaacttgttacagagtgagtaaacctctcgtgcttctcaaagttgcgatccattgacccagctgtttgctacagcaccagtattacaatgctcagcttcaccaccccaccctccctcacacagggatgaggannnnnnnnnnattacggagtgagtaaacctgttgtgcttctcaatgttgcgatccagtgacgcagctgtttactacagcaccaatattacaatgctcagcttcattaccccaccctccctcacacagggatgaggaggagctgagcaacctgcaggcccgtctggaaagcgtgtacagcgacctgcatgctcaggagcgggcgcgccggctggccgacgcggtccctggcgagggcggcccctccacgagggggggctcgtccaggtcccaactcccgaaccccgagtgggtggcgcgcgagagcgctcnnnnnnnnnntggtccctggcgagggtggcccctccgtgaggggtggctcgtccagttcccaactcccggaccccgagtgggtggcgcgcgagagcgctcgcctgcgcaggcagcgcgccgactggctggcaagcgacacgggacgcgcctgggcttcccgcagggcacagctccccatccatcccctgggcccccgcctcacggcggccctggaggccggcgacgtggccatcgtggcctccgagacggggtcggggaagaccacgcaggtgccccagttcttgctggacgccgccatcgacctcctccgcggcacggcgacctcggtggtgtgcacccagccgcggcgcatcgcggcgacctccgtggccgcccgcgtggcggcggagcggggggaggccgcgccagggcagccgggtgggcaggtgcgcgcatgtgggtgagcgcggcagggggtggggcgggtacgggcctgagctgaggctgaggcgggctggcagggagcccgactctgcccgccagccgacgttctgaacatgcctggggtccacgggggccgttcaacaccatgcttgctagcgccaggtcgcaccctgccccgacagtgcttcgggccactcaccctctgaatagagtcagtgccccaatgcctacaagcccacaacaacacgctaccccccttctcactcaccacgcacaggtggggtaccaggtgcgctttgactcggcgatgacggcgtctacgcgcatcctgttctgcaccacgggcatcctgctccgccgcctggcctccgacccgcagctggaaagcgtgtcgcacgtggtggtggacgaggtgcacgaacgcagcatggagggtgcgtgttttggtgcgggcgggggtgtttgtgttgggtgcatcatggtcggtgtggagattctggggggtctgaaacacgacagatgcactggcatcatccatctgtcgttgccctctgcctgccggcccttgcacgccaaaggccccctccccnnnnnnnnnngcgcagcatggagggtgggtgttttggtgcgggcgggggtgtttgcgttgggtgcatcacggtcggtgtggagggtctggggggtctgaaacacgacagatgcacnnnnnnnnnngccctgctgcgtgacatggcggcggcgcggcgcgccgccggccgccccctcaagctcgtactgatgagcgcgaccctggacttcggtgcgctgtccgagtactttggcggcgcgcccgtcctgtcctcccccggccgcaccttccccgtgacgcagcgctacctggaggacgcctacgaggccaccgggtacgcgctggccgaggattcgcactgcgcgctgcgggccggctccgacgctgcgctgcgtgcccgccaggccgccatccggcgggcggcggcggggagccagggggtgctggcgcaggggtggggcgacgacggggccaggccgggcgccgtgctcaacccccactaccacccaggcctgtacgggcacctcaggtgtgcagggtggcaggtaggggcggcgtggtagttcctctgccagagctggggccctccagccagccacaaggatcctgcgcctgtcgaggcatctcagagccactgaacacccccccctgcagccagcgccccccaggataacaccttgccccaacccctctcacccaacannnnnnnnnnaccctgcagccagccacaagtatcctgcgcctgtcgaggcatcccagagccaatgaacatccccccctgcagccagcgccccccaggatgacaccttgccccaacccctctcacccaacatctaccagcccggtgaccatccgcaacctgaagcgggtggacgaggaggcgctggacctggacctggcggaagcgctggtagagcacatcgcggagaagggcaccgctggcgccatcctggtcttcctgccgggcatggccgagatctcggcgctgcaggaccgcctggcgcgagagtccgtggaccgcgcgccggggtcgcgcctggtcctgcccctgcactcctccacccccgccgacgagcagcgcctggtgggtggatggtgcctgcggtgtgggtgtgaggctttgggcgggaaccctggatctggggccccccgtttgacaggcacgcggggcatgcgtctgactgggatgatccgtctggcgtccagcagggcgcagtacccctcgccccccagggggtgggagcgtgctgcccannnnnnnnnncggtgcctgcggtgggggtctcaggctttgggcgggaggcctggacctgggggcccccgttcgacaggcatgcgggggcattcgcctgactgggacgacatgtctggcgtccagcagggcgcagtgcccctcggccccccagggggtgggagcgtgctgccca

SEQ ID NO: 39535 - DNA, 108 bp, Chlorella protothecoides
ggggggagaaggtgcgtggcggaggcagggggggaaaggggcgatgggagtgcagcgcaggcgccaggtcagccgcgtgccccgatgccgaggtggaagcgcggcacg

SEQ ID NO: 39536 - DNA, 61 bp, Chlorella protothecoides
gagggtgcgttgatggcttgtatggaaggaactatcataaggacatcactgcaggaagctc

SEQ ID NO: 39537 - DNA, 72 bp, Chlorella protothecoides
gcgctccgcggcatcctcgtcgtcgtcgtcctcgtcgtcatgcccccttgccccgccccgggaggctcgccg

SEQ ID NO: 39538 - DNA, 78 bp, Chlorella protothecoides
catggccttcagcacggctttgagtgcagccacccactccccgtgcgtggcatccttgggcctccagtccttgaggac

SEQ ID NO: 39539 - DNA, 79 bp, Chlorella protothecoides
agccagtatggtgcccgggatgaggggaaaacggtgtgaagggcacagcatgcatcttctcggcaccaaaccacgcaca

SEQ ID NO: 39540 - DNA, 132 bp, Chlorella protothecoides
gggcactggcgggcagagaggctggacatgggcaagttgtcctgcggatggaccgggaggagggcatggcctcgggcaggtgaacctggtccttgtcggcctctagagcttcagcgctcaggcgtgcactgc

SEQ ID NO: 39541 - DNA, 399 bp, Chlorella protothecoides
  modified_base (121)..(282): a, c, t, g, unknown or other
ggtgaccgccgcgtccggcagcggcggcgtgggcgagcgcgagtgcgcgacgcgcgtgcggataggccgcgggtggcccttgagcggctggaaggcgtggcgcgccgcgccgccctccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcgcgtggtacatctccagcagcgcggctgggggcagcgccagctccggcggcagcaccgaggccagctgccggacggcctccagctcacgcggcggcggccggcgccgcgccg

SEQ ID NO: 39542 - DNA, 20046 bp, Chlorella protothecoides
  modified_base (353)..(362): a, c, t, g, unknown or other
  modified_base (1048)..(1146): a, c, t, g, unknown or other
  modified_base (1327)..(1336): a, c, t, g, unknown or other
  modified_base (1791)..(1800): a, c, t, g, unknown or other
  modified_base (2015)..(2024): a, c, t, g, unknown or other
  modified_base (2416)..(2425): a, c, t, g, unknown or other
  modified_base (3502)..(3511): a, c, t, g, unknown or other
  modified_base (5334)..(5343): a, c, t, g, unknown or other
  modified_base (7654)..(7663): a, c, t, g, unknown or other
  modified_base (8343)..(8352): a, c, t, g, unknown or other
  modified_base (8726)..(8735): a, c, t, g, unknown or other
  modified_base (8800)..(8809): a, c, t, g, unknown or other
  modified_base (9185)..(9194): a, c, t, g, unknown or other
  modified_base (9517)..(9526): a, c, t, g, unknown or other
  modified_base (9802)..(9811): a, c, t, g, unknown or other
  modified_base (14151)..(14160): a, c, t, g, unknown or other
cccacccctcccccccaccacaccacaccccctcacgctcaccttccaggcgcgggagcgggcggcgtcgcagtcgcgctgcgcggccagctccgtctccaggacgcgctccacggccttgaagccgtgcttgaaggggttgggcccgtcccccggccccatgggcaccgcctccatctccaccacgctcagcccccgcccgccgtcctcgtcgtccacggccatgtcgaggcgggtgatgaagaagtgctgatggtgcgcggcgttgaccccgggggccaccaggttgccgtagtcgggaccgcgcagaacctcctcggcgtgcaggggggaggtggacacgatgcccgtcnnnnnnnnnngtgccgtagtcgggaccgcgcaggacctcctcggcatgcaggggggaggtggacacgatgcccgtcagcttcacctcgaactggatgctgccgtcctggtacaggtgccagtagaagccgtactcgtagttggcgatggtggcgatgaaggagaggaccaggcggcgcatgcgccgcacctccacctcgtcggtgcggtagtcgtagtgcttccaggccatgcccgcgtcctcctcgtgcatgcacaccgccttgcgcagcgtgaccgcgcgccccagcgcgtcgttcagcgacgcgtcaaagtagtggatgtggcccaggcagtcgcagcccagctccagggagttggcgcagaagcccaggccgtagtccatgatgtcgtacgcgcacttggtctcgtacggcggccgcggctccgcgtaaggcacgatgatctccgccagcgcggcgcggtacacgacggggcgcacgcgaccgccgtccttgtaccccagtccgtgcaggaccaggccctcgcgccaggagaagcccacctggaagctccagttctgccactccacggcagaccccttgaccgtgaaggaggggccctcgggctggaccacgtgcagcgggcgcatgccgccgcggaagggacgggccagcacgtggcgggagaagtcggcggcggccagcggcacctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgtgaagggggggcctgaaggaagggagcaaggcaggaagaggcggggaagttgggtgagggaacgggcacgcaacgtcaaactggagagggatctgcacaaacagccagttcgagtgcaatgtcagtatagaaaattccatccgaactcctgcacacccacgtgacctgtactccaannnnnnnnnnggggctgaaggaagggagcaaggcaggaagaggccgggaagttgggtgaggaaacgggcacgcaacgtcaaactggcgagggatctgcacagacagccggttcaagtgcaatgcaagcatggaaaattccatccgaaatcctgcacacccacgtgacctgtactccaactcacgtcctgcttggtgttctcgtcgccgtacacgcagaacttggacacgcggtcgacggaggcgttgtacatgagcaccgtgtccagcgggtgggcgtagaagttgtcgtactttcccgtgcgctggtacaggaagcactggatgatgcggccctcggtggggccgtaccgctgcccgctgtacctgcagagcggagggggtggacgcggggggagggatgcagggcatacagtttgggatgtcaacgaggccttgggaatgatcggtgtgggcagcccaatcgnnnnnnnnnngggggatgcagggcatacagcttgggatgtcaacgaggccctgggaatgatcggtgtgggcagcccaatcgcctgaatctgagggacaccgaggcgattgcactcccattcccacccctcctcctgttcgaagatctaatcccatgcccccgccgtaccaggggtccaccgccacctcctccatgtcggtgatgccatagcggcgcgcgacaaannnnnnnnnntaagacctaatcccatgcccccgacataccaggggtccaccgccacctcctccaggtcggtgatgccatagcggcgcgcgacaaagtcctggaactccttgttggccttcaccatcttctccacgtcgatgacgtcatccagggtgacggcaggctgcaccccctccagctgcatgggaacgaaggcggggaagcaaaggggtgggggacaggcggtacaatattgcattgtaccagtggggagcaaatcagggcaacgagcacaacgcgacgcataatgaggccagactgccccggagactcatgcagaccccctccagctaaagcggtcccccggtaaggggctctagggagggggactcgcacggtcacgtggccacggacatttgcgnnnnnnnnnnaacgcataatgagggcagactgccccggagactcctgcagaccccctccagctaaagcgggccccccggtaaggggcactagggagggggacccgcacggtcacgtggccacggacatttgcggtttccttccccccgaaacggcccatcccaacggtgagaacgacgagtggatttcgtatagagcatccacaggcccgcgcacctcctgccacgacaggatgctggcgcgggtgccatcaagatccacgagcgcttcgaacacggagttgcggggaggggcctgcaccacacacagcgcttggcgggcgggctttgcgccacccttgaggtacgccaagaccttgtacttgtggggctcctgtggagtcatggggtgatcgtgtggggctgaatagggtcgcgccggcctggcggtccgaaaccctcgtcccccggtcgcggtagccagggcatgtgacatggggtacgacacccacaccatacccaccttggcagagatggaattgaaccggaggacaggaagcccgaggctcgcggcccgctccctacaggctgcagcagcggcgccaatctcctcggcggtaagctggtcgagggggtggtggttccttccaggggtcagctctcggccggggaagcgagtcttcaccgcattggtgtcgaaggtcggagcttgaggaatggacattcgcgatgggggtattctgggaaagacggactgtcggaagcctgtggcaccgacaaaaccttgcctgctccggcagggtttgcagaggagagtacgaactcttggagtccgatgagggactgggaaattttggggctttctgagtctttggtgacagataattccagagcgttgggattagggcagaggtactagcagggcagcaactccgcggggcagagcctccccctttccaccgggaggtgatgtcgacgtcgagcgtgctgcgtgaggtctggagcgcagcatgcccatcccagcccctgtgttttatttcccgtcgtgtcatgcagaaatttccaccccgactctgacaattgccaccttatgatccaagggtatccgtnnnnnnnnnnagtgttttatttcctgtcgtgtcatgcagaaatctccaccccgactctgacgattgccaccttatgatccaagggtatacgtgatacatagattacctggtgcgcgcggcactcctccgccatgttgcggctgcgaggggcccaggcgctgagcaaagctgcggccttcgcccttcgcaccgacccctctgcttctcagtcgctcctcggatggacttcactggcctcaacctcccggccatcagtacgcggactggcacaggaggcagtggttcacactgaggccgaggcccaacctcgcggaatgtctgcaagcacacgccgctcgggcgtgcttgccgtgaaggttggcatgacgcaggagtgggacaactggggtgcgaggcttcccatcagcatcctctgggtcgacggctgcaaggtaggggagtgctgttgcgggctggagtctgtgtgccctatgctgggtgtcacccaacccggggcatgagttcccagttgccagaggcggagcgaatgggaagcagacgctccatcctcttcaccttcctcctgcaggtcgtccaagcaaagacagatgatcgtgaggggtacaccgccctccaggtgggcatcggcgctaagcgcgagaagcaggtcgccggcacccagcgcggccactttgccaaggccggcgtccccatcctgcgcaagctggcagagttcagggtgacgcccgacgccgtgctcccacccggcacggagctgcgtgccaacctttttgtccccggccagtacgtggacgtctgcgggaccagcatcggcaagggcttcgcgggcgtgatgaagcggtgggggttcaagggccagccggccagccacggcgcctcccttgcgcaccgcgtcccggggtcgacgggcgggaaccaggacccgggcaaggtctggaaggggaagaagctgcccggccggttggggggcgtgcgcaagactgtccagaactgcctggtctacaaggtgagcagcttgccgcgagggggtggcggccaggtatcgggcccactgtggccctccacttgagaccctgcgaaggaaacaagagtcgcgcctcacgccagtgcacctttgcccgcctcgcaagcatcccgcgcctttcccccacccctcaccctcatcgcctcccttgccaggtggatgccgcacgcaacctgatctacgtcgtgggtcaggtcccggggcacaagggcaactttgtcagggtggccgacgccgtgaagaaggcgtttgagcaacaaccgatgagacccctggtgccccctgcggtggggcagggctcaggggtcgctacactagatccaaacgggagggatccctatgacttccaagactgaggctgtgcttcgagtctgtggttgcagccttccctgcgcaggctgccctgcggagtctcacgctgcatgggaatcgttggatcagctgctgtgacacaaagtgctcgccgagcaaggacatgatgagggtagcaacaaccagcatcgccaaggagagatggaaagtacgagacagcgcggagtccagggcacacactccctactccgcaatccctattccgatcgacaaggcaaacgccaggcagggccatgctatattttctgcgtcgctccgaatcttggcttttactccctgctggccaggcaagagctgacgagctgttaaacttccagctgtgtcctccgctctgccgtagcatttttatcagaactctgattccatcgtatcccgttgaccctcagaatctttgacacttctccttccaaaggcgacaggtgcgattcgcttctcannnnnnnnnngccaaggagagatggaaagtacgagacagcacggactccagggcacacgctccctactccgcaatccctatcccgatcgacaaggcaaacgccaggcaaggccatgctatattttctgcgtcgctctgaaccttggcttttactccctgctggccaggcaagagctgaggagctgctaaacttccagctgtgtcctccgcactgccgtagcgttttaatcagaactctgattccatcgtatcccattgaccctcataatctttgacacttctcctcccaaaggcgacaggtgcgattcgcttctcaggtgtgcatgcgtgcagtgttgtcaggttccaggctccggcggatgtcctacagccagaggggacgcagcgcctccaccacacgggcacgctcccttcgaactacgtccggcccgcccaacctcacggggtgcttgatgcgatcatgcggggcacggagaccaccccgcccccgacttccccgcggtgcagactgcgtaccggcctgtgtccagcaggacggtgggtgtcagcgatgccggtggggccggggccaaggtcaagcatgtttaaaagtctatgatccacaaattgagcattccttgcttgtccgtgcacaggtacttccgccactccaacccaccacaccgatgctggattcgagaaagaaccaggactgcattttttacatccagggcacctgcaacaagggtgccctgtgtccattccgacacgaccaggtgcggttgctaatgttgatttgtaaaagggccccctgagtgagttgcaaaccttttgcagcctcacaccatgcgggcagcatctgccctaagttgttacctcggcttgtcccccccacccctccctacccgataccctgagcagagcaaggtccagcagcacagggcgcagcaggcacagcaggactgcatcttcttcttgcagggctggtgcagcaaggggtccctctgcccctttcgccatgaccaggcatgccgaggtgttggtggtggtgtgtcggcagggccttaccccaccatgcattctgttgtgatggcacccaagtcccgcgccggccacgcctctcattcttcagtgagacccttggcggcagaccgccccagtcagtgccataatttccacccctcgattccctgcaggcaaaggctgatgcgctgaaggcgctgaactcgtccactgcgcccagtctccagcaggtggcccgtgccccccctgcagcgccctcccccgcagcacccggccccacgctggcctctgcccccgccccaacgcggcagcaggtccgcctcgcccccgttccgccggcgccccagaggaccagccttgccgccggcctcatgggcggcaggacgtccccggtcccagcggcagccagtggcgacgcgcggcgcggcggcgctacctctgcgagcggcgcgtctgcgagcggcgccgccactgcgagcggcttagccgcgcccgccccgggtccgccccgggccccgcccacgctggcggggcggctgggcccccgccagggcgccagggaccaaggcgcctcgcccctccccccccgcctgcagcagcgcctgggcagggagaggagcgggtcggggcccgatgcgccgactggagctgccagctccctgtctgatagactgggatcgaaggtgcgaggtctatggggtggagtggggcggggacggtggtctgcaggagccatgggatggaggagcacactgtggcccggtcatgctgagcatggtcgcagtcccatctactgcagaggagcagcgatggcttggtgacaatggcctcgcgcacgggatccgtggcctcccccgacgcgcgccccgcaccaaaggtgggtgctcctgtggagggcggcagcgagcagggctggcgtgtttgtgatcgagcggcccgcgcgtgcgcgctgcgtcggggggctgtgctagcgctggcgattccctgcctcgacctcattggtcggccttggctcgaacccgtcttccaggctctgatctcgcagtacctgcacaaccccacgcaggtcgtgagggaaagcgcggcgcctgcccggggcccgaggcagggcgcggcgtcgcccagcccaccgtccccggagcgacgaaggtgggcgacgccaaccgaggcgcctggcgcgcccgggagcgcccacgcggcgccctctccgcccagggacggcgcggccggtgggcgcatgggtggcggcgacgcatcgcgccgcgagccggccccggcgcccgagcctgtcgcgccacgcccgaagaccatcgaggagnnnnnnnnnnacgccctgcaccaaaggtgggtgctcctgtggaaggtggcagcgagcagggctggcgcgtttgtgatcgagcggcctgcgcgtgcgcgctgcgtcggagggctgtgcaagcgctggcgattccctccctcgacctcattggtcggccttggcttgaacccgtcttccaggctctgatcttgcagtaccttcacaaccccacgcaggtagtgagggaaggcgcgccgcctgcccggggcccgaggcagggcgcggcgtcgcccagcccaccgtccccggagcgacgaaggtgggcgacgcccgccgaggcgcctggcgcgcccaggagcgcctacgcggcgccctctccgcccggggacggcgcggccggcgggcgcgtgggtggtggcaacgcatcgcgccgcgagccggccccggcgctcgagcccgtcgcgccacgcccgaagaccatcgaggagatcagagcggtgcggcccgggtgctttgggcgctcctgcgtggctccctgtgtcgggtggggcatgctgtgctggccttgaggttacaagcactctccatccagcattgctggctgctggcaaggggcagtgctccagggaagcgcaagctgatctttcgacgtgggccttccctcccagagctcgacgcatgtccaatcacctcgcaggccaagcgagcaannnnnnnnnntgcaagctgatctttctacgggggccttccctcccagagcttgacgcgagtccaatcacctcgcaggccaagcgagcaaagcaacagtcatccgtgggcagcgcacctgcatcagcacccgccaagccggctggcaagccgacgcagcgagtcacccctgctgtacccgcgcaacaggtgcgcgccaggacccagattctgtgttgtgtcatggccgggccctgcattccatcctgatgcaaccgggttcatgtcatcaggctggacagaccaaacacgtgccgccatccccacgaccactcatgcaggctcgcaagccggcggccccaagcgcgccacctcccgctgagcaagctgctgagcccgcacggacnnnnnnnnnntcaaggagccgaggtggcgtcggatgtggcagcaagcacggcgccagccgatgcagatgccgatnnnnnnnnnntaagccggcggccccaagcgcgtcacctctcgctgagcaagctgctgagcccgcacggtccatacccacccccactgtggcaaagcctgcgtcccgaggtggcgagacagctggtgccgaggcaccacctccaagaaagcctgaaaacacatccctgcaagcagccaaggtggcctcggatgtggcagcgagcacggcgccagccgatgcagatgccgatgactttttgatgctggatgaggtgagccgatggagagaatgcacggggtggatgaaggtgtggagacgcaaatgttggggagctgcattccggtgattgacgggggcagtgtgtgcccagctttgttccccctcgtcattctgctgactcctctcnnnnnnnnnncgcacgggggggatgaaggtgtggagacgtgaatgttggggagctggctgcattccggtgattgacggggccagtgtgtgcccagctttcttccccctcgtcattctgctgactcctctcccataatactaatctgcctggtcaggagctggagggcttgaacgaggacctcggggatctcgtggacgaggactttgaggcgcaaatgagggccttggaagacgcggcggccggatgaaggccgggagggcaggagggaggtgtgatcgctgagctcggcaggcggcctgaatgtttggcacctgaactctgtgcaaaggagnnnnnnnnnntggggatctcgtggacgaggactttgaagcgcaaatgagggccttggaagaggcggcggccggatgaaggccgggagaggaggagggaggtgggatcgctgagctcggcaggcggcctgagtgtttggcacctgaactctgtgcaaaggaggattgctggacggagggcccagccgtgggtgacatcgtcataggacagtggccgcgtttgtcgtcccggcagcggcagcacgccatgcctgcagaccaggcgcagagccgtcaccttgcccgatnnnnnnnnnncccagccgagggtgacgtcatcatgggacagtggccgcgtttgtcgtccaggcggtggcagcacgccatgcctgcaaaccaggcgcagagccgtcaccttgcccgattgataacgctgcaggtcaacctgattgctcttcactcccttcaccatagccatactgcccgatccctgtaatcttcagatgctcttacaagtctatgcagggacaaggaggggggggtggggcaaggaggggtgctatggctgacccccagatgccgcagatgggagaacaccacacctcctccccaccccctgtagtgctgggcaaaagcttccaacacggcataagtatttgacagcagggtataggtggcgaggggtgccacccccacatcgcaggcctgtgggtcaaagtgcagtgggcaggtgccctggggccatggccacttgaggtctcatgtgggcaccgcccacacccggccgcaacatggggggttgagcatcttcatgctccaatgcttgattcagttcagtgcacgggcagtgttggggtgggcaggcagatggccatgtggccggcggctgcgccgtccatttcaggagcagggctgccgggcacggcgcctcacagacttattgcgctcagatgtcggcgagagtgatcatgccaccagacctgcggccctgttggggggtggagggaggcagaggggtgggtgaacaggcgcatggtgtgtgtggacacaagcaggcctcgccgagccctgctatggtatggatgccgatgtgaacacagcagccgcccatagcagagcatgcagtcaatcctccctcaatttacatccaggaggggatgcgcgggtgctcctggccacgccagtcttggaccccgcggaaaaaatcattccctgtcctcccacccccaacatcaccaagaattccccactgccccgcgctcgactcaccacgagcgccgcatcaggcctcgggttgtcgcgggtcttcaccgcgtagccgggcataagggcgacgccgttggagcccttggggtcggcgatgccacgtcgcaccttcatgtacccggcctcgccccagtgtgcgccccaggagtttttgatcttgaagaacttgtcgccgttgggctcggtgccgtagcccaccgccaggagcgcgtggtcgatgggctcggtgcagtgcgcgctctcgttgaagatgccgccggtgtacaggtgccatgcgtcgatgaagtcgccgcagcacatggccacgttggtgggggtgtgcgccagcgcctgctccagcgccgtctcgttggcctccggcaggttgacgatgtagtcgatggtcacagcggcgcgcttcctctcgcggcgacggtggcacaccgtctccttggccgcgtagggccactcggcgtcggggaccaggccgccgttgtcgatggtgtagcgcatgacgtccacgaaggagccgccgtcgcagccccagtcgtaggcgtcgcagtccacgatctgctgctcggacagcgtgaccaggtcgccgccggtgtagagcgcgttggcggcctcgatgccggccacgccggagaaggcgaagcagcagccgcacttggagccgttcacgtgctggtccttgaccggggtgatcatgccctccgccgtccagtccacggccgcgggggggacggtgtgcccgtacggccagtcgcggaagtacttggacttcttgccgttgtcggcggccgttgcggccgcgcgcagggccagcatgtccctgggctgctcgccaaagtagcgcaggcggaactcctcggtggtcagatctgcgtggccgttcaggcccagggtgtaggaggcgccggcgttctgggcctggtgggccgccacgcgcgcggcattggccatgaaggcctccagacgctggctctcctccgccggggagtaggtcttgccgtagaaacgggcccagcgctggaatgctgcctgtgggtcggactgcaggaggggaaggaaggggtgagggcgagggatggaagggttgggcggccaggactgcagatagcactgcagggaggccgcgagatgtttccggctggaatcactgggctgaggaagggtcagcgcaggaccgagacggagggttgccagggtcagtgtgatcgaaggtgtcggggacccggatggtccggaaggcaacccttggggtagggctagccgacgcaccatgcccccgggaagtgcagggcaaacagcattggcaggcacggcatgtcgctctagagggtcgtgtaagcctcgaccggtgtcaggttccgagtgtcgagtcgaggctctgcatcgcggccggcgcggcaccccagcgttacgaaatcagtcgacaccccagccgaggcctggcggccgtcacactcccgcacacctgggacatgatcaggacgtcgtcatgaaaggcagcagtgcgcagggagctggtggcgctggccgctcccaggcaagcgatgaagaccaaaaccgaggtcctcatggtaagggtctgggttctggccgtgcgtattcacgtatgctgcagggagggatccgagacagctgttgagttatcacagaggtatgtgctaagggggaagataatgcctccagggttgaaaaggtgcgccgcgacgccaacagtactgggggggggcgcgggcacaacgggaaattgccagctctcgggaggacggattcctcctttccaggcccgagcacgtgaggtttcaagtccaggcgccagaacgcttctgcccaaccaatccgacaggcgctcttgaacgtggcactggattggagggcggaaggtcagcattcggcgtccagctcacagtccatccccgggaccctcggtcccaatcctgcccgcacctccctcctcccgagcccagctcccggcaacaatgcagggcgtcgccttcgcccaacccggcgccagcgcggctcgcccacagggtgcgccggcccagcgtggcatccagcgcctggcgtcccggcctcaccaggcacgcctggtcgctcaggctcccagccggacggcatgccgcgcctccaccctggagcgcaagggtgcgcccggctatgagcgtgagggatgggggaagcagcggtgcggtttcaaatttcctccgctcccaataatgttcagcccgagcacataatcctggtccgggttgctgctgtcgtgtgcagtgtgcgggcagggaacccggcatttttctccgtcgtgcatgcatgcatgtcctcggtccagggcccaggctgcatggttccatgcaatagcacgatgccccagcatcggcacacctttctggaacatgcccgtctgacaatgcaatgttctcccatgtatggcgttctcagggcccctcgaaagcccgcctccttggcgctatgcgttcctcaacctcacccaccgattcgcacatccaccccatcaatgcccacactatccccccctcaccccccctcccttgccctgcagtggacgccagcgccatgtttttcgaggacggatccctggacgaggtggacccggagatcgcctccatcatccgccaggagaagcggcgccaggtgacgggcctggagctgatcgccagcgagaacttcacctcccgcgccgtcatggcggcggtgggctcctgcatgaccaacaagtacagcgagggtctgcccggcgcgcgctactacggcggcaacgagttcatcgaccaggccgagtcgctgtgccagtcgcgcgcgctggcggccttcggcctggaccccgcagagtggggtgtgaacgtgcagccccactccggctcccctgccaactttgcggtgtacaccgccctgctcaagccccacgaccgcatcatgggcctcgacctgccccacggcggccacctgacgcacggcttctggacggccaagcgccgcgtcagcgccaccagcgtctacttcgagtccatgccctaccgcctggacgaggccacggggctggtggactacgaggccctggcgcgcagcgccgccctcttccgcccgcgcctgatcatcgccggcgcctcggcctactcccgcgactttgactacgcccgcatgcgcggcatcgccgacgcgtcgggggcctacctcatggccgacatggcccacatctcgggcctggtggccgcgggggtggtcgcctcgcccttccaccacgccgacgtggtgaccaccaccagccacaagagcctgcggggcccacgcggcggcctcatcttcttccgcaaggccctggaggcggccatcaaccaggccgtgttcccaggcatccagggcgggccgcacaaccacaccatctnnnnnnnnnncgtggccctgaagcaggccgccagccccgagttccgcgcctaccagcagcaggtggtcgccaacgcgcgggccctggcagccaggtgagcaggtggttttccagttcaagcctgcttgtctgaaccgaggttggaggtggtggtggaaggcccgacaccctgactgaaggtacccttccctccccacacacacctcgtgtcctgccctgcccacgccccttcacacacacacccgtggccgcacaggctgcagaagctggggtacacgctggtgtcaggcggcaccgacaaccacctgctcctggtggacctgaagccggcgggcatcgacggcgcgcgcgcgcagcacgtgctggatgccgtccacatcacgttgaacaagaacagcgtgcccggcgaccgctccgcggtcatccccggcggcgtgcgcatcgggtcgcccgcactgaccacgcgcggcctgcgcgaggccgattttgagcgcgtgggcgacatgttccacgccgccatcggcatcgcgcgcgacctggccgcctccacgccgggcgagggcaagctgcgcgacttcgtggcacacctggaggcgcagcgcggccagcgtgctgacctggccgcgctggcggccgaggtcgaggagttcgcgtcggccttccccatgcccggcgtcccgggcggactctgagggggcagaggggtgttgctgttgaggggtaagaggagaattgtcaaggagctcacagacctgaccacaggcactcctgtcgttgttacccctttcacagacccctgcacctccgaacgcctgacggcatcaacacatgtacaatgaggggacagtgtgtctcctgtaacacagaataacggggagcttggggaagatgcagagccaggaagagttggtgtcggacaaggcacctcactctcctgccaaccctcagcatgccgagcagctatcggcgttcaaagtatatccccgcagcaaaaagggaggcggggagcgaccgatgccttcggttatgcaggtgcacatgcaaagcgccacgaggtcctcccaaatcggcgccctcccccacatgggcgtgccaggcgcgggcgtgggaggcaccgtatgacctgtgggccacaggggccacccaccacaccgtcgtcgggcagggcaggtggcgcgtcccgcgcgatgctgctgcgcagtctgacggactgtgtgcgtgccgtgcatccccgctcccggccttcggggacatggagggtgagttcggggggtggcgacgtttcggaatgggggctctgtaacacgagggggactgcaccgccatgccggttcccatgacccactccagataccccacccgcgtcctcagggcatgcagaggcgactgcatggtgcccactcggcctcattcagcggccaggaggccgctccgcccgggccgcgcccagcgcagcccagcgtgccgtccagcgccacccccctcccggacatcctggccagcctccagtccggcatcgacttcgagcgcgcccgcggcttcgtgaacgcgcagggcagacgccgcgtgttcagcgacttcctgcatgactccctgctccagctggcggcccgggtcgagcaggagagcccgcgtcggcgattgcgggctgccttggccccggcccggcgctacggcgacctgaacgagggcatgcggaggctggccctgcaggagctggtggaggtgctgcaggaggtcgcccggcccccggcgacaagcgcggcgtccgattccgcggcgccagcaccggcagggagcgaggccgccgtgccggttccacttgcggccgagcccaggcacccgtcgccagagacccgggccccaaacgatgcacggccgcgccctggcgccaccgatgtggccccagccgcccagtcgcagcactggcaccccgcagatgctgggaggggggagtacaccgacaccgccgggttcatgctggacctggaaacaaccggtgcgagcgtgggtgcaggggtgcggatacttgtacgaccaacaggcccctgttggaggggaagtgccttgattctttcaaatcagatgagcccaggcttctgcatcgaccagctggggcagcgctcgtcgtgcactttaactctgcggcaccctttcttcccgcgacccctccccgacgcaggcgtcagtgtctacaaagactgtgtggcggagatagccctcttgtgcctccgcaccggtcgccagctgtccaccctcgtgcggctgccggcaggcaccaacatgtcgagacaggccgaagccgtcaacaacctgagcaacgcgatgctgagcgccccgggcgtgcccacctttgagtgagtggggttgacgggggtcccggtgaaggaggggcagcgggtattccgctgagggtatcaggagatcaagcctcattttaacccctgcagggaggcctatgcccaggtagtggagttcattcaagtgcagactgccgcactggggccaggcgccatccccctcatctgtggccacagggtggccggtgagtggcggggagatctttgtgggtataccatcctgcctgcacagtcggctcagggaagccttatgcggagcatcgtgagagtctcaagcctcccaagtcacttgttccaatgcggtgaaaaactgtgtggcagggaatgcctcgtctctcacacccacataccccttcaaacctctgcaaccagactttgacctgttgctgctggcaaaccaggctcgccgctcgggcctggcgccgctggaacgtattctcattctggacaccctgaagctggcaaacgtgctgcggcctcccaagctggacaatctcaagctgggggtgagcggaatggatggttggggggtgttgagtcatctgcaggcagattcacacagcactgctgagcccaggctcctcggctggccgcagcagaccctgtacatagctaagcccatgcctatttgcctccaacaactctctccaaccttgtgactcccccctgcacctcatctaacagacgctgtacacgcacttcaccggcaaggctccggagaacgcgcaccgggcgatgcaggatgtgctggccaacagggatgtactgcagggcctgctgcagtacgccgacgcatggcaaggcgagcggcgtggggctgggtgcggtgatcgctccgatcttcagaaaccagtatgtttgtatatgcgcccggctgaaccctcgctctcccaccctgacgccccacagggtcgttcgccaggctgcacgacctgccgctcagcctggcgagggaggtgctgacctggccggccgccgcaagtgacagccagcccaagaggagccgccgtcctggcggcgctgccccctccacgcccgccgcgccggctcgccagggcttgcaggcctttggcggcgggggtgcagcgcaatgcagcctcctcggcggcgatcccagcgtccaggccccgggccggcccgacactgacctcgcgtcggcgctggatggcgtacggcgcgctcagtctggcgaggggaacctaggcgtagcctcgacacccccgccaatggcgggcatggacctgtggcgcgccgccctggccagtgctgacgccgcaccgtgctttctcgacactccgctggccggcatccgagcgccgcacaagttcaccccgcgccagctcatgtgagttcatggtcggaatctttggggtcccgggaatctgggtgcagggtgattcctgtctgagacacttgctcgacgcactcactgctccgatttcaagagcacgccagctccaagccatctctccggcgacccagcgacgtcccagccccccttcacgcttttcttcccgcgccgccgtgcttcagggctctggagcaggcgggcctgcacacgctgcgtgacctggtggagtgctacccccgcgacttcacggtgtgcgagtttggcaggctccccgagccgggcgtggatggggagcagcccatctgcctgcccgcgcgcctcgtctccgtcacggtgaggggcatgggggcgacctgcatgtgctgcgagcaagggcttcggggtgggagggtggacctgcggggacgtccgggacccggtgacctccctatccccttgaagacgtgggaggatgtatggtgctcacatgtgtgacacagatgtcgtgcatttgacgctggacctggccaccacccgccggccggtccttcctcccaggcactgaccctgccacccccacccgtgcagcacaagccgctgaggagcgccgcggtgctggaggcggtctatgaacccgacctggacctctgcggtcccgcagcagcagcactcaccgagggcggggacccagcacgccagccccgcatcctgctgcagaagtggcggggcggccccgccgcgcgctttctttaccacgagctgagagagctgcggggcttagtgggccagggggcggtgctggtgggcgtggtgcagcccagcggcagctggaaggccgggaagcgcgacgaatggtccctcaccgagcaggggcaccaggtgctggcgggcggtgaggagagcgtggcggagctgcgcatgcggggcgggctggtgcaggccacctacagcgcgcggggcagcctcaagtccaacgccatggcggcggcggcggccaaggccctcaagaccctggaggtgggtggaagtctggatacccacgtgtgctcggggggaggggggggggcggggcaggagggctctgccctgctgccagggcctcctgcgaccatctgccactgccttcaacccctcccctcacacaggccgcagaggcaaagtgggaggatccgctgccggagggagtaagggggagccagggcccaggctccctgccctacctcgaggccctcaaggtagggtgcggctgcggcccgtgtgtgtgatggcgggagcctggacccctggatctggggaaaacgtgtggcagcctttcctgctgcgctcgtcagaacagggaccagccagccgattgcggtgggggcttgctgctggagcgcattggaagcaacatgtccgacccacctcaccaccaaaactgcaccaaacacagggcatccattgtccacgaagcgaggcagacatcgccgcagcgcgggagcgcctggccttccaggagctcttcatgctgcagctcaacctactcctccagaggtccctgctcaggtggaggaggttataagggggagggagtgtccaccaaggctgtgactcgtatccagggggtgcggtgtattcatcccatgtcttttggtctggaggggaggggtggcggccagccttccccctgcctctctcccgccttctcccttacaccctggctcatcccacctgactcctctgcctcacctttcacccctctcaacaccccccctttcaccctctccaccctccccatctgccagggaggcggcctacgatccccagggcgcgctgctggcggtggccacccaggaccacgatctggtggcgctggcgcagcgggcgctgccgtaccgcctgactgcgggccagtgcgcggcgctggcccagattcaggcggagatgggcgaggggcgcggccggcccatggccagcctgctccagggggacgtcggctgcggcaagaccatcgtggcctttctggccgcactgggcgtggcgggggcggggtaccaggtggctctcatggcgcccactgaggtgctggcggagcagcacgcgcgcgggttggccgcgctcctcgcccgcgtcaaccgccgcgccagcgaggagggcctgaccgggctggccctgcccgggctggcgctggtgacggggtcggcgcggcgcggcgaccgcgcgcgcg

SEQ ID NO: 39543 - DNA, 70 bp, Chlorella protothecoides
tgaacgctctgcatagattttggcctgcattaagaacctttcgttggctcgaatgcgcaaagagcaccag

SEQ ID NO: 39544 - DNA, 76 bp, Chlorella protothecoides
gtttttgcgccctggcatgctgtgcatgctggctttcccaccacgtcgccgtcccctcaacatcgctgcaaggcac

SEQ ID NO: 39545 - DNA, 118 bp, Chlorella protothecoides
gcgcccggcgccgacagccacgccacgtggcgcgtgccctcgccggccctccgcgcctgggcgccggcgggcagcgcgccggccacatcccgatccagcgccgccttgctcaggcccg

SEQ ID NO: 39546 - DNA, 120 bp, Chlorella protothecoides
ggcgccggggtggtactcgctgcacgtggcttgagggctcgcaaccgccctcgtacccagcagcaagccggaaaggactggtgaacctcgagagacagactctccgccgaccaatgcaag

SEQ ID NO: 39547 - DNA, 61 bp, Chlorella protothecoides
ctggaggtagttcagcgttgtcatcccatcaaatgccgcgtcgatgtggtccagcgagaac

SEQ ID NO: 39548 - DNA, 61 bp, Chlorella protothecoides
gccccagaagtagctttgcggcgtgcgggggcgacgcgggcgctcccccgcccaggaatat

SEQ ID NO: 39549 - DNA, 88 bp, Chlorella protothecoides
atggcctgcccgtctggtggggcgggggggctcagctccgcgtgggggtgaaatggggccaaaggctccctgctgtgccctctgcgac

SEQ ID NO: 39550 - DNA, 97 bp, Chlorella protothecoides
gcgagtcgagctccaggcgtgagccggaggcagtgcgccccgccgcgccggcccctgcgccagggcccgcgccgtgctggctggcggccgcgggctc

SEQ ID NO: 39551 - DNA, 64 bp, Chlorella protothecoides
tgcctgtgtaaaggaacagaggccaggccttaaagctggggcaggagcggctccctcgcggcat

SEQ ID NO: 39552 - DNA, 61 bp, Chlorella protothecoides
tagggtgggggaggaggtcactgagcacaaaaggtgcagagggatgggaataaactgactt

SEQ ID NO: 39553 - DNA, 143 bp, Chlorella protothecoides
ctcagcttcctcatgcacgtcgggcctgcaccccactcccctcctcgtcgcctttactcccccccttttcccccagggccccacgccctccctaattctggccatgcacaactacccccacaaccaagttccccaacccactc

SEQ ID NO: 39554 - DNA, 117 bp, Chlorella protothecoides
ggggggggggatgatctctgggtccagccttgcaggctatcctttaagaggaatttccaggagctgcaaccaccagcactccgccctgggtacctatgctgccgtcggccgcttgat

SEQ ID NO: 39555 - DNA, 196 bp, Chlorella protothecoides
atgaccgagctggggaaggtggatgaggcgccggaggctgctgaggccgccaagatggcgggctctgccctggccagcggatgtgcgactgagaacctctcattggattctcaaggcgatactcctccgccagtgttcgacgccgggctctgcaaagatcctgaacaaggtgtaggctcggcggcaacacaagagc

SEQ ID NO: 39556 - DNA, 61 bp, Chlorella protothecoides
gcagtgcagccgtcgcaacagcgaagacgtacctagccaatatacagaaaatctacagtca

SEQ ID NO: 39557 - DNA, 67 bp, Chlorella protothecoides
tgcgaccacgccctctgtcagggcgctctctgccgctgcgcctccgatcgttgcaccctctgccgcc

SEQ ID NO: 39558 - DNA, 2670 bp, Chlorella protothecoides
  modified_base (1259)..(1268): a, c, t, g, unknown or other
  modified_base (1900)..(1909): a, c, t, g, unknown or other
  modified_base (2281)..(2290): a, c, t, g, unknown or other
cctggagcagcgcccgggcctcggcgggggcgcaggagcacgcgccccgagccgccggcggctggtgaaggcatggagggcagggggccggagcaggcgggggtgctttggcgacctggcgcgccaatcgggcagaccaactcctcaggggagtgggagcccaccgcacagcagcatgtcttcctgtgcgagtcctcgctgcctgctctcacaaccataccccccacctgcctcgcgctttctcagtacaaaggtgttaatacgtggcaggaacctgctcccgttctggtcatctctgggcagtaccgtgcatgccttgcagtgcccagcccggattacctgttgcacatgctctctccctccatccaagtaacaagttatccaaggattctcagcaaggcgcatgtgggttgtgatactctggggccactgtcagtccaggtgtctggacctcgacgcggtagagctttggtctaccatgatcctgttcatgccctgtctgagaaaccgactcgaacctctgcacagcaactgcagctcattgcggggcactcaaaaacatcctgacacaagtctagtccctgtgcccgttcgtggtcttgggccgtttggcgatcggggctccctgcgcctcctctagggtgcggcagtttaccccattctcaccgcccgtcaccaccaggacgcgctccacgacctccacccgccgcacgaggccggcgcccaggaacagcgcgtcgcacagcgcgcccagcgcgcgggcctccgcgtcccgcccgccggacgcggcctcgcccgcctcctgcgccgctgccacggggcaggcggcggcctgcagggccggggcgcgccatttgagccccaccacgcccgcccccggtgtcaaatcggccaggaccacggccacggggtccaggcgcgcctgtagccgccggacaaaggccgctacggggtccaagcccaccagcaattcacggcgaacggcggcggccccgcgcctcgccaccaccgctgttggagggagggagtggaggggtggagtgtcagggttgtgtgacggtatgcctttgtggaacaatgagagcatgtcgacccacattcaagcggaacgcgggcgccaagatacgacgcagccccagcgtcggttcgccacactctcagccaggcatcccccgtcgcagaaccgacggcctcccagccccgctccacaacagcaggaagctcaccgtaggggatgccgctgagcacggcgcgcgagnnnnnnnnnnaaagcatgtcgacccacattgaagtggaacgcgggcgccaagatactacgcagccccagcgtcggttcgccacactctctgccaagtatcccccgtcacagaaccgacggcctcccagcaccgccccacaacagcaggaagctcaccataggggatgccgctgagcacggcgcgcgaggcgcgcgtcctcaacgccgcgcactcagcctccaggacggtgcgggtggttgcagacccggccgggctctcccgctcctccgccccctccaggccgccacctggcgcgggcagcgcgtcggggcgcaggcgcagcagggcgtcgcactcgtgcagctcgcgcgagaagacggcggcgcaggcgtcgacgcccgcctcgccgcgcaccagggaggcgtgcagcgcggcgcgcgcgcgccgcgccagcacgcccagccgccgcaccacgggggcactgggccggtgcgcggtccaagggctgtgcacggccgcttccccatcgagcaccagcaggctgagcgggtgcgccggcgagcggcaggcggcggggaggtgtccccctggccccagcgctaccaccgccagcggggcgacgctccacggatgctccgacaggatgtgcaggaaggagaggnnnnnnnnnncgtcccccgggccccagcgccaccaccgccagcggggcgacaccccacgggtgctccgacaggatgtgcaggaaggagaggaagccggacagccgggaggcgggcgtgcctggaatgaggggaggggggcgcggacgctcgagtcagcgagtgcagtccgcagggagggtgcagacgagtctggcaggtaccagtcccgggtcaccaggggagaggctgacgacagggatcccgtgccagaggctgcccaccatgcatcctacgcctgagatgggaccccctcctcccgatcaagcacgcccacccccacccacccaggggcctaccttccatggggcgcgtggggccgacgaaggccgcggccaccagcannnnnnnnnnagcctaccttccatgggacgcatggggccgacgaaggccgcggccaccagcagctccaccgcctcctcgcccaggtggttgctgagcaggtgccgtgccacccaggccttggccaggcgcacggcgggcgtgaaggccgggtgctccgcggccagcccgcccacgaagccctggtgcgagacgagcagcgcctggtcggggtcctcctccgcgctctcctcctcggcgccctggtgtgcggcgccacgctccgcgcgctccgcctcacgcatgacggcgtcccggtccgtggccaggtgcaggaggaaggcgtggccgtgggccaggacctctatgctcgcgtcggcgcgcgcctcggcgtgcaacccgtgcgcgcccgc

SEQ ID NO: 39559 - DNA, 61 bp, Chlorella protothecoides
tgtctggtccatggtggggcacctggtgggtctgggcgatcgccacggcgaaaacatcctg

SEQ ID NO: 39560 - DNA, 144 bp, Chlorella protothecoides
ttgcgcatgcagccttggatcaagtgggtgtgttgcataggtcaagcgattcttgcatccatcccatcgccgccctgccgtcctcccctgtgcccaggtcatcacctctccacggcgcagctcctgcacctcttcacggtcctg

SEQ ID NO: 39561 - DNA, 128 bp, Chlorella protothecoides
gggcctggtggacgcagtgcgcgtggcgcaaaaagagaagctggtccgcgtggcgctgctggcgttgcagaacctgctggcgcacggccctgccggcttggagtttgccatcgtggacaagggcctgc

SEQ ID NO: 39562 - DNA, 125 bp, Chlorella protothecoides
tgccagagcagccctgccagaatctccatgcgtgtaactccgagtgcgtgactcacatagttgactgagacacagactcggcgcccaggctttacattctgccccctcggtgctgtgcagcgtct

SEQ ID NO: 39563 - DNA, 494 bp, Chlorella protothecoides
ccctattcccccccacccccctctctcccccccacaccttgcggatctccttgaccgctggatagagcaggctcttgggcacgcacacctgcgcggcgtagaagccgtgctgggcgggcccgccgtcggcgccgcgcgtcagcacgggactgatggtcggtccctccagcccgcccagcagcttggagccgaggagcagggccgccacggcctcggccgactcgccgcgcatgttggccaccacggagtagtagctgtcggccaccaggtgcgcgtccaggcgctccagcagctcgtgcacgaggccgagcaggcccgggcgctccagcagcgcgcggcggctggccaccagcacgccctgcgaggccatcacgcggccgcccgccacctcgcgcaggttgttctcgcgcagggtcacgccgctggacacgaggtccaggatgatgtcggcgaagcccatggcgggggccgcctccagcgcgcctggggggggg

SEQ ID NO: 39564 - DNA, 31753 bp, Chlorella protothecoides
  modified_base (1084)..(1129): a, c, t, g, unknown or other
  modified_base (1289)..(1298): a, c, t, g, unknown or other
  modified_base (1352)..(1361): a, c, t, g, unknown or other
  modified_base (1415)..(1521): a, c, t, g, unknown or other
  modified_base (2518)..(2780): a, c, t, g, unknown or other
  modified_base (2886)..(2895): a, c, t, g, unknown or other
  modified_base (3687)..(3696): a, c, t, g, unknown or other
  modified_base (3819)..(3828): a, c, t, g, unknown or other
  modified_base (4361)..(4370): a, c, t, g, unknown or other
  modified_base (5139)..(5224): a, c, t, g, unknown or other
  modified_base (5899)..(5908): a, c, t, g, unknown or other
  modified_base (6329)..(6338): a, c, t, g, unknown or other
  modified_base (6646)..(6655): a, c, t, g, unknown or other
  modified_base (8573)..(8582): a, c, t, g, unknown or other
  modified_base (9006)..(9015): a, c, t, g, unknown or other
  modified_base (9298)..(9307): a, c, t, g, unknown or other
  modified_base (9836)..(9845): a, c, t, g, unknown or other
  modified_base (10290)..(10299): a, c, t, g, unknown or other
  modified_base (11289)..(11298): a, c, t, g, unknown or other
  modified_base (11661)..(11710): a, c, t, g, unknown or other
  modified_base (11887)..(11896): a, c, t, g, unknown or other
  modified_base (11987)..(11996): a, c, t, g, unknown or other
  modified_base (12087)..(12228): a, c, t, g, unknown or other
  modified_base (14795)..(14804): a, c, t, g, unknown or other
  modified_base (16339)..(16348): a, c, t, g, unknown or other
  modified_base (16681)..(16690): a, c, t, g, unknown or other
  modified_base (17856)..(17865): a, c, t, g, unknown or other
  modified_base (18106)..(18231): a, c, t, g, unknown or other
  modified_base (18401)..(18567): a, c, t, g, unknown or other
  modified_base (19028)..(19037): a, c, t, g, unknown or other
  modified_base (19117)..(19126): a, c, t, g, unknown or other
  modified_base (19731)..(19740): a, c, t, g, unknown or other
  modified_base (20118)..(20127): a, c, t, g, unknown or other
  modified_base (20832)..(20841): a, c, t, g, unknown or other
  modified_base (20981)..(20990): a, c, t, g, unknown or other
  modified_base (22695)..(22791): a, c, t, g, unknown or other
  modified_base (22885)..(22894): a, c, t, g, unknown or other
  modified_base (23384)..(23393): a, c, t, g, unknown or other
  modified_base (24040)..(24049): a, c, t, g, unknown or other
  modified_base (24260)..(24269): a, c, t, g, unknown or other
  modified_base (24336)..(24345): a, c, t, g, unknown or other
  modified_base (24962)..(24971): a, c, t, g, unknown or other
  modified_base (25198)..(25207): a, c, t, g, unknown or other
  modified_base (25268)..(25277): a, c, t, g, unknown or other
  modified_base (25399)..(25408): a, c, t, g, unknown or other
  modified_base (25505)..(25514): a, c, t, g, unknown or other
  modified_base (26111)..(26120): a, c, t, g, unknown or other
  modified_base (26259)..(26268): a, c, t, g, unknown or other
  modified_base (26829)..(26838): a, c, t, g, unknown or other
  modified_base (27664)..(27673): a, c, t, g, unknown or other
  modified_base (28307)..(28324): a, c, t, g, unknown or other
  modified_base (28450)..(28459): a, c, t, g, unknown or other
  modified_base (29650)..(29659): a, c, t, g, unknown or other
  modified_base (31178)..(31187): a, c, t, g, unknown or other
ccgcgcggcgcgccgtagtacagcggcgcgcccgcgccgggcgggaacatgccgggcatgcccggggcggggccgcccagcggcccgcgcggcgcgcccagcaccatgcgctgcgcgtgctgctgctccagctgcgcgcggcgcacctcgcgccgctgggccagggccacgtacacgggcttgccgcgcagcatgtggttgttcagctcgctgacggcgcgggtggcctcctccggcgaggcgtagcagacgaagccgaagccgcggggcttgccgctggccgcatccaccatgaccttggcggaggtgatggtgccgtagggcgcaaacgtcgcgcgcaggaactcgtcgtcggcgtcgtcgggcaggttcttcacgtacaggttcatgccctggtagcgcgcgatgcgctccgcgcgcacatcctcgaaccgcgcgcgcagcatggcctcgcgctccgccttcttctgcgcacgccccacgaacagctccttgccggccaggggcgcgccgttgagcgcctccaccgccgcggccgccgcctcgggctcctcgaaggacacgaagccaaagccgcgggaggcgccgtcctcgccgcgcatgaccacggcggaggagaccgcgccgtgggcggcaaaggcggccttcagcgcctcgtcgtccaccgattcgtccaggttcttgacaaacacgttggtgaagcggccgccagactcggccgcacgctcgctgcgacgcaggaaggggcccacgtacaccttcttgtcctccagcagcatgccgttcaccttggcgatggccaggcgcgccgcctcgtccgcctcgtagtgaacgaagccgtagcccttggactcgcccgcggcgtccagggccaccttgcaggacaggatgttgccaaaggcggagaaggtgtcgtgcagggccttgttgtcgatggacttgtccaggttcttgatgaagatgttgcccacgccagacttgcggtaggaggggtcacggtggctccacatcagccgcatggggcggcccgccaggggggcatagttgagctgctccagggcacgctcggctgcagcagaagtgnnnnnnnnnnnnnnnnnnnnnnnnnnnnnnnnnnnnnnnnnnnnnnggagatgaacaggtagattgtgcgacgggctgcagagaacgtggcatggtcgtccacaggaagggaagaggatcaaatagccccctgctgctgacacacaggacatggctggccaagccttgcgcctgcatccagccagacaggcatttgcacgcgaaannnnnnnnnngggtggggtggaagtgtcaggcgaggggaagagcacaggaagccttgcgaggtnnnnnnnnnntggtggggtggaaatgtcaggtaaggggaagagcacaggaagccttgcgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggtagaggatcaaacagccccctgctgctgacacacaagacatggctggcccagccttgcgcctgaatccagccagacaggcatttgcacgcgaaagcatgccacggagggcgatggtaaccaaagaccctcgctgacgcacctgcgccggcatcgacgccagagttgtagttgacgtaggcgtagcccaaggagcgacgggtcacggcgtcgcggcacacgcggatggaagccacgggcccaatctacagaagggagtggagaaaactggatggcaaccagcatggcgatccagggatcacagccatacaatggcccacggcggccaggcgaggtcccgactccgacctcactccgcgtcgttttcaaaggcgacaggatcggcagcaaacactaccatctgcacgccatgtacacggtccccttcctacctgggcgaagacctcgtagagctgcgcctcggcaacgtcgcggtcaaggtcgccgacgtacagggaggagttggccagggcggggttggcctggggctgggccggggcggcctcggtggagggggtggccggggccggggtggtggttgccggggcgacggcagccatgatgaagtggtgtggggtggtgtggggggtgtggagtggaagggagggggtggtagtatattttttgggcggggaagcgcgagcagcccctgttttttctttttgggcctagtagcgcgaggctagacagggctcgggagccgagtctgagcagcaagtcgccctggcgtgtgtggaggcacaggagagaatggggaggtgggattaaagaggggcggagcgagcgccagtcgcgacattgagccgcccgctttgccatgagacacggtcacactttctttttcggaagacgacattctgcctgttttgcccgacagatcgcgtctgcagcgagtgcgaacccaaagcgcccccctgatcctgaatacaccccacacaaagataaagtatgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcacccagtgaagactcacttcactggttccaccgcaggaagcctgaggtgttggtccacgaggtggctgcgaggaaggcgggtgtgaccctcattcgccgtnnnnnnnnnntcgtctgcagcgagtgcgaaccccaaacgcccccctgaccctagatacaccccacacaaagataaagtatgacggaatgggtcatcaagcgtatgtctagccagtgagcccacgagcagggctgggggcgccagggcgccatgtccggcgtcgtcaaggtcctgcgcctgcagaacttccagattctccggcagttgaagctggaagaggcgctactccgcgcatccaacgacaactggtttcttgtgaatgacggcaccccagaccccgccatcgtgctgggaatctcggggtgcgaggtgctccagaggcctgtcctgggtggttgagggccccgagtggctggggcgtctgggtggccgtggacctccacaacagggaatggcaccccgtgaagactcacttcactcgttccactgcaggaagcctgaggtgatggtccacgaggtggctgcaaggaaggcgggtgtgaccctcattcgccgtttcaccggtggaggcacggtggtggtggacagcgacaccctcttcaccggcctcatcatgggtgtggacgaggtgccaggcctggaacccttccccaggcccatcatgaagtggacggaggacctgttcaagcctgtatttggcaagtatggcgattttgcccttcgagaacatggtgagtggaacgtgttggtgtgtgggtggtggtggacggaaggatacagcaccattacaaaacatctgacatagagttccctggtgttcctgtccccaaacccccaacatccagtctcgacttccctcccnnnnnnnnnnaaacgtgttggtgtgtgggtggtgatggacggaaggatagggcatcattacaaaacatccgatacagagttccctggtgttcctctccccaaccccccaacatccagtctcgacttccctccnnnnnnnnnngggcaacgcgcaggccatcagcaagcggcgcttcgtgcaccacacctccctgctctggcgatttgaccccgaccgcatggccctcctccagcacccggccaggaccccggagtaccggcagggccggccccaccaccgcttcatcacgccgctccaggatcacgtgccctcgcgaccccacctcctggaccagctgacggcgagcctcggcagcgccggcttcgccctgcaagaagcctctctggtggaggcggaggaggcactggcgaggaacaagatctgtggcacacgggtgctatagctgtcgggggcggctggccgaggcaggggacccggccggcgacccgcctcaagcctgccaacactgccagcaccccccctgaagcctgccatacctacaaacccaaaactgaacccctgactgagcgtcaacgtcttacagcagaaggacaagcggccagggcagaagctcatgggctgggaggggcaggggccgacgcagacattccctggcaggctgttcccagccatgnnnnnnnnnnactatagctgtcgggggctgctggcccaggcagggacctggccggcgacccgcctcaagccagccaacactgccagcatccccccttgaagcctgccatacttacaaaccccaaactgaacccctgactgagcgtcgacgtcttacagcagaaggacaagcggccagggcgggggctcatgggctgggaggggcagggggcgacgcaaacattccctggcaggctgttcccagccatgggtggggtggcccagagccactgccatccccactccccagccctcgcgagggagacctcgctcgggcgccggcatgcacgcctaggcagcagcgggcttgtcaccctccagcggcggcaggtcgccgtcctcggagctctcgtcgtcctcctcgccaaactcgcccgcccccaggccctccaggcccgggccccccgcacccccgaggagggaggagaagtcgggcatgccgccggcgccggcgccgccaccacccaggttctggagggcggagaggtcaaagccatcctcctccaggccgcccgtgccctcctcgtcctcatcaacccaccggttccagtccaccttgacgttggagggcgcgcgccctgcggccttgaggagccggggccagtggggcccctcctccttcttcgccaggatcaggaccactgtccggtcggtcttcacctgcacattgcatacgacaagattgaggtgcaaggcctagtaggattgatgtccacacagcagaggctgtcctgtgccagnnnnnnnnnnnnnnnnnnnnnnnnnnnnnnnnnnnnnnnnnnnnnnnnnnnnnnnnnnnnnnnnnnnnnnnnnnnnnnnnnnnnnnggacgcgagtggcatggcatggcagatgtgcaccggcagtcatggaaaaaacagggcccatgctgccgcgctccatacctgcttgacatcgctgtcgtcgatctcgccatacagctccaggtccatggagtatgtgtgctcatcaggtcctgcggattgcattggatcgagggtgctcagtagtttgtaaggaagctgggacctggagcgccagcggtgccccgcccatggagtgcatgctgcgagaacgaccgcccacgcaagacaccgccgcacctgtggcatgggaatgagcgtttcccttgaaactgacgcggccactctgggaggcctcgtcgttcttcacctcgatggtggggtccttgcagtcttgcaggtcaaaggtgaggtacaacctgtccttgcgctgtgccctgggaaggtaggcgagtattggatggaatgaggcatgcgtctccaggtaaattaaagtaaagctgcaggcacacaccacccatcctacccacatcgtaccactgaacgggaggggagagaggcatcttgatcgaggtcgggtcagtgcctaggatcgtcgagcttcagcaaatgagcaatgcaatatatgcttgcgagtggtgttgtgttgctggaccgacccgcccctacgcaatgacctgctgtgtgcaaatccatgcnnnnnnnnnntagcttcagcaaataagcaatgcaatatatgcttgcgagtgttgttgtgttgctggaccgacccgcccctgcgcaatgacctgctgtgtgcaaatccatgctgcgaccttctagagagccacccctctccgggtactgccatgctctgcgcgcgttgtcgagcgcgacggcaggtgcgcatgaggacgacgcgcggccgtgctcgtcaagcggttgatgtggctcgtgttctgttccgtgttctaaccatgtagataaccgtgcatagatcttgagtccaagccaatctacggtgcctggggcgaacttctcagctcagcaacaatatggtgagcacggtacccacgtcacagcatgaagcgaagccggccctgaaatgctctagaatgaaaaaatgggagattgtttgtcactgtgcatnnnnnnnnnnaagagcaacaatatggtgagcacggtaccccacgtcacagcatgaagcgaagccgggcctgacatgctctagaatgaaaaatgggagattgtttgtcactgtgcattccctgccccactcgcccgcagccatggttcatctgcgacaattgcggggagtccctgaaaaaggtgagtggcggcactcaatgcccaccggccgccgcgcaggagtccatcttggtttcgggagtatacacgataaatgcacatgcggatgtgttccggcccttcacatcgtcacccgtcatcctcccactcctccccagnnnnnnnnnntagtccatcttggtttcaggagtatatttgatagatgtacatgcggatgtgttccggcccttcacgttgtcacccgtcatcctcccactcctccccaggccaaggtggcaacccatgcaggtcagtgcggcagcaatggcttcacttgcctcgactgcagcagggcctttgaccgctggacggtggcagggcacacctcctgcgtcaccgagcacgagaagtatgctcagggcgccaccaagccagggggctatgcctccaagggctgttttgcgagtcaggcggcgcaccaggcggcggcggaaccctcggcggagggccttgtcggaccgcagtttctgtcggaaagggcgccctggaggtgtagcgtctgctctgtgacgtgcaccagtcgcgagtccctggagggccatgcctctggcgctaaacaccagcgacgggtgactcactttacaaactggctgggtggaggggaaatctgcactcgtcggccactgtgtcaatggaatcggggatgtgccttcattctgggaatgtttcagctgcgctcctgagctcaagggtattgattcatgcaggcgagggctgcaatggcggctgccgccggcccacttcctgagggaggaaaacctggttcgggtcacgacggcgcggcgccagtctccgaggccgcggctgcagctgtgtcagggaagccatcgctggagacaagtgggaagcggcccagggatggggaggaccttgcaccaacagggcctcccaagaaaatcaagtggaaaaagcttgctgctgcagagctgaaccggaaggggggcagcatgaagctgaagaagctcaccgcagctgttctcgccgcggctggccgaggggaggacagcgctgcagagctgcttcagaaactggagagctcggggcgattcagcctgaaggagaaccgcgttgccctggttgacgagtaaatgctcacccgcgcgcacttccccattcttccgactctgctgagggcgcgagaaaaattcgctcgcaacagtggcattgcgaatttgaattaaccttatgctgcgcttgaccacatgaattgaacaacaactgcttacgatctttatgctgagcgaggtttgagaagcaattgcattttcggggaggtgccaaggcccgacagccgactgtggtcttcaggtcaggagggacatgcggatctcaacgcacacattgttttccgatccggatctagaaccaaaataaacatcgttgctattgcgctgcgagccgcaacttgctggccccagggtgctcctctagccaagattcattccactgccacatttcaccaccccacctgtggcaggattcgatgccagctgagggtgaggtctccatgatcttttttgccctggcctttggcgctgttttgggcccgtacaccttttacagattgcgtgccggccccatccgcttcaaggtcaggatggggttggggctgtgcatcaaatgctctgggagagcaccatagctccaagtccatctctagggaggattttaatgtattcaatccaattactcacactcctgctgtacagaagaacgctccacaaggtcgaaagcagcggcgggatgcccagaatcagaccccggtggcgcccccaacgcctgctttcaagctcctggtagagcgtcacctgaccatcctctgggtcctgtttgcgctcctgctatggtgagaggtggccgaggagcttcctttttttgcaatggaatgcatgaccagcccattgatgcatcatgagcgcccagcgccacccgttcaggcagagcgctgcgttgaggcggcgactgtatcctgctctgggactcagccgtgccttcgatcaacaggggagcaagcgcaacacctgtcccttggacccttcctcgcagnnnnnnnnnnattcaggcagagcgatgcgatgggacggcgactgtatcctgctctggggctcaggcgtgccttcgatcaacaggggagcaagcgtaacacctgtcccttggacccttcctcgcaggcaggcatggggcagcctcaggaccatggcgccctttgacccctataataccctgggggtaccgcacggtgcaggggaggcccagatcaagcaggcatacaggtccctgtccctgcagtaccacccggacaagaaccccgacccggaggccacaaagtactttgccagccacatcaccaaggtgggaatgcacgagattgcatgcatgcaactcgctgtgcgagtgcgtcccatgctgtgccctgcggttgggtttgaagcacgctccaaggcagtcgaggccattccacatccccaatcccctccctnnnnnnnnnngaggatttgaagcacgctacaaggcagtccaggccattccacatccccaatcccctccctcaaacccaggcatatgagacgctgacagatccggtcaagtttgcaaactggcaggagtatggacatcccgatgggatgcaggactacgacgagaggtctgtgcccatcgtgttggtggggtagtgtgattccatgacctggacgaccccctggctcaactcgggaggcggcagaatgcaagctcgatgcccagctgcaaatggcttccacagcaagtgctgcnnnnnnnnnnttactcgggaggcggcaaaacgcaagctcgatgccccgctgcaaatggcttccacagcaagtgctgcgcttaagcagaactcatcccaatctcctcaaccctgccctgcccctctcacctcggcagtgtggcgatgccaaagtggatgaatgccaaggtgagcgccatggcaatgcgtggggtgacggcctccttggagagtcactgcactcgatccattccactctacgtgttgttgagcatctgccacaccaatgggttcaccctggcatcccgccccctccacaccacccagtcaaaggcagggtccacgctgatgatgctcagcatgctgggtctgatcatcgtgctccccctagggctggtcatgcggcacctgatgcagtatgaatggtgagccggcgtgcttgggatgtggtgttcctgtggaccccaccccctgtagccctcctcgatggccccttcggccaggcatccccaaccactggtcttcagaagccctgatcgttcctgctgtccaacccctggnnnnnnnnnnatagccctcctcgatggccccctcggccaggcatccccaaccactggccttcaggaaccctgatcgttcctgctgtccaacccctggaccctcctccgctactcagactgtcctccccaccgccactggcatcttacagatggaactgggggctggcagtggagtgggagcatggcgacaagcccacctctcccgcccagcgcgccccagctcactcgtcctcttcgctgctgtagccttcgtcgtcgtagtcatcctcctcatcgtcgtcatccccgtacttggacagaaccctcttctccacggcacctgcggacgtgacacacgtgatttgctggacttttgcagtaaccccttgtccttgtgctgctacaagtgcccaagccttgaaggcttatggcccctggatcaaataaagagcagagaaagccccatgccgtttccnnnnnnnnnntacacgtgatttgctggatttttgcagtaaccccttgtcctcgtgctgctacaagtgcccaagccttcaaggtttatggcccctggatgaaacaaagagcagagaaagccccatgccgtttcccacaatgcccctgcgcgacgcaccgagctcgtcgcggctccttgaaaggtcgacctctggggccgcctcatctgccttcagccgggcacggggattgctgtccaggcggaacgcccatcgaaactgcatggattttgtgcgacgacgggccggtgtgctttgccaaggcaggcggtccaagacagcggggcgaggaccatacacaaaggttcacgctgcggcttgaagagcaacacgagagcccacaccaagcaccacctccccaaggcagcgcaccactttggcgatggactggagggcaggtttccacagcgcgaagctggccagcaccaacacgaagagggtgctggaggcgacaaacttgatgaagcctaccaggccctggcgcgcgtcggtgagccacgacctccagtcgccgctccactcctcgcctgtggccatgcaaggtgcggagaattgtctgcgatccttctgagtaggaaacttgcgtgaaattcggcagccataacgagtgccttgcagatcctcgtccctccccaccgcctcacctccctccccaccgccaccgccgccaccaccgccgccgccgccgctccccccatccccgccgccttgacgcttcgcacgcttggcagccaggtcctcggcatccttgaacacgttcttcttgccctggaaggcatcctgcagcgccttcttggcagcgtcctgcgacaaagcaaatgcagaccagagcgtgtcgaggaatcccctccagcaccttgcaaaaggatactggagtgccaggtcggcagtcagacgcctgcccatgatcttcgtccccgcaagcagcacggctgcgcacacggctgcccacctgttgatccnnnnnnnnnnggcgtcctgcggcaaagcaaatgcagaccagagcgtgtcaaggaatcccctccagcaccttgcaaaagggtactggagtgccaggccggcactcagacgcctgcccatgaccttcgtccccgcaagcagcacgtctgcgcacacggctgcccacctgttgatccccatccttgcgccggaagggattgaagccgccactatctgccctcacgaccacactggtgctgcgctgaggccgcacactcctcctgcagcccgtctgactcccaaataccggcctgaatgccgcattggagctcaggccgctcgccaacatcggcagggtgaggtcctgggagagcgcgacttcctcgcaggatatcnnnnnnnnnnnnnnnnnnnnnnnnnnnnnnnnnnnnnnnnnnnnnnnnnngatgggtgggaccgatgtgcacggcacgcatggcacccatgcggtggtgcccatccgcaagggcgccatcatgttcggatcggtccccgtcagcctgacctggctttgccccgtcaaggggaccctcgtgtaggagtaccgggctcctctgatggtcattcttctcttggtatgctnnnnnnnnnntcacgacactcgggacggccccggtccaaatatcctggaccgctgcaatcgctcgtgaacaattccagcgggtcgcagcatccgatgcggnnnnnnnnnnacacgacgctcgggacgcccccggtccaaatatccccgaccgctgcaagaactcgtgaaaaattccagcgggtcgcagcatccgatgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctggccatgccccgtcaaggggcccctcgtgttggagtaccgagcttctctgatggtcattcttctcttggtatgctagcatcgagggcttgggttcccatgatcggggccgcaagtcggtgcatggccccgctctggttgtcaccaaagcccccatcccagcccctgaaccaccgcctgccgccgcccagactgcagtgcaaggccatgcatgcctccaccacgatttccccatcctcagagaaggatatggcgatgattaagggattccagcgatgggtccagcgctgcaacaatggcacagccatgctgccggacatgaccgcattccacatccaaggccatgaccagcctctgggctacatcttccactcgtgcgttttgtcggagagggctctgggtgagacatttgcttcctccagcgatgcattgggcatgggcgccctgcatcgcctcagacgagcacatgttggtgaagcccacttctccccgccttcccatcccaccgccccgcaggtttgcagaggagctccgtcggttccccgacgtattccagtcccccaccccagcctccctgaccctgaaccccgcactgagcagcccggaggagcggagccgggccgtggacgacgtgctcaagacattgcaggctcgcggcctcgtggacggctggcggggagagctctacccggtggcgccctccttccacgcgccgcccctgctctccctggagcgcgcggcggccgtgcactttggcatcaaagcctatggtgggatatggagagcctgggccgcggctgggaggcggcattgcctcggtggggccgctgaggtcggtgaaattaatgtcgtcccgcaggaggggcggcctggcagaggcacgttggcctcgccggcatcattgcacctaccttgctccgcgggtattctgcactttgtatagcatggcgaattcattgcacgccgcccgccccttgcgtcccggcaggcgtgcacctgaatggctacgtgcggctgcctgggagtgggtcgctggagctctgggtggccacccgtagccggctcaagcccacctggccggggcggctggaccacatggtggcgggcggccaggtgggcagtggggtgcgggctgcgaggctgtagggcgtccggtagaaccttgccttggcggggcattctatcgcggcaccccccccacttcacctcaaaccaccactcaccaagctgacccccaccccttcaaactcctcagccgcaagggctgagctgcgccgccaacatcgcgaaggagtgctgggaggaggccggcgtccccgccgagctcgcccgcaccgccgtgccagtcggcgcggtgtcctacgctgcccggcaggccgcgggcgtgaagagggacgtgctcttctgctacgacctggagctgcccctggactttgtgccgcagccccaggtgaatgattggcgggggaggggagggtgtggcccggttggacggggttgacccgagaaatcacgagtggcgacatcgtagagagggtctgatttgggtgagacatgccttgcacatgcgcaagcaggtccctcaccttgcccagttgccggtgatcgatcgtaatgattggcaggcctggcctctcagcaaggcatgcccggattgcccatttcaacacaggacgacgaggtcgagggcttcgagcgctggcccttggagcgcgtggcggaggaggtggccggcggcgagcggttcaaggacaactgcaacctggtcatcatcgacttcctgctgcggcacgggtacctaggcccggacacgcctgggtacctcgaattgctgaccgggctcaggagcggcgactgctcgtgagatgcagaggcgggggggcaagagggtagccgcacggggaggcgccccacagccaggctgggaagacgaggccgcccgatcccaggcccccgcggcttcttaaagcctggtgcagcaccaggagggggctgtgccgcctgctcccctgtctgccaccgagcacaccgttgtttcagagcgcgccgcgacctgcactgggcaacgggcaggcagagcatgtgcatggaggggaggggaacaaggctggggggcattttgcaggcgtgtctgccatgggactaatggccgcactccaaggctcgggagtgcggatgcgaattcaggcagtggtgtatgatgtggcggcgtcattccttgcatcacggggctgtactgaacccccggcactcgaccaatcagccgcaggaacaagggtggggtgatcgttcagtagtaggcggcgaggctcaaggctaggtgtgaaccccagccgctctactcacttgtcgccaacctcctgtgaaacgattcaactccaactgggaaaattccagcgctcgaatgtttcggatagtgtgctgatggtctacagggccgtctccagcagcagggtataatcacgatgctttaaggagagatcgtttggtatttatatacctattgaaatatggaatggcgacgcaccctcgttgcactccatgagcccccgtggtatttaccnnnnnnnnnnactttggtacttatatacctattggagtatggaatggcgacgcaccctcgctgcactccatgagcccccgtggtatttacccgggacctctatactggaattggcattcccactcagagtccctctttccttgagagcagggccaaaagaatatcacatacatcctgtggcaatgcaccactggagcttgagagaaagcgtgtgtgagcgtagaggaacagagcagggtaacgagaagttggaggtgaatatcagtcaatatgcaaaattgcaagatgaggtcagccgtccaattgtgtgatgccttggtcccaaatcatgggcaagccactcaaaactggccctcactcggtgacgcgggcggcccgctcagccaacactatgctgaggctggccttggttcgcccgcctctcaagatgtcgagcctcacctcatcccccacctacagatggagggagggagggggcggtgtgttggatgttatcaggcaacatgcagccagacaagctcgatgctgcagcatcctgtcaatgccgggtcttcgagccctgcagcagttcaagtctcccttccattggtcaccttgcgctctgcatgatacccccaccctccttcttccccccaaaatcattactcctcacacgcctaccttgcacgagtccagcgcatcgaaaagatcgccctcgttggccaccttcctgccgttcacgcccacgatgacgtcgcccaggaccacgcgcccaaacccatcgcgcatggtgcctttgaccccggcggcgtcagcggggccgcctgggggcacgtccagcaccagcaccccagagaggcccagctggcgcagggcctggggcggggccagggtgatgcccagcatcggtcgcaccactcgtccataggtcaggatctggtccaccaggccccggcacgcgtcgatggggatggcgaagccgatgccgctgctggcgcccttgcctgtggcaggtgtttggggagaaggggggggtggtttgacgtgggcggaaaaggaaaggcaggtgaaagaccctgggcagtccaggtacagataacctgagccaaggcactacctgtggggtcggcgatggcggtgttgatgccgatgagcctgcccttggagtccagcaggggccccccgctgttcccagggttgatcgcggcgtcggtctggatcacgttgcgcagactgggtccgttgttagtccctgggacgcacaggaggagcagtatatgtgtatgagtggtaggattggcggaattgcgtgggcaacactcgataataaacaagagattgcttgcaacttctgcaagtaggcatcccactgcatacagatcagcaggcacagccacagccggtgcgcctgcatgcaggctgtcaggtgcaggccagttgccatccacagctcccgctcttggtgccttgcagccaaggaccattcaaacctttgccgcataataaaaagatcctgaccacccaactcccccctgtacgccccgcctcacccgctcccagctcccnnnnnnnnnncgaccacccaactatcccctttacgccccgcctcacccgctcccagctcccgattcaagccagagatgatgccgctagtcagcgtgtggtccaggccaaaggggttgccgatggcgtacaccttttgacccacagctaggccgctgctctttccctggaggcgaggtggacgatgggctgggggtgagcatgacgagcatggatgccagagacgacttggcacgtttggttgccccctcacttccagacgtggaaggcccaccgcgactaaatgtaacaatcaataaaaagagtatcctttgcccccgttcacaggatgcttaccacttccannnnnnnnnntgggtgagtatgacgagcatggatgccagagacgtcttagcacgtttggttgtccccttacttccagacgtggaaggcccacggcgacttaatgtaacaatcaatcaaaagagtatcctttgtcccccgttcacaggatgcttaccacttccacggccttgagggcggccaggctggcgggcggggcgtccagctggaggacggcaatgtcccgcgaggggtcgccccccaccagcctcgcgctgtacacgctctggtcgatgagcgtgacgcggacctctgaagcgccgcggatgacgtggtagttggtcaccacgtggccctggtcgtcccagaggaagccggacccctggccctggggcaggcgcaggaggtcggtggagaggtaggcgcgcttggtggcgatgttggctatgttcaccaccgccggcctgtggagcgtgaggttggagaatgaggagacaaagtcttccagtgccaggccatgcgcacatgtgcaggcaggtggggaggaccgtggcctcgtgctggtgtacaatgggtgcaaagacggccgtgagccgaggggacccaagaggggacatggcagggctgtgcaccaccaacgaggtcccagaaatgaaacacaaaatcatggttgagcacggccttgccctgctttaccatcaatgatgacgccctccagcaacctacgtgttttctttgaagatgtgaacactctgctgctcctcgggcgtgaggtcagacggctcaggttgctgtggggttgcattgatgcatacatgaggaaaaacctgatactgatgtccagagcgatgctgcctaagtggcaatgcaggcctgagtcgatagttgccaccccagtgcatgtgactcccatcggcagctgcaccccgatgcagactatccgctgtcccaccttgttctcctggatgctgggtgcctcccgtggcgcagtgagtgtgctacctccgaagagagctgctggggtgtaggcctgggctgccatgggtgagagcagcgttgccacgagggcgccagtcttcagggcggccgccgcgccatgccgcaatctctggaccagcggcatggccccgtctgatggccgagatcctgaacatcccgcttcgtcagacgcggcacgacaggttgcaaggcctcctcgnnnnnnnnnnagagcgtgaggttggagaatgcggagacaaggtcttacagtgccagctcatgcgcacatgtgcaggcaggagagaaggaccgtggcctcgtgatggtgcacaatgggtccaaagatggccatgagccgagggcacccaagaggggacatggcagggttgtgcaccaccaatggggtcccagacatgaaacacaaaatcatgcttgagcaaggccttgccctgctttaccatcaatgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgatgcatacatgaggaaaagcttgatactaatgtccagagcaatgctccctaagtggcaatgcaggcctgagtcgatagctgccaccccagtgcatgtgactcctatcggcagctgcatcctgatgcagactattcgctgtcccaccttgttctcctggatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggccccgtctgaaggccgagatcctgaacatcccgcttcatcaaccgcggcacgacaggttgcaaggcctcctcgctgcatggagaccctcgtaaagggcaatgcacggccagcccgcgggccatgcgcacggatcgcatggcgtccgcatgctgttcgggaaccatccatgtgcgctgaaagacatggagaccgcatctgcatggtgatgttcatgctagtttacctgcaggcaatatattggtgaaggatatgtactctgagactatgggcaaaagggagccttcttaggccttacatagacatcatgcatcctcaagcatggcctcggcacccgttcccttcccttccgtgtgcccgattgctcacccgtgcgctctcaagaaataatggtagcggactgatagagtgtgttcatagaattgaatgcctttaatcgcgatcattagttgccatgannnnnnnnnntagatgtggtctcgaggtagattaaccaacaaattactgctacaaaaatacaatgctgtcacaggtgaagcgggctaggnnnnnnnnnngaaatgatggtagcgggctgatagagtgtaattatagaattgaaagcctttaatcgcgatcattagttgccatgaaccttctggatcggttccccaccaccagcagtcctcccatggcaaacactgggcgcggattgcgatgcgggggcgctcctcgcaacgtgagccagcgcgtcatcgtcacagccatggtacaactttgggcagatgtagtctcgaggtagattgaccaacaaattactgcttaaaaaacacaatgctgtcacaggtgaagcgggctagggctgcttggcactgctgtgcactccacgctgacaggcccttcctcacccaccctgcgagccttccctcgaacatcacaggccatctctctgggccctcgggcttcgttggacgtagtggcacgacccgctggcgtccgacgtgtggcgcgtccccttaccggaaggagggccggccaccctcgccgccaaaccctcgagtcaccccctcgggcaggggccacggtgaggcctgcacggcttcccggggccccgaatcgcttgatagcttgtatgtatgatatacggtgcttaattgtcactctaggcattataattagggcnnnnnnnnnncgcttctcggggccccgaatcgcttgatagcttgcatgtatgatatatggtgctcaattgtcactctaggcattataattagggccttgtgagtcgcgaagatttccagctgggttgctcagcatgatatctcccctcctccttgcagctggaggcttcaaccacagccgccccagccaaggacattgactgggcccagactgccaaggacctcgactccaagtccccgctagagatcatggatcacgtgggttggaagggtgactctcaatcgggcgtaccagcaaatcgatatctggctgctgtcgagcacagttgtggtgcactcacaccagccctgtgccacctccactaactcactgcaggccctggctacgnnnnnnnnnncatctggttgctgtcgagcacagttgtggtgctctcacaccagccctgtgccacttccactaactcactgcaggccctggctacgtttggtgacaccatcgggattgcctggtctggggctgaggacgtggccctggtggagtatgctcacctgacggggcgcccttaccgcgtgttcaggtgcggcgcgcctggccaatggaggtgcagagagcgctgcatgaacagcctgagctgactcaattgtggcctgatcaccttttgaggtactatgctgaacctaaagttccttgccctcctgccgcagcctggacaccggccgcctcaaccctgagacctaccgtgtctttgctgccgtggaaaaacactacggcatcaagattgagtacaccttcccagatgcccaggtgggcaggcgctttgtggtggggacttgagcgtgccgagggctcagctgtgcgggctgcagccctgaaatggctgcctgcttcgtcggcaggtcatatgcctacgctgagaggccagggtcttcacctgatcgtatgcccctccccgagcgcaaggcctctggctcgacgccatgcagtcgctgcatgatgcagtcacagcgtcaatgccactgggctcatggtgaacgcccccctcgccctcctccctccctcccttctaacctcctgccttaaacaccccccccccccccccttnnnnnnnnnngagctgagaggccagggtttcacctgatcgtatgcccctgcccgagcgcaaggcctctggcttgacgccatgcagtcaccgcatgatgcagtcagagcgtcaatgccactgggctcatggtgaaccgccgcccccccccnnnnnnnnnnctggttcgcgacaagggcctcttctccttctacgaggacgggcacggcgagtgctgtcgcgtgcgcaaggtgcgccccctgcgccgccagctggcgggcctgggcgcctgggtgacgggccagcgcaaggaccagtctccggggacgcgccaggcggtgcccgtggtgcaggtggatccggtgttcgagggtgcatcgggcgggcccggctccctgatcaagtacaacccgctgtccaacatgaccagcacggaggtgtggaacttcctgcgcgtcatgggcgtgcccaccaacgccctccacggcgcgggctacgtgtccatcggctgcgagccctgcacgcgccccgtgctgccaggccagcacgagcgcgaggggcggtggtggtgggaggacgccgccgccaaggagtgcggcctgcactccggcaacgtcgtgcgcagcgcggaggagcaggccgcgcgagaggcggcggccgccgacctctggcagagcggggacgtggcggcgctgagcaaggagcagctgagcgccgcgctggaggacgtcgcggggcgaggcgagcccaccctggtggtactctacgcgccctggtgccccttctgccaggtgggcgggcggggcggggccgtttcggggtgtgcgcctgcgacccggggcgggggaccgtttgtggacgagtgcgtctgtaggagcggctgggaacgacggcccctcaccctctcgctcatgcccccccgggtgaagcttcagttgcctgccagagggcaggatgggcaggcaagcctccgacctcgctgccacctgggcgtggagaacccccccacacacacatcccactcctctttgcctcttcggccaggccatggagccggcgtatgctgaactggcgcgccagctggcggggtcgggcgtgaaggtggccaagttccaggcagacgtcgagcgcgagtttgccgcaaccaagtttggcctggagaccttccccaccatcgtcctgctgccgcagaagacccctggtgcgtgcacagggagcggccagtggcttttctaggacttttgattctagggggggggtctcgagtggctcaagactgctgggcctcgggtctcgggatgccatgtctgagcctgaagtcttctacagatcaatcgcgcgtttctgtgactctgtcatccctgtttcgacgcagtgcacatgcccaccactccgttctccattacacccatgcaggcttcatcaagtacccctccgagaggcgcgaagtcgactccctgaagatgtgggtcaaggcactgactggcgggcagtgacagcgacgcgagagcatcgttggcggaggacagagtatctgctgaagaatgcttgcttgcctgatcaccagcggcacatctgtggaatgcgccccgcccaagctgtagaacgacagaggctcttgcactactcacgtgctgatgctctgttctccgagaaactgcaagtgccacgctgtgcccttgtcgaagaatctttgttgatgcaagacacaagttccaggtgatggtgacgagggagggagagcatacgtgatggtctcaaaggtgggtgtgatgatgagaggtgacgccaggcacagtgagaaggagttcagcaggatgtttaccgccatagcagaacgggctggcggtcatgggcccccccttgtcagcttgtctatgagctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtagagtggaaatgacacgccgagcagcatccagagcgacaggagcacagggagggagacgatgaaggagtagaggcactggatcccacccnnnnnnnnnntttcagcaggatgtttaccgccatagcaaaatgggctggcagtcatggccccccccttgtcagcttgtctatgagctccttcatgggcgccagttcccgatcgtcgatgaggcgattgccctgcaggaacagggggcgtagagtggaaatgacacgtcgagcagcatccagagcgacagggagcacagggagggagacaatgaaggagtagaggcactggatcccaccctggtgggttgggagagcagtctcttcccacacctcacgagtaccttggtgaacagcacaaagtgtttgaagcaggtgtgtaggtggggttctagctctagcctcacgatctgcctgcacaggagcattgcaagacagggattggcccgccaggagtgctcaatgtatgcgtagaatcatattccctccgttgggcaaagttccttgccaccaagaaagcacaccctttctctgtgtaccaagccaccgcgtacttgaagtnnnnnnnnnnggagattggcccgccaggagtgctgaatgtgtgcgcagaatcatattcgctccgttgggcaaaactccttgccacccagaaagcaccccctttccctgtgtaccaagccaccgcgtacttgaagtgggagtgatatatgtgggcatacactcggaacagtcgttttaggattgtcttcacagtgttcagaaagtcgcgggggaatgctgcaccgtatcgctgcgggaacacagcaggattgtccagctgcggtgccgaggggggggagaaggagtgggcagatgtaccaatagaaagtgtggcgttgtcagaatgatacatgcaaacgaccacaataaaaaaatgcaatgcgtgcaagccacaataagcatcctgcttctgagctgctagccgccaggaggtttgcatgaggccactttctcctgtctaccactaacctgttcctccacccagtcaaacagggtgttgacataggcgggcgccgacagcttgacagggtgcttgacacggacaccgtctgcccagaggtactcatactgcgaagaggcaacagttgtgatcaggggtttgaattcagcaatacccaagtgtaatatgcacatcaatctacgaatgacaagagatagggctgcaggcctcccctcctnnnnnnnnnntcgaggggggagagaaggagtgggcagatgtaccaataaaagttgtggcgttgtcagaatgatacatgcgaacgatcacgatcaaagaatgcaatgcgtgcaagccacagtaagcatcctgcgtcagagctgccagccgccaggaggtttgcatgaggccaatttctcctgtctgccacaaacctgttcctccacccagtcaaacagggtnnnnnnnnnntacccaagtgtgatatgcacatcaatttacgaatgtcaagagatagggctgcaggcctcccctcctnnnnnnnnnncaggtatacaacgacagatgcggagtttgctgggagagtgtggatgcaatgcattgctgtggaacatgtaagaccacctggcggcaggcatgggctcaaatttgggcgtgaatctgccctctggactctcctcccaggtgcccccagctcacctggtggcaggcgcactgcctcctcgatggtcccagtgccgagggtgtgctcgatgtgctgcttcagtgtcagtccctgcgaagatgctcgtgtattgagctgagttccggagggactgcgagggtgcgctggtcagatcaccacactctggtcccctcgacccattgccctaccttgctacccatgggcacggtcttcaccgacctgaaggtgccgcccttcctgcgattgcggtgtgattaagtctgcatctgaatacaggtgcattacaacattcgctgcgaggatcaacaccaacccgtgcagtacttggagaaattgaagaagctcgccatcgcacgatcctggcccctcgaggacagcacttggttcgtgcagcgctgcgtgcagtaattaacgcagcttagagcatttagcacatatttagcgtctgtgaatagtatcgggggagctgttacaggagnnnnnnnnnngcaggttggttgagcagggtgggtcaggcatacaccccatcccgctctcgctcccgtggccgtttcggcccacgctcaaagctgcggtccctctcccttttcctgtagtggagagatacgagtgggggtcagcacgtcggggccaggagcagtggttgggacgttcggctcagcgtcgagcagcaggtcacaccctttccaatccattccaaaggtgccccactcannnnnnnnnncgagcggcttcggtatagtctcgcgcctgaactgctcgtgtgatccgctccgcccaggcannnnnnnnnncagtagagagatacgagtgggggtcagtacgtcagggccaggagcagtggttgggacggtcggcgcagcgtccagcagcaggtcacacccattccaatccattccaaaggtgccccactcannnnnnnnnngtggagcaatctcaactgcccccttcaccctccgaggcccctgcgctgcacacaacgatcccctttacccctcaaaccgcccagcgacaaccctggnnnnnnnnnnccggtcactgtgtcgctccccatccccatgtccattcctgctgcgatcccggctccgctcccggccaaagtcgttgggcctgggggacatgggagagcagagggagggcaggtgtgaagttggaagggagagcatgtggcaaagcatgccaagcagccttgtgctacaactgcaagggcatggacagcacagccccagtctctggagcaatcccaactgcccccttcaccctccaaggcccctgcgctgtacacaacaatgcccttcacccctcaaaccgcccagcgacaaccctggtcccgacgtacgcgtcagcaatctcgcccgcctcccgctccgagtcgtccccggatgccaggtcagcgctgcgctccctgggtcgcgtggggggcgacgagctgcggccgagcccccggccccggtccgcggagcgggaccgcctgtcgcgcgagacctcacgcggcaggcggtcgggggccggtgcccggggtccagactcctcccgcccccgcgaggccgagcgaggggccgcctctgcggtcctagcctcggcgccgcccctctcaggggaggctggaggtggttccttggcccgtnnnnnnnnnntcgacgagccaacactcatccatccaggccatggtcgccagagtccatgcaattcaagtcggaggtgtgccaaccactcgatacagagcaaccgccacccccacaaataaatccccgcctctcgcctctcttgcaggtnnnnnnnnnntcgggaggccgagtgaggggccgcctctgcggtcctagtctcggcgccgcccctctcgggggaggctggaggtggttccttggcccgttccctggcagtcgcagcgtggggaagggtgtctggaatggggccaggcaatcaccgatgagccaacactcatccatccgggccatggtcgccggagtccatgcagttcgagtcggaggtgtgccaaccactcgacacagagcaccaccacccccacaaacaaatccccgcctctcgcctctcttgcaggtagcgctcgatcatgcgccgcaccatcagcctgcgcgggtccttgggcaggcgaggtgctctgctctccccgccttttcctcccccaaaccgacgtgacagcctgcaggttgggagggagcaagggttggtcatccggcaagggttttaggccgggcgcatggcagggttagcggtgaggctcctgtacattgggcgtgcatgcagcatcgaggccctctggggatctgagctgccctaaactcctgtctttgctcaggagagagtcaactgcctcgacatgcnnnnnnnnnncggtcatccggccagggttctgggccgggcgcatggcagggttagcggtgaggctcctgtacattgggcgtgcatgcagcatcgaggccctctgggcctcgatgctgccctaaacccctgtctttactcaggagagagtcaactgcctcgacatgcacccccccaccctcttccgtccacaaaatcccccccttccgacacgcccacagccgcgcctcaccacccggtgacggcgcggccccgctccacgtccacgaggatgcggcggtcctccaccttgcgcccctcagccagcttgtacgcctgcttcatgtcgttcttgtgctcgaactcgacaaaggcgtagccacgcggcttgcctgtgttgcggtcgtgcacaatgcggatgcggcggatgggcccaaactcctccatctcgcggcgcagcttccgctccgaggtgtcgtaggacagccgccccacgaacagcgttttgaaggggtcgccctgcacgttggggtccttggtcgggtcccatgtttccaggccctcccggatcgccgcggcggcggctgcctgggcctccgcagccagccggatgtccctgcagggaggcagaggggtgcgacggggtgaagtggaggagcgcgcgcgggggggggggagagacacggaccgcgccaggcggagcggtgggcaacccaggggtcctgcactcctggcagcaggctccccggcgccgacggtgatgtatctcccccaggccagcctgccagcagggaaacaacgtctccatgcacccctaccccggaccagcatccactcaccgctcaggcagcgtctccannnnnnnnnnagacggtgatgtatctcccccaggccagcccgccagcagtgaaacaacatctccatgcacccccacccgggaccatcatccactcaccgctcaggcagcgtctccacatcgatcctggcctgatactggagctcagggctgcggaacaagcgggtctcttcctttatctcctgggcgccgtggtactcgggatcgccgggcccggcaaacttgtccatgtactgggcgatgccggagagcgggacggccttgggcttggggggtggcaccggcactgactccagaggtggccggggagcgaaaagcttcagcaggcgctcggtgagaccggtgcgatgacccgtcacgctgtccttcatgcgattcttctcatcgatgcgctgggcgaggaaggactggggcctgggagggcgtgggagggagaggtgagagggtagcaaggagactcgaggagctcactgtattcgtcctacagaagaaccatctgttgaagcgtacttcttggcgaaatccatggcgtcgccctcacgccaggccccactccagcgctctgttcggtgggcactgccccttgatggccaacgtctcttccctcacaattcccgagcggtattccccgtatgttgaatgcgtnnnnnnnnnnnnnnnnnnagctcttaatatctggctttagtatatcaacatcgaactttgaacgagtgttggattgaaatacgcacaaaccggactgctcgagcactcggtcccggctgctcccaagggatgcagcgaccttannnnnnnnnntaccaagcaggatactgttggtgtgtggtgtgatgaggtcgctgtcctagatcgggcagggggacccggctggggagaattcttgtcgtagggatgtgggttgcttcccgccagcgctgtcacgccgctgacgtgcatcgcagagaacaggcgatgggagctccaactggtgcgcgtggctcttaacatctggcttcagtatataaacatcgcactttgaacgagtgttcgattgaaatccgtacaaaccggactgctcgagcactcggtcgcggctgctcccaagggatgcagcgaccttagacaagtaactttcccccacctctggcgccgacatggcaagggaagcgtccaagcctgtcaagagtagtaaaaggcctgcaagtggtcctggcaaggatgcaaagcggccgaagtcgtcccacgccggcggccacagcgaccgcaagtctgcgcctgccaagccgtccctccccagcaagccacaatcaaggtctgtatggaaggcgggagatgctttaagaatgcgcaacatagagggatcactccccagtgctaggaacatctgcaacacatcccagccacttgacagtatcctgaatccgtccacgaccctagcaaggagcgcaaggaagccctgcgcgagcgcaagtccaaggtcaagcgtaactttgacctcattcaggtgcctggttgggtgttgtgaccggcttgcagccgtcgaggaagcccttagaatggagaaacatgcgctgagctccccaagcacagctgctgctgtcactccatccaggcaccccactgctctcactcggcccccccctgccaggatgctacttccctctgggaggagctgcgccggcacgacgtaacgcccgagcgacggagccagctgaccacccaggtgctgtccaagatcaaggggcgcctggtggagctcgcttcctcgcacaccgcctccaggatcgtgcaggcctgcgtgaagcacggcagcgatgcggagcgcgctgagatcctggcggagctcaagcccaagctccaagagctgtccaagagcccctacggcaagtttgtggtctccaagctcatcgacacggcgcccaaggcccagctgaaaggtgggggcatacctctgggcgtgtgcgcggcatgatccccagaggggtatgttgtgaagctgaatgtctgggnnnnnnnnnnccctctgggtgtgtgcatggcgcgttccccaaaggggtatgttgtgaagctgaatgtctgggtctggcccaggacgtctttttggccggactaacactgcgggcatgcagggtatcgaaactgcggtgcagtgtgtatgcgtcacaggcgataccatgcagagccccggcactttgcgtgtccgtgacaccatcttctctccccgctcttgtgcaacctgggccgtacgtttcttgcgccctgcccttcctgcccctccccccgcgcccccctggctggtgatgccaatactgcgttatcttactgaactccactgcgcccggcggggcgtggcatatgctgcggcccgccgagcccgtgccgttgaggagaaataacactttgaagccgggtcggcggattcgttgcgggctgcttgtcgtactgcagcagcttgccttcccctcgcatgctcttttcccttcagggcatctccttgactctacacctcttgcaccttccttggacctgccactcctcagccgccacactcctcaccaccaacccacgccgccaccctcccatcaccgcagagtaccacaaggcgatgaaggggcgcatccccgagctggtgcgccacccctccgccgctcacgtgatcgacgagctgtactccgcctccggaccccccgcccgcaacgccatggccgccgagttctacgggcgcgaataccgcctgttcgagggcggcacgctcaacggcgtggcgggcgcgccggcctcgctggcgcgcctgctggcgggcgtggacgcgggcaaggccggcgcgattctgcagcacatggccgccgcggtgctgcccatcgtggagaagaagctggtggactgcgccctggtgcaccgcgtgctggccgagttcatggccctggcccccgcctcgctggtggcggacgcggtggggccgctgtcgggcgaggcgctcctgcacatggtgcacacgcgggagggcgccgcggcggcctgcgcggtgctggcccacggctctcccaaggaccgcaaggcggcggtgcgcgcgctgaaagggcacgtcgcgcgcatggccctggacgactgggggcacctccccctcatcaccgccctgagcgtggtggacgacaccgctctcctccgcaagttcatcgtgaccgagctccaggtgagtgggggtttgtggatgcttgtttgcacgggaagggggggatcggtcaccgcatgggacctggcccccccttcacacaccgcaccacaagcccacccacccgcctgcttgtgcctgcgttcgatgaagaccattgtgtcgacgggcggactgattcccgtgatgagtgtcgacgagagagcgtgcaggggctccgcccggccctgaccggctgggcgggcggcccccgcgcgcgtctgagaacgcccgtgccatgcctgcgctttacgaggggagggttcctgccaggtcccccggggccgcccccgtcgcccccccgctccgtgtccccttggactgctnnnnnnnnnncgacgaggggagggttcctgccagatgccccggggatgcccctgtccccccccgctccgtgtccccttggactgctgtgcacctgctctccccagggagttcacaccccctccctcgacacctctccccgtactccctgcagaaggacctgctggaggtggtgcagcaccccaccgggcgaagagtggtgctccagctgctgcagcccgactgcaaccggtacctgccgccggcgatgcaagccatcgtgcaccctccggagaagatctacacgccccctgccgctggggcggcaggcgcggagtgcggggcggaggagccccacgtgcacagccccgggtgtgggcatgcgcacggcgatggcgcggagcccgaggcgaagcgggcgcggaaggcgaaggggcgggcccccgatggcggcgggtcggaggacgaggacgcggtgcggccgctgccgcccgcaggcccgctgggcctgagcaagaaggaccccacggtgcggcgcacggaggtgctgggcggcgggctgggcgccgcactggccgcgctgtgcgccgccgaggccg

SEQ ID NO: 39565 - DNA, 109 bp, Chlorella protothecoides
ggtggcactgcaggagggaggctccctcactctgctcgacgccgggagcctccgctcccagcccctgccactcaagggcattgcgctggccacctgcgccaacgaggag

SEQ ID NO: 39566 - DNA, 132 bp, Chlorella protothecoides
ccgcctgggaggtggtgcccgtggaggtgaagacgcggcgcgggacagcggtcgtctcgcaggtgggtggggtgagggcgggggtctgggagggcgtggactcggatgagcatgttgtcccagggtagaagg

SEQ ID NO: 39567 - DNA, 77 bp, Chlorella protothecoides
cgcatccaggacggggcacatgtgggatgagaacaaaggcgaaagttcttccttggacaagagtgctgatgagatac

SEQ ID NO: 39568 - DNA, 128 bp, Chlorella protothecoides
ggcaaggaggaattctttggttgtcactgactgcatattcacgttccttgtgagtgagtacgagtccttgcagaggtaaagacatgttgatcacaactacgcagcacctgaccgtctcgggggcgatg

SEQ ID NO: 39569 - DNA, 76 bp, Chlorella protothecoides
tcaagtggagggctaccgcgttcgtttgtcaattactccagtcggctccacatccgtatgtctggttcgattgtac

SEQ ID NO: 39570 - DNA, 72 bp, Chlorella protothecoides
atgatatggcgattgggacttggtggacaatgaccctgcactgctatgagaatggggatggcaaggcatact

SEQ ID NO: 39571 - DNA, 353 bp, Chlorella protothecoides
  modified_base (152)..(290): a, c, t, g, unknown or other
cgtgtatccatgcagtcgtgtggtgtctccccccgccccctttcgccccgcacttatttccaccttcctgctgcccttgtgccacccctgacgctctcgaatgtcgaaccctcctcctcccccttgctcccccagtcacctttgaacgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagatgtcccaaggatgcatggcgccccccgagagaatccgagcgcgcgagcacgtgcgtg

SEQ ID NO: 39572 - DNA, 83 bp, Chlorella protothecoides
ccctccagctgcgcgttggttggtggagggagacctgatgcacttccctccacagggcggttgctacagcgcatattagcctt

SEQ ID NO: 39573 - DNA, 61 bp, Chlorella protothecoides
agacgccagggtgtcctgattcccaagcacgcacgggacggggctgttccccgtaggacac

SEQ ID NO: 39574 - DNA, 61 bp, Chlorella protothecoides
gggaggggggtgagccggacgcgacactgcggtccatggacgatggcaacgaggagcccct

SEQ ID NO: 39575 - DNA, 106 bp, Chlorella protothecoides
ccccgccgttgtcggcgcggcaatggtgcgccccctgcagagcaacgtctttcctaccctctacttcatggccgggagcctgatggtgtacgacagcacggtgatc

SEQ ID NO: 39576 - DNA, 174 bp, Chlorella protothecoides
actctggatgctgggcggcgggcttgggagggtgtgcggatcacgcagcactccacgtcctgtcgaacatccagtcacggctctcttccccggtggccatcacccacccccgcacacctcctgccatgcccatccctcacgatccagtgggtcgggattgcacgtgggccaccc

SEQ ID NO: 39577 - DNA, 8205 bp, Chlorella protothecoides
  modified_base (164)..(259): a, c, t, g, unknown or other
  modified_base (3002)..(3154): a, c, t, g, unknown or other
  modified_base (3781)..(3824): a, c, t, g, unknown or other
  modified_base (4120)..(4129): a, c, t, g, unknown or other
  modified_base (4800)..(4809): a, c, t, g, unknown or other
  modified_base (5757)..(5766): a, c, t, g, unknown or other
  modified_base (5975)..(5984): a, c, t, g, unknown or other
ctgcgcgccgcggcgcagcgccgcgccgagcaggcggccagcggcgaggagcggtacgcgcacatcggtggcgaggagcgcgagcgcctggcggccgaggcggcggccacgctggcctggctggaggagaaggagcgggcggggcgggggctgacgcccgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgggcgactgtgtgaggaagggcgagacgctggagcgcgtggccgcggccttcgaccgccccgcgccccccaagcccaaggcgcccgccgcggccgaggaggacaaggcggcgccgccggcgggggaggccatggacaccgacgcgccgggggccggcggcgccgaggcgcaggacgccgaggcgcagggcgccggcgcggaggccggcgccgccgaggcgcccgcgcccgacgccatgcaggagtaggccgcgcccctgcgtcgtctccgacacccctgggggtggttggaatgcggccccgagacaagccccgtccccacgacccccctccccgacccatgctctcctcttgcttcttgtttggtgttacacacgtgcgacagcgagcctggggcgaatggttcgacgaggggcgcccgctcaaaagcctctgcggtgcattgtacgtgggagaggggtccatgagcagatccttggcccacggcgccagatgggggaccaagtgcagcttccgcgaggaagacaggcaggggcctggggaatcagacattcgaagcaggcaccctccccatcctccaccccctgcctcacctggcttttcggcgaaagatccagcgcagcttggccttgaaggcccggcgcctcagccgcttctccgtctcctccgcggcgagcttccgcatctccgtgggcttggtgtacaccgcctgccgcttccactccacgttcatcttgttgtccatcaccctccgggtcacggtcctccaggcagcgtcgacgttgttgccacgcacatcgacgctcacgatggaacggcagggcgcttggccgatggtttgggtggcggcttcgccctgccgagcggcggcgaggagggacgacgggcccagaccggcacccacgccacgcaccgctgctgcgagcctgcaccccagcccagacacggcctgcatggcgctggctgggacagcaccagcgacgaaaatcaccctggggatataccgatcgtgtttgcctctggtgtgtctcgtcatgtatcgcaaggagggggggaaagaggaggtgcgagggtgcagattgccacgtaagcgtgcccattttcgcgggaaacgtggctctcgcgagcccacagaccgagagtagattgatgtgagggggagcgcgacaagcatcccacacatgaagaatccacgtatgtggcggacagaagagccgttttctagccgattagtctccgaattatcgggtcgcttcgtgtcgctgaccacccctgcgttttcaaaccaagcgcgtcgcaagcacggcgggccccggcctttttcagagcagtccgtgtcggagccgttcatggtgcatcgtttagcgtcaaaataatatgtgggactgtcggctggggtccaacctcgcggcagggcctagcaaccggtgctcggctgctgcgtggaacctccgaccccaggtattgtacactctcgccagaccaatctctccaacaggtttcccctcggcgcccgctcacgctgctaacacgcacatatatcgacttctctcaggtccagaggcggcagcgagatgtcgggccgtgctgtagtgtcgcctccgagactgtgaaccggccaggtgacacagccccctccccccccgcccctgccaccctgcggtccacctttgctaagccagactcggagctacagaggtgaggcaggattttgttttgtggcagtggacgaatcttgtttttgggggcgagaggatgggtcccaccggacgccgtggctgtctttgtactgctgctcctggactccttctgcccgcccctctcatcaccctccaccacgaccatctccctttgcaatcgctctcgagcagcctgctgcggcgcgtgtacgccgggcgctcctgctccgtggcggcgccctcccgcgacgctgcggccgcggcgccgcgccgcgctcccgtccccgtctatgtcatgctccccctggacacggtctggctgctagagcgcgacggcggcgcccagcctgtgctgatccgggagaaggccatggcggtggggctggagatgctgagcgcggcgggcgtgtcgggcgtgatggtggatgtgtggtggggcatcgtggaacacgccgggccgcggcgctacgactggagcgcgtaccgccgcctgttcgacgcggtggcggccaagggcttgcgcatccaggcggtcatgagcttccacgccgcgggcggcaacgtgggcgacacctgcaccatcccgctgccgcgctgggtggtgaaggcgggcgaggccgaccctgacatcttctacacagacgcgcacggcgcgcgtaaccgcgagtgcttgagtttaggttgcgacgaggcgccggtgctggccgggcgcacgcccgtggccgcctaccgcgactttgccgccgcctttgcggccgagttccgcgacctgctggggtcgggcatcaccgaaatcacactgggcctgggccccgcgggcgagctgcgctacccctcctaccccgagggcgacgggcgctggcgcttccccggcgtgggcgagttccaatgccacgacgcctacatgctggcgagcctggcggccgccgccgcgcgcgcggggcggcccgagtgggggcgcggcgcgccgcacgacgccggcgcctacaactcgcgcgcgcacgagacggggttcttccatgacgtccacggccgttgggacaccgagtacggccgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgcggtgcgcgccgcgctctctggcccgggctggccccgcgtgctggcgagccgtggcgggggtagcggcggggttggcggtgctgcgcccggcgccgccggccacaggggagggccgccgcaccccgcggacgcgccaccgccggcctcccacccagcgacctcggcctcccatcagacgaccacgcccttggacgccagcgcgtcgacgctgctgcgcttccgccctgccgccgcgctgggcgtgaagctggctggcgtgcactggtggtacaccacgcgcgcccacgccgccgagctgaccgccggggtgtacaacacgcgccagcgcgatgggtacgagggtatcatgcgcgtgctggcgcggcacggcgccgccgccagcttcacctgcgtggagatgcgcgactgcgagcaccccgccgaggcggcctgctcgccggaggggctgctgggccaggtgctggccgccgcggcgcgggcgggcgtgcccctgggcggcgagaatgcgctgcagcgctacgaccgcgccgcctttgacaagatcgccgagtcagcagtgggcaggagcgtgctcgccggcaggctggaggtgtgtgggaggggggggggggggggggggnnnnnnnnnnnnnnnnnnnnnnnnnnnnnnnnnnnnnnnnnnnnggacccaggggtgaagcagggtgctgaggggagaaccctccatgtcacatcagccaccactccatgttcaaagcttgacacctcacccgattccctcgtccagaaaatcaccttcctgaggatgggcgacatgatggtggacaactgggacgcgttcagctccttcctgcagcggctgacggggccgctgtgctgaggagtgcgcggcctgtcagcagcaccgcaggcactgtggagcttgcagactccaacatccatcatcgcgccccctcccccaaaccccaccccccaaaccnnnnnnnnnngctgtggagcttgcaggctccaacatccctcatcgcgcaccctcccccaaaccccaccccccaaaccccaccccctcgctgtcgattaccggcatggacgccttgatgcaatggcgacgtcataccaccaccccctcccgcgcttaccttacaccacttgaacagctcccccttgtccctttgtgtagagactgatgcaccattgctgcatgtcactggtattccccttttcagagccttcttctctcttttcactggcatccctttgtacagcgaatcccctgtgtctccctccggcgccgcccctcgccctcactgacaacccagccaccgtcggcagcacgcccacgggacgtctggcagttgcgtgcggtggcaggggccggagggtggtgtactatttttgtggcgagggagggagtgcgggctgtgcgattctcagcggcacggcctgccctccctacccaacccctgcgatgcttttgaaatgcacgcgaaaggatgccctcctccagcgccgtgctcaagagattgccgctgttgtagcaagtatgtggaaggtgtggggttgcagcaaaccgtgtttgatttggcgccttgcacaatttgaaacatgcatgggtttcggcggtcgtggcattcttcgggccgggcaagtgcagcgatcaccnnnnnnnnnngtgcatagtttgaaacatgcatgggattcggcggtcgtggcactcttcgggccgggcaagtgcagcgatcaccgagcctgaaggaccttgcgcaccgtttagcagtgacacaggacacaaattcgtcttgtgaaaacatcatgtcacaggaaaggggactgcaggtggtcaccaacccacggccagtggtcaaagatgcgcaactggaccgactgcgcgaggagcgcgaggtgcaccgtcatcgacaaatctggaccaaggatgctcatggaggaccatacaaaaaggtaatggtcgtctcgggtgatccctctgtgcaggggcttgccatactggttcgcctcggcatcccctggcttgccccccctccctgctcgcaggtcaacgacggcaaagggtacgaccctctcttgcaaaccccggacggcaaggataaggaggtgagtggggaccgtgacatcaatgcctgggacggtctcttgggatttggacgccagtgcttgcacaagtcacgggaggagggacgtgctgagaactctctgtgcacaccaccacgggacgcgcttccaggtccctccctgccgccgtccccagtaccttgcccctccccaccaccaccacagtgggcgctggggtatgagcgtgtcaaggtgggccccaccaccaacttcgtgggcaaccacatgacccaggcggccatcgacctcgtccaggcccacctccagccgccgcgggagcccgtctcggaccccggcgccctgcgcttgacccagggcgcggagcacgggccgaagctcctgcaggtgacccctccccagtctgaacagcatgcaggcagccctataagggccctggacaggtacaggtggcaggacgcagcggagagcgtggatatcagtgtcgagctgccacagaatgggccctgggacgtaacctgcgaggtgacgnnnnnnnnnnggcggacagcgtggatatcagcgtcgagctgccacagaacgggccctgggacgtaacctgcgaggtgacgcgtggcagtctcatgctggaagcccgaccccagagagggccgcagctacggctgcacatccccgccctctgccatgccgtcacgcccgaggcctgccgggtcattgtggcctgtggtgaggatcatggcgagcaggcannnnnnnnnnactctgccatgccgtcgcgcccgatgcctgccgggtcattgtagcctgtggtgaggatcatggcgagcaggcagctgtgccatcggtctctggcgtctgggcttggaaggggcacctccccggtggcaccctgctcctgcatctgcacaaggagcaggagggcatgcagtggcagcggctggcggctcagaaggaggacgctggtggaaatggcgcacgtgccccagctgctccggcggcagcaccggacctggacgccaccaggtcagcacagcagccttgtgtggaagagttctccagtgtgggggggctttcttgggctgatggagcacatgccctatcaagcatgccatgaagcaggctcttggccatgctttcgtcggagccgccctgccacccggctggtctcacccacccacactgcacagacgcgccttgctcgccgcgaggaggcgaggcaggccctacgacgtccaggcggccctgcccgccacaaggcctgggcctgagcctgctggtttgcctggcatagaggatccaacacacggcgggggtgcggcgtcggtttcggggccgcacgccgacctcctcccggaggcggcggccgccgaggcagagcgcgctgccagcgcgggcgagtatgtcggcgcggtgcgcgccgcgagcctggcgctgagcgcggcacccttcctggcgtcctctgcaggtgcagatctgctgctggatcgggctcgctggcgcacctgcttgggcgacgcggcgggggccgtggcggactgcagccaagttatcgatggcgagggcgttcattcaaacaccaacgtggtcaccagggcgctgctcctgcgagcaagcctgcgggaagagggggagtgtctgccccaggccttgcaagatgtggaagccgcgctgtccctcgctcctggcacacccggcctggcggtgacgagggaaaggctgaggacccttgttattcgcccgcagcgtggcgttcacaagacgctgatgtgctgagcatgggagagaatctgccgtgctatgtatgcaatacatctggctgcatttgcacgccttgcaaggactccattgtatatgtaggccctgtggcattccgggacccgggaagggagggcccgcaagatcggatccgccggctgatggcgcgtcggtgggcacttgcaaagcgtctataggttccctgctcctccatcgatctggcctccgcataagatctttatatccattgtgcaccccgatacattgacagcatgcgatgagggtatgaatgtcctcggccagcaaggccgggggccttccctccatgctgtacttgttctgcaagggcatcctggcgtctgccctgccccgcctgggatttgtccgatgcgcatcgaccgagcatggccctgacgtgctcaagtcggcgctgcgagacctgtatcgcctggtgcaccccgacttcttccaccgacacccagaggccagggtgaggcattggtggcttggagaggacaccttggctagttgattgtcgctctggtgttgtacctcgtgagaaggttcgtcacaatggcatcgacacactctccaggctgccaacgagcgcagcttcaagctgctccaggagtacctccaggcaacaaagacccatgcccaccaggagcagcagcctgctgtgccataccgattcatcttctacctcaaggacggggaagcggcggaggcgccgagcccgccggttgccacgccccattcgatccccggcctcaagagggtgaccgtaaacctccctccaccggtgtgcgcctcgtgaggtgttgcatgaattctcgtgtgtatcaagcagccagcacatgggagccgcgggcttggctgcctgctcctctgaagatcgccggcggcttgctctgccccccacaccattgttccacccttcttggatgtcttgtcgagtgctgcgccctccgttcccagcctcgactctcaccagtccgtgccaccctgccactgacctgagcaggctccgggtggcggacctggtcaccacccagacacacgtcgggccctgggccggctgctgcatgcctgcggcgtcccctgcgcaggcgcgctcgccggcggcgcgggcgcgcccccactcgccccccgccgcctccgtgacttcctgccggcggcggcggaggcgctgcaccgcgctgcagcgggcgcggccggcggcccc

SEQ ID NO: 39578 - DNA, 145 bp, Chlorella protothecoides
atttggcatttccagaatccgtcagtgcacagtctccagatgtcgccgctgcttccaggttctgcaaggagaatatcagaaagaaagggtgttagtccaccaagcatgaccttgcgctagcagcggatagggattgggcagaaca

SEQ ID NO: 39579 - DNA, 77 bp, Chlorella protothecoides
ggctatggggtgacggcaggtgggctggagagaggaagcttgctgcttggcagtgaggggtctccaatcgcggggcg

SEQ ID NO: 39580 - DNA, 61 bp, Chlorella protothecoides
tatattcatcccaggcctgaagtgcccataccccccccctgcagccatggactgcatccca

SEQ ID NO: 39581 - DNA, 61 bp, Chlorella protothecoides
gagtgaagatggccatggcgaggtgaggatcgagtgcgagggggagaagggacctctccag

SEQ ID NO: 39582 - DNA, 75 bp, Chlorella protothecoides
cgcaggatggtgatccggcgattcaggctcactcgggtctccgcctgtcctgaccttggccgttcggtgaatgag

SEQ ID NO: 39583 - DNA, 63 bp, Chlorella protothecoides
gggcccgggaggaccccggtccgcacccacccggcacaatgcggaagggatagatgaggtccc

SEQ ID NO: 39584 - DNA, 61 bp, Chlorella protothecoides
cgtactatccccctcaaatcacccctcatccctccctcccctttgatcgcagcatcccggc

SEQ ID NO: 39585 - DNA, 83 bp, Chlorella protothecoides
aagtctgtggcgctgggctctgtcgcagccgggcgcggcctctcctcacgccccacacccagtcaaaggtgtggggaggcagg

SEQ ID NO: 39586 - DNA, 65 bp, Chlorella protothecoides
tttgtggcggccaagcgcgcgcagcggctgtgccgccacctgctcaatgtggcggggtccttctc

SEQ ID NO: 39587 - DNA, 61 bp, Chlorella protothecoides
gcacagcccatgctcgtgccgctgcagttgcctgcagtgaagaggcccgcaggaggatttg

SEQ ID NO: 39588 - DNA, 63 bp, Chlorella protothecoides
tgggcgacatgggcttcttggtccgtgtctcgtctcaatctgacactcatagggaccccctca

SEQ ID NO: 39589 - DNA, 107 bp, Chlorella protothecoides
agattgtatgttgcgttgcagtcagacccagacgtactttcaaccgccacaactgttgcagtgcttagccatgggtgccccatgtcacagaagctggcactcttgac

SEQ ID NO: 39590 - DNA, 61 bp, Chlorella protothecoides
tgatggcatcgggtggggtgcatgggaagggtcatcgcatggcacttgggcgtcgaggggt

SEQ ID NO: 39591 - DNA, 85 bp, Chlorella protothecoides
ggagaagagggaacaacagtggcagaatgacgccacggtgaatgaatggcggacagcgcccggcgaggcgggcacgaaaggccga

SEQ ID NO: 39592 - DNA, 79 bp, Chlorella protothecoides
gggggggggggggggggggggggggggtgatggagggaatgtttggggtgctggaggtagggcagctcgattctggtga

SEQ ID NO: 39593 - DNA, 61 bp, Chlorella protothecoides
tacgcgtgtcggcactccaccgaggaagcgaggcgagccatagggcccgccaaaagcccga

SEQ ID NO: 39594 - DNA, 76 bp, Chlorella protothecoides
cgacggattgtccttgacaagctgtgaccctggacctcattggtggcttgtcccagacgccaaacggctgcacccc

SEQ ID NO: 39595 - DNA, 120 bp, Chlorella protothecoides
cggacaggagcacagcctccggacctgcggaatggcaatcgaagtacagagcgagctgacatcccggccctgtctctagagacagtgcatgctctcctgtgcgctccatgatggcaggat

SEQ ID NO: 39596 - DNA, 120 bp, Chlorella protothecoides
gggcactcctggcgctcgcgctgggaaccgtgcacatcctctcgtgctttcatgtatccctgggcacgcctctccccaggactcccatcagaatggccctcctcccagccccaatgtgcc

SEQ ID NO: 39597 - DNA, 76 bp, Chlorella protothecoides
cgaagctggcagtgctgctgctgaacgcccggcaccaccacacactccacaccccgctctcaacctgtgaagtcga

SEQ ID NO: 39598 - DNA, 75 bp, Chlorella protothecoides
tggacctcctcccacttagaagctcctcgagcacgactaccctggcaggacgctgaccggcgagcatctgggggt

SEQ ID NO: 39599 - DNA, 18123 bp, Chlorella protothecoides
  modified_base (1415)..(1424): a, c, t, g, unknown or other
  modified_base (3725)..(3794): a, c, t, g, unknown or other
  modified_base (3954)..(3963): a, c, t, g, unknown or other
  modified_base (6307)..(6316): a, c, t, g, unknown or other
  modified_base (6776)..(6785): a, c, t, g, unknown or other
  modified_base (6862)..(7024): a, c, t, g, unknown or other
  modified_base (7818)..(7827): a, c, t, g, unknown or other
  modified_base (8474)..(8483): a, c, t, g, unknown or other
  modified_base (9013)..(9022): a, c, t, g, unknown or other
  modified_base (10555)..(10564): a, c, t, g, unknown or other
  modified_base (10906)..(10915): a, c, t, g, unknown or other
  modified_base (11442)..(11451): a, c, t, g, unknown or other
  modified_base (11650)..(11659): a, c, t, g, unknown or other
  modified_base (11903)..(11912): a, c, t, g, unknown or other
  modified_base (12489)..(12498): a, c, t, g, unknown or other
  modified_base (14191)..(14200): a, c, t, g, unknown or other
  modified_base (14612)..(14621): a, c, t, g, unknown or other
  modified_base (15071)..(15080): a, c, t, g, unknown or other
  modified_base (16531)..(16540): a, c, t, g, unknown or other
  modified_base (16746)..(16755): a, c, t, g, unknown or other
cgcgaggcgaccgcgcgggcgctggcggcggcgctgcggcccgagctggagcgcgcggcgcgcgacaactccgacccgcccggctcgccgtacgagttcgaggcgggggcctgcgcgcggcgcgcgctgaagaacgccgcgctgggcgcgctggcgcggctggggggcgagggcgtaacgcaggacctgctggcgcgcttccgggcggccaccaacatgaccgacgaggccgccgccctggccgccctcgaccgcatcggtgaggccttggatgtgacggcggggtgggaaggggggggtcgcgcgcttcaccacgtgggcagggcacgaacagagccctcctcgtcgtggagcggcaccggggcagcgcatcggtgatgtgcatccctccatccctccccccgctcctccagggggcaaggtgcggcaggaggcgctggacgccttttacgccaagtggaagcacgagccgctggtcctgctcaagtggatcgccatgcaggcggccagcaacctgccgggcaacacggcggcggtgcggaccctgatgcagcacgaggcggtcaagctgtccaaccccaacacctgctactccctcttcctggcctttgcgcgctcccccgtcaatttccacgcaggtgagggggtgatgatgaggggtagttttggggaggtggggagttggggtttccaccgtgccgtgcgattcatggtgtggtcacccacaccatgattgggcgaggccgcagaccgccacaccattcctgtgtgggtccgatcctggatgacaggggagtggcagacttcccgcactgcctctgtgctccgtttgagcccatcaaagcggtggcctcacgtccatcctccccacaaccttgccatttccgcagccgacggctcggggtacgagttcatggctgactcggtgctgcagatcgaccagatcaaccaccaggtgcggggagatatgggtttgacgctctgactggcaaaggaacgtttgtgtgctgttcagcatcacccctgccccagaagtgcgtgccagcatcactagccttgcgttcgcaatgccaaacccccatacaattcccccctcaccctgccaggtggccgcacggatggtgggtgtcttcaacagctggcgcaactacgacgccgagcgtggcgccctgatgaccgccgccctgcgccgcatggcctctgccaacggcatctctgccaatgtgtacgagatcgtgaccaaggccctgccctgaggtcgaggcgagcgaggatcgctgctgcgaggcgaggcctggcgctgcttcatgacatcgaaagccttgtccactccggcagacctgctgcaggcacccatggccaggcatctctgctcgtgcatgctgcccctgcaagtatgccgtttgtcaggaacnnnnnnnnnntcgagcgaggatcgctgctgcgaggcgaggcatggcgctgcttcatgacatcgaaatccttgtctactccagcagacctgctgctggcacccctggccaggcatctctgctcatgcatgcggcccctgcaagtatgccgtttgtcaggaacccttggcttcctttgtcgaaaacgtcgagcattctggaagaaggatgggcccctgctccagagggctattgacactgacaacccatttgggcccctccctgctctccaaagcatcaacatcccggctgcccacacaagtcgggctcctgcattgcagctttgactcaacagacaactggggtgcgattcggtaccactctggcaacacagactgagcctcatcaccagcggctgcagcggccgaaaggggacgggccgtgcgcccggcaggcaatgtgcgcacctgaggcacggcgcaggcgccgctccaatcaggccgccgcctcggcctccttcttcttcgacttgctcggcagcgcgggcagacccttgggcgcggtggtgctctcctccgtgggtgcatcctgggacacctccggctcctccggctcgggccctatcaagtccgccagctcctcggacaatgggtggcccttgagcgcattgcggatgtccacctggtgcgcacctgcaaggggggtgaaagggggcgagtgcctatgagctggggattcagggcaagagaccagcaagaacaagttggtcctcccagatggcgacaggaggaggtacatggccagcatatcgacactttcattctagacatcatcccgcttgaccatgcctggcccactctcccttcttccccccaacctcccttcttccccccaacctcccttcttccccccaacctcccctcgtcccccagacaactccctcaccagcttctcggaacttggcggcggccttctccaccagcggcctccagtccagccctcccgcggcgcgcaggatggagtgctcgtagtgcgcattgcccaggttgatgaggagggaggccttgaccggcatttccgactccgggtcgccgggcgtctgctccgcagtgggccgcatcggcttcacctccttcccccgctcctcctccgacatgtggtcgatggcggccccgatcagcgcatagctggcgtccatgaaggcctccgcggcctgcgccgactcggcactcacgcgctgaaacgccttggcctgcgcggcgcggttggccgcctcctccgcagcggcgcgctcggcggcgtccttgaggtcctcgcgcggccgcaccggctccagcaggtagtctgccgccagcttggcgcggctctgggccacgctggactgccccaggtacccgtccaggaaggtgggcttgtactccagcgcctcggcgtgcttggcttcggcgcgtgccaggtggcgctccacctcctccgccacgctggaggcgggctcgcccgcgcgcgcggcgcggtacatggcaaactccgcacggtactggtgcaccgtggcctggttgtacatgccgaagcagacctggtcctcgaacttctccagcgccgcgtccagcagggtgtcggccttggggtcgccctccatcatctcctggaaggcggcctgcagcttgtcgttgcccacctccgacgcctccagggggcggtcgggatcgatgccgcagtgctccttcagaaggtccacaaaggacaggatccactcgtccacctgcacggggccggcctcgggctccgcggcctcgggctcggccgcgccgccgcgcgccgcctgcgccttctgcagctgcgccagcatctgctgcacgtacgccagctcgtcctctggcaccttgggcacttggtcctgggtgtgtgggtggggaggggtgttcggggtgtgagaaggataccgatgcgtcagtgtgctgtgctgtggggtgccacgccatcgctgatcaaagatggaacgagggatctccgcccagaacactacgacactactgctgtgtgccggagcaaaacacctccccccacctagccaatccccaaacatccgcgccaaaacttcttaaggcgcatgaaaaacccccggcgcccctccacacacctcgctggagacgcggacgacctgcaggcgtatgggcgccagggatgcctgggtgacggggccgcggttcccagatgagcgggacgcggtctccaccgcctcctgcatggccctctggacgtcgttacgggagccgatggtgaccaggtcaccctccctggagcagggaggggtggacattgagcagggatatnnnnnnnnnnnnnnnnnnnnnnnnnnnnnnnnnnnnnnnnnnnnnnnnnnnnnnnnnnnnnnnnnnnnnngtgcgcgacaactgtcagcctccctgctcaagcatgggccacacagatgcagcggaccacgcataccgactgcctccccgcccctacactctcacaatggccaccaaccacgctcacttgtccaggtatttgagcacaaaggggctggccgcggggaagnnnnnnnnnnggcacacagactgcctccccgcccctacactctcacgacggccaccaactatgctcacttgtccaggtacttgagcacaaaggggctggccgcggggaagagctggcggacatgctcgatcagctccagatacgtgacgccagggaccagctgcagggcgcgcacatcatcctcgaaagacagcttggccgggaagacgatctggcgagagggggcgggggccttgcccgagcccgccgctccgcctgtgcggcgggggcccaggccgttgcccaagccggatggcttcttgccggccacggcgtccctcaaccgctgctctgcttcctgcaagtcgggggaggagggacagagtggagctctgcgcaggcaatggcagaaccccatcctcgccatacttctgagatgatctctcggacaaccttggtatccagaagtccctccactccctccccaccttgctctcttgggtggcggcatccagcttgttggcacgctgtagatccgtcagcgcattcttcagctggcccatctgctcgtaggccttgccgcgccgcaccagggccttgaagaaggagggctgcagctccagggctgtggagcactcattcacagcctctttgaagctgcacagaaggcggagggatgggggggcgcattctggcagttggcgtagccgggagactcgcatgcaaggcccagcatttcagacgatgagggcagggacgtgcggacgatacatgatgtccaacaggaatggtgctgccccaatcctcgtcctcaccgcttgttgatcatgtggcaggcagccttgttggaatgcagcagcgccgcatcggtgctgcccgaaggcgccagcttcagggcgcggtcccaggttgccagggcatgatcgtactcccgcttagcaaaggcgatgttggcttcgtccttcagggaggccagggaggctgcctcctcctggaggcagggcgatggggtgcaactttgccgcacggagccatggaggcgaggcgtgcgcggacacatcaatgctcatatggaatgaatgatatactagaacgaatacgagcacgcatccgatggatgggcgcatcggccaggccacacaccaggcaacgctgtgccggcagagctccctcgtcagcattggaccacagagagctgtccgggtcccaaggcccccatcaccccatgcatgccgcatccattcacctgaggtgcggcaaccggtgaagtcggggtgctccgtgtcttcttgcccatgttcgcaatgtggcactggcagctactgtgcgtccgagcctcacgtgccgggaggtgacagcaatccaaggcaccaaaagtagccctgggatataaaaggcaccaaaaacaaaaatggctatggttgaacaggtccctgtcggtgctggagtgctcgttggtggcaagggcagtccggataagccccgtcggtctctcccgccctgatatccttccggggctttccaccaccaggacacgcaaaggtcttgcccccccaggggggccggccaccgtggacatgcgctcagacgctgagttggaaggcactcttattctgacacagtgatctccacacctcatcaacagggcgacatggctgtgcagcagggcttggctgcatgtcctgccaatgcatgctttcgacccttccaggccacaggtatgtgcattagacatcaatgggtgggacgtgcagccccatgtcctcttcaatatttccattggctgacacatctaatattcaaactactcatatacagcctttggtgcgctgaaggggcgtcacgcaagaccccgcctacacctcggtggatcactttgtgagtgctacgggtgggcatcgagttgcgaggtgaagtgcagagggctttcatgggagctgtttggtggaataaaactgacattttacattatcgacagacaatcggaggctgccttatgtccgtgcggagagcatagagaaacctgagaccgctttcagacccaagttggttcaaggtgggcatgatgcagcgagagctgcgccgatcagttatcctgacgaggggtatgcatacagaatttgcccccagggatcacagctgcaccccgctcgccatcacagagctccctgttggagggctcctcgccaatggaaagtatgagatcctggagacgctgggctctggctccagcggcatcacgtacaaggtcggtgcttgatgaatggttgtgcatggtgaggaagcagctgcagggatgctggctgtgcccgctgcccagagagcacgactcccagggtgcccagtcacctaccctgcttccctccatcccatgnnnnnnnnnncgcacgactcccggggcgccccgtcacctaccctgcttccctccatcccatgcaccaactacagtgcaaggatctggagacccagaaggaggtggcggtgaaggcgttgtccctgcgctccctgcgctcctggaaacagctggacctgtttgagagggaggccgccgcgctaaagggcctgcgtcaccccgggatcccccagtacctgggatactgcgaggaggacacgcccgacgaccgccgcttcctgctcatccaagtgggtggttacgctgtcgctgaggcgccttcatgttggggctcttgcgtgaggatccagggcctcttatagattcgcgatgaccctgctggattgctgcatcgtacccggggggcctgccgctcctctcctcccaggctccgtggctccacctcaccatccccatttcccccccccacaaaaccacaggagctggcgccnnnnnnnnnntgcgcttaagggcctgcgtcaccccgggatcccgcagtacctggggtactgcgaggaggacacgcccgacgaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctccacctcatcatccccttttccacccccccacaaaaccacaggagctggcgccgggcaagtcgctggcggagctggtgcgcagtggctggtcccccagcgaggagcaggtgttgcgcgtcgcgcgagaggtgctggcggtgctggcctacctcgccgaccgccgccctgccgtggtgcatcgcgacgtcagcccctccaacatcgtcgcgcagcgtggggacgcagatggccgcttgtccctggtggatttcggaggcgtgcaggccgtcgccgcgggggcgggggaggatagcgacggcctagggtcgggcttcctccccggcagcacggtggtgggcacctatggcttcatggccccggagcagtttgcggggggtgcctcccccgcctccgacctgtacggcctgggcgccacgctgctcttcctgctgacggggcgcgcgcccgtggcgtccgaccgcatgcgcgtcagcacgagcgccaccgccatgtcgccgcgcctgcgcgcgctggtggagggcctgctggagcccatggccgaggaccggctgagcgtggaggaggcgcaggagatcctggagggcggacgggcgcgcgcggtgggggcgcggaagcgggatgacgccgaggccgggcggccgtcgggcagcagggtccaggtcacgcgccgcgggccgcgcctggagatcgacatcccgccgcccgggttctctggtgggtggagcatgacgagggggtggaagggtgtgtgtctgtgtgtgatgggactttatggtcggggctgtctnnnnnnnnnnagtggagcaggacgaggaggtggaagggtgtgtgtctgtatgtgatgggactttatggtcggggctgtctcggctcaggcggcctggtgtgcctgggggcgtcagctgactgcgcggagcccacaggacagccatgggaactcaaggtgtatggggtccagcagcaacgggaaggtcaccgccttgcagagtttgtggcgcgacatgccgctgctgcacgagtctgcccacaagacttggccgatggcctggccctgccactgccgatgcttgcccccaatctcaaaccctcacccacctcccacacaccctccacctctcatgcaggcgactcgctgcccagcgccgcctttgctttggcctggaacgcgtttgtggccttctggacggtgagcgcgctggcgggaggcggcatcatcttcgccctcttctccctgcccttctgggcggcaggattgaaactctccagagcggccctggccggccagttcctcaggtgggcgggggtggagccacgaggtgtttttttgagaagactgtctgtgtcagcgcatgccaggtcctagtgcctcataccctttcgaacgcctttctgacgagtcaaagccgctgtgctacccggaatccctctcaacctctggcttccnnnnnnnnnntcgcataccctctcgaacgcctttctcacgagttaaagccgctgtgccacccggaatccctctcaacctctggcttcctgatgaaaccactgagagccgcatcccctcgtcttcctcaccacccaaccctcaacagagagcggctccagatagggcttaagaagtggaatgtcaagcagcagctggccctgttccgcggtggccagcctcagtgggacggctccggcgtcaaagaggtgggcggacgctccagcgacctctcccgcgccggcctggtggtggcggggtatgtgaatggtcagccccagacccagctcgtcctccaggaaggtgggcggtgatgaattctgtgtgtgtggggggtggggtggcgggcaggctctgttcatagggagcgtgttttcggtgggagatgatgctcctgctcccggccgtcaattttgtctgcgtaggttaacatttgtcaaatttggagaccctcgtctataacccccccacccttcattacacaatcctaaatttccaggcannnnnnnnnnagagacccttgcctataacccccccactcttcattacacaatcctaaatttccaggcacacgcaaggtggtcctgggtgagggcctggggctggaggagcaggaatggctgtcgcggctgatcaacacccacctggcggccaatcgggagctgcggggggaggagccgctgccggagccccggccgcggggcaggcggggctggatggcagacatggaggagcggatggccaccttctcggaggacctgagctccaccttcaaccagggccgctccttcctggtggatgtcgaggacagggcgcagcgtgaggcccagcgtgcacagcgcgccgcccgccaggctcagcgcggcgcggaggagggggcccggcgcgcgcggggcgaggctgaggccgccggccgtgcggcgaggcgcttcggcaaggacctcggcccacgagtgagtcccactggcaccatcgacgtcgactttgacgtgctggacgatgagtgatgcggggggttgtcttggaaccccttgaacgatgatatagcttgcacaattcgccttttcccctataaaggtatacctccctgatctatcacccttgccatggacatggtggctgcgaccaaacccttctcattgttattccctgccttccggctccacggaccctctgccgcgaagttgtgacatcgattccgctcagatcgctggcttggttctcacatcgacccagtgaccggccacaatttaccattacagaccactgtatgcattgtcgaggggaaatggcataggtcatgaccacgatgaccaggcttgcgggggtgctcctgctctgcggactcgcggctctggctcccacccccgcccgggcctcgctgtacgatccacatgtccccacaatgtacgatcccgccttccgaacctggttcgagggatggtatgtccggatcacgaccgcacagccagagggcgagggaggagacgacgggacgggcccggtcctgccctcctccctgggcctcatcgtgggcaccatgcctcgcgggaggttgggctggaacatctccctggcgagcctgctggtgcagcagggcagccgggccctacagaccttcgagagcacgggtgtgcagctgtcggtcacgggggccggtggtcaaaccgtggtgcgggaccccgagccccacacccccccggacttctcggtggtggcggacgacggtaccgccctgctgcacatgcggggggagcagtgcgccctgcatgtgacactgggtgggctgaccatggacgcacgctgcactggccctcccctgcgctggggccccaacgacgagtccccggaaggtgggctgggcggtactgatctgcagcaggggccagcaggggcctggcattgggtcgggctgtgtgtgttgcagcctggctttgctgccacttgtcaagctgccgagcgcggccggcctgccaggtcccatctgtgaactacctcaaacctccctttccaaaggcggcatctccggcctcccaacccagctnnnnnnnnnntggccggcctgccaggtcccgtctgtgaagtacctcaaacctcccttcccataggcggcatctccggcctcccaacccagctggtgggcctgcactggtttgtctactccctgggcacgcctgtggcctggtccctgcgcaacgactccagcggtgagaccgtgacgggcgctggcctggcgcacttcgagaagaactggggcggcacctttccgcccggctgggcctgggcccagggcctggacctggcgccgggtcgagacccgtcccggccccgcgccgccgtggcgctggcgggcggccagctgccaaccccagtgctgccagggcggttggttccgnnnnnnnnnngcccggccccgtgccgctgtggcgctggcgggcggccagctgccgaccccagtgctgccagggcggttggttccggacgcctggctgctgggcgtgcgctcgccaggcgggcgggagtgggacttccggccccaggaccccacctccttcacagcagaggcggatccctgcaacgccacgctgcgcctcaccgcgcactcgccctggacggggcagacggcggtggtgacggcgcgcgccccgccaggcctgtttgggcacgtgacctgccccatggcggagggcttcgagccgggcacggcggtggaggcgtaccgagcaagcctcaccgttgagctgtacgagggcacgcctgggtggtggcggggggaccgggagctggtggaggtggtggagatcgagggcgccgcgctcgagttcggcggcgaccgcatgtgcggggcggggatggccagagcgcgcggctctgctgtggggggtaaggaggccgaggagacggacgcgtcttggcacacggcgaccctctnnnnnnnnnnttctgctgcaggggggggggaggccgaggagtcggacgcgtcttggcacacggcgaccctctgaagggttggtcccccggccaccaaagacgcatgcctatagggcccggcgctgtgcctacattgccattgtatgagggctccctcccacccctgtatacatgttgttgccctggaatggtcccacccctcttcatcnnnnnnnnnntgacgctgtgccaacattgccattgtatgagggctcgctcccacccctgtatatatgttgctgccctggaatggtcccacccctcttcatccgtgacattcccatgtcccacaattttgtgtgagtgtaggatctataaaacctgcttcagcagtggggaagggactcgcagcccggaaatcactggctgcttgcggcagggtgggccttggcggcagattcctttgccagccgcagctgccannnnnnnnnntagggacttgcagccctggaaatcactggctggttgcggcagggtgggccttggtggcagattcctttgccagccgcagctgccacttgttccgctggaaaatctgcagggggtagtgagtggtagaggatgggcatggaggtattcgagatgggaaggggggtgcccaacagtccatccatgccgtacgccagtctctctagggtttggctgcacatccgaaacatcccaccaccccgagcaatgcattcagccgcagagtcgcctccatcctcgcctggtagaatgtcccttgcgcattccgggggatggagtgcagcaccgcgacctctgcggccccgtctccctccggtccatgcacttccaagcttgtggcctcgtcgagcgcgatgcccgacaggatcccaccgtccgcgcccctgaatcgtatctggtaacacgggaggtagggtgagtgatagcacggttggttgcggcgatgggatggcgcccagctgggcacttgccactgagccccccaacacacaggccgatcacagacatatttgtcattcctgggcacctggtgatcatcctnnnnnnnnnncccctccggtccacacacttccaaggttgcggcctcgtcgagcgcgatgcccgacaggatcccaccgtctgcgcccctgaatcgtatctggcaagacgggaggcagggcgagtgacagcacggttggttgcggcgatgagatggcgcccagctgggcacctgccactgagctccccaacacacaggccgatcacagacatgtgtgtcattcctgggcacctggtgatcatcctcgaggtcagtcagcacgactccgatgggcgatgccgaggctgcctcatattccaccagcaggccctcctgcgatccatgcaggggggtgcaaatgtcggtgagcgggaaatagcggagggttaacgcccgctcgctcggtagttgccaattatgtgtgagtcatgtacgtatctccggggccctacgacgacaaacaccagaacaaccagaccgaccttccttcctaagacggcgccgttcccaatctgaaaccactgtgctgctgtggattctagcgcctcccctccctcgaactggagcccaggcagagcagacatcacgggtctgcacaggatgggagtggaagggtgtcggcctggggaggggtggctgacacacaggcatgcgcccctgttcttggcagggtcatggcaccaggcaggcttgtatcccagggggaattcacttggtggagagccacacctcaggcccaatgggttgcatgcacatctacatgctcaggtcaccaccgtacacgactgatggggctttcagcaggtttgttctgtttggacgaggggctggcgctgccctgctccccctggcaggagattggggaagggatgatgggacgcgtctggcacgcaggcgaagacactcatgcctccattggagggcggtggaagctccatggatcgtctcagcacccatgaaggtgggctgaggtccggcacgcgcaatggtttgtgctgttgacatggtacatccatcaagcactgaaggcatcaacatcactgattcgcaccattcttgtacaaggtccagcctcagtctgccagtgccatggtccaaagtctgcagtctgtactctgtgggtgttgctgcaaagaggtagcgggaaaggtggttattggttgtcaggcacgtggaggagggtggggttgccttcaccctcacccaacatacacttcaggcccaccgctgcaatgagtttcatacctgaaaggacccaggagtgcctgaagccatcccgattggccttgccgatgacacctgtcgtggcgaaggctgttcgacccaccaccgatatgctgtctgtgcttgggagaggaggaggctgggagcaaggaatacatccaccttctggctcgtgcagctgagcgacagcaatgcagacgcagcccaaaataaatgtgcatgcgaatggatgccaggctcagacgcactcgatttctaccccgcacccccaccacacctgcatagttgtggctgaggtggaagtgcccgctgaaccacaggtgtatgttggggtgggactccaccagctccatgaacacatgggggttggtgctgtggttaagccaggcgcatcgattcttgacgtggacatccagcacggactgcgtggaaggtcagcttttctctgttgttctactgaaccgtggcaccgtgcatgcaatgtactgccggttcttgattnnnnnnnnnnactctgttgtgctactgtaccatggcacagtgcatgcaatgtactgccggttcttgattgggaggcggcatgcacccatgaaactgcaacctctgcattccttggagcaagatcgctgacgggtcgaccgtcgacccaagccgacagcccgccagcgacccaccctgacgccgctgccgagaatgggcgcatggctgaacacaatgactgggcgaccctgtgaggcatccagttgattcctgaaccaggccaactgctctgcgtccacatggacctgacgagagggtgaggtagggtacaacggtgaaatgcacttccaacctacggttgtggcaaggggcagaagacgtgcccgagtgatggagaaagactgggatgatatcttaccaaccagcatgtaccaattcacgannnnnnnnnnggagatagggtacaacggtgaaaatgaacttccaacctatgcttgtggcaaggggcacaagacgtgcccgagtggtggagaaagaatgggatgatgtcttaccaaccagcatgtaccaattcacgagcccagtgcacctatcacgtgtcttacttcatgtgcagagtgttggttactcctgaagcgagacgtgccgaggcccaagaggatggcgggccccacatctacccgccagtggtgctcctgctggaatgtttcctgccaggccgcgagattcaaggcatccgtcttgaactcgagaccctctggggaagttgggaaagggtgtggaaaagggcctccttttgggcggtcataaaagaaacagagtgcagctgccacatcggcaacgacagtgtgggcatcgcccatgcactagtaccctcagccatcctatgcagcgtgctccannnnnnnnnnccagagtgcagctgcaacatcggcaacgacagtgtggacatcgcccatgcactcgcaccctcagccatcctatgcagcgtgctccacaagagggcactcaccaaggtcgtgattcccagtgatgagagcgaccgggaggtcgaagcctgccaaccagtcccggcaacgctggaagcacgccagtgagcctggctggtggtgatatccacccacatccccgagctgtatcaagccagcttggcaggcagtgccgccccccagcttggcctgttgggactctaagactgtcacaagttgatccttggcctcctcgaacagtctcatctgtctgtccggtgacaggtgcaggtcccccagtatgcccagggtgaagttgggagcctggctgcatggcgtgtgcagggatgcaggcgggatctcgatcatagccatgcgctcccacctctatagatgtccatattacatgcccgcccacaccctttcgtgccccatgtaatgccacaccttgccagctcggcgatgctcctgtagccatggctagccgagtacgacattcccctccgattcgctctaccacttcctcgtccaaggaacctcaagctgcttgtgccatgctcagttttccgcaacgattgtgtgccgaaaataatactctgaacaggaccgcagggcattggtgagcttcaaggtgaaccgacctgtgtggggcccgcaacgaggcggacacccagaggtggagcgccctgccctctttgttgccacctcagtttctgaaagataccctttgcagcagcattatgatgcatgccttgagtcaacatgtacgaaatgggtctgcatgagggacgaagcaggctcctctttccctgctcgtgctgcgcatgggttgtgcgtgaaagggtgcctggagaacgaccttagaaaaggaagctctgtcctaccaacaggaaagtgtcaagccaggggctgggtatgcaggccaatataaagctctttctgtccaagatcctttgcatctcgagtggagcgatggtatgggagcaaatcatgatgctaggaagtaccaggcagagcaagctgataaggaagtgtgtcctggcagcaaggttccaaggcacacaccattcgctttgcccatgcactttgtgatacacctagcagcacgcctcattgtaacaagatagaatgcgctcaagcttttcattctgggtatcctgcatggtcacgagactgacacctgatagcccacttcagcccatcaaacgccgttcctccaagtgtaaatgctgcaaatgattctcctgctccatcatgcggcgctccagtgcatcatgcgcgcgtgctgcttgcagagcctgctgccctctgatctggtcgggattgactgatgataccttaatcctgtgcagtttggggtttgaaagcggttcagggggtggtcagggcgctcnnnnnnnnnnataatcctgtgcagtttgggggttcaaaagcggttcagggggtggtcagggcgctcagtgctcgttggcaagtggcttccagcatggctgacctagcaaccaaatgcatgcccatttggcgcgggctcagtttcaagataggactcggaatttgatctccccagggatgatcacagatcaggactgccatggcctcccagacagcnnnnnnnnnntaggataggactcggaatctgatctccccagttatgatcacggatcaggactgccatggcctcccagacagcactcccctgcccactacccgcctggagcccggggtgatgctgaaggctgccagctggcgtccgaggtgcgcactgatgtcctcgtgcccctcgccggtctccaggaccagcctctgtgctgccgcagggacgcccatcagtcgctcgatgagcgcccgcagcctctgcaccgtcagcgactctgcgttgggaggcggtgcgggagtcggatcgcagggtgcaggcggcaggatctgacccccggctgtttcccatcgcagcgtgcagctcttggttgcctatgaaactatctagacaccgatgggcccgcattcatccgacttcctccaccgacaagcagcacctggcaggcgcttgatgaccacacgctcttcatggtgcagggcgatctccaggagccggctggaccctggcccagtccccctggaagccagggcaggggcaggggcccccagtgcttgcagcagagcggggtagcgggggtggcaggcgagcacgccctctttatcctgcgggctcgcagccagctcatctgatgagcagggcgggggagggcgatgaccctgtgctcatcaggcatgggccaggcagaggtgcagcgcctcatcacacagggcgtcggccaacccctgcctccgacaacttcagccgcattcagggccctcaactcttcccccgtcgccaccccaccagtgactttacggaggtaccacagctcagcatccctccgctcctcagccgccacctggctgccgttgagctgcaccaggccccccagtcgggcgatggtctgggctcgtgcggtggcgggggcccgagtccacaggggcgtgtcagtcaggcgaaggctggccagcgctggcaggccgtccagggcctgaacttggctccagctggacacgcgggtgccgcccaggagtagcgtacgcagcgtgcggaagccaggggggcagggcactgcgcagtcgctgtcgtcgccactgctgccccaggggttacccgtgaggttgagggtttggagcgacgggagggtggccagggctgccacctgccgccagctggcaaggaggttcccgctcaggtctagggactccagagcagggaaggtggccgtcaggtcgcactcgcccatctcagcagggctcacgtcctccacgctctcgtcgcagaggcacagcgcggcgagggagggcagagagcgaccgatccgcagcgcgcccccccagcctacccccgtgctggacagaaccagggtccgcagggcagggaggggcggcgggggcggcagggcggggg

SEQ ID NO: 39600 - DNA, 61 bp, Chlorella protothecoides
tcttttaacggaccttttccatcaataggggtacctaaaccatctaatacacggcctaata

SEQ ID NO: 39601 - DNA, 69 bp, Chlorella protothecoides
gatgaccgtgcaaggacgcggcaggaccggcggggcacaagctcgtcggtctgaaaacagtgcgtatgt

SEQ ID NO: 39602 - DNA, 77 bp, Chlorella protothecoides
caacgaggagcaacatcgaaggagcaacatcgaagaagcaactttgaattaccaagaaaccgagtcgaagatgagtg

SEQ ID NO: 39603 - DNA, 78 bp, Chlorella protothecoides
tgtgacccagcatccaatcagggtcaagaacctcattattattttttatttctgccttatcgtagtactctatctgtg

SEQ ID NO: 39604 - DNA, 61 bp, Chlorella protothecoides
cgactgtgcaacacgggtggtcacggactctagatgcatggcatcacgtcgtcatcctcca

SEQ ID NO: 39605 - DNA, 74 bp, Chlorella protothecoides
cccttccagcgcaacacctcttgcatccacagggcaggtgaatacagtggtgtgagtggtattggcccttgcac

SEQ ID NO: 39606 - DNA, 108 bp, Chlorella protothecoides
ctgtcgcccgccgcttgcgaggccggccacgcttcccgcccaggtccccctcctgaggatcgccgtccgcacccacatcgcgcatctgagtgtgggcccctgtagtag

SEQ ID NO: 39607 - DNA, 61 bp, Chlorella protothecoides
tagaacctttgcatccaggtacctagatttggaagggacagaggtggttttggaggtttac

SEQ ID NO: 39608 - DNA, 76 bp, Chlorella protothecoides
cctggaggaggagcagggcccgctgcaggccggcgacggcgattttgggcacggcggcgccaactgcacggcctgc

SEQ ID NO: 39609 - DNA, 61 bp, Chlorella protothecoides
gcacggcggcgccaactgcacggcctgcccaccgggctgggccagcagcacgctgaacgcc

SEQ ID NO: 39610 - DNA, 61 bp, Chlorella protothecoides
aactagataccggcagatggtgacgagagggccaccttcgtatcgggcgtgagacgctact

SEQ ID NO: 39611 - DNA, 97 bp, Chlorella protothecoides
ggccttgcgcgacgtgtcgccgccggggcgcggggctgcagcctctgcgctacacctctgcctgcgcaacctggtgggcggcgtggggccgctggcg

SEQ ID NO: 39612 - DNA, 61 bp, Chlorella protothecoides
ccccccccccccccccccccccccccctcgaaaaaaacacttcatgcgcgcagtacgggcg

SEQ ID NO: 39613 - DNA, 66 bp, Chlorella protothecoides
gggcgtgatgggagaatgggcgagggggcccgttgggggtgcatgggagggtgtgggaggctaggg

SEQ ID NO: 39614 - DNA, 73 bp, Chlorella protothecoides
gagcaccgcgcggtgcatgaccgcgtggtggccgacgccgccgccgtgctcgccgagctccaggactggcagg

SEQ ID NO: 39615 - DNA, 61 bp, Chlorella protothecoides
gtcacgggcgaccgtgggctgtgcggcggggacaacgccatcgtcatcaaggtgggtggag

SEQ ID NO: 39616 - DNA, 136 bp, Chlorella protothecoides
tgtcctcatcgatgaggtggagagcctgacggcagccaggttggcatgggtcctgggtgaggggggtgggggtggccgggtaacatcgctgtaacaatctgggacgagggtggaagcattgctgcttggacacact

SEQ ID NO: 39617 - DNA, 74 bp, Chlorella protothecoides
ctgaacacctggcctccagcccgctgccgcatcttcagggggggctcaacaccccaaatcagagcttgcatccc

SEQ ID NO: 39618 - DNA, 155 bp, Chlorella protothecoides
gggagtctgcgtacaggatggggtgcctgggttggattcagcccatcgctgcgacgttcccgattcccacgaccagcgggctcccaagcgctgatcccccgtcaacctcctcgtccccaccggcaatcgcaggcggaggccgcgtccctgctcca

SEQ ID NO: 39619 - DNA, 101 bp, Chlorella protothecoides
ccccccccctccccccccccccccccccccagttcagcaatgtaacccccgcttccgcccccaaaacagcgaaatcgcctcacaaccccatccaccccttg

SEQ ID NO: 39620 - DNA, 137 bp, Chlorella protothecoides
ggggaaggggccagcgtgcgccttgggcacgaagacccgccaggcagctggcccccctcggacccctccccagacctcgggcgccggcgccccggcaatgggggcgggggggggcccattcgcgtcccatacggaac

SEQ ID NO: 39621 - DNA, 61 bp, Chlorella protothecoides
gcggcggcggtacccgcaggtctacgacacacaggaccgcctggtgctggacctgcaggcg

SEQ ID NO: 39622 - DNA, 61 bp, Chlorella protothecoides
ccgggcccggtcccagtatatttatggctaaagccaagccgcgacgcagctttcttcaggt

SEQ ID NO: 39623 - DNA, 61 bp, Chlorella protothecoides
cgctgtcgagcatgtgaggacaagggtcgcacccctgccatggccggggaggactgggccg

SEQ ID NO: 39624 - DNA, 78 bp, Chlorella protothecoides
gtgaatgcaccccaccctcgtttgcgcagcagcgatgcaaaagcttgcaaagcttgccgttcatcgctctgcaaccgc

SEQ ID NO: 39625 - DNA, 62 bp, Chlorella protothecoides
gtgggtggcggtggcggggtggggcgcagtaaagcccccaagagcctcactcccgcaccgat

SEQ ID NO: 39626 - DNA, 114 bp, Chlorella protothecoides
gcatcgtgttggcaatgggcctgactggcatgcggcgggatggcgtgcacccgcgacacatgatacccagggcaagacaccccacacacacacaccttcgcaacacatccctcc

SEQ ID NO: 39627 - DNA, 423 bp, Chlorella protothecoides
  modified_base (117)..(340): a, c, t, g, unknown or other
tgctggtctgggatcatgccgagcgggggaggcgagggcatgatgcccgctctccgccccccggcctcttgggagccccctgtacacctactcacgcctgggtgacggaggtggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccctggctgtcatgaattgtgcaatcggctgggccaggggcgggggaaccaggcaataccgaactgtgagggtgccacc

SEQ ID NO: 39628 - DNA, 79 bp, Chlorella protothecoides
cctgcaaaggcctcctgctccagcttgccccagttccaaggggcgttgtccttgagcagctcggtcagggggtgcgcca

SEQ ID NO: 39629 - DNA, 97 bp, Chlorella protothecoides
tgagcaaagactaagcaggagactgtttcaaaaagggacaccgggaagaaagtgtgaggcttgcaccgaggatcttcatgctgctctcctgctctcc

SEQ ID NO: 39630 - DNA, 62 bp, Chlorella protothecoides
ccgctcccttccccgtgcacgtcgaactggatgtggacggctttgccctgcgcttcgcccac

SEQ ID NO: 39631 - DNA, 61 bp, Chlorella protothecoides
gtgtgcattaccatggggtggacttgaaacaccccttcaccaacctgcgagccaaaaattt

SEQ ID NO: 39632 - DNA, 61 bp, Chlorella protothecoides
ccaacctgctcatgctggtcaagtgcttttgtgagaatgcaccacgtccaacagcttttgg

SEQ ID NO: 39633 - DNA, 72 bp, Chlorella protothecoides
gaccagagttcaatggacctacacaaggggtatgccaggcattgtgctgctcagcacccaggctcgcctgga

SEQ ID NO: 39634 - DNA, 78 bp, Chlorella protothecoides
tgaggagcacgttcgaggatgattgggggaaacagcaatatatactcccttgctacacgccgaggatacttactgcac

SEQ ID NO: 39635 - DNA, 61 bp, Chlorella protothecoides
tcccatgtcgaacctcgtcatgcgcgagtggacagagcacccctcggctgcaccgatccct

SEQ ID NO: 39636 - DNA, 138 bp, Chlorella protothecoides
ccctccaccggcatctacggtgagaaggctaggggctgctagattgagggtgggaggggttgtgccaggaatccatgggcctacctgcgccaggcttgcgaggctggatggtcctcgtgtcatgcttggggagcgact

SEQ ID NO: 39637 - DNA, 61 bp, Chlorella protothecoides
tccccatcttgaagcaggctgtcacaatagcgtgcttgattagtcggtggactggcgagag

SEQ ID NO: 39638 - DNA, 6019 bp, Chlorella protothecoides
  modified_base (137)..(216): a, c, t, g, unknown or other
gccttccgccggcgctccgacgagcggcggtccagcgccgctgcgcacgccatcacgctgggcgcgctgggcgtaaatgtgagctgctgttttgcgggggtggggcattgaggagggggtgtggcagggggaggggnnnnnnnnnnnnnnnnnnnnnnnnnnnnnnnnnnnnnnnnnnnnnnnnnnnnnnnnnnnnnnnnnnnnnnnnnnnnnnnntgtgggcatacgctcacctctgggcgtagcagtcgctgcgtgaggcggtgccggtcttctcagcgcagccactgacgcccagcggcaggtcgcgtctcttacctccacagtctctctttccaattcaacccaggctgctctggagcagggcctccccctgaaggagccgctgggcatgctggggtccgctgccgccgatgaccgcctcgtggctgccacgctggcggcggtgagtcaaaggggagggattgagtggctttgggcccaccgcacgagcatgcttggaggagagttttggccacaaccctgctcgttatggcatgcagtgggcgtcgcagaggcttttggcgactcttttggaggcatgaaccccgtcctgttgagagtgaatgtgtgacagcacaaggcgtgcatggcttcgcctggtcccagtcacccgtctccagtgcgcgccatgccccctcccctgcacagctgcctgcggatggcgccccactgcccacgcgcacccagctggcggaggagcttgcgaaggtggaaagcaccgccaaagagctgggcttcctgcccgcagagggcgggggccccctcacccttgccgtggcaaagctcgcagccaaactcaaggtgcgtatcctggggtggggggatgtggtgtccaagacgtccatgggtagaaaggagggatacgcggaggctggacgctcacctgtgcatcatcctttgcgtcacactgcacctgctgcagcgccgcccgaccctgaccccttccgcaatctcggcaggtgtcggagcgcggaacaccccaggcgggggcgtcctcctcccccaccctggaccaggccctggcgcgcgccagggacgagctggccaaggggcgcctcacccacgctgcggctgccctggagagcgccgccggtggaacagcagcggggcccctggtacaggcctgggtgtccgatgcgcggcggcgtgccgtggtggagcagggcgccaggctcttgggcgcccatgcagctgcgatatccgcgtcgctgacctgagggtgactgctgtgtccatgcccactgtcttgctcagggcagaacagcatgcgcccagcagcgtgaccaaagatggtaagctttgctcctcacagaggatgtctgttgctgcataatatcttgaaacgaagcgccccgcgagaggctgtggagttatcagagcaaaggcaggatgaggttcgcagacggatatccaaaacgaacaccattctacatgccttttttccgaatcatattaagctggataaccctcccctccatggttcgttcataccatccagaacacatccgatcccattagacctcggcaattaagctggattgggcgggaatagtactgcggtgggggaccacgtgggaagtccccgtgacgaactgttttttgctgacatttggtcgtttcgatgaatgaaagtgtttcagcagacacgtatctagacatcggaccagcaatggagagcacaccattttggtcgcactggtaggggcatggtgcgctctaacacggtcggtgccggaatttcaccatgttcgtcagtcgcatggctcaggccgggaacgctgcccacgcagtgacttccacacatcgccagcactgggaatcctcctccaccaccaggccctggccctgcctgagctcagcttctcctcaggcacattgccagcaccagactccgccacatttccggctttgatcccctcctcagttgcagcacacggctccctctccttaccatcagaactctcggagcctgatgctgcatgaccaggagattccgctgctgtcgttccttgaccctcctttcctcggcttaccaggcctctggctgcagccagcgccctgtctgtccaggccccagccgctgccaccgagccactcacagccgcctggccagcttctcccgccccagccaccacctgcctgacgtgcgacactctgcgacccacttggctccccgtgtcatccagggcgctgctgacgcggtgcttggtgcgatgccacacgccccgcgtccattcacgcatcgtgggccgacgaagtgcccaaatgccaactcctggtagattgaggaggaagggtatccagggatctacgagcggcaacaaagcgagaagcagaggtagcaaagctcttcctccacaggggtccaagaggcactcgctcagtcagacacgtttatatcatataccagctcacagcccctcgcttccacgtacctgccctggccgcctcagactctgccatatccaggcggtgcatgcgggcccatccaacatccagccagtcgaggtctattggctgcatcatcacgccgcttccctgtgccaaacgcacccagccgtcagaaggtaaacgtcaaagaaggtatccttccccgtgtctacgcgatgggggagagctgcatccgcaccagactccatcccctgctcagttgctcacctgtcgcagcagctcctcacagacatccacacgccgaaagttcaagattgacgcaaggcctgttttcggtgtgcgagcccacagctcaacccataccatgtctggcttggtgtcttgtctgggtcggtgtctggaagagtccggctccagggatatgtaccctagctcattccttgaccctgcacaggtcgatgcctcaccaagctcctcatcccccgcctgaagatgaggttgactagcctcctcagtctccggggcagcgttcgagatggaatatctgctctctgcaccactctctgcctctacactgccagccaagccacgcgtcagctgcctgagaggcatgctggctgcattgccctcccccgtccacgactgctcagcatgtggtgtcagggagaggaggcgtagtttatggatgccatctctcggcaaggagtttagcaggctccagcctcccgcttgcgtctgcagcactcctgccaggtggcaagtcaggagaccgccctcctgggccatggattgcgcccacagatctggcgggatcctgtgcacggagcatttggaatgaacggagcttgaagaatagtggcgagataatgtactccctgagctgtgcttcatctcctgcacggtggttgaaggcaaccaggagacagatgcacgcagcacatcaatgtaccgaccgcaacactcacccacggtatcgagcgatcaggcgatggagcagagggaaatgtgcggcctggatctctacgagttctccatggggcgcggtgcgcatgatgacaacggggatgcgaggtgcagtgggaccccaagcccgggctgggatctgatgagcactggtgaaccttctccaaccggggatggacccgctgtgaagcaagaacgctatccctcctagcacatttggatgttgcaggcggaattggatttgcagggttgccttcgtgagtggatgttctcgtgagtacgagcagactttttgcacagtcacctgccacccttccgcaccggcacatgccatgaggctgctcaggcgcacagcggtgcgatgctggtccatccagctcactgtcagctccatatgagcagcgattttgcgtctgtacgcctcccaatcaaccttggcaggtgcatcggcaggcgcagtattagcctgcatgtcgaggggtctcgttgcatcgtcgaggggctcctcggcagacccagcgggtgaaagcatcgttatcgaatatatttaaagcatgatggtctcgtttgtgggtccgtaagcttggaccggagtcttaagcgatctgaacgtgcttaagcaagctgcggagcgtgctgcgggctatcgttgtccagctgggatctcgctcctgacctgcactcttcgccctcacgacctaaggagctggtcaggccgatcacatctgcaatctgtgatcggcgtgctcacgcgcctccactagatcgagccgtggtggtgcttccaggctgcgcatgctgaccactgcgtgacggggcccactggccagccagcctcatgtcggaggttcgtgcgctgctggagcgcctgagcgtggatggaggcgatgagaccgtgctggagtacgttgccagcgtggtcgaggaccccgattttgagtttgggcacgactgcgaggaggccatggacgccatcgcccccgtgctggtgagcctcggtgggcggtccacgtcgattttagatggtggaaggcaactgtagggggtggtgtcggcgatcagatgttacctgtgtcgccagcatctcctcatcgaaacactccttgccagggggacaccctgccgcctgcaggtgcggctgcatgtccaatgaccatgcctcaacccatcatccttcccttctttccaaggtggattccggttgcctgcccgacgatgcggccgtgctgcagctgtgccgctccctgcgcagcctgcttgggcgagaggaggccaacggcacgagtaatggcgccgccggccccggcccccacccgcgctccgacttccacgcgctggagcgcggccctgtgctgatgggggagctgggcgacgccgcgccgcacccctccgacctgctgtctggccgcgccctgatccaggggcggtaccaggagggggaggaggaggagttcacggtgatgcggcccaaggacgtgctgaagctgcgcaagcagaatgagcgcgcggagaaggtgcagcgcgcggccttcgcggtgcaccaggcccaggccctggcggccatgaagggcaagcgcgtgacggtgctgcgcaacgcgggcggcaccgccgtccgcgacatccacttggagcgcttctctgtgtccaacggcggcgcggacctgatcgacgacgccacgatcaccctggcccatgcgcacaagtacgggctggtggggcgcaacggcacggggaagaccaccttcctgcgcgcgctggcggagggcgagatcaagggcgtccccgccaactgccaggtcttgcacgtggagcaggaggtgatgggggacgaggtgtccgccctggacgccgtgctgtccaccgacctggagcgcgccgagctgctggccgaggagcaggtgctgctgcaggcgctggaggaggtgggcggcgcggccgacgcgggggagggcgagggcgccgcgcccgcgcgcgacgccacgccggaggaggaggggcgggtggccgagctggcggggcgcctggaggatgtcagcaagcgcctgctggagatcgacgcgtacggcgccgagagtcgggcggccagcatcctgtccggcctgtccttcaccaaggagatgatggtgagtgtcgtgtgttgcgcggggggggtggggggttatgttgaccttggggctggtggacagggggagttggggtacccagtgagttcagggacatggggtgaggcagggagatggaggggcgcacccatctgagggatcagggaacgccatccactcgaggcctgagtcccgtgcgagggctgctgttggaggaaagtgggcacgagagtgccgcacaccctgcctggcagatgtctcaagtgcatccttgagcagctcgagttgtcaagccgcgcctcatcaaccaaccaccctcgcccacaccccaggaccggcccacgcaagagttctccggcggctggcgaatgcgtgtggccctggcgcgtgcgctcttcgtggagcccgacctcctgctcctggacgagcccaccaaccacctggacctgcacgcagtgctgtggctgcaggactacctcatcaggcaagcacattttggcgggggagggggtgggtgggtg

SEQ ID NO: 39639 - DNA, 64 bp, Chlorella protothecoides
caaggtctggaccccggccacgggcttctgtttcgtcaccttccgcgaccacgccgcgcccgtc

SEQ ID NO: 39640 - DNA, 79 bp, Chlorella protothecoides
acagcccggcctctggccgcgcaatcatccagggtttgggaaggaggatccggtctagggcatacgggcctcgcagcgg

SEQ ID NO: 39641 - DNA, 61 bp, Chlorella protothecoides
aaaaccaccacaggtcgagctgaagactggtgagatcttccgaggggagctccacgacgcg

SEQ ID NO: 39642 - DNA, 104 bp, Chlorella protothecoides
cgcggagcaccgggacctgcgcgcacgtggcatgcggggtatcagcgtccagcagctcggacatacgcgtgtgatgaggatctgcaccgtgcctcatctccccc

SEQ ID NO: 39643 - DNA, 72 bp, Chlorella protothecoides
ggcgccggagtaattgctggtgggccacagcccggtgcaccatgagcagaatccagagattgtcaagtagca

SEQ ID NO: 39644 - DNA, 89 bp, Chlorella protothecoides
aggcgcaggaggagctggggctggaccccacctcggtccgcgtgctgggctgcttgggtcccgtcctttccaagcacctgctgtctgtg

SEQ ID NO: 39645 - DNA, 81 bp, Chlorella protothecoides
cttgaacgaggtcgatgaccctcgccacccctgagcccggcaatcaagccctcaccgccatttcatgcatgccgtgactgt

SEQ ID NO: 39646 - DNA, 61 bp, Chlorella protothecoides
gctacagagcacgccgcaccatgcacaacccaagctgcccttgggccataccttggctgcc

SEQ ID NO: 39647 - DNA, 73 bp, Chlorella protothecoides
gagggttgggtgttgtttcatgagcaattcaagtttagggagaataaggtcctcagatgatgtcatcctactc

SEQ ID NO: 39648 - DNA, 449 bp, Chlorella protothecoides
  modified_base (179)..(369): a, c, t, g, unknown or other
cctcacgctcgcgccagctgtgggacgcggggcgcctgcgcgcgggcgagcgcaacgcgctggccgagggcgtgctgctggcctccgcgggggggggccccgccgcgcaggccagcgtgctggagtgggtgctggcgcccgtgcggggcgcctgggcagagcccgggttccacgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcggcgcggcccagcgctgggccctctaccacgagctgcacctggtggagcgcgccgcgcggcggctggcgccggccg

SEQ ID NO: 39649 - DNA, 69 bp, Chlorella protothecoides
tgcagtggtgttttgccgtggcagatgcctgaatcactcctgcccatcacccacaccgaccccaagcac

SEQ ID NO: 39650 - DNA, 61 bp, Chlorella protothecoides
tctgctgcaacactccgcgtccgggggcgtacccaccagccggtccactacatgatgcacc

SEQ ID NO: 39651 - DNA, 61 bp, Chlorella protothecoides
ggccgcctctgccccccctctgaggtgtggggatgtcgcttttgggggctggtgaggagcc

SEQ ID NO: 39652 - DNA, 74 bp, Chlorella protothecoides
cgacgcgccgctcctccacaaagtccacgttctgggagtgcacaaacacgcgcttgggtggcagcttgagcctt

SEQ ID NO: 39653 - DNA, 61 bp, Chlorella protothecoides
gtaatgaccgacggcaggcggaccaaggggggcatcgacgtttctgggcgccgggcggcag

SEQ ID NO: 39654 - DNA, 823 bp, Chlorella protothecoides
  modified_base (205)..(214): a, c, t, g, unknown or other
  modified_base (711)..(720): a, c, t, g, unknown or other
cacccccacccccacccttccctccttcttgccccctgggcggcgcacctggctgtaggccgcgtctgaccccccgatcagcgtgttcccccggtactgggtctggtagcagggcagggtgacggagacccccggcaggttctccagcctgggattgagtgcgatgacgtcagcgagggacacgttgtactcctgggccaggtcnnnnnnnnnncctccctttcctccttctcgccaccctggcggcgtacctgtccatacccagcgtccgaacccccgatcagtgtatccccccggtatggggtctggtagcagggcaaggtgacggcaaccccgggcaggtttttcagcccagggttgagcgcgatgacgtctgtgagggacacgttgtactcctgggccaggtcgaagacgttggtggtgatctccgccgcgcccgtgtccgccgcggtgcaggtgcgcaggcacggccccaacgtgttggtgatggtggtgaccgcgccgggggtgaacaggtccagcgccatgagctggagcagggttgtgttgcccgcgaggatcgtggtcacgccgccgcagagcagttcgttgccggggcggacgtacaggctggaaccggtgtcggtgttgaaggcggagccggaccagaatttggaggggatggtgccagccaggttgttgttctgcagctgcatgaaggacagcgactcnnnnnnnnnnggtgttgcccgcgaggaccgtggtcacgctgccgcagagcaattggttgcccgggcggacgtacaggctggagccggtgtcggtgttgaaggcggagccggac

SEQ ID NO: 39655 - DNA, 72 bp, Chlorella protothecoides
ttggacgcgtgtggggcgcatgcattccaacagtctcagacctcaactgcccacccctactcgccttgagat

SEQ ID NO: 39656 - DNA, 61 bp, Chlorella protothecoides
tcaccgcctgtgcccattgagcgagagccaaaggcggacggatgcttgggcgggggagggt

SEQ ID NO: 39657 - DNA, 61 bp, Chlorella protothecoides
ccacaccggccacgacgaggacaccaggcactgcccccgtctgtcttcctgggtgatggac

SEQ ID NO: 39658 - DNA, 31673 bp, Chlorella protothecoides
  modified_base (1440)..(1449): a, c, t, g, unknown or other
  modified_base (3380)..(3389): a, c, t, g, unknown or other
  modified_base (4190)..(4369): a, c, t, g, unknown or other
  modified_base (4481)..(4490): a, c, t, g, unknown or other
  modified_base (4552)..(4561): a, c, t, g, unknown or other
  modified_base (5700)..(5709): a, c, t, g, unknown or other
  modified_base (5951)..(5960): a, c, t, g, unknown or other
  modified_base (6471)..(6480): a, c, t, g, unknown or other
  modified_base (6774)..(6783): a, c, t, g, unknown or other
  modified_base (7488)..(7497): a, c, t, g, unknown or other
  modified_base (7579)..(7588): a, c, t, g, unknown or other
  modified_base (8996)..(9005): a, c, t, g, unknown or other
  modified_base (9383)..(9392): a, c, t, g, unknown or other
  modified_base (9471)..(9480): a, c, t, g, unknown or other
  modified_base (9543)..(9552): a, c, t, g, unknown or other
  modified_base (9870)..(9879): a, c, t, g, unknown or other
  modified_base (10585)..(10594): a, c, t, g, unknown or other
  modified_base (11053)..(11062): a, c, t, g, unknown or other
  modified_base (12250)..(12259): a, c, t, g, unknown or other
  modified_base (12406)..(12415): a, c, t, g, unknown or other
  modified_base (12568)..(12577): a, c, t, g, unknown or other
  modified_base (14733)..(14742): a, c, t, g, unknown or other
  modified_base (14798)..(14807): a, c, t, g, unknown or other
  modified_base (15661)..(15670): a, c, t, g, unknown or other
  modified_base (16054)..(16063): a, c, t, g, unknown or other
  modified_base (16745)..(16754): a, c, t, g, unknown or other
  modified_base (18170)..(18179): a, c, t, g, unknown or other
  modified_base (18441)..(18450): a, c, t, g, unknown or other
  modified_base (18964)..(18973): a, c, t, g, unknown or other
  modified_base (19728)..(19737): a, c, t, g, unknown or other
  modified_base (20704)..(20713): a, c, t, g, unknown or other
  modified_base (23974)..(23983): a, c, t, g, unknown or other
  modified_base (24499)..(24508): a, c, t, g, unknown or other
  modified_base (25208)..(25217): a, c, t, g, unknown or other
  modified_base (26212)..(26221): a, c, t, g, unknown or other
  modified_base (26593)..(26602): a, c, t, g, unknown or other
  modified_base (27152)..(27161): a, c, t, g, unknown or other
  modified_base (27574)..(27583): a, c, t, g, unknown or other
  modified_base (28596)..(28605): a, c, t, g, unknown or other
  modified_base (29007)..(29016): a, c, t, g, unknown or other
  modified_base (29775)..(29784): a, c, t, g, unknown or other
  modified_base (30102)..(30111): a, c, t, g, unknown or other
  modified_base (30330)..(30521): a, c, t, g, unknown or other
  modified_base (31187)..(31196): a, c, t, g, unknown or other
  modified_base (31399)..(31408): a, c, t, g, unknown or other
cctgccgcgcgcgccgcccgcgcccgccggcctggcgccgtccgacctcaacgtgcacggcgatgcggcgaccggccagctgggggaccacctggcgcagcactgggcgccgggggaggccggcgccgcgcgcgcgctggccgggtttgcggccacaggcctgcccggcttcagcgtggaccgcgccaagggcgaccggccctccacctcccacctctccccccacctgcactacggcgaggtcagcgcgcgccaggtgttcgcggcggcggtgggcgcgggcgaggcgcggcgcgcgccggactcgctgcatgccttcctgcgccagctggccttccgcgagtatgggcggtacctcgccttccactaccccttcactctggaccagcccatgctggggcatctgcaggccatgccctggcactacgacgtggagctgttcaaggtggaggagggagggggggtgggagcaggctggaggggtgtgagtggggagagggacatgtcgagcagtcttcattttttacaaagtgccaaagcgcacagaaggagtgagagcttgcctgtttctcagggggatatgacgttcggcagtgccgtgcttgtcccctggcgctcgtaccctgtcgctcttgcactgccctgcagcttccatctcgtcgcagttccctttcctccattgcaacccctcccccccctaaaaaacaaacccactctacacaggcctggaagcggggccagacggggtaccccgtggtggacgccagcatgcgccagctctggtccacgggctggatccaccaccgcggccgcgtggtctgcgcctccttccttgtgaagaacctgctgctgccctggcagtggggcctgaagcacttttgggacaccctcatcgacgccgacctggagtccgacagcctgggctggcagtactgcgccggctgcctgcgcgatggccatgccctgtcccacatggtggacctggcagaggaggccgcgcggtacgaccccggcggcgcccacgtccggcgctggatacccaccctggcacgcctgcccaactcccacatccactcgccctggaccgcgtccccagacctgctggcggccgcaggtgggcgatgagagagggggaaagggggggggggtgtcctctgagccactagcactgacaggggggggggaaaggacccttgacattcaaggagggagggtgggattggggatgggaggtgggcatggaatggagtggggggtcgcaggtgcaggacaaagctgcgtgggcttgtggcagggaccgtctctgacccctcgcccctgggtgtgatgcccttccacatcgcgagaaactcaagccccacacatgacccctgcccctccctgctcccccatcgtcaggcatccagctgggggaggactaccccttcccagtgctggacnnnnnnnnnngcacctgggtgtgatgcccttccacatcgccaaaaactcaagccccaaacatgacccctgttcctccctgctctcccctcgtcaggcatccagctaggggaggactaccccttcccagtgctggacatgcccagcatgcgcagcacgctggatgcggccgccaaggccatggacgaggccgcggcggaggaggcggcggcggagggcgggcggcggcccagccaggggcccttccgcccgtccacgcggcgcccagacctcaccacctgctcggccctccccgcttttgccgggtgagcagtctgttttgtgtggtggggcgggtggtaggtgtgcggtgatcaagagacgagcgtgatgtggttggtgcaacagtcctgtgccatggtgctgtgggtgacacccgcgacacaatgcttttgggtagggcgtggctcgtgtgcccatgcatgtggtgctctctctgagtttgtcagggaggtcccaaagcccatgggccacaaccattcctcacgcacgcactgccttcttccgtccagggcccagcactccatagggaccgtcatgaacagcctagacaaccaggccagtttctcagtgacagtcgactcctcagatggtgttgcaacggagctgggcgccgccaccgctggttgccagctttcggatggcacccagtagcccacacatactcttcattaggtacagatacagtcacctctccattttaccagggaggggtctcagacacccctatagacttcccttctgaatgctctacggctttcttgagacttgttgtatgctttgacagggttttgactttggagcatggccgtgctcccaccttcacacatccctccggcaatactgccgccggtcccgcgcactgggctctttagcacaatgtgccagaaatctggcatgcgggcgccaacgctgtgagttttgcaaccttataccgtctttcatgatcaagcggggctggtcgactggtcatgtcgaggtgctggtccccgacatgcactggccactgattcgtcattggcgtacgcctctcgcacgcacaactcacgccagacaaaggtcgcgcaccgcccaatccttgaattgcaatcatctttcagtggcccctaaacatcgatggatgtccagtcaacgactcattcgaaggcagtggtgacccttagagcgacagtcacgggggccgttgcggactctgtcattggcgctactgctctgcggttgtagccagaatggctctatcacgagctatgcgaccggaagtccaactcgcgagtccctcctgccggaatgcgggcatggacggaggtcacagctcaggctgcatgcaccgggacgcgttcttccgggcgtcgacctccagcgcggctcctgcacatgcacgacgaccgactgtgcccagcctgagccggtgagtagacgaaactcagtaccatccggctgcgaatgtcattggcagctggacgtggccgcatgtcctgtgccttgttgccatcgtcccggctccggggtggtgggcagtcggatgtctggtcccaggtcgtgaacagggccccctcccctcccatgcagcccctcgcggtgccacgccatggcgtgcagagccctccctcccgctcatgtggcgcagcagtccatgccgtccactcatccccttctggggacccgatggttccaggatgcggtacgggatgtggccaagcacgtgagcgagggcctgcccttcatggagctcgtccagctgcacggaccctgctccggcaaggccccccacttctcttcctttaaagtagaggacgacgtggtcagcgccccccaggtactggagggtggggatcacggggacgggctttgatgcatatcggcaggatcacctatggaggcccaggaaaatatcatggtttcgnnnnnnnnnnatggggatcacggggacgggctttgaagcatatgggcaggatcaccgatggaggcccaggaaaatatcatggtttcgccacagtcttcctgtgtcatttttcgccttggcgccgcaacaggcgccagacggcaacgttcatgatgacctgcactgcatccacccaatcgtgacctgaaaaagctccccttcccccctcatccttcagttgtggcgcagcatcgcggagtgcctgagcggggaggaccccgatgtggtcatgctctgcaagcgcgtggactccgccgcggatgtgggcggccaggcctcgccgtcctcggacacggtgacggaggtgaaacaggcctgccgcgcactggtgcgctccggcatcgcccacgccgtcatgcgcgggcgcgtcggcgactgctgcgaggaggactcgccctgggatgaccgtggcgcgggccccgggttctggtcccgacaccaccaccgcccccatggcaaggccgcacgcgttggccaggcgcaggaggtcaacttctggggcctggtggtgcagtcgcgcgcgcacacgggcgcagagggctgctacctgctcaagacggtgcgcaacgtggagccagccaccgactgctcctgcacgcactactccctgacccgcatctgccagggcgagggcctggagggccagttcgtcaagagctggctggctcggtcgtgaggcatgcccacagatggtcacctgctcaggcataccctaggatttttatcccatgttcccccttcataagactctcctgctcgtaccagcagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctccaacacagcattgcacaaggggcgtgagagggtgctcgatgcaggctggcaggccgcgaggcggcccggaggctgcgcgagtgtctggtgccagcggtgaggttggnnnnnnnnnntggcacggggggcaaaaactgggggtggttgggcacacgaagcaagcacgattgccatgcannnnnnnnnncgatggtcacctgctcaggcataccctaggttttttatcccacgttccccctttataagactctcctgctcgtaccagcagcacttgtacagccccctggcacgctcgatacatgctctgtgcccggcacaggtcggactgtaccttgtccctctttgccccgatggttttcccccctctgtgtacccagtttttccacttgcttcccgcttgagctcgagtgtgaatatctccaacacagcattgcacaaggggcgtgggtgggtgctcgatgcaggctggcagggcgcgaggcggcccggaggctgagcgagtgtctggtgccagcggtgaggttggtggcaatgcgacaagcagtggttctgaaggagcagtgttggacgcacccagatgtatcgagtcgtgggaggcatcacgaggggaccctaggcagttcggcgcaggattcagggaaggcaggggcaaggaccagcctcatcttttgggggcggagaggaattgcagggagcaggggggcatggggggcaaaaactgggtgtgatcaggcacacgaagcaagcacgattgccatgcaggtagccgtagagaagagagggagggcatcctcgtcgcagattctgcaccccctcttgagagtgccccctacccaaaaattttgtctgcgggagggagggttttgccaggggtggagtcaggtggctggcctgcaatggagcgcttgaggccggcagcttgccatgaacagcctcgctgccgctgcaagatgcagtgcgcacagatgggaacccccctgccttcccattccacctcccatcacccgcccctgcgcctcacatgtggaccagttgttgatgatgttgcgcgctgaggcgatggtggcggcggcactgatcagaaccatggatatctcgatggcgtacagcatgtggttgaaggcgccttggggtttgaacacgatgcgcctgtagggatgagggggagaagagaggtgaggatgtgggtgtaggggttgaggcagctttctggaccagccctcggtggccagggccaggtcactctgcgccagaatggctgctgcccacggtgtgaatccggcagggagtgctcattggcactgccctccgttgcggggggggggnnnnnnnnnntttggtggccagggccaggtcattctgcgccggaatggctgctgcccacgatgtgaatcagcagggagtgctcttcggcactaccctccgttgcaggggggggggcctgcgtggcttcactgcaagtctgcgatggccatgcgcgggactcctgggcctggctggcgccaccaagggttttctgcccccacccctcccatccctccccgaccggtgcacgcaccagcagcggatggggtagnnnnnnnnnncggctggcaccaccgagggtgttctgcccccaccccttccatccctccccgatcggtgcacgcaccagcagcggatggggtagaatacggagagggggaagaaggtgatggcgcccaccaggcctgccatgtcgctgaagaagggcatgatgcaggcaacgagggtggtgaagaagacataggccgagcggatagcgatgcgctgccaaaggggcaggtagtcatggtcggcgttgctgggcacctcctggttggcaaagccggtggacacgcggtacatggaggcggtggcggacaggcggtgcagtcgctccccggtcgaggcggagatgcggtgcagcctctcgcccgcggcggccgacacgcggcggagggcggtgggcggcccggctggggcgccggccccggggccagcggcgccgccgtcctcccccgggctggggcccccttgggcaggcttggcctgcgccgcctgcgccgcctcgccggcggggggcgcgtcctcggcgtnnnnnnnnnntgccccggggccagcggcactgccgtcctcccccggcccggggccctcttgggcaggcttggcctgcgccgcctccgccgccttgccggcggggggggcgtcctcggcgtcgtgcagggtgcgcctgcgccgcaggctccaggccttgatgtgggactcgatggtgtcaaacatgggctgcgagtacacctggaaggctgacaccatgtgcagcaggatgcctgtgtggggaaggtggggggaagggcaggtgagtactccaagggggggctgggggcgttgcggggagggggnnnnnnnnnnaggggagaagggcaggtgagtacttcaagggggggggctgggggcgttgcggggagggggtgcagcacgggtggccgtcccagcgagagggcttggagggagcgcagccgggtcgatgcccaggcccctttcgagagccccaccctggcaccgctcacagatgaatccaatcaggaccagccacttggggcccgggtaggcgtcgaagatgaatccggggacgtcgttgccgaatgccgagtagttggccacggccacggtgaagtagaaggcaaaggaggcggagatggagatgatggaggccggcttcatggtcttcacagccttggggggctgggaggcagggaggggagtgtggagaggggggtgggagggtgggcttcgtgtggtgtgggaggggcccggcgcagggggagggggcgtcccggagcgccgccgacgtcgaggcccggccagcgtggctggggagatgctgccagccgcccggcactgcagccttcctcctggcttcccccgcgacccacctggcgcagcgtgtcctggatctccagcaagatgacggcaaaggagtaggcaaaggcgatggcccccagcgagcccagcacgccaaaggccttgtccgccgggttggtcacgatgccgcccacggagcccaagcgcgcgccggctgcacgcgcgtggtgttggctggggactcagggtggnnnnnnnnnnacattcccgtgcatccacccacaggccttgcgagcatgctgggccctccccgcagcgaacccaggccccactcacagtactnnnnnnnnnncgctcacgatgccgcccacggagcccaagtgcgcgccagctgcacacgcgtggtgttggctggggactcagggtgggcggggccagggcgtcgcggcgaggtggtctggcatgctcgcatgcatggaccacccttgcgttcccgtgcatcaacccacaggcgttgcgagcatgctgggccctccctgcagcgaacccaggccccactcacagtacttgaggcccagggagagggctatgcaggagtagaagatggcggtgaagacgcccatggcggacacccaccaggccgactcgagggaggggacctgggacaggaacagctgcagggccccaaagatgagcaccatctgccagatggtgtcgaagcactgggtggagccgcgccaggcgcaggcgatctctgccaccgccttcatggaagtggccgccgaaatggtgtaggtgatgcacgtcagcaccatgttcaggcactggaatatggacacgccaacggcgctgtagtggccctgcaggttgtttgggcaggggggcgagagggaggagtgtcagagccctcctgggtggctgctcacccgcagctcccaactggctctgcacccaccatgatgctcttcacggcgctgtggtagcgaccatgctccacgccattaacctcgtaaatatcagccaggagcctgggcgatggtgggagggtgggaggggggtcgtgatgccgcggttggggttgctcacccgcccacgccacccaggaacatccggagcctggggccccgggccggctgcgcacatgctggtcagaagcgagatgaggtagaacacgatgatcatgaggggccccgcaatccatccaaggtaggcaacagaacgcggaagagccagtacaccagctcctgcgaagcggtacgggaggggggcgagagtgggaggcctgagtcggcaagcgtagccggcactcacacatcctagattctctctccaggcgacttgccactcacctacaaccccgcaaaaaatgtgtatggccgctgttgtgcgcgttcctgcgcggagaggggacgcagagtgggtgcagcctgcaaccctcgtcgagtcgcaaggcaccgcggcgaatgcccgcagacacacgcactcaaggaatcagccacgtccgtaccggtcttttcatttggtatgccattgggatgggcgtccagctctatcgaattcttcgtcattttttcgtgagggtccgtgccaccccgacgcccgactggttaccccggtaggtgttgtgagctcagaccgcccttgaagtactctgatagcgcaagtgtcggcacacaaaagcaattgatgcaccgtgagtctggtggcgtggatttacgccaaggagggtgctcgcggaattggacgccgcgggcgaccannnnnnnnnngttcttcgtcattttttcgagagggtccgtaccaccccgacgcccgacgggtcaccccggtgggtgttgtgagctcagaccgcccttaaagtactctgatagcgcaagcgtcggcacacaaaagcacttgatgcaccgtgagtttggtggcgtggacttacgccaaggagggcgctcgcggaattggacgccgcgggcgaccagcaagccctccatcaaaaccgcgcgatcgtcccggtgccggtgtggaggtccaagtcccttcacaaaacctggggatacgcaaggcaaatgtccaccagattagaccaatattgttcaaattatacatctgataattcggaatggctctcggtctggtgcaccatcagaggacannnnnnnnnntatcgaaaccgcgcgattgtcccggtgtcggtgtggaggtccaagtctcttcacaaaacctggggatacgcaaggcaannnnnnnnnnatcgcacctatgggagaattctcccgattcacgcgcgcggggccgtccggacgtcctccacgnnnnnnnnnngtcgcacctctgggagaattctcttgattcatgcgcgcggggccgtccggacgtcctccacgtggcgagaggtgtcccaagaatggggcggtatgcagaccaaagtgcatcacaggaaacagccttggaggagcattaaatcttcatatcttcctgtatgttgtatagatcacgcgtcagactcccatctaggctgcatcaccttccctgcttgcgcatcgatgatcacatgctggcaaccctgcatagcatgtatacaaccttggatccctctcggtcatgaaccttgcagagaccctgtgagcagttgaatttaannnnnnnnnngtatcttcctgtatgttgtatagatctcgcgtcagactcccatctaggctgcagcacctcccctgcttgctcatcgatgatcacatgctggcaaccctgcatagcatttatacaaccttggatccatctccgtcatgaaacctgcagagaccctgtgagcagttgaatttaagattgaaattatcgttggttgagagatcagttttcgaatctgggagagcaaaggaaaacagaccaagtctcgcttctccaaccccacgttactttcatcttggaattcgctgagaatcaatccctgatcatcaagcctcactgttgcagcgagtcagacacatgactctgctgcggcttcaaagaatttcccacatgcgcaccaggtgatcgtcatgtcccctattccctctcaaggcgaggatcagacagccaattatacattctatcgtgtgtgtggtgttgaggcttgaggacgtctcgagtctgggtgaaatcgaccgcaaaggatcgcctcagatctcacgcaatgtgctggtcaggacaattcttcaagtcgatcacacgatggaagaggtactcaagaagactgctcggcaagatatccggtgagtcttcctatcgttttgctggctagagtatttccctccccagggctataccagcttgcccttggaaaccccatcccatgctgctgaagatttacttcatgttnnnnnnnnnnctcttcaagtcgatcacacaatggaagaggtactcaagaagactgcttgccaagatatccggtgagtcttcccttcgttttgctggccagagtatctccttctccaggctatcccagcttgcccttggaaaccccgtcccatgctgctgaagatttacttcatgttggcgccatcatggagagagtgtcttccggggactacatgtcgggccttggagccgcgaagggtgcttgataatgaatcatagtggcattacacatgcactcatgacatcgcgcggctgccctccaaagtccctcatgacaaggcgtggtcgaccttgacagcacggaccagcgaaagggcactcctagcggtgttcccagcggtgagcgtgcaatccatttgggcccgagaagctgctttttgccgccttgccaagcttttaggatgctttctgctctgctttgcttgcaggnnnnnnnnnntttttgccgcctttacaagctttttggatgctttctgctctgctttgcttgcaggacactcccatgcagtgtctacaccgcaaccccttgtcgcggccggatctccgctttcggaatcggaggatggaggccgaattcgtgaatgatccggcgtccagttgtcgccgcctcgccaccctcaccagcatcatcagcatctgcctgtccattgggtgcacggtgcgcgcaggggagtgccggcggtggcaggaccaagaggccgaggctcccagtagggcccaggtccccgcctcctggacaccccgcgggtcagcgccacaaatgccccgcccgccccccccgcattccctggcacaggtcttactacagggctggaagaggtaccttcagtgtgcttgcgtcatcctcgaggtaggggccttccgtacagattcgggatcaggttgtgtggggcccctagcctcggcccttggctgcccttccgtaccggggtggcgtggacgggtgtcgccgaacgccagcggcacccgagacagaatccaaccggatatcgtcagccctcctgggcctcctcatccgtcgtcgtcctcgcacccgcagtccggcctggagctgctggcccggtgccccccctcccccgcctccacaggcctgcgcctatggctcggccacgccctccgactggggttcctgttggtgctgggcctccacgtgtccatccccaccccctatacctactctggcccccaccctagcctgcaagccctgcgctgggcggcggtgtgctcgcgcgcccccctcttggcctgggccgccctgggccaggcacccctcctgcatcagcgcctgctcagcctccccctggtcctcgctgcggccctgcttgcatcgcccggctgcacttgcctggaggctggcgcggaggtgctgcgagggggatcgggctggatagggtcggaccttgccttcctcctggcgaggacgggcatgggggccgggctggagggcgtgcagcttgctgccagggcccggccggcgcaagcgctctgtgtgaccctgcactgggcggcgctggtgtttggcgtgatcctgccgcagctggtctccctcagtgcaggtgttggtgaaggtgtggggtgccccaaaggagagggggtccagtttctgctcttgtttttccatgaggannnnnnnnnnagtggggtgccccaaaggagaggggtcccagtttctgctcttgtttttccatgaggaggggggaggtggcgcgcattagattgctatgcagggagggattgggagccgtcaactcaaggcatttggctcctggccgctgtatggccnnnnnnnnnnattaggtcgctatacagggagggattgggagccatcaactcgaggcatttggctcctggccgctgtatggcctggcgtcgtttaactcaaatacgcagacactcatttgatccctaccccggccgtgcagaggtccgggccaggaacagcttnnnnnnnnnncgcgtcgttgaactcaaatacgcagacactcatttggtccctacccggcccgtgcagaggtccgggccaggaacagcttcctgcggcgcaaggcgctgccaggcagggtgtgcccctccctctcctcgaccaccggggtggccctcctcatcccgcccctcaccgcgctgagctggatggcggtgatcgtcgctgcaggccctgcctctgcctgaccgtgatgcgtggaaagggccgtgacccatcgtgcccggagtcataccacacggagcccccgttcccttcacacacctcttcgtccatttttctctccttgcaccagggccccagctgccccacaaccacaaccccttcccattctttcggacccctccactggcttgagggcctgtcgcagggcagccattgtgctggccctcatcagacggtccccaccaccagccgacccagcttgtgctttagggtcttgccccgatgtttgactaagcctgtgtggtactgccccacccctccgatttcccccggctcggacatgtttcctcccctaccaggttgtccctaggcgcatggagttgccctcagcatcctgctcgcgccaccgaggtaccctcgccctctacagtcgccacggcgccttgctcatgaccgccgcagcccactggcggacggccaagagtccacctcatgtgagtgccctgtgcacacccattgatccgcgacgcatcaccgagctgcccccagacgtagttctcccttcttggcacacgccccttgatactcctcccgaaaatgccagctcagccctgttgaggcatgtgcaggcctacctaccttatatacaagtactggagacaactggaccccctgtggtggccccttgatcctcctgcccaagcccttcctgttgctgccatgcacgcttggcgcccgcccaggcctgcattctttttccccacctgcgacgcagattgtttatcagaagatatggcaatatccttgagagcctgggaagtgcctcagtacggaggaatcggatggtggatggcctgcaatgtgggtgctgtgtggggaggagcacactgggcagcgctgcagcaatcaactgtggaggcaggtggccccgggactcctggcggggcccggcgctgctgctggcaggtctgcggataaggtacagcctgagaatgtaggaatgggatacacgcccgttacgcatctgcgggtgggccggcagcccgagtgcgcgccgcctccctaagctccacggtgtacagcttttgcttctgtggaggaaggggcacgtggggtaaccaacgggtgggacactgccaggaagagctctgtgaagccaagcagtggggtggaaagacaggcaaggaacacgcggccccctttcctcccgcaggcatggctgatggggcccccagtcctacaaccagcgcacctccttcaaggtgttcagcaagccctccgagccaggtggcgggctcacactccccgacagcacatcctctgcagtccacccagcaccatacaccgattccatggacttggtgtccacaaacgttcgtagacctgtgttgagtttgggaagggggcgccagggtggacaacaaagagatcaaaccttgccagggctgctgtgcctgaggggctgaggaagggtttgacctggagtctttggaaaagatggcgatcaacgtctgccgccctttcaatgtggcagggagcgccacgatgctgagcccagagcaagcgacacctgccctctgattccacagcagggcctacccctgaatgactgagaactctcgtcagcacaccttccacactgagcatgttggcgatgacaccattcaccagattgtaggagaagaaggtcttgttctcgttgtgtccaaaggagaggtgggcgcccgccgactcgcccagcgcgcccgtgatgcaccctcccacgcccagcctgctcccggcaaatttcttcacctcctcaggggagtcgactatcacgcagcctgcaccagcgtggggtggacttgccgcgtgatagatcggcatgcgactgtgagatgtgggcaaaagacattgggaggggttgtgtgcatcgatgaggagagcaggagcgggcaagcaaagttgagggaacaaacggaaannnnnnnnnncgctggagacaacccccattcagatcttcacgtactgctgatggtggtgtagccgnnnnnnnnnnagtggggtggaattgccacgtgatagcttggcacgcgaatgtgagatgtgggcaaaagactttgggagggcttgtgtgcaccgatgaggagagcaggagccggcaagcaaagttgagggaacaaacggaaagctctcagatgaatcaacctcgccaaccaaagcagtgtcaacttcgtttgccattgcatgcaagatgtgagccgtcctccgcaattcgttcagtctttctatgctggagacaaaccccattcaaaacttcacgtactgctgatggtggtgtagccgacagagatgcctatccctcccgccttcactttgagaaagagcggggcgctccatttcgcgctggcctgggcatccgcggacgttatggccgggttgtccgtggcatgcttgtcgatgacctgagcagtcagggcggtgcagagagcatgatgctggggtcgatttccagggagcagggcctgctgcagcggccctggtcgcaagcctcctgtatggggcccccagtcatcaactgtgtgatggcccagccttgtgcatccctcctcaccttggaaaggatgaatccctgacctgaaccacctgtgatgcccaccccgacctgcagttgtgccagaggctcaaacgtgagtgcctctcaagcaggatgtttgacacgcatcagcactgcaacacatgcctcgtttgcactcgcctttttcaagaagaagaacgcgatgccagaagcaaagaataattccctgtgtgaggaagaggcgtcatgcccagcgtctctacaggctggaaactcgtgtgcacctcaacgactcgcagtgctcgctgcgcagcgctgtcagacttggtcatggnnnnnnnnnnttaggctgaaaactcgtatgcacctcaacgactcgcagtgctagctgcgcagcgctgtcagacttggtcatggcctgcagacccctctccagtgccatcaaaatgtagaaaagcaccctcagctcaccgtgaaggcattgcagctgcccctgtctgaagttcatcccgggagatcagcttgtcaatcacctcttcagccttcctgaacagctccgccacgccctggcatgaatgggaggagccatgcataggggaggacgtgggaggccaggacgggcaagccagacaggggggaattctctttccagtgtaaagtaatgtttcaatggtaccactgcctccatacctcctcgagtgcagcgtctgcgtccgtcatgtccaacnnnnnnnnnnaaggaaccatgcataggggaggacgtgggagcccaggacggacaagccagacagggttgaattccctttctagtgtaaagtaatgtttaaagggtaccactgcctccatacctcctcaagtgcagcgtctgcgtccgtcatgtccaacccgtgtcaagggggtaccctccgtttcgtggtgtaacccagtgggaagacccgcagggattgcgtagcgaagacttttcagagcattatacaggtcatcaaaggttgttgctgcacacgtatgcagcgatcgcgatgcgattcgcgcgagggggcccatgagctctcagctcatcgattacgtatgtctcggaggaatggaagggcaccacgaacaagggcatttcggatctcgctgttgtagctgcatctttcaacatctttgaactagcatcactgtcctatcaagcttcagtgtacattcaggggcacacccagcttgcatggcttcctcgcgcatgctcactttcaagctgtctccctccacaaggctgttcatccagcgggcggacctgacgaccttccgaggggatgcaatcgtcaacgcaggtgcctgatgtcccaacggaccccttgtgtcccatctgaattttctttcacagagtctgcagcgctctgtcagccgtggcatttgcccagacacaatgaaagcctnnnnnnnnnncgtcccaacggacccccttgtgtcccacctgtattttctttaatatgagtctgcagagctctgtcagctgtggcatttgcccagacacaatgaaagcctcaccaatcacttcccccccccatcatcccccctttccccgctcccagcgaacgagcggatgctggggggtggcggggtggacggcgccatccaccgcgccgcgggccccgacctcctgcgcgcctgccgggcagtggcggaggtccggccgggcgtgaggtgccccaccggtgaatgtcgcctgacggacgcgggcgcgctgcccgcccgccacgtcatccacaccgtgggccccgtctatgacggccccgccacgtcagcgcccctcctggcctccgcctaccgggcctgcctgtgcactgcgcgagacgccgggctggccagcatcgccttcccggccatttcctgtggcgtgtatgggtatccgctgcgggaggcggcgcgcatcgcgctcaacacgtgcagggaggaggcgggtgcggtgcgggaggtgcactttttcctcttcagcgagccaacgctggaggcgtggactgctggagccaaggagctagggctggaggaggaggggggctgagtactttgaccctggggcatccagtcagcgctaggatgttgtgtgacgcgagcgaatcgccaaaccgcacaccgcctgctctgcaccattttcctttgattcatcgcggcaggagctgtgcacacaagagctcggcgcgccaagtcatccctgatctggggtggaccccgggcttggctcgcctgtgagctcaagtagggggacagcgctgcagggcatgcaccgccggcacgagttcacatcgatgtgcgcaagaccctgcagcggtggcgcacaggctcgcatgggcctgcgggtgccgcaccggctcgatgcctccggtccctcgcatcaaaacagtctgagcttggggtcctccccggaaaacaagcgcttgtcctcggcgtgttccaccagctctaccttgtagtcagcatgcacctgcatggtgacagcgtcgtgcagtgggggaaagcgcgtcgcgattgccaagaatgggccagcagcagcacggagtggatgctccaccccgtgttgtgccgtgctgccttggacagccacaccccctggccccgccagtggctgacccagaggggggtgtcgcttcacccaccttgtccagggcagcatacagagacttgagaggggcgggcagctccaggtccccggtcagagccttggcctggtcgacgcccggcccgtatgcggccctcgcggcatcctcatccaggctcaggcacccacctgcacgtgtgccaggcttggtgagatggcgtgggcggcttggatgtgggcactggtggctgaatggggctcgctgnnnnnnnnnnaacgcccggcccgtatgcgaccctcgcggcatcctcatctaggctcaggcacccacctgcacatggggcaggcttggtgagatggcgagggtggcttggatttgggcactggtggctgaatggggctcgctggctccccggcgctgcctgtgcgaggtgccgccatggcatgccaagagctttggctgctcccctctttcctcaaaaggctggtacgccacgccaacccgcccgcacctctcaggctcaggtcgaccatgtnnnnnnnnnncttcctcacaaggctggtatgccacgcccacccgtccgcacctctcaggctcaggtcgaccatgtgcccctgcgcgatggagtatgacacaatgtctcgcatcgcggcggggctgccgaaggtggtgccggggcgctccgcggcatcagaggtgcccagggctgtgcgaatgtcggcgctgatgccaatcctgttgtgcaagggggggcaaggggagggggacttgggggattggccaaggccagggtgcaggtgggaggggggcatggtccacttcaaggcaggcatgtgagacgtcctgagagcccaggctgacgtcatttgtggtgaggcagcagacctcctgaccaggacggctcgacgcaggccccagtgtgcccactcactggaactccaggaggcccttgagggccgcctcagatttcaccacagatatgcctgcacagggtgtgtcggtgatgcgggctggcgcatcggaactgggatgcaagagcagactcgagcaccaactgcnnnnnnnnnncgtgtcggtgatgctggctggcgcatcgaaactgagatgcaagagcagactcgagcaccaactgctagagtgtccccatgctgccctttcacgggacctgcagagagcgcacccagccaggcactcactcttgatctcgctcactccgagggtgatacccaccccgcccgagcgaatcttcacgaacacaggggcagaccaggagtcctcgccgcccacacccgggagctgtggggagcacagggggtagtggacatgttggagggcatccaggccctgctttgagaagctggctttgtttctcagcatgcagccaacttgtggcagggactatgcggctcatgtcatgtcctgagatgcaccagagcaccggcagcgagcctggccttgacatcaccttggcaatgaggaagccgtgaccgtgctggatggaggcagcgatcccaacctgtgcgatgcatggccagcaattggtggggccaagggtgtcgagcgggttgtgaggtgccatctcgatgcaccaactcagaaggcacagatcatggcagagcggggtgctgcctccacatcctgccaagaagacacaccttcttactaagcatgaagaggagccccttggctttgaccaccttcctgcgaaagggagtttggtaggggccggaggatgtgggatggtctatggtgatatctccagtagagaaggagtgtcatgaaaatctccacccacccgcggggtagggcctccgtgccccgannnnnnnnnngagggattttggtaggggccgggggatgtgggatagtcgatggtgatatctccagaagaaaaggagtgtcatgaagatctccactcacccgcggggtagggcctccgtgccccgaggcagctccttctgcatgatgagcttgtccagcaggtctactgcctgctcgctcatcacacgcagctcctggggattggggttgggacgtagtaggtgcctgatcaaaacccacgtggctcgttgccgcgagcatcccaacactgtgctatgaaaagcgacacattggccaggtaaagctgtaaaacctcatcagatcgtatcatgatgtcggagacccccagcacggtccgctcctgcgcgaggcacacctgctctgtgttcggcattttaaccagtgctcaagtcggccgcccccactccaggcgcttgcgtggaggcagtcactttccaaccccaacctttgggaccagaagtgtagacgtcctagcctggaacgatcgcagggttcgcccctgcagtgttgggatggtggaagatcttccgacgtgcgcagcgacgtacgccttctcgggagggcagatagaaaaccctaaccgagggagactccagatgcccaagtgcacgtgctgcatcgaagcccaagaagagggcctgactgcgccggctcaaggctgatcccattcgacttgcgtattcactaggatgatcaggggtacctactcgcccaacgggattacgcctcgactggggttggagatcgtcggccccttgtgctcttccacccttttggcccaccggatgttgagcacccctgcaaagatcctcctcccacactgcagttcccacttgctggtgcccctgttgggcaacggcgtccagctcccccacagggaatctgcttctccttgcgccctattcgttgctacgcctcgcagcagtctgacggctgcaaaaacctgggacgcctttnnnnnnnnnnctcccacttgctggtgcccctgttgggcgacggcgtccagctccctcacagggaatctgcttgtccttgcgccctattcgtcgctacgcctcgcagcaacctgacggctgcaaaaacctgggacgccttttagcggtactgtgcagtgcagggatcacagacgagcagcatgatacaggggcgagggaagcaggcattggcatttacgtgaagatgtggggggggggagggtttccctcttcaagcagggttggtgctgccgccaggaagaaacaggagggtttgatgaggccagggattcgaggggtttgctttggaggggcaaaaaggaggatctcgggcacgtcgctgcacagctgcacagctgggcttgggtgcagggtggcacgcgcccttcgatgcaggctctcccccgcatcaggccggcgcgccccccatctcggagcggatgacggccgccaggcggcgcaggccctcctccacctgctccggcgtgttgtaggagaaggagatacgcatggcgggggatgcgaaccctggcgttcccgccctgacgttcaacgcgccccccggcaccgccacgaccttggcctcgcgcatggcctcccagatgcgggccgagtcggggatgccgcgcagcgtgatccagaggaacatgcccgcccgcggctgctcccagtcggcaaggccggcgaggtggcgctgcgccgcggcatgcacggcggcggccttggccgcgtagtggcgctggatggcgcggatgtgggtttcgtaccccgtgggcccccaggcgcgcagcacggccagggcgatggcggaggagatggtggagggccccgcggtggagtaggagatgcaggacagcagcttggcgaccaccggcggcgggcccgtgatccagcccaggcgcagccccggcgccatcatcttggcaaaggtgtcgacgcgcaccacgcggccgtcgaggtccagggacaggtagcccggcgccaggtcggtgccggggacgtgctccgggccggccgggtactgcaggtagtagtaggggtcgtcctccaggatgagcaggccgtaccggcggcacaggcggtacaccgcggccatgcgctcgcgggtcaccactgcgcccgtcgggttctgggccaccgggttggtgtacagcagcttgggcgcggggcggcccgccgcggcgcgcgcctccagcaccgcctccaggctggcggggacgatgccctgcgcgtcgatggccacgcccagggcctccacgccgcgcggcaacgtgtgcccctccgtgaccacggggtagtggtactcctccagcaccagcgcatcccccgcgtccaggaacacgttgcacatcatctccagcgcgtggttggcgccgttgctgatcatggtctcggtcgcgcaggcggggcgctggcgggccgccacctcgcgctccgcccaggcgcgcagcgcgggcaggccgtgcagggtcaggttgtactgctgggccacgcccaggtcgggaacgtccaccacggtgccgtcgtgcaggcgcacgctcatctccgcgatggggaagacgtccgggggggggagcctgtgggtgtcggaggggtggggggtgggggagagaggtaccgggaaggtgtgggcaggacggggatggctgcgactcacacccatgcccatgcccctcccaggctcacccccactcaccctcccgccatgctgacgacgcccgggacattggagaactccgcgaccagcgtcctgcaggcacgggagaggggtggaggggggcgtcaacaggtgtgaggccagaatgacgcacccggaggcccgcgacggggatgcacggcaagggccagggatcacttcacatcccttatcacccacctgaggatgccgggctggcaggccttgccgacctggctgtagagcgactcgtagtcgggggtcttccggggagttgggcacgcggcaggggcgagagccttgaagctcactttcgcgctcaggctggaagacaggccttccatgcccacgtcatgggagccgagctcgtgagggggcatcccgagggaggctggggagagcggggaggctggctagaagtggcctctgcaagcccggtcgacgaccgcaaacgggccttcgcaagacggagcgggtgcaggaacacaaccaagtaacaacgaggattgcaagaattgtggcaatgtgttcttcgggatcgcaaagtgtgagagaatggctgacaggcccagcgtctcccgttttatgctcacgtaagtccgcgccccatccagtcctacccttgcgggtagcgtcggagctactgagactagggagggatcgaacagacgaggtctaggtcaacttacaaaacgatcacaatgagtcacaatggcaagatcccagagtagattgcaaggctggctttgatgcgtaccattggatggggccgcccggtttgaaacggccccgagatggagttggctagggttctcgggcttccggcacgtttcggcgagggggcttacgctccgacagcagcgctcaccctcggaaggaggcgctccgatttccgctgcgagggttaacagagcttttcttccccggcttgatgccagagtcgccgccgccgtagggattgtacatgccctccgggatggtggggcggctctcctcgcccctgcccctgccgtctccactgcgtccgcctctggccccgcccctgcctcctcgcccgcgcccgcgccctcctcgctgagagttctccacagctaaggacaagggatggtgaggtcgaggttgaggtcatgggtttccgggactcccatgcctggaggctgaggtcaccctgcccacggtgctattggacctccccgttctcacacctctgggaatggtattcttgaaggcatccttggcggtgctgtagtcgaaggcctgaaaccccctttcagcgcctggggtggggtcgccgccccctgtcggttgtgaatgtggtgatggtgggctgaaatgctgctagcttttcgagcccagcagggtgccaacgtcattgctgccgcaaggcaacacccatccacgggtccactgatggcgcggtgctagaaagatttcgttgcctgaccaatccaacccaccatcgtactcagccatgttccagacggcatgtcgtggtctccctcccaggtctcccttttacccccctccccagcaacacacccacctgatgcagcgaggcgggcggcggcatggcgccgnnnnnnnnnnggatttcgttgcctgaccaatccaatccaccatcgtactcagccatgttccaaacggcatgtcgtggtctccctcccgggtctcccttcaccccccctcagcatcacacccacctgatgcggcgaggcgggcggcggcatggcgccgtcccgcctcgtactgcctcgccttcttccccgctcgctcgttcagggacaggggaaggtagtctgccaggtcatcgcgcggtccccggggtccagcaggggccgcaaccccgcgcattgcctccatggccgaccgcacctctgccgccgtggtgggctctgcctggtccagtgcgtccccctcagtagctttcgcctcctctggggcatgggcacttggtgcctccgccgcctcgccatctgccacacccgccggctgtttcgcaaaagggagggtcagcgaggcccggatggccgccagcgcgcgcggcaccgccccggcccctgcaggtacagggagagcgccgccaaatgcgctagacgacccggnnnnnnnnnntcccggcccttgcagttacaggatgagcgccgccaaatgcgctagacgacccggccatgcgcaccgctggcacccgttttgcgcctgccctgggtttgcaggggtcgggcccggcgagcggcaccgcagccacaggtcccgcctcgctttccctttgtagcgtactcggggcggggggggcgtctttagctttaaccacggccgccgcctgctcctgatgctgcggctcttttgcgctggcctgtagctcctctgcgccgtccttcgcatgctcaccactttgagacccggccacgctggcgatcgctgccgcatcatcctcgaccgaagcctcctctggcaatggtcctccactgcccgccgcagcgcacgccctcgcgctcgtccccgcgccactcagtctgaccgggcctccccgcgccggcgccgccgcgccttcctgcgcagcagacgcgatgagcgcggcgcccaggcccttccccgtcgacccgaggaccagcgggcgcttgatgccacgtgggcgcagcgcgcgcttcgcggagccggcggcaggctccagtgtggctgtgggcgctgggcccggagtggcgggctcaggatcggcgttggacgctgcgtcctcgggttctctgctctcagactcgacccctgcgacattctccggccccgcctggttcttatgcgcccggccgccggccannnnnnnnnnagctcagggtcggcgttggtcgctgcgtcctccggttctctgctctcaggctcgacccgtgcgacatcctccggccccacctggttcttatgcgcccggccgccggccagcaggtactccctgcgcagctcctccacgcgcgcctggcgcgccgccgcgccggccacgacggccgcgacctcgcgtgcgcgcagaagcacgtagcgcgcgcgccggcccagcgccgccgcgacctcggggcccgtggtgggcatggccagggccagggccaccagctgggcccgaggacaaatgaagccgggggactcgtcctgtgtgcgcgcctcgccgtccctccagttgtacagcgctgggaggatttcgattggggtgttggggtttggggatgagaatgcaccggggatggtgcgtggattgcgcagcaccgccccatttcctttgtcaatcgaggggatgcacaggggctgtgcgtggcataatgtgaccacaagtggtctgcacacaaactaatgcgcccttgaagagcccactgaatgcgaggatgagaatcaagctgcccagcactctgaatacaacttcacaacctcacacaacccaacctcaccctcaaagacggccagctggggaccggacaggaccacgtccagtttcagtgcggcctgcaggaagctgtcctccctgcactgctcacgctcgtactgcagcatgcacagcgtgcgggagcgctccagcacagtgcccagggccccgctggggccgtgctcgggcaggtcaactgccaagtggggtggcaccgactccttgctcgccagcagctcctcctgcggggtagacggcgctgtgatgtgagctggctcatattcgaatggaggagcctgcgctgtgttgagggcgcacagggcattctgcaggacggactcgcatccaaagcctagtgaaaaacgcgagaggtgcaggttgtggggcggctcagcaaacctttcctccctctgacnnnnnnnnnncaaaacgcggaggtgcaggttgtggagcggctcagcaaacctttcctccctctgacatgcatgccgacatcggggctcagaggcctcaaccatggatgagcgcacaggatgcccctgccccgggcccgcctcacccgcatcttgtcatagatgaaaaggaggtagtgggtgtccgcccgagcgtatgcctccatctccggcgacagcggccgctgccgccagtcggccagctggtaccgcttgtccgcctgcacatgggaggaggctgagctcagccttgatgcctgttgcctgggccggaacgtactcatcctctaggacgtgtggttaccgcacagggcatctcaccacatgatgcatttggagcggtcnnnnnnnnnncagcgtactcatcctctgggacgtgtgtttaccgcatggggtatctcaccacatgatgcatttggagcggtctttgaaccgcgtcgctcgataccaggccacacagccgattatttgattggaagcctcacccaggacccaccttgatgctacaaaagtggtccatgaggaaagccagcccatggcccgggtagtgcaggacgcgtgccgcctggcccgtgtcaaagagattggccacgtagatgccaaagtcccgctgcagccagacgatgtcacagtctgagccgtgcaggaccttgagcttgccagggtcggcaaagatgggccccaggagggggcctgcagggagcaagggtggtgtgagggggggccagggtgtcgagtggcgccaggacctggggagggaggccagcaccattctagggcccagtcaaggaagaccctctcccaacggaaaggccacccagcgtccctgcctcaccgatgtggctgcgcagggctaacgcatccacgacataatccgcagcccgcgtggacagctggatgaggnnnnnnnnnncgcaccattccagggcccaaccaaggaagaccccctcccgacggaaaggccacccagcgtccctgcctcaccaatgtggatgcgcagggccagcgcatccacgacatagtccgcagcccgcgtggacagctggatgaggcaggtgaagccctggaaggagcggtatgagtgagcttctaggtccaccgcaatctcgcgtgccgcctccagctgggcagctgcatggggggagcaatgaaggagggtgttcaggtctgctcaggctctggccaaatatgctggtctcggggtgtgccgccccaagtctctagcactcgtgcacaaacttccgatcccctccagtgcccatgagaggcttggctatcaacacgtgcacacaaaggaggcaagccccaccttgagccaccccaccnnnnnnnnnntgacagctgcatgggggtagcaatgaaggagcgtgttcaggtgtggtctggctctggccgagtatgctggtctcggggtatgccgccccaagactctagcactcgtgcacaaactttcgatcccctcgattgcccatgagaggcttggctatcaatacgtgcacacaaacgaggcaagccccaccttgagccaccccaccagctcacccatctcccgcagcccttgcggcgtgtccacaaaggtgtagggcgtcgtgtcgaatcccagggggagctggggcggcgcagcctccgtctgccatggctggtacctcagcgtgctcagtacggcctgcagcgggtgcggcggctgttggtcggccgccagcgccgccgccgcagcggccgcctggccgccgccgtcgaacgtcggcacggcagacaggccatcgtactttggcatcacccgggcattggcgttgtccaccccgtcctcgaacgccagctgcgacttggggcccgtgccatcgggggtccagcgtccgtgggaggtggggctgggggcgagggcgccggagacgggctgggccgcccgcccaggcccctcctgccccgggcgggtggtcatgcgcccctctttcttcgcgccggccgcatccagggccgaagcggtgagcgcgtcgtccagcgcatcgtatacgagctccagcctctctgtcacagcgtccgtgaattcgtcatcctcgagctccacaggagctgatgtttctttcccggatccctgggaatgggaagcccctcgacaggtattggtcactgtgagggggcggcccaaccactcctggccgccagcacccaatgcaatgccccaagtcatgttcacttctgatccccgtccctgcttgtatcagattgaggtctctgctcgcaaccattgcatttcccatccacagcccccgtcattctctacgcactaggaaccgttgtgcagtcttctgcaccgtgctcctcagggccaacaccctggccttatnnnnnnnnnncgattgaggtctctgctcacaaccattgcatttcgcatccacagcccccgtcattctctacgcaccaggaaccgttgtgcagtcttctgcaccttgctcctcagggccaacaccctggccttataggcggggttcatcatgtagtactgtgggatcaggcgtgcaagggagggagccttgagcttgagaatacttcccctagaagcccgcagcagggcaaatcattgacgaagacacccccagccacgcacatggaagtccgcgccgctcggcagggagcaggcgctccccttttgtgatgcattcgatagcggcgcgaaaagggtgagggataggtcctccatcggaatggaatccgaggtgggtgagcacgagcaggttggaccttcacagcatgctgtnnnnnnnnnnccactccccttttgtgatgcattggagagcggcgcgaagagggtgagggataggtcctccattggaatggaatccgaggtgggtgagctcgagcaggttggaccttcacagcatgctgtcggggacaggcagcgagcagctcgagataccgcttgtgttttggacactgatttcaataaaagaaattaagcgagtaagctcatatgtaggtgcatgcccagcttccctgtgggacatatcgccggtgtggtgcctttcggaatcgggcgcgcaattgcagcactgcgctcatgggacgcagtgcaggattcccctggtatccgcgccgagaatccccgacgggggagtcaacagaccaggacacattagccgtcactaccatactatctcccggaccaaacgcacggaacttcggtccaggaaagagggctcgtgcgctggtggcgtcgcgatgatgctgcaagcacccacctcctgcggtgtgcagcagcgctgcctgccatctctgtgcaccttcaggagcacagatgtatcctcctgtagttatgtgaggaggatgcagtccctgcgaacgacctctcgcgcacacgtgacagtcgtctgcagcctgaacaactccacggttgtgcaaggtggggcaaggcaccagacctcttacagcccttctctgagatgatggggagttttgtgccttcagagatctgcataatttgtggagtatctgggaaatcatgcaatgcagcgctgtccagggttcannnnnnnnnngagcttgtggagtatctgggacatcatgcaatgcagcgctgtccagggttcaggaacaggcatatgtcacaccctgtagaccccccccaccctctccccatgcaccgcagctcctcggcctaccaccctccagcaacgagacaacctgcggcttgcccttcccagcaaaggacgcatggcagaggacacactgcagctgctgagggtgtgcagtgcgtgctttggggtctgaagctggggtgacaagtgtactgattggcagggcttgcggttgttgcaaggccgaggtgcactgtcatgcatgcatgcatgcatgcnnnnnnnnnncagtggaagaatgatggtcttctaccactacactgagcataccttgcttgacgcatcatctcaagggctccttccggcatcaccgccacaggactgccaactcacagtggtgaagcccaacccccggcaatatgttgcagaaatcgcacaggcaagcccggtctgcagtgtatagtgttttatagaggagttgcagagcaatgtctgggatacacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggcacagcttgggaagggcaattgaccggggatggtgctccaccatcctggctccccttcaggcaccgaggccccattgatcgtaccaacacaccaccccggccactccattccaaccttgctcttcagatctggtggtggtccacgacggtctctcctttggcaagtgccacctggcgctgggagtccccaacaccgggaagtttgccggggtcaagtctctggacgacctcaagcggatgtacagcagcgagcaggcccccctcaggtgcggtgctggggttggtgctatgtggtggtgcggccagctgactcgtggtgcaggtctgggttgtgactttgtcttgagtggtaattttggaatccccctgtccctgcccaatgccagcagccaccaccatcctgtgtctcccactccctcgcagggtggtcaccggctaccacaacgtcgctcgcaagttcttcgcggacaacaactttgagcacgtcaagctcctcagcgccgatggtgagcgtgcgactaggcgggtgactggtcgcgtggatgggtcgaggcccccgggttccacagtgctctgcacgcaggccccccgcccggcccccttcttcttcagggccctggtttcgatcctcagaattcctcaacccccactgcccccccnnnnnnnnnngaggtctacgtcgccgtagaggagcttccttacaacatcggttgcccgctggaaccaaacctccagtccgggcatctgcaggggtcaagaggacaggatatgaggatctgtaactggcgaccaggcatgttgcctcagggctggtgccaagagtcgtttagagaagctattggtccagctgtgtatcccagacattgctctgnnnnnnnnnnaaggtctacgtctccgtagagcagcttccttacaacatcggttgcccgttggaaccaaacctccagtccgggcatctgcagggtcaagaggacaggatatgaggatctgtgactggcgaccaggcaggttgcctccgggctggtgccaagaccagtgagagaagttatcagtccagctgtgtatcccagacattgctctgcaacttctctacaaaagactctacactgcagaccggggcttgcctgtgcgatttctgcaacatat

SEQ ID NO: 39659 - DNA, 17041 bp, Chlorella protothecoides
  modified_base (122)..(131): a, c, t, g, unknown or other
  modified_base (478)..(487): a, c, t, g, unknown or other
  modified_base (999)..(1008): a, c, t, g, unknown or other
  modified_base (1714)..(1723): a, c, t, g, unknown or other
  modified_base (1883)..(1892): a, c, t, g, unknown or other
  modified_base (2063)..(2107): a, c, t, g, unknown or other
  modified_base (2207)..(2216): a, c, t, g, unknown or other
  modified_base (3407)..(3416): a, c, t, g, unknown or other
  modified_base (4299)..(4308): a, c, t, g, unknown or other
  modified_base (5528)..(5537): a, c, t, g, unknown or other
  modified_base (5983)..(5992): a, c, t, g, unknown or other
  modified_base (6398)..(6407): a, c, t, g, unknown or other
  modified_base (7564)..(7573): a, c, t, g, unknown or other
  modified_base (7843)..(7852): a, c, t, g, unknown or other
  modified_base (8029)..(8038): a, c, t, g, unknown or other
  modified_base (8257)..(8266): a, c, t, g, unknown or other
  modified_base (9111)..(9120): a, c, t, g, unknown or other
  modified_base (9293)..(9302): a, c, t, g, unknown or other
  modified_base (9363)..(9372): a, c, t, g, unknown or other
  modified_base (9433)..(9442): a, c, t, g, unknown or other
  modified_base (9694)..(9703): a, c, t, g, unknown or other
  modified_base (10409)..(10418): a, c, t, g, unknown or other
  modified_base (12105)..(12114): a, c, t, g, unknown or other
  modified_base (13225)..(13234): a, c, t, g, unknown or other
  modified_base (14595)..(14679): a, c, t, g, unknown or other
  modified_base (15217)..(15226): a, c, t, g, unknown or other
ggtccggcgctgcctgctggagcccgaggttggcgcgccatgaggacgccaggctgggaacccaatcactagacaccctgtactggctctaggtgcttgagcatgggcatgctcatacgatnnnnnnnnnntcgcccctgcgcctgctgccgccggccctgctgcaggccgtgctgtgcgcgctggggccgcccggcggctgcttggtggaggtccggcgctgcctgctggagcccgaggtaggcgcgccaggaggacgccaggctgggaacccaaccactcgacaccctgtactggctctgggtgcttgagcatgggcatgctcatacgatctacgaattgttcagcaagtcatgtaaaactctgtacactcagcagtactggatgattgctccgccggaggattcaggggtggaagaagggccccgcgctgcggcgcaagtccataaggagccttgggtaatggtagtcgatgcannnnnnnnnngaaaggggcccccgcgctgcggcgcaagtccacaaggagccttgggtaatggtagtcgatgcagcaagagcaccagccatcgagaccgccgctgctcctcttccaccaccgccgctgtatgcggccacgcgcttgagacaggagcctgcgcgtatgcagtcacgagcgagcctgtagcgccctagctgcagccggcggcggggtccctgtggcggtattctcccgctccttcacctgcacggcctcacccctccccgccccccggcccccgccgcacgagtctcttcctctccccctgccgcgcgaatcctgcgccctcccccgcccccgaccacttgcagatggggcgagcgagggcgcctcgcggttggcctgccggggtcctgaggccacggcggctccagccctgggtccgcctggagcacctcctccccccccgcccttggcggaagggctggcatggctgccagctgctcgtccctggcttgccggcgagggggccgccctccgcnnnnnnnnnngctcctccccccccgcccttggcggaggggctggcatggctgctagctgctcgtccttggcttgccggcgagggggccgccctccgcgcatggccgccgcgcccgccggcaggcggctgggcgcacgtctcggtctgtcgctccctgcagccgtgccggaggccccgacccctgcacccggcctcggagcccacctgccgcacctctcggggctctgctactgcagccgaggcggtgtccctcgcggcctgcctggacgcctccagctccgccagggtcacggccacgcgcgtccccaccaggccccccgcccggcgctgggcctccagcgtcgcgcgctgcgtgcgctgcagccgacgcagggcctgcagtgtcggaccgtccaggagggacgccagtgccgcgggcggctcggccgccgccgcggccggcgcaggggcgccgcgcgcccgcgccgcgaagccggggggaagctgcgccggggccaccacggcgcggcagcaggggcagggcatggcgtaggcgcccgtcgctgcatccgcagcgacgccctccttggccagctgggccggggccgcagccttccactgctcagcgatttcctcggcgcgccgggcgagccggtcctgctgccaggccgcgtaggataggaagcacgtcctgcacacgaggggcgatgcagtacggaggggtggggctcggcagnnnnnnnnnnataggaaaggaagcacgtcctgtacacgaggggggatgcagtacggaggggtggggctcggcagaaggggagcggcaggcgtccggggcgacacatgcgggggcggcagtgcacttgaacagcacgcgattcaagctccctctccctcccggcaatggcnnnnnnnnnncgtgggggcggcagtgcttttgaacagcacgcgtttcaagctccctctccctcccggcaatggccccaaagacaatgcgattctcagacagacggacgacagcgatccttttttgaacccacgctagcctgccggtcctgcctgcatgcccgcccatcatcacggggcctnnnnnnnnnnnnnnnnnnnnnnnnnnnnnnnnnnnnnnnnnnnnncccactgtcctggaccaggccccgcagcgcctccacaagctgcagctcctgggagtcgcttaagcctgggggggggaaggagtccaagaggcaaggttgnnnnnnnnnntgcaggcaggggaggaggcaggcctgcgctgcagagacgtcgtccagggcttccaggcagagcacgcacgtgcccgagggcctgttccactccgtgacctggtccagggcagaggccacaagggggaggaggcccgcctcatcgccaccgtcctgaaccaggccccgcagcgcctccaccagctgcagctcctgggagtcgctgaagcctgcgggggggaaggagtccaagaggcaaggttggggagcagaggttgggcggtggcgggaagcgaagagggtgccacggcatcgcctggaagcccctcaagctctgcaaccccagcaggcagacccaggaccctcgcacctttcaccccctccaggagcacattgacgccagcggcggggtagtcggtaaggtcgagcaccagggtgcatgtcaggaagacgtcagcgtccgtgtagggcaggatgctcacgcgcacgctgcgctgctgtgagtcccagaccacgccctcgaaagtggccgacagcgcttcgagctccgtggccaggcacgcctcggccatggcacaatgagtcaacagtcggtcattctaaattagctgcagactgtatgctgcactgtctgcgaatgggattgtgggcccgattagtggaggtgcttcgacttgggccagcacgaactttgagcgcccacttgagatgctcagatctcacggatttcccatccctcatcgacggtggcgacgactgtaccagggccccgccccagcataaaccttcattctgattcagcaaaggcccgcaaagtgctgtgtcgtcgcgatgacaactgtcctggctccgctccagaacgggggtctggagcagccgggtctggatccccgtgtgctccagtgcggcttcgcccgcctcctgggcaaggacgtggactacattgtgcggaagtatgagatcgtgctgggcagacgcagcaaggcctccaccctggacgtgatcctgggtgacttcatgtccgtgtcccggcagcacgcccgcatcctgtacagcttcccttcaggtgtgccgcacatcgcacaatggcctggcgtgtatgttcagcgggcaggcgcctgtctgacaaagcagcgcctggagatggggcatggctggtgttgcaccttggtctgacgcatccctgtgcctcacacgctggttccctcccctnnnnnnnnnnactggcgtgtatgtcctgcgggcaggcgcctgcctgacaaagcagcgcctggggatggggcatgcctggtgttacaccttggtctgacgcatgcctgtgcctcacacgctggttccctccccttcgtccactgccttgcgtgcccccctcacagcccgttgggagctgcaggtcctgggcaagaacggggtggcagttgacggcgtcacctacctcccaggcggggacccggtgcccttggcctcccgggcgctgctccagatagggcaggatgtgtccttccacttcctgctccccagcagcactcgccgcaggcacgtctcagtgatcagggtgtccggtcctgatcccattgaggtctggtgccccctggcaaggggcagtgttgagtctcatgtgcccttggtggtcctgacgcccgacggcggtggtcatcaggggacccggcaccgtctggatgatcgtgggatcatgcgatgtcctgggtgccgattgctccgctcgaaatcacttaaacccgcgtgccccacgcctgaacgcaggtccctgacaccctccgccccgcacgccactgcgcccgctgccccggctgaggaggggcctggcagcgcaccggtgccgcccgctccggccgccgctgcggccgccgctcagccggcacccgcccccgaccagccgtcgacgcaggctcacacccaggaccttggtcctgctggcgcgccgccggccgcctcgccagcctcgactcccgtggaggaggagcggccgcacgtgccgtctgcctcgcctgccgcttggttttctggggagcaagggccggcgcagggcaccgcctcgccccgtgcgcaggccccccacccccagccgtcgcctgccgcccggnnnnnnnnnntgcctgccgcttggctttctggggagcaagggccggcgcaggccaccgcctcgccccatgcgcaggctccccacccccagccgtcgcctgccgcccgggaggccgcggagtggggccgtggcggcgtgcaggcgcagcaggcgcagcaggcggccccgcagcaaccggggccccaggcgctgctggccgcgctttccggccacccaggcgtccagcaggccctcgcctccaaccccggcattttgcaggccctgctgggaaacccggcgctcctgcaagccctgctgggcaacccaggcattttacaagctcttctcggcaacccggggctcctgcaagcacttctcggcaacccggggctcctgcaagctcttcttggcaacccggggctcctgcaagctcttctcggcaacccggggctcctgcaagctcttctcagcaacccagggctcctgcaagctcttctcagcaacccaggactgctgcagcagggaggtggcgcgacccctggcgtactgcagggcctgctggcaatggcagggcagcaggctcagcagctgagcgcgcagcaggcccagcagctgagtgcgcagcaggcccagcagcgggcgatgcagcaggctcagcagcgggcgatgcagcagagggccgccgtgcagtccctccaggggcaggcgctggagcaggaacaggcggagctgacaccggcgcagcaccagcagctgctgcaggcttggcaggcgcagcagtatgggaacccgcaccagtacgggcggtgagatgcagctgagaccccccgctgccttctttgccctgtcgtcgctgtacaacaccgggatcgaggggcaggtttggcgaggtgccccaggccagggtcatgctgggtcaagggcgagggagtcatggcggggtctatagaggggggcgcgatttgggatgaaccggagtggggcgggatgtgcctggggcgctggacggcacggctcccctcactccatgggtgcatccatgtccatgtccatggccgccgtgctttccttgaccgcgtcccactcgatgggaaacttggtcacacggggcttgtcggcgaggatgctccgcatcagcctgggcagggtttgagggcggcctggagttttaagtattgcattgtgtgactactggtggcggacaagtgacgctgccgctaaagaagagagtcgcaacttgcatggcatgcnnnnnnnnnngcggggcttgtcggcgaggatgcttcgcatcagcctgggcagggtttgaggggggcctggggttttaagtattgcatggtgtgactactagtggcggacaagtgacgctgccgctcaagaagagagtcgcaacttgcatggcatgcatacagtcccatctccctgcagcaaccacccagcaggaactcagcagcagaagagcctcccacctgtcaagctgtggagtctcgggaggctcctcccgtagcgtctcctcctcgtactctgtgttcacgtagtaccctacccgaataaactcctgcacatgtgcagggtgtgtggactggctgcgtgtgcatgccattcagaacaacaaaactcagtggacgagaccagccatccacatcccacaccccacatccttaaaaaaaaaatcttgtctggcccctgttgctgccagcccaccnnnnnnnnnnctcagtggaggagggcagccattcacgtcccacaccccgcatctaaaaaaacatgttgtctggcccctgttgctgccagcccacctgcgtcttgtatgagcaggtgaggaggatgactgtcactccgacaatgtcgctgggtggtatccttgaaaagtctggagggtcagcctgtggagattgggtgcagcgagagggccatcagtggcgtcaaagaccaacagcgtcaagcactgcgtctgtggagcggcgcgcgcagcaccaacctcagtgcagtagctcagaggcaagaatgtgactcgaagcaaacagatgcaaaagaaggctgccatgcttgaatgctgtaataaaaaaccagatgctccttccactcccttcccacctggaacacaaatcggtactggcnnnnnnnnnngcaacctcagtgcggtagctcagaggcaagaatgtaactcgaagcaaacagatggaaaagaaggctaccatgcttgaatgctatagtttaaaaccagatgctccttccactcctttcccacctggaacacaaatcggtactggccgggcgccacagggccgacgaacactgcatctagcacttgatcatacttctcggactcggcggacccaacgtaggtgagtcgccattccagatcttcgaggtgtcggggaggtgggacaggggtgatgttgccaaggcgagagcacaagggcacagcagctatcccctcgccgagcaactgccccgcgcaccatcttgtagatcatacaggcactcatactgtatctcgaactgcagaggatttgtgatcttggtgggattgtccaagacgtgaacggaggtcaccgagatggccgtcatgacgtcctccgctgtcctccgagcgccgaggcggatctagcagcacggtgagactcgaaacgatatgatcttgaaaccgtgactcaggtggaacgctgttcaccgcctatattcgaagcgcaacagtctggagggaggcggagtgtatcttcaaacagggtgcgaacggaaaatgaggcaacggatgcaggcaggtcgtcttaattagaaaagggatggacagctcgaatgtggggtatgcagcgtctggcgggacggacagtgcagatcgcagacagacccccttgaacaggattttggatcgtctggtttgcgtgctgtgggtgggaggcccctcgaaacaaggaaagcctggccactccgcaagaccagtcaaggatgatgcttgcagcttcgcaatgcggcgctacgcgaaattggagctgtgcctttggaagaatggaagagtatattgtatattatgcttacaagggaatgagacaagtatccagctgttatgacacagggaacattgagaggcagaactgccggtgacgagcgggggcacgcactgttgagggcacagaaggcgaggtcttcttgcagtgaccctgtcatcagcaccccagaagaactccagtgccttggagtacaaagggtgcactgcactctcccagcaagatgcctcacaaaaatcttcgttgtttcttgggcagtccctcaaccttgccttnnnnnnnnnngctctcccagcaagatgcctcacaaaattctccgtggtttcttgggcagtccctcaaccttgccttgcgcgatgagctgctggtaggcggcatggatgtgcatgggctgcagcgggccctcctcgccctttcccgctgccagcattcgagctgtgaggcgccggtggaacgtgacaagtggtgaggggcccctttgtaagagtcatgctgagttgctgtaccctatgacccgacgcctcgcgagcagctcagccaagaagtcctggccannnnnnnnnngagagtcatgcggagttgctgttccctgtgatccaacgccttgcgagcagctcagccaagaagtcctggccactgctagctccaccccagtgagatcccacggcatgccctcaccagtctcgaccagctgtccaacaaaagacttcgcgacgctggccagagcgatgagagacttgnnnnnnnnnntcccagtgagatctcacggcatgccctcaccagtttcgaccagctgtccaacaaaagactttgcgacgctggccagagcgatgagagacttgtcctggggcttgggattaaccccggtcacgatgtgcatcacctgatgcacacgccaggatgcagaggggtttggatgagcagcgcactgagaacatgcacactgctattcccccattgaacagtgannnnnnnnnncgacgcagagggggttggatgagcagcgcactgagaacaggcacactgctattcccccattgaacagtgaactgtgtctcccagactgacgagcgcaccctctgcatgggcttcttcagggatgagcggcggaaggcttcgtaacgatcgagttccaccccatccagcatgctcacaacatgtctgggacagggaaatttgggagggaaactggtggtgaccgtgctcagttcaggtcaaaccatgccagccagccacaccaccgcatacagtcccgaaccagccctgacccacgtgttcaactcagcgcgctgctgcttcgtcatctgggacaggtctatggctccgatggcaacctcagcgcctcccagaccagtgacaactccagatggtggtgcaggggccacccctggtgcctcctcttctcccacgccctcaaaatcagcctcgagcgcggcttcgagagccgcctccacatcatcgccgtcggatagtgggacctcaggcgctgaatcctctgctatctgcgctgcctgggtcccgggctgcgtcatggacgtcgcaccctggccgtgccgctcacaaccagctgccgacagatagcaaagagtcacggatgaatggcttcataaataagttgcctgaattttcccaatgtaaccgcaaatattctcggtccctagatctcactcgacatgcaagtgcggagttcccgacgatctcgcgcgcgcggacaacaggcttatcaactcctttctgttcatgcgacaacagaaggaattcttccgttcagaaactgagccagtcaatggacagcaacaaaattggtctgacaactccttgannnnnnnnnncaccaactcctttctgctcatgcgacaacagaaaggattcgccccttcagaaactgagccagtcaatggagagcaacaaaattggtctgacaactccttgaaatcatatgaacaagctgatatcactcccccccaaaccactcgctggtctcgggctcctccaccgccccagnnnnnnnnnncaatcgcaaatattctcggtcccttgatcgcactcgacatgcaagtgcggagttcccgacnnnnnnnnnngatgacggctttctggcagctcattccgtagtggtgcagcagccaccgcaggtctttgccnnnnnnnnnncatgacggctttctagcagctcattccggggtggtgcagcagccaccgcaggtctttgccgctcctacacgatcaatgaggcggatggaaggtcagcagggattggaggctgctaggctcgttacaatgtaggacagctagaggcctcaagtgtcaggtgctgagtgttgcaggctcgcgatgcaaggttgactgaagcaataaatttgcagaacacccacaccaggatagaccccatcgcagcagcagcannnnnnnnnnccgcgatggacggttgactgaagcaataaatctgccaaacacccggaccaggatagaccccatcgcagcagcagcaagtcccacctctggcactggtggggcctcgggcatgcccagcatgtctcggaccgccgcctcgtcgagcggctcccgctccctctcccactgcacgatagtgcatgtggcagcgcagtgttgcagaggctggacatcaggacgattgcagaagcctcacccacacacatgggcgcaggcagcaccctcattctgcaaagctaagctcactcttacctgggcgatggcctccatctcctcagccggagccggcttgggaaattcaaagccgtccacacgctcgttgtgcacaaatcccctgcgaatcgtggcaaccggcgagacagtgtcccagagatgggaaacatcatacccaggagcgcagcagagaggcgcccaggtcattgttgttcctgcccccttttatagcttagtcccatcgccgatgcaccccaatccacagtcttgggagccattgccgcccacccaggggcccagcttgctggctgcaatgccgtgcaggggcgccctgtccggctcttctccaatacttccctgccccgacgctgaacaacccccccaaaccagcacatacccccctcgattatgtaagcctacgtgatcttggtggtgcgtgtgatggccgtcaccnnnnnnnnnntcagcagatacccccctcgattatgtaagcttacgtaatcttggtggtgcgtgtgatggccgtcaccgcctcctcgtccaggtccaggcgcaccaggatttgcaggccctccgcccaggccagcgtgcgcgtgccgcgctttcccgtgcgcgggttccaggcgcgcaccgtcttacgcggcacccagaactccaccaggcgcaggccatcctcgtctacggccatgccgggggtgggcggcagcgcccgcagtcgcatgcccaggtagtcgcacagctgcttcaccttgttggggcggacgtgcagcatccaccaggcctggcccagtccgcggccatggtatgccagctggggccaccacttgctggcaagcaggaatgtttggggcaggggagggggagggggagcggagcagtgggaggggtggagtgaagggcggcgcattgaggagcgcccgaggccagaggcatccacaccgaacccttcagcaccccatcgcagtcccctccctcacttgcgctcccggtcgtggcggaagagcatgctgcgcctgtcctccgcgctgtcctgggtctcctgggggatggagccggcggaggggcggagggagcgccgctccttggcgtcggccagggaggctggggacgcgacggtcccgttctcgagtgagaggggggtggacggctctgcggggcgctgctcccagtcctcctccggtgctgtcgccctgtcaggcactgtgaggggccggaggggagtcgtgctgggccgcgctccacgccggggcctggcatcgccttgcaaggcgctccaggttttggcagggcgcggcagcacagacacggctacgctcgggctgcaccccccggcatacctggttgtcggaggagcctggccagtctccgacttcccggtctcgcagccctgtgctcgctccgggtgacctgcgtcgcccacacggccgggcatgggcgagggtgcctggtcgtgaaccacatgctcgggggtgttacctcagtccaggcagggcctcatgcacccttgcgcaaagcatgcaatgtatcgttggatttaatcatgcaacaaagggctcgatggacggggttgccgtgccccggcatgcggctatgcatggcattgcagtgggaccgtcatcgcgcagtatggatcgccgcacactcagcagcaggtattcccacccactctcccaacagtgctgtgcgcttgacatgccgcgagggatattatttcaggggggatggcgtgcctgggaccggctgaggggtctcaggtgcttgagcagcagtgggagggtcaagcatggggggggggcaagcgcagtgcagaggtccttcaccaccgcgctgcccctcagtccgacagccggatctctgcgcccaggacctccttgacctgctcgtacgtcacgaaggcgatggcaatggaggggacaaccttgaggtagttggggcccagccccttgaacagcgcctgcattggaatgagtgtggggaggggggggttacaaggagggcaaccaatttgagctggcctccacaggcctggcatgccgcagttcagtggtgcagcggggggcaggccatggaattagaggctcaggcagggcctcgtcatccttatcccacacatggcacccccacagcacggctatggctctcgcccctcnnnnnnnnnngttggaatgagtgtggggagcgggggtttaaaaggagggcagccaatatgagctggcctccccaggcctggcatgcagcggtttagtggcgcagcggggggcaggccatggaatcagaggttcaggcagggcctcgtcttcctcatcccacacatggcagtcccacagcacggctatggctctcgcccctcccacaaccaccctcccctcctcccccccacccctcacgcacgatcccaggcctcaccgtgacgccctcctcacggatggtgcgcacgaagcagtcggtcatgccactgtagcgcaccgccgcgccctcggcggcgtgcaggctctgcgcccccgcccagcccgacatctgcagccgccggcgcacgacgtcaaaggggtaggccacagtctggcccagcgtgcccgccgtggcgccgcaggcgaggcgcgtggcgatggccaggtcccgctcatcgcggcagccgtaggccttcacgatcaggtccttcagcgtctcgtacaccgcaaagttgaggccgacgtagggcacgacgccgatgacggagggcagccaaccgcgccacagtgccaccagcccctcctgcgccacgatgctgctggcggcgtgccacatgccacggtactgcgcgtgggaggagtgctgcaccgtgatgcgcccccggatcatgtccagcgggtaggtggccgacatgcccacaatgcccgcgccggcgcccgccgcgaggcgcaggcccggcgtcagctgcccgtcgccgccgcggtcgatcagggcgtggctgatcttgcgcgacagctgctcgtaggtcatgaacttgatggcctggttggggatgatgcgaatgcagttcagcccgttgcccttaaacaggccgcggatgccgtcgctgacccacatatggcgcacgccctggcgcggaggaggggaccggggggagagggggagtacggtgggaacgactgggtgtggatcaccccaggtgagacgcgagagggagcgggggttgccagacctgcggcgcgtccagcatcaaaccccactcccagaccaagccagggccccagtgcgagggcattacaatacaagccgcgcatgcatgcnnnnnnnnnngggaggaggggatcggggggagagggggagtagggtgggaatgacttggtgtggatcaccccagatgagacgcgagagggggcgggggttgccagacgtgcggcgcgtccagcatccaaaccccactcccaaaccaagccagggccccagtgcgaggcattacaatacaagccgcgcatgcatgcaggccctgcaatgcacaagcagtgattttgtagcctcttcgtggggcccaggaagcaacaagagcccaattctggcatatgagcgcagacagcacacgacatcgataacccacatcccaccacaggcatacacacacagagtccctgcccacctggaagatgccggtgtacaccttctcagtgccttggacctgcatgagaatcttcagccgctctagaggggccaccgaggtccggctcctgcaggtcgggccgggcgtgggttggggaccaggtcggcagggctgcggcacatggggcgcctacagtgctcgacgggtgcccccgtcgcctacaagggtccgaatccccaactcacacagccccagcgattcctccagcacatagggactttgtgagctgcgcccatgtaaggttttgcttctcgggtttctcggccatcgcggccggcgcctgctcaaggtgaggtgccgggtgtggcaatctggtgtctgtatccacacccacagctgcttgcatgtcaaggtccgccctgtggccgcgcagcggcaaggatcaagccgcacggctcgcgccgatggggcccaaggggtgtcggggttcgaggtgggggtgaccagagggcgtgcctgcgggcccagatggcaggctgctcccgctttcagccggtctgctggctatgtatggaggaaggacgcactccctggtcgcggggcgatgggacatcgccagggtgatgagtgcttggtggccctatggatggcccttgtgtaggtgtcattttagtggaaagcacgacgcatgttgcgagtaccgtaaggccagctgtggctggaacgccgagtttgatcaggaagtggccgactgtaatgttgatgaacatcaaggcatgccgaaattgaagtatctccagggctttgcgacacgcagtggagatcggatgcatggtgccctcctcacaaccacacccgtggccaccgcataacaatgtcttgagcatccggccccatcacagccagcacctgcggtggcatgcacccaattgtatgaactaacctcatcttcatatttcactgaatcagcatgggaatcgcgagcctctggaagctgctcacggaggaaggtgttgtccgcaagctcagtggctccgacccgtcgcagcaccacaccttgctnnnnnnnnnnnnnnnnnnnnnnnnnnnnnnnnnnnnnnnnnnnnnnnnnnnnnnnnnnnnnnnnnnnnnnnnnnnnnnnnnnnnntggatcatgcaggccgatcagcagctggccctgctcccacactttggcaggacggagcgatgcatgaaggttgccctcgagagggtgcgtggtggtgagcatgcagggcgcaaccctgcacgcatcatggggttactggagcgctacttgcggtgcagaactgggtgaaggcgataaactctgtcttctggcatccttgcccatcgcagagcatccagtggctgcggcatggctgccttccggtgattgtggtggagggccgtgcgcctgcagagaaattggcggcggtgcaggcccggtacgccgcccgcaacggcgtcgacggcggcggccgcggctcttcctccttcatagcactgggcaagtcggtgggcgtcatgcttcagcagctggtgggtgctgaactggagcgtagtggagctgcatgccgtgagccgggtggtacggagtgcaagactcgaggccggagggggtgagagtgacactacagtcccgtagagacgtccgctgcattgtgaggggggcccggagggctgannnnnnnnnnagcagtggagctgcatggcgtgagctgggtggtacggagggcaggacctgaggccgaagggggtgagagtgacactgcagtcccgttgagacgtccactgcattgtgaggggggcccggagggctgatgggcccacaatgctcctgcccgcctcccctgccttccagccaacactcctgcaccccgctgcagggactgccggtgttctactcccccggcgaggccgaggcgacctgcgccgcgctggtgcgggcggggcgggtggacgcggccgccagcttcgactcagacaccatggtgcacggagccaagcgggtgtaccacacgctgaagctgtcggtgaggggcttgaggttggccacctgcagtgttcactctgctgctaagcttgcggtgtgaaggcagcaaggcgtccctgctgccggaccccatgcctcccaggaaggtggcctgggcgtgagtgaaaccccacccgctgccccccgcaccctcacagaccctgaagccgggcgagtgcgagctggtgtcctgcgacctgggcgacatccggaaggccctgggcatccagcgcggaggccaggccgccctgtctgtcatcgccatgctcgccggctcgggtgcgctgcctgcctgttggaggcgcggcccatgagtgctgactcttgtgggagtgcccctccatggacaggcgccgtgggctcctctagagcgggggtggcatcctcgctgctgccctgcatggctcacagccagggttgcacagcccacctgggagcacagacatgcagacccttgagcagcccaggcgccccacttccaccccacatcccgcagactacgacctggtcggcaccagcggcgtgggatccgtggggagcctgaaactgctgcggcacctcctggggcccggcgcccaggcaggaccatgtgggggttaggggggagtgtgaggatgcaaggggcctggcgcggcccccgcgctttctggacagccagggggactgagcggctggcattgcttgcccctccgaccctcccctgcgtcagcctgttgcgtcgagcagcggtgttgagggtcacggcgtgcactctgctgccacctgggcacccgtcgaacaagcatgccgcggtgaagccttgcatccccacaaccccttgcccttctccccaccccaccaggatgacagcggcgtgctggaggcgctggaggccctggtagcccggcctccggacgcggagctggcggcgctgaccaagtgtacgggctgcaagcgatgtgggcacgagggtgggcgcaagggcgccgtcgcgcggcacacgcccaagaacccctgcccctgctgcgccgagctggacgcggcgggggcagggcgggggccggcgggcgaagagggggacggggctggggcggcgcgcgccgaggtactggggcgtggtcgccggtggagggccgaggccggggtggagtgcggggctgtggaggtggtgctgttggaggggtccaggtgtgcccactcccatgcagtggccgtgtgtcttccccaccctgtgtgtactgtgatgctgaggcagcgtgcgccagatctgcatgttgggtggcggagggccctcagaccagctccctcccctcaccgtcaacccccaccaccaccaccaccatcctcaaccccctcccacctgcacctgtgcgccaggggtgccgggcgcgcgcctttgcgcggtgcgactgcgccttccaccgccgcgaggccgagcgcggcgtggaggccatcgcgcgtcgcatccgggccgacgccgcgccgctggccgccgcgc

SEQ ID NO: 39660 - DNA, 118 bp, Chlorella protothecoides
gtccatgccctgcatgctgctgcgggaagatttggggccgccggggacggatcccacgggcccccgccccagcgcatcccgggaggccgagctgggcctggagctggacgtgggccag

SEQ ID NO: 39661 - DNA, 74 bp, Chlorella protothecoides
cgttttgccaccctcgcattgggacctgggtggagaagagggcaatgaatgcagcgcttgcacgtggtcgagtg

SEQ ID NO: 39662 - DNA, 61 bp, Chlorella protothecoides
ccttgctccccacactcctcttgcagctcacttccagcctgaacacccgtacgacccaccc

SEQ ID NO: 39663 - DNA, 151 bp, Chlorella protothecoides
gctggccccaccgccctcctgccagcctgctgtcggcttgcagttggtgcgattcccctcctccatcttacctcatgcaggatgaagagtctggcaggtgtggcccagctgcacaaggccgagcctggctcccacgggtcctcccgggtcc

SEQ ID NO: 39664 - DNA, 90 bp, Chlorella protothecoides
gtttttggcaaccgcactatctctgtatgtagagcacacagaccccgtcgacttcccgtgatctaactgaagatcatgcgccgggctgcc

SEQ ID NO: 39665 - DNA, 77 bp, Chlorella protothecoides
cattgaggccactccctttgcccatcccatcccatgtgcctcgaccctgcaccctcctaccccttgatacgccccct

SEQ ID NO: 39666 - DNA, 73 bp, Chlorella protothecoides
cggcagcggccccccttccttccggggcccccgcaccgcaagcgacggcttgactcaacaagctcgtgatggc

SEQ ID NO: 39667 - DNA, 99 bp, Chlorella protothecoides
gagggcggcttccgcctggccgccggcttcgatcgcccgggcgacaagccggtgagcagcggggcgggggagacggcgcccccggccgcgccggccacg

SEQ ID NO: 39668 - DNA, 61 bp, Chlorella protothecoides
ccccaccctcctacaaccattatttacaccaccccccctcctccctcccgctgcagctccc

SEQ ID NO: 39669 - DNA, 167 bp, Chlorella protothecoides
cgtggaaccttgcatcacattcattctgtacggataatgggtcattggtgataggtttgagccagtgcagcaaggtatgtcagccccaagacgagggccggcaggcgcccgctggcgttcaggggttgccaagggaggaggtgcagagcctggtgtgccaggtcgcc

SEQ ID NO: 39670 - DNA, 76 bp, Chlorella protothecoides
ctctgcgcattgcagacgaggcagggtacagatggcttgctccgaatcgccctggagtagtgcacggcagagtctc

SEQ ID NO: 39671 - DNA, 63 bp, Chlorella protothecoides
gaagcagccgctcaagccgggctggcccccttcacccccgcatcaaccgcccctaatcaccca

SEQ ID NO: 39672 - DNA, 88 bp, Chlorella protothecoides
ggagtgcggccattagtcccatggcagacatgcctgcaaaatggcccccagctttgtccccctcccctccatgcacatgctctgcctg

SEQ ID NO: 39673 - DNA, 20104 bp, Chlorella protothecoides
  modified_base (236)..(245): a, c, t, g, unknown or other
  modified_base (620)..(644): a, c, t, g, unknown or other
  modified_base (849)..(858): a, c, t, g, unknown or other
  modified_base (935)..(944): a, c, t, g, unknown or other
  modified_base (1021)..(1030): a, c, t, g, unknown or other
  modified_base (1597)..(1691): a, c, t, g, unknown or other
  modified_base (1756)..(1765): a, c, t, g, unknown or other
  modified_base (1830)..(1839): a, c, t, g, unknown or other
  modified_base (2054)..(2082): a, c, t, g, unknown or other
  modified_base (3230)..(3239): a, c, t, g, unknown or other
  modified_base (3612)..(3621): a, c, t, g, unknown or other
  modified_base (3687)..(3696): a, c, t, g, unknown or other
  modified_base (3812)..(3884): a, c, t, g, unknown or other
  modified_base (5268)..(5277): a, c, t, g, unknown or other
  modified_base (5637)..(5646): a, c, t, g, unknown or other
  modified_base (6171)..(6283): a, c, t, g, unknown or other
  modified_base (6438)..(6447): a, c, t, g, unknown or other
  modified_base (7087)..(7096): a, c, t, g, unknown or other
  modified_base (7811)..(7820): a, c, t, g, unknown or other
  modified_base (8562)..(8571): a, c, t, g, unknown or other
  modified_base (9190)..(9199): a, c, t, g, unknown or other
  modified_base (9569)..(9578): a, c, t, g, unknown or other
  modified_base (9823)..(9832): a, c, t, g, unknown or other
  modified_base (10339)..(10348): a, c, t, g, unknown or other
  modified_base (10700)..(10709): a, c, t, g, unknown or other
  modified_base (10770)..(10779): a, c, t, g, unknown or other
  modified_base (10870)..(10879): a, c, t, g, unknown or other
  modified_base (12199)..(12208): a, c, t, g, unknown or other
  modified_base (14710)..(14846): a, c, t, g, unknown or other
  modified_base (16926)..(16935): a, c, t, g, unknown or other
  modified_base (17165)..(17174): a, c, t, g, unknown or other
  modified_base (17332)..(17341): a, c, t, g, unknown or other
  modified_base (17616)..(17625): a, c, t, g, unknown or other
  modified_base (18250)..(18259): a, c, t, g, unknown or other
  modified_base (18336)..(18345): a, c, t, g, unknown or other
  modified_base (18463)..(18472): a, c, t, g, unknown or other
ccccctcccccgcaatcaggatcggcgctgggcacgaggagcgccagcccgggcccatgctcctcggcccccacaccgacacctccagcgaggccggcagcagcgtgaatggccgcggcgcgagctcgcaggcgggtggtgtgggacgagggaagagggaggtcgagtcttgtagtgcggggtgaccccagccgtcggcgagtgatggtgcgacggcgactgcagatcgtgtgtannnnnnnnnntgggtggtgtgggacgagggagaagggaggttgagacttgtattgcggggtggccccagccgtcggcgagtggtggtgcgacggcgactgcagatcgtgtgtatcgtcggcccgcgccgcaccaggaggctgccctgtactggcggcgccagcctgtccctgctcctggtcgacagcatggggtcgcaccgacgctttccttcacagtatgaatctacatcccaatgccaccaaccacgcacagggcgacgccgggcccgacggcgacggccgcacctcagacacagcatcgcagtcgcccgcgccggaccctgccccgtctgccaggagggccgaggtgctggcctcgccggcggcaggcattcccggcaccgnnnnnnnnnnnnnnnnnnnnnnnnnggctctgcggcgggagcggagtgcgctgcgctccatcctgcaggagaaggtggcggtggtcgtggcggacgccgagcgctccctgcgctccggcggtctgaacgccgaggtgcgatggggttgggacagggaggacaggaaggcggcggaaggcggcgggagagcttggcgacgggctgcttcctggcagggcgtaggctggacnnnnnnnnnnacagccctgcggcgcgcccggcgtcggccaccaaattgccgccagacacccccaccctcctgcagaccaagctggannnnnnnnnnccagccctgcggcgcgcccggcatcggccaccaagttgccaccaggcacccccaccctcctgcagaccaagctggannnnnnnnnngacgctgaggtgcggtgggggtgggacagggaggacaggaaggcggcggagggcgacgggagagcttggcgcctggctgcttcctggcagggcgtaggctggacgtgcatcgtggtgcggcggcagaccagactggggcctggcagcgacggtggtcattgcgatccccgccctctgcatccaaacctcagtcccgcacgcctccctaccgtccccaggcaccccaggacgcagtgaagaagctgtcgcagcagctggcgtacgtgcagaatctggtgggcgccaccatcagcgccatggccccctcggagtgagacctcgcaattcttccaacattgcagccttcgtgcactgcccaacaacccctaacgtgaccaccttttttattcagtgtacatttggccaatcagagagggaggctgagaacagggtttgcaggttcaagccacatactcaggatgactgatgcaggttgagcactttgcatatccagggcaggagcacacaaaagtcctccctcaccacaggcacgaccgcccccctagcccttgctgcgcggtctctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgccaccagggcgccggactcgttgtcctctgcagccggcgctgctgctccatcggccagcnnnnnnnnnngagtgccaccagggcgccggaatcgttatcctccgcagccggcgctgctgctccatcggccagcnnnnnnnnnnattcaagctacatgctcaggatgattgatgcagcttgagcactttgcaaatccagggcgggggcacacagaagtcctccctcaccacaggcatgacctcccccctagcccttgctgcgcggtctctcagcgggcgcgccctgcatggccaccatttgctcgagcgccgctgccgccctttccagctgcagcttgaggccggcgttctcctccctnnnnnnnnnnnnnnnnnnnnnnnnnnnnnggggcggcgtcgctctcccgcaaagctcccacccgatgtgcggcgcccccagggacgaggctgtccccgctctcctgagcacagccggcggcggcctcgtcgaatgcctccaccccgctgccgtccaggagaaccagcgcgtcctcccagggccgcagcgtgcccggcgcgcccgggaacttggccagtgcccccagcggctgcgtccccgtctccttcttcacgccctgctgctgccggccccgagaccccagcacctgcatggcgcgcggccggtccagggtgaccaaggcggcgacggggcccttggcgggagtctccaacacccgtgtctgctgcctggtgcgtaggtcccagaacctcacccctccgtcctcggagcctgcaagggagcgaggaggtgatggagcggggagggttggcagggaggactgacgcggcatccgactggctgcacagagacgcgtggcggcgtgcacagcaacttccagtgacagcccaagaacgcacccccacactccccatcctgactcgcacccacaaggatgatcccacgcacacacctgagatgagcgtgccggcgtcgaggcccgcaaaggccagcgccaccaccggcaggctgtgtccctccagcacgggaaactctgcgccctgggcgcctcccgccaggctgacctcgtacacggcgccgttgacggcccccgcatacgcggcatggcccccggggtcgagcgccaggctgtgcagggggctgggcagggcgtggcgggccagcacgggccggtcccccaccaggctggccaccactagggcccggtccaggccgacgctgacgaggatggcgtcgcaggcgtccagcgccagcgcggtgacccccagcgtgtggctggcccaggactgccagggctccggcgccgcgcccggcgccgcggcagggtcggcggcggccgccacgagccaggccgacaccacgccgtcgccgccggccgagcagagcagcgcggcgtcggcgctccagcacagcgccgcaacggccttgtagtgcgcgggccagctgcgcagcaggcgcccggagcccgtggaccagaggtggacggcgccggaggcggcgctcccggccacaaaggtgccgcaggggctggccgccnnnnnnnnnntggcgccggaggcagcaccccccgccacaaaggtgccgcaggggctggccgccaggcagcgcagcggctccggcgcgtggctgcgcacgctgacctggtcgttggaccaggtccaggcgtgcacggcgcccttggagctctggcaggccatgaagtggtcccgccccaccagggccaggccattcacggtgcaggcgctggacttgtagctggtgagcgccgcgccagtgtccacgtccctgttgggcagtattgggtcgggttggaggggtggtgtcccctgcacagacgcggggactggaaactatccgatacatgcatctaagcacatgcgggcctgtactacattcacgcgccctcaccagacggtgannnnnnnnnnttataggggtactgcccccggccgagcgcgcgcccggccacttgaagtcgagaccggtgtcacctnnnnnnnnnntatacatgcatctgagcacatgcaggggctgtgctacattcacgcgccctcaccagacggtgatggggccctcctccctccccgcgacgagcaacacttgcgggagcattgggagnnnnnnnnnnnnnnnnnnnnnnnnnnnnnnnnnnnnnnnnnnnnnnnnnnnnnnnnnnnnnnnnnnnnnnnnntacttggtgcaaatggattccaaatattgaatatgtatgtctctgaatcatctcgccagctcgtttgcatgacgcccgctcggatctggtgccccacctgcgcgctcggaagtgcgtaggggggtactgcccccggcccagcgcgcgccaggccacttgaagtcgagaccggtgtcacctgcccacaacggcccttgcagcacccggcgcgaggcctcgggagagacatgcgttcagacaccatgggcagggagcaagtgatgatcaaggtctcaagtggacactccctggagggggacatataccggaagacgccctccctgcacggagtgggggtgctcgtcctccacccatatgcctacctaggaggtgggatctgcccgatttacccccagtgatgacaatttgggatttgagggcgcgtagtctcgcgtcatgcccctcttcagctcgacgccgtgcctcttgatttcgtgccgtagttcaccggctttcgtcaatgtatctccacatcccacaggaagtatgagggaccccgtggtcacagaactcttcgggtgagcttcttaaaagtcgttcgcacagtttgagcctatggcgagccgtcctttcggccctcaccattgtgtgcgaggccccaccagctgctgtccaatcccatccctaggtcagggcatgggaccgcagcccgacccagcgagcccctccccctcacacacaggtgcctgtgccgaagctcctggacatcagtcatcctgcgatacaaccagcggggcgtgggagcctccacgggttaccgccagccgcgggggtctggcgacttccaagatgtgctggacgtgctggattacctggcggggaccctcccgccggggacaaacaagcgcctggtggtggtggggtactcctggggctgctgcgtggcggcgcatgcgctgcgccacccgctcatcgccgcatacgttggggtctcctttcccctcagcggtctcagcatgatcctgggcaccaaagggcactttgaggagctgggcgggacgcgccacctcccccgtctgctcatcaccgggtctcaggtgactgctcaggaggaagagaggggtccgtagggcagtataagcttcttggtcggtggcgatgccgctgggatcatcagctgtgtatgaggccttgctgtagagtgctggaggctatgcagcgaggggggagacatgctaacagaagcaatgtcagatctcagctgcgtccgcacagcttaccacactattttctggatctcctggactggctgtgaatcttgccccgtcacacacattgtttgcatcctccggcccccaggatcaattcagcggcgaggcgcagctgatgcagagcttgaccaagnnnnnnnnnnatgtatgaggccttgctgtggagtgctggaggctttgcggcgaggggggagacatgctacagaagcaatgtcagatctcagctgcgttcgcacagctcaccacactattttctggatctcctggactggctgtgaatcttgccccgtcacacacgttgtttacatcctccggaccccaggaccaattcagcggtgaggcgcagctgatgcagagcttgaccaaggcaggcgggcgcctgctggaggacgacgacagcttccaggtggttggaaccagcggcgcgcccgcacccacgcccggcggcgcagccgccgcgcccctccttcttcgggtgtgggccggcgccgaccacttctggnnnnnnnnnnacgcccgcacccacgcctggcgacgcagccgccgcgcccctccttctccgggtgtgggccggcgccgaccacttctggttggaccaggtggcggccatggcagagtatgtgaatgactggttgcggggcacgctggcggcggcgggggcggccgaggacggcgccgccattacggcgttttcacaggccgcacgcgcctgatgacgctgaagacgatcagtgacagacaggactgacgcaccttgctggcgtctcccgattttccagtagagggaaccctccgccagccgtgaccatgaaacctcagtactgctctatggtgcgggagtgggacagttcatacgaggagggatgggtgagttgggccgcccaatcattcagagaggatgcacttacagagaagcaagtgcggtgctggcgtatagaggtgggtggaggctacatggtggaggcccttgccaaaccccagatgtcagcctgcttccacagcgggcgccagcttctctctcaggtacgcctgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcacctgagcccatcacagtgccggggacaaaggctgcgagttcgtcccgcaggagcccggtgtcaggtggtcagggcaagccagcactgcaagccgagtggttgatgcacatgcacacgctgcttgagccagcccccgcctcacccattgtnnnnnnnnnnaaggctacatggtgggggccctggcccaaccacagatgtcagcctgcctccacagctggtgccagcttctctctcaggtacgcctgcttctgcgtgagtgacctcagccggttccactcgtagaaagggacgctcacgacggtccacctgtgacgtgcacacatgctgaggtcagacatctgagcccatcacagtgccgtgaacaaaggctgcgagttcctcccgcaggaggccggtgtcaggtggtcagggcaagcctgcactgcaagccgaatggttgatgcacatgcacacgccgcttgagccagcccccgcctcacccattgtattccagcagcctgtccctgaacagggtgtgagagaggggctggtacgggggggggggcgcaaagtggagcgggccatctgcctcgactgcaatcttcctgctggtgtgctccccttgcactgtggggttgatgatggcggtggtggttgatgagacgcaatgcgtgtgtgtgagagtaggaagggagggcgggccgcctggtcaggcccaggacttgctgggtccatgtagccccccgtgcaagacaggccgccaaaggtaggaacctacaatcttcccggccccaggtgactcacgtgcaaagtccactgnnnnnnnnnnttgggtccatgtagccccccatgcgagacaggccgccaaaggtaggacactacaatcttcccacccccaggtgactcacgtgcaaagtccactgacagcagaccgttcacggccctggcctccatttcgaattccagaccaagcgtattcagggcactctgcgaagggtggggtgggtgacttcagggtcgagaggggcagcaggcatgggtaggagtgaaagaggtttatgccatcaatgcttccttgcatatatgcacaaggatcatgctgaggcagcaacggtgctgtggaatgcaagtccctcccatcaaattctcaccaggatgtcttgctgcaagtacgacaccgtgggctggtcctccctggctcgctcctccaccaccgccagaatctccgcgggaaggaaggtggagtagtgcttccccgtctccatctgcatgtggggtggagggttccaggtgggtgcacgcagaggggggaggtggaggagatgtggatggggctggttgtcaagaaggtgcctacaaattgctgcaggtttgccggcacttgaaccacgcagggccaaatggtgtcggagtgattgatgcctcctgcgttcatgtccttcaacctcgcatccagccacaataccacagaaaatacagccctgggcggccctcgcccataattccactcaagagcaccatcactggtcccacagcacgccagnnnnnnnnnnaggagtgattgatgcctccttcgttcacgtccttcaacctggcatccagccacaagaccacagaaagtacagcccctggcggccctcgcccataattccattcaaaagcaccatcactggtcccacagcacgccagaaagcccctttcccctcaataaaggctcccactccatcccgcacctgcaggtagagcgcaatctgcagcaggcggccgtggttccccacgtggctgggctccgtggcagcaggggcggcgcgcaggaactccgcgaagcgcgccgcgctgagctggcccagcgtggccatggcccaggccaccatgatgaggtggctatgggaggcctggcgccgttccagccgccctagcacctcctccgccacggcgtcgaggaagggcttaccaggcgactcctgcagggccgcacacgtcaccaggtagcggatgatcgtctgggaaagtaggaagatttagggagagggcctgtttgtgggcaccaaaccgcagaatgttgtggaaaggttcacgccagagtgcaagcagagagccccattcgtcgcatctgcgaaggctggttggactaggccttgctgtaatgtctgtcaagagcaactccacccatggtcagcccagccagaaagatcatggtgaatacccaatcagggctattcgcagcagcaggaactcatctacctcggccttgcaactactgacaacagcccccaaagtctgaaatcaaggtcnnnnnnnnnnacatctgcaaaggctggttggactgggccttgctgtaatgtctgccaagagcgactccatccatggtcagcccagccagaaagattatggtgaatacccaagcagggctatccgcagcagcagaaactcatctgcctcggccttgcaactactggcaacagcccccaaagtctgaaatcaaggtcccctctccttccccgtgccccaccaccaacgcccaagccctctcagcgcctcacattgttacccacagaacccaggtcctccaagattcggccctggatggaggccagcagcggccggtccaccacaaagtgcatgctcatggcctccagagcgtgcatgatgccctgcatgtccatgtacggtgctgagcatgagaccggggattgatggcctgatatggatgggagggcggaacgctcaaccgccccagagatgagcattgcgccacctggcccgttcccaaagggcaagcagcctgtcctcctccttctccagcgcctggcgcgtccgacacagacgcctctgccagccgcttcccgcatcctcaccttccagctgagattggcgcgttgctgggtgacggactggaagcaggcctgcagagatgcgcggnnnnnnnnnnccccgcatccccaccttccagctgagatcggcgcgttgctgggcgacagactggaagcaggcctgcagagatgcgcggggtgcacgcaaccaacggacccagacctcgttcgccacccgatcgaggtcgtgctgcgtcaccagttcctgcgccgcattcagccgccaggcggctgagcgcggtgccgcaccggggcccggggcctttgatggctgagcggcctcccgccctgtgtctggggcggtggggacaccgcgcctcccactcgcagctgtcctgtcctcaacaacctcctcctcctcctcctcctcatcttcctcctcctcctcctcctcatcatcatcttctgcggccgcggcgcccaggagannnnnnnnnnccctcatcttcctcctcctcctcctcctcctcatcttctgcggccgcggcgcccaggagaccgggcggcgactcgccttccgtcgccgaatcagcgctgagctcagcaccgtcaccctcgtcccccgccggcccttcccccgtctcgacctcaagcagctgtggcaggcgctcctgctgggagggcgacgacccctggccctcctccctgcccacaccggggttccaggggtcgcgtggggcggnnnnnnnnnncagcagctgtggcagtcgctcctgctgggatggcgacgatccctggccctcctccctgcccgcaccggggttccaggggtcgcgtggggcggaccccggcggcagccgctcatccagccaggcggggcgcacccagtcctcccgatactccagcatggccggggtgtagtgcggcaccgtcgacgtgatcccagtgacggggtccacgacagtgcgggacggccaggactcgtcgtgcgacactctttccacacgcggtgggagctgcccctgccgccgcgcggcgctgccgatggcgttggccagggcccacacgctgtcctccaggatgagcgtctcgggcgcgctgggctcagaggaggccggcacggcggctgggccgccctgggcggcgcaaagggggatgttgagggtggggcaaaggaaggggccgctcatgtgcgctccttgattttcttcctcccctgatggcgtgtgaccatccaatcaccccgccgcaccgacatnnnnnnnnnnatccctctcccccgcacaccttcttcagcttgtacttgcgccggaccgcggcaatgatctcctccgccgccctcaccgtgtcgcccgccaccttggccacctggcgcactcgcaggtcgtgggtgcgctggaggaaagcgcgcacctcgtcgccgtccagctggcccagcgtcctgccgctaggcagtggggtgtcccggctcattccccaaggcagcacgtctgtggaggggtcagggggttatcaggaggggcgagggggaggagggggtgtaccgcttggcgaggcaagccaaggggaggcggtgtcgaggtcagggcggcggctgtgcctggcgagaaggcgccgttnnnnnnnnnngaggggaggcggtgacgaggaggtcagggtggcggctgtgcctggcgagaaggcgccgttnnnnnnnnnnaaatcagggaggcaccttcacggacacccccgacgcaaacgagcaccccacccatgcccgatcagtctcaccgttcttgtgcagccgcccnnnnnnnnnngtcggatgagaagttgcccatctgcgcttggcgcactttccaaagtcccccgacgattgactcccccccccccgctctgcaatcagggaggcacctcagcgaacacccccgacgcaagcgagtaccccacccatgcccaatcagtctcaccgttcttgtgcagccgcccacccaggaacgcgtccggggtgccgtcgtcgtcgtgcacgtgctgtgcatgctgtgcgagcgcctgcagctggccgccctgcgtcccagtgctcagtgggggggcgtggacgaagccccgcacgtccaccgactctcccggtcctgcagggtcagggtgtgcaggcggggtgtcgtggcagtagagcagtgcatgtgccgctcagtgacaggctctggcaccctgcggaggaggtgtgctgggccgaccacaagcagcagcagtcagaggccccctctcactccactcacgggctgccaggtggttgaggagccgggcctggcgcgtggaggagggcgccaggtgccacctcagcttgccgtaggcccacaggcagcgggccaggtcgtccggggggcagcgcgcggggtccagctcctgcagccgcgcggcggtggcctccagcgtgggcacgcccatgcgctgccgggtggcgtgcagcgcactcagcgcctcgcccagggcctcgcaggaggcgtcgggcagctggcgccacacctctgcagccgcggccctggccaactgcgagagtgaggggtgtttgtgggtgtggaaggagtgtaaggggccgtgcgcggagaggcgtaaggaaggccaaggccgagcgaatgaatgccagcaaaggactgaatgatatcccccccccctgaccatttgaaaccctcagcacacaccccgcctcaccctgccctggagcgggtcgggatcgtgccgcagcagcaggttccagctgcgtcccaggtccagcaggcccacggcgtggtggcggagctggtacagcgtggccagcgcggcatgctccaccaggccgggatcaagcggcttgccggcccgcgcgccagcgcccagcactgcgtgcacgctctgcggcgtgaagctggccagcggcgcggcgcccaagtgcgcggtcagggcctttgcagggtgggggggtgggggaggaatgggggttggaggagggagggcgctgacgggaggatgaagagcgagccattgttgatttgcgaggacgcagctccggtgagggagtgttggcacccaaacgggcacgggagccccgcaccaccccaggctgcttgccaccgggcggggcaagccaggcctcatccgcnnnnnnnnnnagggatgggggttggaggggggagggcgctgacgggaggatggagggcgagccattgttaatttgcgaggaagcagctccggtgagggtgtgctggcacccaaacgggcacaggagccccacaccaccccaggctgcttgctaccgggcggggcaagccaggcctcatccgcctgctgccgagctcatcgtgcatcctccattctcctccaaatcgcaacaccgcctcctcccacccccccagcccacctgcgtgagcctgccgtggagcggatcgtaggcgtagcgcgcggcgcaggccagcgcccgcgccgcatcgggcgtgcccgccgtgaccagcagggccagggtctggcgggccagtcggtccagcatgcggtggctcaccgggtggctgcaggcggccagcgcctcccacagccgcgtcaggctgtccaggcccaggcccgggcccggcggcgcggcgcgggggccgccgccgcgccgcgcccccgccagcgcctgcatgtacatgtccaggtaggggcgagccacgctgtgcacgtcgagttcccccgagcagcgctgcgccagccggcacaggccgacggagaggaggacgtggaggtgggcgggggccaggccggaccctgcacgctccgcgtcgcccagcgccgccagcagcaggccgtgctggcgctcggggtcggccgcgcaggcggcgaggcggaggcccaacccctccagcaccgcctccacgcgccgggtggcggcggagacctcctcgggggaaggtcgccggggcggggcaggggcgctgtgcgccggcggcctcgcgcctgtgatgccgccgtcctgctgcctggagggcgggcggcgcgcgggggcgggcttcacaggcgcagctgcgctggggagagtgggtgggcgtggcgctcggcggcggggcttggccctggatgccggagcaggcctgctaccagagaggccacgggcccaggctgggacggcatgcacatcccaggatccctcctctgacgctctgcagcccgcgcccgctgcctccaggttcctggcgccctgcagcgtcctcaggcttgtgtgggaggaagaggggacacatgggtgagcgtggtcggggccaccctgtagcccatccacccagccccaatcgcaggccatcatccccaatactcacaaggacacccgctggagggacaggaagagctggcgccgcatgcctgcgacgacactactccgcagccagcacgcagacagagccccgaagggcacgttcacgccgtggttctatgcatgcattcgcatcccgagagggtctgataaccttttggtatatttaggccatcctttgcagtgtactctctgtgcagagcgatgcatgtggggcgtttgcatgacggaggtccgtgcccgtcatgcacatcatggcgcacatcgcgccgagagcatgcgcccccccatgggcgaagtcgtaatgcgtcacgcttggtctggcgagatttaaacttttcagatgtcggacgatcgggagaaggagctgcaacaggctctagcagggtgtgtcctcgactccagctggttttactgcgtggcaggggtgggcctggccatccccatcggggtgcgactcaagtcttacaaccccctggtctacttgggactctctggaacactgctggaccttctcaacggtgaggtggtgcaagggaagttggcgccgaggtgtcgtcgggcggtgttgctccgaaacagaacccacccctgggtgcaagtcctgcaggctacaacaagtgcacgaaggagcgggcggagttgcgggactaccagctcgcggtgtccacgcgtgcaccgtgacgctgcgccctcatgtggcaaaggtagaatggggtcaagagaggttctcggcacacccaatctgttgggtggacacaggagtatgcagcagagtatggtgcagcagcggtgcgtcatccatctccctcaccacgctatgcacgctttatcaccctcaggcggctgtgtgggctggtcggccatgccagaggcgcccaggctcggcggctggccactggtgcaggcccagacctcggcctgggagcgaccctacagcgtgccgtcgcttttggcccctctgaggtggcggcgttcgtgaggctgacgggggacaccaaccccatccaccagtccctgccagccgcgcaggccgccggcttcgagcgatgcctcgtcccgggtatcatggccgcctccctcttccccgccctcatcggcagcgccgttcccggcgcgctctacctcacgcagaccctcaagtttcgggcgccagtccaggtgagggctggcggctggaggcttggcgaggtgacgcacagtacgctagaagcagtgcgcaccgagcgtaacgttccggagtcccaatcagaccaatgacagcacgcttgcatcttcctcggccacctgtccgccacgggaagtcgggcgattatcgctgcgtcgagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcgcgtgtccggttcggcgctggccatgctcccttcttccacttgatgctcatccccttgcctggctggcaagcagcgtgcaaggccagaggcattacaccatcattgccggggtcggttttccagcatggcagcaggcaggcgggccgtcactcctcctcatcatcctccagaccggggatcatgaccagggagacgtcaaacacgacgggggaggcgggtgggacccgcggcctgtacatgaaggaagggaggggaaacgggatcagagtgggctgagttgctgaataagcatggaaggcgagccagggagcagcatgagcggcggcctgacacccgccgagctctgcaccccaggccatcccccaccaccgtgcgagaggcatgccacaccgttcctctcacctgccggcggcggcagagaggcccttggggaaggccagtgggccggggacatacaggcgccgcacgccccccagcttcatgctctgcaggccctcgtccagccccgccacgatctggccggcccccacgcggatgatgtagggtgcccccctgtccaaggagctgtcaaacacggcgccctggggggtgctggccacgtagtcgcacaccacctgcatgggcatgtgagggggtttgggggtggggagtggggggtgacatggtgcgagggaaatggagggtgacatgatggggagaggggtttgggtggaggtctgccaaggggtgggggatgtttgaacacacgatcagcacaaacacttgtagatcatggctgtgaccacagtaaccaccgcaccgaccagccagggcccctgggggccagcgtggcggggcccggcactcgcctgaaagcctatgcgagggctgggccccttgcctgggacgagatcgatgtactccaggcccgaggcggtgcgcacacgctccttgtcggccaagctggcagcacagtcggcgtcgcataagacctttgagtccaggctggcctccgcctgcctgccatgggagtattcacgggaggggatgcagagctccatgcaagcgactttaccaagcttaagaagtcaggactcccgccaacgagatcatgccacctcacctgggaatcagctgcagggctagcgtggagaggagtccggcctgcaccagctggcgccgggtggggccggatggcacttcatgggcagatgcctggacctgccggccagcgctccgacaccgtcgaggggaatgctgcggagagaggggcttgaagacatgcatgggatcccaggcaggtggtgaggaggtcgatggccacgatggtgggtcagcgagcgtgcacatgtggtactcttgtcacatacctgtggagtggcagggctgaaaatgtgggtgctggtgcccgtccctgtcaggaaagccattgcattcaggaccatggtgaactatagcatctggctggcgtggatgagctgggtaagggtctgcttcatccctgctggcgtcctgtggtcgcccatgcggaagaatcccttgcagattgcgcgccctccgcctcggcacccgcctggaaagtgcgacttccgacagaaacacgcgatgtcggataagagtgcaacaatgcagacctcgacacccacgttatatataattttgaatccgtagatcacttcctgagaggcgacctggctcggagcgcattccgtgtgggagcttgtgaatgccttgacagtgacccctcgagccttcctcgtcggcaggcttcccaccctgcctggcgatgacgtctcccccgcgtggctgggcacaagcccaggcggctctcctcgcagatgtgaggactttcgaccgcaaagctgggctgcgacccgtacagaagattcatgtcaagacgctcgctggggagcgcgtggagctctggcacggactcgaagacaacgaggtgagcatggtcatgtggctgtggtgtcgaatggactgatgtgtgacatttaattgttgtaccaatgagtgtcctgggccgctcagtcctgtccctctgttccagcaggaaccacaggggcaagagctggatgtgcgattggccatnnnnnnnnnncaattgttgtaccaatgagtgtcctaggccgctcagccctgtccccctgttccagcagggaccacgggggcaagagctggatgtgcgattggccatctccaaattacaggcaatccgtgcgggggccaagcaggaccgcatgccctgcagagttctcaaaggcctttacgtaggtatgtaccatggtatactggcgagaggggggaagcttgctggatgtatgcatggannnnnnnnnncaccgtggtattctggcgaggggggggaagcttgctggatgtatgcatggacaggtgcttgtaggatggacaggtgcttgtaggatggggtgttgatatgaacttcggtggacatctccctgaggttgtctggggtgtccattggaggcgcatcccannnnnnnnnnatgaacctttggtggacatctccctgaggtcgtctggggtgtccattggaggcgcatcccaatttgcgtccaatctatcttgaatttacatccatgcatctcatgaagcccctcatggtggcccccatgacgctggagtgcggacactgaaatgtttcctgataggcccctgcatgtccagtccctcaccaccccgtccaactcctccgcagggggcatcggggcggcccggaacctgcgcggtatgcgcaaggcgggcatcacccacgtcgtcnnnnnnnnnntggcatcggagcggcccggaacctgcgcgccatgcgcaaggcgggcatcacccacgtcgtcaacgcctcccccgtggtcccctgcttcttccgcgacgttccggaaggcgcagtcacctacctcaccatcccgctcttcgacgacgaggaggccgatctgctcagcgccctccccgacgttgttgatttcatcgctgcggcgcgcgcacagggcggcggcgtgctggtgcactgctatgccggccagtcgcgcagtgtggcactggccatcggttacctgctccgcacccagccggggctgggggtgcaggcggcgctggagctggtcaggcggacgcggccgtgcgcgcggccaaacgcaggattcatgaagcagctggagcagctcgagcgagagcgcgagtgagcgcgtgaatgcacgcaggagcgtgagcgagacagttacaccgaccccccccctcctccaccccccaagcccccaatccctcccattccgagggtgtgatccctgaggcctcagttcaggtcccattccggccagactggtccaagagcgtagtgagatgtatcccaccacccccctgtaccctccctgtaagatcccagtgtacaccctgagggcgtnnnnnnnnnnggagtgagcgcgtgaatgcacgcaggagcatgagcgagacagttacaccggacccccccttcctccacacccccccnnnnnnnnnnctgagggagaccgtgggaacgtggaggcgggtacccaggttcctccgaaaaatcttgaaataattcatggagcaatgggatcgaattaggatgtgccgcacgggattgagtttgtgcnnnnnnnnnngtgagggagaccgtgggtacgtggaggcgggttacggggttcctccgaaaaactcttgaaataattcatgcagcaatgggatcgaatcaggatgtgccgcacgggattgagtttgtgcgagggcgtgggcgcctggcaaccgcagggccggagagtgccgtgcgggggagagatcatgccattttgccccatggctggccccgcgccgggctagccatttaatgcagaaatctccggtcccagtgtcctgcctcgatgatttcgtccagaaggcgggcttcggcacaccaggatgtaaaggatggccggaatgattagttgagacgggggagccatgcaggagagtaccggctgggtgccctggcacagcccccaggatcaggagctgcgggccaaagtgctgaaaattatggtatggtgtgatcggcaggctgtaccggggactggtgccgggccgggggggttgtccccagccttccctcgggtgcacaagcggatggtgccgggtcagcaccgaggccctgagccccgccgatccggtcccggcctcgcggggcggtcggacatcgccttttctgtcgcctgcgcccatccccggcgctgcgcagggccgcgtgctcggccatgacccccagcaaggcctgcgtgcccgaaaagtcgcaggcctgcgtgccttgagtctccgtgcctgcttttcatcccaccgccctccctcctcccaccccttgctcctgcagcacaacctctttgcagcgcgcaagccggacatactaggtgggcagccggttgtgggtctgggtgggagtttcaattggccagccactcgggcagtcacatgtgcccccgtgcaaggcccctgtttggtgtggcctggctgcccatgcttgcctcgcctctgtcgcaccatatcggggcaggggatgcgcctgtcctcctccacattcactgccgccatgtgccacccccctcccgccccgcctcgccgccgcagttgtgggcgactccgatgaccccaacaagctccccgacttcctgggccggctggaggaggcgctgtacaaggccgcgtccagccgcgaagagtacgccgacttctccacgctggaggcgcgcttgcaggccgtggtccgccgcgtgatgaacaagcctggccgctcggcggcgagtgcagcggcggcggcggcggcggcagtgggccccgcaggcccgggccccgcctccagcacgccgcccccaggccacctggcgccggggcaggcggcgccgcagcaccacatgcagaacgggtacgccgcccccggcagcgcgccgcacgccgcacaggcggcgcaagcggctcagtacgcggcgcaccaccatgcgcagcagcaggcgcagcaggccgcgcagcacgcgcagtacacagcacagcacgggcaggcggcgcaggcccaggccgcgcaggcgcaggcgcaggcgcagcagttccaggcgcagcacgcgcagcaggcgcaggcccaggcccatatgcggcaggcggcgctggcgcagcagcaggcgctcgcgcagcaggccatggcccagcatgcgcagcacatggcgcggtatgcggcggtacagcagcagcagcagcagctcggtggcgggcccggg

SEQ ID NO: 39674 - DNA, 75 bp, Chlorella protothecoides
tcaacccgtgcgtcgtgtgtgttatgtgtgtgtgttggaggggagggggggggggaattgagggaacgcagactc

SEQ ID NO: 39675 - DNA, 67 bp, Chlorella protothecoides
cctgccggtgcagggagcaggggagacaagaaatgcacaatggcagacgtgaaagagcccatcgggg

SEQ ID NO: 39676 - DNA, 79 bp, Chlorella protothecoides
ggcttcatgctctttgcctacatccactacccagggtcctggatctacttcaccccaggtagagggaggcatgggcgag

SEQ ID NO: 39677 - DNA, 61 bp, Chlorella protothecoides
cctcgtgtcaggccaacgaaatcatggctggtctggtccctgtttccacttcacatggagg

SEQ ID NO: 39678 - DNA, 176 bp, Chlorella protothecoides
tgggtcccggcgggtgggatcagatcatgccgaattgggacctggcgaggccttcagctgggagcaccttcaccatttggtggacagccagggtggcggctggagactatgtacaccagactacaggcagcggaccccgtgctccgtgccaagagcagcaggacccgccatgcttg

SEQ ID NO: 39679 - DNA, 133 bp, Chlorella protothecoides
ccaggttcttggcctggggagtggggcagtatgtgacacagcatgtgtgtgtgtgagtgtgcgtgtgtgtgtgtctggccggggtctgtggagcgcgatgctcgagagcccacaccccaaggaccggcgggcc

SEQ ID NO: 39680 - DNA, 105 bp, Chlorella protothecoides
gtgccactcgctggagggcaggtctggcaagcttcaggattccattattttcaaacggaaacagagctctccccctagcctcatgcccagccactctgcacccca

SEQ ID NO: 39681 - DNA, 61 bp, Chlorella protothecoides
tggaggtgggggacggagaggtggcgggaggcgaggcagtgggagtggatgtcttggggct

SEQ ID NO: 39682 - DNA, 61 bp, Chlorella protothecoides
ggttaggaagggggaacattaatggcaggggactggcctgcagtgggggggatgggggggg

SEQ ID NO: 39683 - DNA, 61 bp, Chlorella protothecoides
ttagcaacgcgtacgctgatcgacttggcaggagctcaccccttgtggcatttcataagaa

SEQ ID NO: 39684 - DNA, 13343 bp, Chlorella protothecoides
  modified_base (303)..(312): a, c, t, g, unknown or other
  modified_base (613)..(622): a, c, t, g, unknown or other
  modified_base (1071)..(1080): a, c, t, g, unknown or other
  modified_base (1615)..(1624): a, c, t, g, unknown or other
  modified_base (1896)..(1905): a, c, t, g, unknown or other
  modified_base (3300)..(3309): a, c, t, g, unknown or other
  modified_base (4064)..(4073): a, c, t, g, unknown or other
  modified_base (4419)..(4428): a, c, t, g, unknown or other
  modified_base (5113)..(5233): a, c, t, g, unknown or other
  modified_base (5889)..(5898): a, c, t, g, unknown or other
  modified_base (6668)..(6677): a, c, t, g, unknown or other
  modified_base (7099)..(7108): a, c, t, g, unknown or other
  modified_base (7276)..(7285): a, c, t, g, unknown or other
  modified_base (7651)..(7660): a, c, t, g, unknown or other
  modified_base (8375)..(8384): a, c, t, g, unknown or other
  modified_base (8719)..(8728): a, c, t, g, unknown or other
  modified_base (8963)..(8972): a, c, t, g, unknown or other
  modified_base (9442)..(9451): a, c, t, g, unknown or other
  modified_base (9621)..(9630): a, c, t, g, unknown or other
  modified_base (9897)..(9906): a, c, t, g, unknown or other
  modified_base (10033)..(10042): a, c, t, g, unknown or other
  modified_base (10130)..(10139): a, c, t, g, unknown or other
  modified_base (10684)..(10693): a, c, t, g, unknown or other
  modified_base (11188)..(11197): a, c, t, g, unknown or other
  modified_base (12104)..(12113): a, c, t, g, unknown or other
  modified_base (12448)..(12457): a, c, t, g, unknown or other
  modified_base (13092)..(13101): a, c, t, g, unknown or other
gccgcgcggccaggcgccgcgcggcggaggccacgctgcccagcgcgccacgctcgtagtccgatccgcggccgacggagaggccggcggcccgccaggcgcggaagccgcccttgaggaagtatgcccgccgcgcgcccgcggcgtaggcggcgcgcgccacggccttggcacgcgcgtcgttctgtttggggagtgggtgtgagggaatggaggatgagggatgcggtgctcgcagaggagcgcttgctttgcggagtgggagtagagagggtgccatgatgtggcactgagagactgctnnnnnnnnnnaagtgggtgtgagggaatggagaatgagggaagcggtgctcgcagaggagcgtttgcttcgaggagtgggagtagagaggtgccatgatgtggcactgagagactgctccaccctctagaagcacgccatggtgccagatctcaacagtgacaatgtgacagcggctctgcacggctctcaaggcccagcacacagcggctatagcccctgagggtggggcatcggctccccgacccctttcccccccaccgcttgaatgggcacccttttaccaactcaagaacaccgctcgcctcaccnnnnnnnnnntcgaccccttcttcccccaccgcttgaatgggcacccttctaccaactcaagaacaccgctcgcctcaccctcgagtccaggatgaccagcttggtgccgcgctggagggccttcagcctcgcgatctccaggcccagagtccgcagcgcgacgccctgcgggtccgccagcctgcggtagtgtgtggagggaatgggtgatggggaggtgtttgctgacaggagggggacccagagcactgcatcagctctgtaaaagctgatgctgtggggtgcatggactagctgacagcgatggccagctctgcattcgccaggcagggaaagcatgacctcatggccggcgctgcatggactagaaagcatagcccacagccacccacgagagcgtctccagacacgtcagtactcaaccccccccacccaccacccaccacaagcacgaccannnnnnnnnnaagctcggcattcgccaggcagggaaagcatggcctcatggccggcgctgcatggactaaaaagcatagcccacagccaccctcgagagcgtctccagacacgtcagtcctcaaccccacccacccaccacccaccacaagcacgaccaccagacccacttcttgaccaggccagggtcgagcgtgggcacgggcagcgcgacggcggcgcagccctcgccgtcgcccaggtcggggatgccctctgaagcacgcgtgccggcctcgcggatgtccaccaccagtattccgccctttccgggcgcagccagggcggccgccaggtcctcggcggagagtgtgccggagaacccaccccgcgttgcgcgccagagcaagaaagtggggagcaggaaggcggccgcggcggcgggcgggctctgcgccgtccactgcacggcctgcaggagcgcgctgccacctggacatcgtgtgaggaagggggaaggttgagatttggggggaatgggcaatggcatcagtggtttgagctggnnnnnnnnnngggcacccgcggcagcgggcgggctctgcgccgtccactgcgcggcctgcaggagcgcgctgccacctggacgcagtgtgaggaagggggaaggttgggatttgggggggatgggcaatggcatcagtggtttgagctggtacacggctctttggagtgaatctaggccttgctgagtcgcgcatggtcatgcaaggttgggcgggccgctgacggcatggccaggcaggagcaccttcctgcatgcttcaccaaaaatatctcattctcannnnnnnnnnctgagtgaatcttggccttgctgagtcgcgcatggtcatgcaaagttgggcgggccgctgacggcatgcccaggcaggagcacctttccgcatgcttcaccaaaaatatctcattctcaccggcgccaagcaggctctgcgcctcgggcgggagcaggtcgtagtagcgcgccacgctgcccaccaggctctcccgcgtggccgccagctgctcggccgccagcctcgcctcctccgtcacggcgctggagctgccctgggccaggccctgcaccgcctcggaggtggacccggtcaggttttggaccgcgtccgtgaccgtgccggtcaggccctgcaccgcgtcggcggccgagccggtgaggcccttgagcgccgcggccgccccgccggccgtctcgccgaggccctggaaggcgcgctccagtgactctcgcgtcccctgcagggccgcccccccgctctcctgcagacccctcaggtccggggcggagggcagggagaaggtgctcgtcccccctcccacggattgcaggagcgaggggtctggcgctgcacccacggcctgggtcgcctgagctgtggcatccatggcctcattcagtatgtctgacgcagcatgcggggccgggagctccagtgttgcccctgcaatgggccatggaggggggggcaccatttgttgctgtcggcatgtcgctgccaactttggggcactgctgctacaggcgtgggaacccatgcccatgcgacctggcatcgacacgccacggaggatctcaccatcaggcgcggctctgaggagatgaagtcgcctgacactacgatacggtctcgcgccccgaccagggtgacggatcggtgcccgaggggccgtgtgggacgctacggtctgcgggtggaaatgggtgcgttgtcatgaacatcctccagccagtcaagcgaggcttcatactctgaattttgccgacttgaacccacgggaccacaaataattcatttcattgcagtcagacctgagggatgccctgcatgggagctggcgatcaggatgaagcccgattgagtgctgccgtcgatctgctactgcgggctcttgatggaaacagaccccttgctcgcatgcccggacgtcacttgaggcctggaaatgcgccaagcatggattgggtacgctccccccccggcaaacggtcaggggaatcaggggcgcaggggatcggtatgtgtcggaccctactttctttcggacgaatcgcgttggggagattttttccagctcctcgggggacaggtgtccaggataccccaaaactcacttcaatctagaacctggagtgcagcctgaagccaacacgatcaaaatatgctacagagctcgtcatcatttcccannnnnnnnnngattttttcagctccgcgggggacaggtgtccagggcaacccaaaactcccttcaatctagaatctggagtgcagcctgaagccaacacggtcaagatatgctacagagctcgtcatcatttcccatcgacactccctggttgggcatccttcttcaccgcggcctccatctcagccttccgccgcctcagctcgcccagcagctcctcttcgctcagctcttgcaagtttgccctagttttcgctggatgacctgctgccccttgagtcacctcccccccttggcccccagccttgccccacgccagctcggcagaggctcgccgtttggcctcgatgtcgacgtcctcctctgcggctggggggcccacgctcgctagtcccttttcccccacgccgcgatcgtcctcgtccagctccagggtcttgaagggcgcccggggccgagtgacggagcgtaggtcctccctcacctcgtccagcccgatctccctttccagcgtgctgcgcagctcggcagacacctgggtcagctcctggatggcaggctggaacgtacgcagcgtcttccccagactcttggctgcctgtggccagggtgtgccgagtgggatccagtgtgtgcgaggagctcaagggagcagcctggcaggggtaagcttgcattgtgctccagaccatgaacgcttcaacaatctgggtcaggaccctctgcgactatccttgctgggcccagagcacacctgggccaggcnnnnnnnnnngtaggcttgcattgtgctccagaccacgagcgctccaaacatctgggtcaggaccctctgcgcctatccgtgctgggcccagagcacacctgggccaggcctttgggcccaaacaccaccagagctaccactcccacgaggatggcttcaggggctcctacgccgaagaacgatgcctgaactgccagacccctccgggaccgatccaggagctggcgtgccgctggagagccatggtgtgacgaaatcaaggggcgttatcttgagagtgttcaggcaccgacacaagtgatcgccccctccagtcacgggacagtctcacctctccgtcgaggtctcgcggtgnnnnnnnnnntaaggggcattatcttaatagtgttgaggcaccgacacaagagatcgccccctccagtcacgggactgtctcacctctccgtcgaggtctcgcggtggtgaaatacagggcagaggacccagcaaaggctctgggaccctcgttggaagatgtgcaatgcgataatcgcggcctgcagcagatagactgcgttccggtgcgatgttgcatttgcatggcggaggggccccacattgggcaggaggattcccttgaacgcctgggctgcccctcgatgcagcaggggcacgatgtcaagcggtcgacatgccacttcacattcctggtctaagtgcagtcgaggtctgatcatgtacagcccggcccaacgcatgccgtcccggagcccccgaatcctcgttatcatgcgtgccgtgcatgctgcgcccccgagctcatgatgatgaggcacgatccccccctgtacaggacccgcgaaacggccagaaccatccgctcagccccctctagcgtgtagatagtgctgaggagttttctgtcacccataaaactcccgtagactccgtcttgtcgagcgagaagtcgcagcaggtgcccactcctcacaaccacatggcatttgcgtcgagcaaggtgcgctcgagccgcatgggagcatgcagcgcactttttaaaccacaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcagccaatggaggccagtccctggcctgccggcagccccagcccgcctcccgccacctggcctcccgccccgcccccaccactgccaagggcgagggcatgaagcccttcgacggcttccgcaaggtcgggggccagagggggaacatgaagcgcgacgtgactgacggcaccaagcgcatcaagctaccggtgggcaccattccctttgactctggggagcggcgcggggacaacaagaacctgaaggccatcgaggtgtacaacgggcgcagcggggtgttcaagcagagggaggtggcgggcaaggcctcgccacgcatcctggggcgcatcgagcaactgcgcctgttgagcaagctggagagcgcgggcctgctctccgccatcgagcgcggcggtttcacgctgtccgacatcgagaagtacggcctgctcagcacgactgagagcctgggcctcatctccgccgcggcagacaggtgggcctggcaggggtatggtgggtcaccgggccttgcaggcgcctaggtggagccagggatgcacttgggcaagcgttgtggtggcgctggatcaaacccctctgctggagctaatattgtgggtcagcatgcctcttcacttcaggagctgcactcagagctactcccnnnnnnnnnngcttgggcaagcgttgtggtggcactggatcaaccccctctgctggaactaatactgtgggtcagcatggctctgtacttcaggagctgcactcagagctactccctatccaccatcctaatctgcaggaacacgccacggctcctgttcggtgcagctgcagccctgctggctgccgcgcctgccctggtgtactttgtgcccgacaccagcaactggctgattgctggacaggtggcggcagccgtcctcctggtcctgggtggcaccgccgcttatggcggagctgcgctgctcaccgccctccacaaatgagcctggaggctctcatgatccgaggtttttagaattgcacttgattcctgtgctccccgtggcatggggatgcacccttgtttgaagacttgtaaaggcgaggcgggccaggcatgtagctgagaggggggagctttgttcactgcctgcccagctcacgaccatgggaatgaatgattgcatgccatgctgacatagtcgtgtagtctcatgcaggacggaagctcacggcgatgcgtcaatgatggtttctattgtggttcactctgtctgagttcatgctccggcagcagatgtgtcagagtatagcgggtgcagaactagcacctgcactcccagcaaggctgttaaaggtggggcggagtcattaagctgggcctttacgagctctgactggagggaggtgcatcaagggcatcaatgcgtgtcgtgatggatttcgaaagcctggaaannnnnnnnnnaaagctcacggcgatgcgtcaatgatgattactattgtggtttactctgtctgagctcatgctccggcagcagatgtgtcagagtataatgggtgcagaacaagcacctgcactcccaccaaggctgttaaaggtggggcggaatcattacgctgggcctttacgagctctgagtggagggaggtgcatcaagggcatcaatgtgtgtcgtgatggatttcgaaagcctggaaaggacacctaagcatgatgcgtcagcggaaatcctatgccatgtcggagaaaagcgatcattgatgcgatcctgcgggacagaagacccaatatccattcacttgagcatcacactaggaacaggaattgttcgataaaacaggggatcccggtccagcgcatcacaattatgtccacagcacatccgnnnnnnnnnncgttcgaccaaacaggggatcccggtacaacgcatcacaattatgtccacagcacatccgcgtgagctcgttttgtgcaataccgatcccacgcactgagcctccattcaaaaacaatacagatcatactcaatcccccatgccactgtacctgggcctcgatgtggnnnnnnnnnncgcgcaataccgatcccacgcactaagcctccattcaaaaacaataccgatcatactcaagcctccatgccactgtacctgggcctcgatgtgggaacatctggtaccaaggctctcctgtatgacccagacaagaagcaggtgttgggtaggggatccgttgcctatggcgtccagagcagtcgcgctggggaggcagagcaggaccctgcaatctggatagaggtgcgcttcaattgacaggttgatcctcctccttcgggcagctgtgtgcaggggggggtgctgcgcttgcgggcctggggcgacaagcttcgttggcaggtgctctccccatcacctccccacaccaggcggtctgcacgnnnnnnnnnnactttgggcagctgtgtgcaggaggggttgctgcgcttgcagccctggggcggcaagcttgattggcaggtgctctcccaatcacctccccacaccaggcggtctgcacggcgagcaggcaggcactgcagggcctcccggcggaccaggtcaggggtatcggcgtcagcgggcagcagcatggcatggtggtgctcgacaaggacaacgtggttctgcggcctgccaagctgtggtgcgatgtgaccagcgctgaggaggctgaggagctctccagggtctacggcaccaccctcgtgccctccttcacaggtgggatggttcaggatgtcaatgctgacctcatgcctgtcttccttgtcatgtggatagacaaagggggtggacagctcgttcagccgtcagggtgcagggaatggtttctatggagaggaggggcaccatgctcaactcatcccgtggccttggaacggcaacctctgggactcccactcaccgcgtgcatcaccactctgtgctgcagccaccaagctcctttggctcaagaggcacgagccagatgtgtttgcccaagtggccacggtgctcttgccccacaactacatcaatttctggctgactggcgaggctgtaatggaggtgagggggtgcggggggatttaaattctttcctttgtcgtgcgcgtgtaatcaatcacaccgaaagctaggccgnnnnnnnnnncatggaggtgagggggtgcgggaggatttaaattctttcctttgtcatgcgtgtgtaatcaatcacaccgaaagctaggccggctcccgggcaattgaggatgctgcatcagtagccctgcttgacaatagccagtccgcctcagggctgccaatctttcatcttccagtacctcctctttcctgtctgacctccaatgcaactggcacaggccagcgacgccagcgggatggggttcctgagcgagaatcctaggctgtgggattgggagcgagtcaaagccgtagaccctaggctctgcgattgcctgccgccgctccggtctgccaatgagnnnnnnnnnncggggttcctgagcgagaatcccaggctgtgggattgggagcgggtcaaagccgtggaccccaggctctgcgactgcctgccgccgctccggtctgccaatgaggtattgcctgcagtccatggcctgatctttggaggaagaggggccgcatagaggttgctttggaattctggccttcagacagggactggatggcaacaatttctcatcccctcgcccacccacagcccgcnnnnnnnnnnttttggaggaagaggggctgtatagaggttgctttgaaattgtggccttcagacaggactagatggcaacaaattctcatcccctcgcccacccacagcccgcggggcggctgcagcccgacgctgctgagcgcttgggcctgccagctggcatcgtcgtgggtccaggcggtggggacaatgccatggcggcgctgggggtgggcgccgtggaggagggcacgctggtcctgtccttggggacatcaggtgcacggggactctgcatggcattccacatgccttgcatcgcatggagggctatcgatttcagccaatccctgtgttgaggcaaaggtgttgtgtcatttgatcttacatggcatgagggtgcaaggcaccagttcactctcttgaccctttcccaagcatgaacatcataaccacaacagggacgctgtttggtcccagcatgggcctgatcgaggacnnnnnnnnnncatcgatctcagcaaatccctgtgttggggcaaaggtggtgtgtcatttgatcttacaagggcatgagggtgcaaggcaccagttcactctcttgacccttccccaagcatggacatcaaaaccacgacagggacgctttttggtcccagcatgggcctgatcgaggacnnnnnnnnnnatggctgcccctgctgtgcatcatcaactgcgctggtgtgccagaggaggcaagtggcggaggtggtgtgtgggtgtggctgaagtgctctgcattttggttatcagaggagtgggatcgctcatacaaagagcaacggaggttcccagcagatgttcgagaccacccttttgagcgagaatgctggggccgcggcagcggctcaacaggtacaccttttctttgctcacctcgttcacaccctcatcacccccacctgcaccgcgnnnnnnnnnngtggctgcccctgctgtgcaccatcaactgcgctggtgtgccagaggaggcgagtggcggtggtggtttctgggtgcggctgaagtgctctgcatgttggttatcagaggagtgggatcgctcatannnnnnnnnntgccctgctcggtgagggcccccgggatcactgagcatgacggggcagggtggggggttctgccctgtggcccggccagccctacacnnnnnnnnnncgccctgctcggtgtgggccccggggatcactgagcatgatggggcagggtgggggtttctgccctgtggcccggccagccctacacagctccaaacccactcctgaggccccaatctcaccctttcctgtggcggctgcaggtctgcgcgtcggcagcagcaggcccggcctggtctaccgcgccgcgctggagggcgtcaccttcctgctggctgccgggaaggagcggctgcgtgcgcatggcctcgtccccgacgagctccgagtggtggggggcggggcgcgcaaccgtctctggcgtcgcattgtggccgacgccttccagctgccgctccgttttcctctggagcccgaggcggctgcccttggcggcgccctgcaggtgaggcaggaaactcgggatgcacgtgccagggggtgggggtggcgtgtgatgcatgcagtgcctcccgtacctgccatgtgtgcaccgcctgccaggggaacggctgcgtgattggcggcctgcaccggccgccgaccggcacacacggtgcccatcannnnnnnnnncggcggcgccctgcaggtgaggcaggaaaactcgggatgggcgtgcccgggggtggggtgggcgtgtgatgcatgcagtgcctcccatacctgccatgtgtctaccgcctgccagggggacggctgtgtgattggcggcctgcactagccgccgaccggcacacacggtgcccatcaccaccagccccgtccaatgccccaacgtaggccgctgccatcgatcgtggccagagggtgggcaagttcgtgtcgagccacgggatcgcactggaggagggcgccacgctgccggaccccggggtggctgacgcataccgggccgcgatgcagcgcagccgggctctgggccaggcgctttttggcgaggggtcccctggccagggtgcgcactgaggacgctgctggccgggcagccaggcaattctggtaggaaagggtgctcgtgaggcacgcgccacggcgcatgccatacctcccatggtgtccaaggggtannnnnnnnnnaagggtgcgcactgaggacgctgctggccgtgcagccgggcatttttggtaggaaagggtgctcgtgaggcacacaccacggcgcttgccatacctcccatggtgtccaaggggtagggtcgcctcctgtctatgcctggtccacctccctctcccctgatgcaaggagaccctgcatcatgcacccaggccttggtccccgtccctgtcctgatactgatccaagaattcttgggtaacaggtgtgaagctgggggcaattgggcagggcacccatgtgagtgccgggcgggagcaagggagacaatggggaggggtgggcacagggagtcgcaaggcaagcttgcagagcgagacatgggaacgagggcgagggactgggagggagaaggagacgacgagggagctctgtggaggcgcaccacggcaggggctggggaggtgagtccaggggcagctccctcccgggcgcaggcgtcggggcgtgcgagcgcagccatccgtgtggtgcagtgcccgccagcctgtgagacgcgcgggccacagagcacgacccctggggcgctcaggcctctgtgggcacatccggggcgtgcccgttggtcagcttgtcgctggtggagggcgagtgcagctggagctcctgcagcgcggcgcgcatggcctcccggctcatgcccgtgctcggtgtctccccgcccagcaggctgtgtcggtggggcgggaggaaagggggtcgtgggatgacatgcggccccctctttttgcaatctccacgcctcctcgccacccctgcagcctcgtaccaggagccagccctacgccacgccaaagtcctcctcatacctcccccacccaccacaatgacccacaacacacacacactacctgacgttgctgccgcgcnnnnnnnnnncgtctccccgcccagcaggctgtgtcggttgggagggaggaaagggggccgggggatgacatgcggcccccattttttgcaatctccatgcctcctcgccacccctgcagcctcgtaccaggaaccagccctacgccacgtcaaagtccttctcatacctcccccacccaccacaaagacccaccacacacactacctgacgttgctgccgcgcttgccccgcgccaggcggcgcagctgcaccgtgatgcgcacacgttcaacggcctgggtcagcgtgccaatcagctccgacagctcggcatgggacaggtcgtccaggtagtacccctgcnnnnnnnnnngcgctcgacggcctgggtcagcgtgccgatcagctccgacagctcggcgtgggacaggtcgtccaggtagtacccctgcacatggttgttctgcgcctccagccggtccagctcgcggcgcaggcacgcgttctcgccgcgcagcgtcgtgttctccgccgtcacctccgacagctggccctggatctggtcctccagccccgccaggctggccagcaccgcgcgctggctcccgatctgctcctccttggcgcgcagcgcatcaatggccgcgcccaccttgctctccatggccagcaccttctccgccagcacgtggtcgtagccgtggcgcagcgtgcgcgccgcggacaccaccgccgcactttctccggccacgtcctcgtccagcccgtagccgatggcgtcggggtccacaccgcgtgactcggcaagctgcgggttgagttgatggggatggtgttctgggtgtggaggggcgggagaaagcttggagcaatgcaggagggctgtgggggggtggagcaggaagattgcgcagaatgcagaggcaggagcaacgtgcatcgcagggctgttcctcgcagccatcgactcacccctccctcacctgcaggcgcatgcgctcgagggcnnnnnnnnnnggagcttggagcaatgcaggggggctgtgggggggtggagcaggaagattgagcagaatgcagaggcaggagcaatgtgcatcgccgtgctgttcgtcgcagccatcgacccaccccctcctcacctgcaggcgcatgcgctcgagggcgcgggccagcttgtcgctgtgctcgtccgaggcagagagctgggcctgcaggaactcgcgctcggccagcatgatctgaggaccggggggggg

SEQ ID NO: 39685 - DNA, 61 bp, Chlorella protothecoides
gccagggcagcgtagcagcggcagacgcggggctgcggcgaggccatcctctctgtgcggc

SEQ ID NO: 39686 - DNA, 96 bp, Chlorella protothecoides
ggcgtcgccctgggctcgccgcatagacgtgaaggtgcagagggctgctgatgggtcttggttcgatgaggggtgatggcggcgaagggcagcagg

SEQ ID NO: 39687 - DNA, 61 bp, Chlorella protothecoides
gttggggggtataatgtgggtgggtacgacggccgagtctcaggggcacacaccaaagggg

SEQ ID NO: 39688 - DNA, 80 bp, Chlorella protothecoides
ctgcctgcagagtgaggaggtgtggggtggcggtccagggtgggctgcgtgctggctggcctggcagaaagtgtccactc

SEQ ID NO: 39689 - DNA, 61 bp, Chlorella protothecoides
aagcagccctcaacccctgcacctcgggcatggccaccaaacactccccgctgcccagcac

SEQ ID NO: 39690 - DNA, 77 bp, Chlorella protothecoides
ctgcacaggcaaccccgccccgcttccctttcccctcgggcccctaacacctccccactcttccaccagcactcact

SEQ ID NO: 39691 - DNA, 23495 bp, Chlorella protothecoides
  modified_base (212)..(221): a, c, t, g, unknown or other
  modified_base (394)..(403): a, c, t, g, unknown or other
  modified_base (774)..(783): a, c, t, g, unknown or other
  modified_base (1020)..(1029): a, c, t, g, unknown or other
  modified_base (1329)..(1338): a, c, t, g, unknown or other
  modified_base (1752)..(1773): a, c, t, g, unknown or other
  modified_base (1986)..(1995): a, c, t, g, unknown or other
  modified_base (2060)..(2069): a, c, t, g, unknown or other
  modified_base (2329)..(2338): a, c, t, g, unknown or other
  modified_base (3451)..(3460): a, c, t, g, unknown or other
  modified_base (3852)..(3861): a, c, t, g, unknown or other
  modified_base (4026)..(4035): a, c, t, g, unknown or other
  modified_base (4273)..(4282): a, c, t, g, unknown or other
  modified_base (4444)..(4453): a, c, t, g, unknown or other
  modified_base (4789)..(4798): a, c, t, g, unknown or other
  modified_base (5152)..(5161): a, c, t, g, unknown or other
  modified_base (5291)..(5300): a, c, t, g, unknown or other
  modified_base (5372)..(5381): a, c, t, g, unknown or other
  modified_base (5545)..(5554): a, c, t, g, unknown or other
  modified_base (5837)..(5846): a, c, t, g, unknown or other
  modified_base (6120)..(6129): a, c, t, g, unknown or other
  modified_base (6627)..(6636): a, c, t, g, unknown or other
  modified_base (7150)..(7159): a, c, t, g, unknown or other
  modified_base (7437)..(7446): a, c, t, g, unknown or other
  modified_base (7930)..(7939): a, c, t, g, unknown or other
  modified_base (8023)..(8032): a, c, t, g, unknown or other
  modified_base (9561)..(9570): a, c, t, g, unknown or other
  modified_base (9832)..(9841): a, c, t, g, unknown or other
  modified_base (10447)..(10456): a, c, t, g, unknown or other
  modified_base (10762)..(10771): a, c, t, g, unknown or other
  modified_base (10834)..(10843): a, c, t, g, unknown or other
  modified_base (11285)..(11294): a, c, t, g, unknown or other
  modified_base (11715)..(11724): a, c, t, g, unknown or other
  modified_base (11845)..(11854): a, c, t, g, unknown or other
  modified_base (12435)..(12444): a, c, t, g, unknown or other
  modified_base (12853)..(12862): a, c, t, g, unknown or other
  modified_base (13080)..(13089): a, c, t, g, unknown or other
  modified_base (13446)..(13455): a, c, t, g, unknown or other
  modified_base (14224)..(14233): a, c, t, g, unknown or other
  modified_base (15366)..(15375): a, c, t, g, unknown or other
  modified_base (16330)..(16339): a, c, t, g, unknown or other
  modified_base (17152)..(17319): a, c, t, g, unknown or other
  modified_base (17397)..(17406): a, c, t, g, unknown or other
  modified_base (17790)..(17804): a, c, t, g, unknown or other
  modified_base (22198)..(22278): a, c, t, g, unknown or other
cgggcgcggcggaggcccccgcgccggccccggctgcgccggccggcgcgcgccgcaaggccaaccccgccatcctggcgaccaacgcgcccctgtccgtggccaaggtgcgtgcgtgcctgggtgtgggcggtgggagtggcgcttgggcctgcagggcctcgtccgatggtggatcggcgccgcggcccggtgaggagcagcgcgccctnnnnnnnnnnacagtgggagtggcgcttgggcttgcggggcctcgaccggtcgtggatcggggccgcggcccggtgaggagcagcgcgccctgctgcccaaccagccagattcggaccccctagcacgacgcccgctgcctttcttccttccccccccctcgtcccactcgaaccagtcgcgnnnnnnnnnngccagcagattcggaccccctagcacgacgcccactgcttctcttccttttccccccctcgtcccactcgaaccagtcgcgcccctcccctccgcaggccatggtggccaagcccgccgcgcggcgccccgcggccgcgcggaagtcgctggtcaagacgctgcgcagcttctaccgcgagaacgagatggcgatggtgctggccctcatcggcctcatcgtcgcggcggtggcgtacatgagcctcaccgccgcctgaacccccgctctggcccgcacggtgcgcgcgcaggcgtggggtctgtgcaccgggtggcacggcggccacgctggcctgcgcgccggcgggcgtagggccccttccttcttgnnnnnnnnnncctggcccgcacggtgcgggcgcaggcgtggggtctgtgcaacgggtggcacggcggccacgctggcctgcgtgccggcgggcgtagggccccttccttcttgaaaagacaaccgattgaacctttgtgccgctctctctcgtgtttgtgacgctgatgttgcaggcccgggccttctcattgatgtgagagagcgagcggatccaacgcttgatgacaagagtgaggatggtgttnnnnnnnnnncctcattgacgtgagagagccagcggattcgacgcttgatgacaagagtgaggatggtgtttctacctcagattgctgtgagcgtggggggatcccaggaccacaccgggtgctaccagtctgttgcggtaagcttgggggagtacacagttgagttcaaagaatggagtgaccatggcaggcaggagcgagtacatttcagagtatacacaagtgtcaggtgcgaccaaggccatgctatgccagcatggtagggaaaacagtcttgtccatgctggtcggtgcatcatgcatgggtgnnnnnnnnnntgggagtacatttcagagtgtacacgagtgtcaggtgcaatcaaggccacgctatgccagcgtggtagggaaaacagtcttgcccatgctggtcggtgcatcatgcatggctgcaagacaggtgccggggccgggccccagaaagctggcgctcagccctgtccactttgcacgacgccttagcttgaccagacagaagataatcacggtgatgacctgcaggacgagggcccaggcgaggaagtccatgcctggcaatgtgtggatctccaggttggcccccgagtacagcccagagcaatggtcgcgcgggccaacatcattccagccctggctggcgttgatgccgccaaacgtgatgtagcccggcatctcctccagacctggcatggcggcagggaggggtgtgtgggnnnnnnnnnnnnnnnnnnnnnnggattgcaatgtgggagactgcatcgctggcaactgttccagacgatgcctgcggggctctcttctcgacagacatcgagtggcaagacagcatcattcctcggctgtgaagcccaacatcgaactcaggaacctcacccttcttgaaccagggctcgtcgtgcagtccatacttgcgttttaccgcatcatcctcgtcccactccgacctgnnnnnnnnnngaagggggcaaggggccgcgacgagatgtttgttagtcagactggactgcaagcagcatgccgtnnnnnnnnnnccgcaagacagcatcattcctcgtctgtgaagcccaacatcgaactcagggacctcacccttcttgaaccaaggctcgtcgtgcagtccatacttgcgtttcaccgcatcatcctcgtcccactccgacctgggagtggagtgggggcgcagagtcgatcgctgctcccaacgaggacaacatgcagagccgtgcagccaaccccagacgcagcccggcatggaatgatcccaggtggcccggcgcaccatccgtggggnnnnnnnnnnaagtggagcggggacgcagagtcgatcgctgctccccaacgagtacaccatgcagagccgtgcagccaaccccaggcgcagcccggcatggaatgaccccaggtggcccggcgcaccatccgtgggggtgggtgagggagtagatggcggtcttctcgctctggtgagcagggtggatcatgcaggctgcatccaccaccccgatcctgtccctcgggtagtcgaggaggaggggccacacaaagtccagcgctgggcgagaggggcgatgggcgggtgtgtgtcaggttgcagagggtccagagaagggggcgacggcccgtgctgcgctgccagggaggcacagctttccatctgcgccaccttgtcattctccccacaccacaccaccccctcaccgtagcctgtggcggtgtcttcatccaggttggggagcaggacagaggtgaccgtcggcatgtcaaagatgggtgccatgagttccacgaatgccgtgtaccgcagcaccttctctgggtcctggtacacctgggtccagaaggtgtagctgtctgggtgccggcagacagagggctggctgagggccagccgatactggctggcgacatcgaacgcgacgttgatggctgggacggggggcaggggtggattgcggtgagtcagtcgtggctcgccgagtcccgcacagcagtcggcaggccggcaggggctggtgatcgcaagcccagcccagcccggcagccgtggcacctcgcgtggacatgatgaggtcgtcgtccgcgaccatgatgtgggtgtagcgatcggtgacccgcggccacacagaggtctgggaaacctggcgcagcagctgccaggagaagccatggcggcgatagaccgccacgcactcgggacaagaccactctgggtcgttgccgacgtagagggcgaggatgtcgaaggaccggtgcttcttatcgtccagccacctacatgtggagggtttggcatgtgcagagaaaacattgtcttgggcattgtagggttttacggtacaatgaccagccccgtgtcccctgtcccccttcactcacgtgatcttatgctgagagttgtcagtgatggctgcannnnnnnnnntagagaaaacatcgtcttgggcagtgtagggtttaacggtacaatgaccagccctgtgtcctctgccccccttcactcacgtgatgttatgctgagagttgtcagtgatggctgcaatgatgaggtaggggcggtagcagtcgaagccgttccattcaagggtcaccactgtgggagctggtgcaggatccgatgcctccgatgtcgcgccctcgctggacttagattcggcaccgtggctgtcctcgttggggctgtcctcgcctggatcagtggctccatcttcgctgtgggtgctgctgctatcctccgcgagcaggctggcagtgtccttaatgggctggtcggcagtctcctcggcatcagctgagggtgtgctgtccccagtatgnnnnnnnnnngcgcgagcatgctggcagtgtccttgatcggctggtcggcagtctcctcggtatcagctgagggtgtgctgtccccagtatgagccagagtcatacagcagaggaggatcaccagccacacgaggccctgtttttgcaatggaaatgagacacttcataaatgtnnnnnnnnnntgcagaggagaatcaccacccacacgaggccctgttttctgcaatggaaatgagacacttcataaatgttggctcgtctggcatgccgaggggaagctcgggtgaagtaggggttcccatgtgcgcacctgcggtgtgctccgtggggccagttcacccgcattgtgaacctgccagataggctgtcgacctagattatggatgaataggatgcggccaagtgtcagtgacaaggggnnnnnnnnnnaccgcattgtgagccagccagataggctgtcgacctaaattatggatcaagaggatgcggccaagtgtcagtgacaaggggcatttcttgctgcatggcacgatggactcgattatgcccctatatagcacctgacgtgcacacctgcagaagctggtgctnnnnnnnnnnccggtggacttgattatgcccctatataggactgacgtgcacacctgcagaagctggtgcttgtggaggcgaggcctgagcgggggacgccgactgcaatattggacgacagaagaaaaatatttaatggtgttcagattggtgctcttggtgacgagcttcattttcctggcgtcgagctggagggcggagttgggggcatgttcaagctgtcgagagttgaccctgggaatctcgtgtgagccatgcgcgaagcatcatggtactgcgatgggcattaggcctacgcctgggagtcctgggcaaaagagcgactccgaatcggcgcatggaaannnnnnnnnnagcacggcgctcatacccaggtaagagggggatcagacccagttatcacgggcaggcatccgtacgtatagaacatagtcagatatggtctaggactcctgataagaggccttcattcagcagaatatagtacacacaagccgcttgggtgttggtatggatggaagagggcttcgctcttatgaggtaaggaactcctccgatggaaggaatatgcccagagccagctggccgcggacgaacccttgaaatcttccccaccattgaatctgaaaagcagattcccataaatcataatcaaatgccttattaagagtggatgagtagcacgacagcttgtcgcgcgtaagtttnnnnnnnnnncctaggactcctgataaggggccttcatacagcagcatatagtacacacaagccgcttgggtgctggtatggagggaagagggcttcgcttttatgagttaaggaactcctccgatggaaggaatatgcnnnnnnnnnncaccataaataataatcaaatgccttatctagagtggatgtgtagcacgacagcttgtcgcgcgtaagtttnnnnnnnnnnaccccccgtcaacaaaagttcgagtcgccatgaccggccacctcgttatggtacgagtgctagttttgcacttgtgatctcccaagaatgatgtccgcgcgatgagggcattcgtctacaggcactagggaggaaatgcgccctgggtcgcaggcccatatctnnnnnnnnnnccccccgtcaacaaaaggtcgagtcgccatgactggccacctcggagcggtacgagtgctagttttgcgcttgtgatctcccaaaaatgatgtccgcgcgaagagggcgttcgtctacaggccctagggggaaaatgcgccctgggtcgcaggcccatatctgcaggataacacgttctgctcggttactggatacgtccttgttccagattaacccagttgactgaacgaggtggttgagaaattacacgaaacctgccagtctctgagcgacgggcaagcnnnnnnnnnncttcgttctgctcgtttactggatatgtccttgttccagattaccccagttgagtgaacgaggtggttgagaaattacacggaacctgccagtctctgagcgacgggcaagctctcgtcgttcgcattccaaagacgaagagtcaccagccccaacattcaagcaaggccgagaggcataatttccaatcttcaaacgatgtttcgtcatcattataaccagcagatggtttgtgaggtaagcgctgagctggcgtggaatcgtttagtggcannnnnnnnnntgccccaacattcgatcaaggccgacaggcatgatttccaatcttcaaacgatgtttcatcatcactttaaccagcagatggtttttgaggtgagggctgagctggcgtggaatcgtttagtggcaaagaaaactaattcgggtgtggcttgataccctcggacaagctgctagcgcacagtgtgcgggatcgccaggtccaagagggccatcatcacagtcgccgatgtggggacacatcaccctccctcaataaatcagcccgctggcgctttccgtgtgtaaaaatattgcgtcgagccccgtgtactccttccgtaaatgggtttcctcggatgggtccagtcgaactcgacctgatcagcgctgcaagcataccatagtgtgcatgaacctactagcgatcacggggtggacgaaggttttgactacttcattatgctgtcttcaggggcaccacgcaagggttttgccccatggtacggatccatgcacgtnnnnnnnnnnttcgcactcggcctgatcagcgctgcaagcataccatagagtgcatgaacctcctagcgatcacggggtggaagaaggttttgactaagtcattatgctgtcttcaggggcagcacgcaaggtttttgccccatggtacggatccatgcacgtgctgtgatgaagctggtccctcacgtgcgcgcgttggataatcgggagtagaggaacgtcgacgatctcgacccctgccagaatcatctgatcacgctcatgatgatactaatgcttttaaaatcatcggagacgaagaccgggacgacgaggcagcggtcgacgagcacccattgatcgattcgtccccgggcgagtaatcagactgggcggaaacccctccaaaactagcttggcgcatcccttgcgacgaattttatccagattgccactttttgttgactgagaaaggtgctgctgtgggaagagcgaacgtgagagatgctgctttcggaatctggaaaccaggcgtgagtcaggnnnnnnnnnntaaacccctccaagtctagcttggcgcataccttgcgacgaattttatcgagatggccactttttctgactgagaaaggtactgctgtgggaagaacgaacctgagagatgctgctgtcggaatctggaaaccaggcgtgagtcaggttcgcgtacttctggaatcgaccctgctgaccttctccgggagaagtgaaggcacatcttgtagtatcctaaccaaattggcgtgaagagcttacacttcagcattggcgaagcaacaaggggttcgcgtnnnnnnnnnngcacatcttgtagtatcccaaccaaattggcgtcaagtgcttaccctttagcattggcgaagcaacaaggggttcgcgtttcgatagacatgccgcagatcatatgcgagggactcctcgtcggttccccagcttctgccggtctcaaacaggacctggctccggggatgaccatccgacgggataagaatagccttcaggcgttctcagaaggcagaacttgagcgaattccgggcgatttgcatcaagccaagacaattttcgtttgcagctcggctaccagtatgagagctcatactggtgccatcggccttcgagctcataatggagtagaatatctcactggcccctaaattaactcagaacctcgagtgacggtcgtctccaatggcacgctaccttcatgccgcacgcaagtgcctcgtctcgtacagacccgtggccattctgacggtcacgattgtcgtcatggtgctggccatnnnnnnnnnngggtctttgcagctgatttgatgccttgccatcgcattctccacggctccaaaccttttcagtgaacctctgccgatgctggannnnnnnnnntcacaacgaaggtcggtctacccagcaggtcttataaatttttcagagcgtatacattttcgccagggcattggggtcattcatcgggcgtcctctggcctgggaggggccaggcagacgccgtggcacgacacagatatgagcccgagaagccaccccttgaccaccgagcatggttccggtgtacacgccaacttcaatctgatactcaccctaccttacagactgcttcagcgtcgcgcagactggactcggcttttcgagtgcgagcctctccggtccccgtaccatgctccctcccggtctcccctacccgccatccggtcaattcaaggggataagggctcacctgctctcacggtgaggaaggcatgggtaggtcttcgcagctgatttgatgcgttggcatcgcattttccacgggtccaaccccttttcagtgaacctctgccgatgctggaccaaacaaccgtagctggtgttgcagctgcatggctgcgagacgccccacaccctgccccttctccggcagggatctggtggaactgcatgccagcagcaaccacctggtcgtcacctggtccgactgggacaaccgcgactttgtgaggaattgggtgtaccatctacacaaggcgggctgctctgccctgctggtgggggccacagacactcagctccttgagtggctctttgaggctggcatcccagccttctttatcgagcaaaaggtgccgagtgtggtatctcagcaaggggcaaaagggaaggggagggtgctgctactgactctttgaagaggagtttacaatgcccatgaggcacattcatgttggccatggtggtggctccattgtccctgagctgggcagagtgatgttgcattaagctcgtgagtgtccaacaggttgaagctgtgcaccctatgcgtgtgcacgtgccaatctgcagccatgtggatccccaccagctccagcctcatctccgcctatcctgctcaatctggcagagtcccgccagagtgtcactcctgcgggccttttctgagctggggacaaacgtcattctgagcgatgtggacgcggtctggctgcgagaccccattccgttcatgcagatggtgaggctttgtgggcgagggagcggcggtgctcaatccttcccatcattcatgggagcaaatacgggagggatgatgtgagaccttatgtgggtcaggcagcctccaagtcctcctaatttggcaaactccatatggattggctatgcctcgaagtttgaagcctgtacttcacactgtaccctcagcttccactgagcctgtcctaaactgctgtggtgcagtacccggatgccgacatcttggcatctagtgatgccatggagcatggcagtccctcggagaagctggaaagctctaccaatctcgagggccccgccagtcttgccgtcctttttatgaggccatctgctcgtaaattcatcatggtaaggattggggggttgagagggtgtttgatccagatgannnnnnnnnngagctctaccaacctcgagggacccgccagccttgccgtccttttcatgaggccttctgctcgtaaattcatcatggttaggattgggggttgagagggtgtttgatccagatgatgagcatgctctcgtcagcttggtgtgcaaggaggtggacatggcctaggagcaagtggatatcctgagggtccctgtttgtgtctccgtctgatggagtggaggccattcacgagcaccttgccatctcgtcaagtgactgttccnnnnnnnnnnatctgatggagcggaggccgttcacgatcaccttgccatctcgtcaagtgactgttccctttccacacggtgacaggagtgggagtctgccctcccttctgatgggagatccggggagcgggcggccttcaacgacctcttccaccgtgagcttgtgcagctgacccggcgcaacgacaacctggccaggtgggcggcggggtgcagcccctgggctggttgcggggagctgacccacgacgcatgtcatccgctacgtcgcaagagcgcccagtgtgcctctcaaactactgccccccctttcggcagtgtattccgagggacgctgctgggaggcatcctctccacctccgccttttgttcgggccaggcctacagggcaggcctgcaacaaaggatccatgtcagaccattcgtcgtgcacaccccacacccggggcccggcgcggctgcggaaaaatttgtgctgagggagctgggcctgtggcgggtgaggcgaggctgcggggcatggttctcacctgtgcatgggatggttttatggctgcagccgcacaccttcagccccagcaaaacgagcgagccgactctcactgactgtgtgcnnnnnnnnnnacgggcgcagctgcgaaaaagtttgtgctgagggagctgggcctgtggcgggtgaggcgaggctgcgggacatggttcacacctgtgcatgggatggttttacggctgcagcagcacaccctgagccccagcgaatcgagcgagccgactctcactgactgtgtgctctggaaaagcttggccccattcgcgatgggctggtccgggaggacatagagctgcaactgtgccacaccgccgaagagcctccgacattcaccgatgcctggccccttgccctgctgaacaggacctgcccgagcactnnnnnnnnnngtgcagtcgatgccgtggacctcacacttgaagcagcactgcagccattccaagacgtcctannnnnnnnnncattcgcaaggggctggtccgggaggacatagagctgcgactgtgccacaccgccaaagagcatccaacattcaccgctgcctggcccctcgccctgctgaacaggacctgcccgagcactggactcatccggcagggttcctgacctatgacaacaagctcccagctacactgtgggagtcagccccaagggtgagatgctgctgcgcagagggcgggacctgcagacgaagtcaaccatgcagacgatgccgtggacctcagattcaaggcagcactgcagccattccaagacgtcctaccacggttccctcttctgctcctccttctcagggcgctctgggcgagctcgacgcccctctgcgtgccgaatccatgctggtcaaccatcagctgagccagtaccgcaacgcattcatagcagcaagggtgctgggggggnnnnnnnnnnccgcccctctgcatgccgaatccatggtggtcaaccatcagctgatccagtaccgcaatgcattcatagcagcaagggtgctgggggggcactccgtcgtacagcccccagtgtggcttcgtggagatcttgccgccaggcccaagggggggctagcgggcacagtggcctcggcgccctccgcccacatcccagtggatgccatcatcgatttggaagcgtgagctgtgtttcaaggacaggactgtcattccttgcgtgccagagggtgccagctctgccgacatgagggaacggcaaggtccttgtgggagtctcatgcccaccagcatgcaagttgcaatgcgcactggcgagagggccgccatcacatgccggcactgcccctctccccctcccatagactggacaaggacgcccnnnnnnnnnntggtgcagcggtgctgggtgcggagcagctgggccttcagaaactggtggcctcaagattcacctgcctgcatgtccgccaaggtgctcatcgtgtgccgatgcagaggatgccgagcatnnnnnnnnnngtgcgcactggcaagagggccgccatcacatgcccgcaatgcccctcaccccctcccatagactggacaaggacgccccgaatggctaccgcgagagctccttcctcaggaacccccaaggctctggcttgctgggagatcggctacaggtcttcatctgcccggtgagttgcgctgcaacagtgctgggtgcggagcagctgggccgtcagagactggtggcctcaagatttcacctgcttgcgtgtccgccaaggtgctcgtcgtgtgccgatgcagaggatgccgagcatgcaccctcgacgcaggacatggtcatggcagagtgcgagacgggggacgcggtggtctggcccctgtttggtgaagtcaggctcaagcccaggcgcaccctgcagcagctccgcactgccctctttgaggcatccaaagggtatcaggtgcgagcaagacacaccccaaaggaaggatcaacttcatgatttgaacagccagttctctgaagcagtgatgcatgttcctccctcaactttcaaactggcggatgaccgtcaacggatcacagtgcagatcctctcagnnnnnnnnnntcaatggaaggatcaacttcatgattcgaacagccagttctctgaagcagtgatgcgtgttcctccctcaagtttcaaactggcggatgacggtcaacggatcacagtgcagatcctctcagccatcatgtcctcgtgctgccacaacaacatgcaggacagatgcctcaaccccagactgttgctttgtgcaggtgatagagttcaagggcaacattgccgatgccatgatcctgagcaaggaggaggtgcagcgatacagcaggtggatggcgggctggttgtcccaccctcccagtaaattgcaccaggaagaaaccaggtacaggggctgggttggttccgagggtggaatcagtgcctgccttagattcagggtccccaccacggattgcccagtccctcttcnnnnnnnnnngatcagtgtctgcattagattcaggttccccaccacggattgcccagtccctcttcacctgtcggccgcaggtatgacctgttctgggactatcctggagctgccccgcagtcaacccgcatgcagactatgaacaggaaggtggacttgggatctggcaccctgtcagctccaaagcaggaagccactcaatggtggcaagggctgacccactcatnnnnnnnnnngaggaacaggaaggtgggcttgggatctggcaccccgccagctccaaagcaggaagcccctcaatggtggcaagggctgacccactcatgagaccagcgcaaaccgagcttgcattgtaccatcctttcatgaagtttattcaccattgtttgaattacatgtacttgccggcctgttgggatattgcctgactgatgactgtaccgccctggaatgccaaggaccaatctgacgaggcatgtgtatcgggtgggctgtggtagatttctgcaaggtgacttgggccgaggagtgacaaatcccttccctctgcatgtcacctcgacctggagtgtggttggtggtgaggctgcacnnnnnnnnnngcttgggccgaggagtgacagatcccttccatctgcatgtcacctcggcctggagtgtggttggtggtgaggctgcactacgactcgtgacagatttcctggtgtgatctgatcccgcgtgactacccagccctcacaccactggtctagaggtctttgcaaagcatccgggggcaaagattgtggtctgggcgcgaacccgcaggtgggttttgttggggcagacagcaccataccaggatccttgagctgccatgaaaggtttgcaggggtgtggcccacatggtgcacggaagctgaggaggtccttggcggctgaggtgtcacccctgtgccatcggcctgtcgcgcccagttgtcctcgagcacggcctggtcacgcgcgggctggaaccgagtccatgttccgacggccacctcctcacttccgcttgcgtgcaccggcgctggccgcgcccgccgccttgcgcttgcccgccggcgcggctgccgccttgccgctcttggaggtggcgccgttggcgggcgccgccgcgtcctccgcggccacgtcccataccggcagctcgcccaccttggggtggtccggatccacgaggaagaggctgtgcccgaagcccatggccacctgcgggagggtgtcctccgggcctgccttggccatgcgctgggggatgaggtggcgcggcgcgcaagcccccacgagcttgtccgctgcggcggcgtgcatcgccccggctcgcgcctccagggcccatggggtcccaannnnnnnnnncctccgctgcggcggcgtgcatcgccccgatctcgcgcctccagggcccatggggtcccaactctggacgacggacgtgcagggcaggcctgcatgctggcccgccccgacttcatggcctcccacccccatcgtgccccccctgcaccgcacctggtaggtgttgactccctccagcgaggggcacttgtccgggttggcagagctcttcttgcccccgggaccgtaccccaactcgcagtacccgtttgagtgacccctgcaccgggatgggagaccgtcctcctctggaggctgctgctctcgagcgcactgccttcacagcgactcaccgggtgcaggcggcagcgagacggtgcggcacggtgtgggtttctggcatagtatccccccccaaggcaacctccttcccccaagactcccactctccctccatcggccccgcatcgagcgtcgtccgcccccgaagcctcctcaccaggtgatagtggacttctctgcgccgtaggtggccgccacggcaaaggtggtggagccacaggccagactccggatgtcccaccccgccagctccaggtagggggtggggtacatgaggttgtccccggacaccttgagcttgccccaagcaaagagctggccgcccacgatggagcagaaggaggaggtctggcctgccgccacgatggcgtcgggggggaccaccagccgccccgtcagtgtctccaccagccgcggcttgtactcgtcctgctgcacccggtgccccagacggccgtagccgccaaagccccaagtccacacgccgccatcagaggccaccgccaccgagtggttctggccgcaggccagacgggtgacatccttctcggccagggcggtgatgagcttgggcgtgtactgtggctggaacacgatctgtgagatggtgttttgaagggggaccgaggaggggggtgttgagagcgctggggcattgtgggttgagcatccctgatggggaggagccaggcacacaggccaggggccatgcgacagcaaggatcggcaccagaccagcccaatccctgaccagggcatgtcagattcacgccgcaaaccaccacagccattcaccttgacgctgctgtcgnnnnnnnnnnaatggggaggagccaggcacactggccaaggggggtgagacagcaagagtcggcaccagaccagcccaatccttgaccagggcatgtcagattcacgacgcaaaccgccacagccattcaccttgacgctgctgtcggccgcattgtagcttccgtccgtgcctgcaattgtacaggaaagtttcctggtgggcatctcatgctcagacctccagccgcgaccgcagcctgtggctaggaaccacaccatccacgacgaagagtcgttgtgctgtgagcatgccccttccggcaacaggcaccagcgtgcgtcgaccacacaagcgccctgccagcgcagtggccgccctcccgacgtctcccctacaaccccacgctcaccgtgccccagctggccgtactgcggcaagccagcagagtagagctttccctcggacagccagacggagaactctgcacccacacccacagccgacaccttgccgacgaccacctggtttcaaaggagggaaggaggtcgcatttgtttgagggtgcgaacagggccggggcgcacggtggcccccctggcgctgccggcgtgccaggatccagccgccacccatggagccagtgtatggtcccgacctcctcaccttgaccggggccaggtgcatgtcctcggcaccctttgccagcttcttggccggcgcgccggaccccagctggccataggtgttcagcccaaagctgtaggactcgcctgtgttacgggtggtaggagatgggcgccagggctgtgtctcaccttgtctgatgactcgtcgtaagagcactttgctgctgcaaggcagccagagcccactgacacacgatagcaaaaaagaaggtgcgttcctgccgcgatactatcctaggcccgaaccccacgcccgactgaacgggagatatccatcgtcaaagcgcaaacccacgnnnnnnnnnncagcaaaacagaaggtgcattcctgccgcgatactatcctagacccgaaccccacgcccgactgaacggcagatatccatcgtcaaagcgcaaacccacgcgcaccatcatcggtgaagacgacggtgtgatgccgtccacagccacctcccaccaccttcttgcccttcaggccgggcaccagtgtgggtacgttgcgggttacggtgtcccccagcccaagctgccccttgtcgttccttccccaggtgtaacacctgccctccgtatccgcaatgacggagtggaatgcggaagacccagccgcaatgaagctcacgcggatgccctgcgtagttcgtgatgagtaaggaggggcgcctgcttcagatccagtcccggtagcaggaccgaacggagcgcagcccccttccactcccacaccagcacccacacctgcatcgccttgaacttgtgcggcagctgtaggttagggtagacgtccgcgcggacatctttggtgcgtccgatggcccagtaatctgtggctccgcagacgagcagctcgccggccggaggcgtagccgcttcctccttctctgtcattacgcttccgtgggcacacgatccaaatggatgattcaacgcgcaaaggcgatgcgtttgctggctaaaaacttgtttgatcgatgcgagagtgcgactcgtatgaacatagctgacgcgcgagacttgaaaatttcgtatgcagtttaagggactggagtcctcggggtgcatgtccttctagcgtgtggctttgatgctgagattaaacctcgcgatatagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggcatagtacttgaacatagcaataacattattcatttccaaaacgtgcctgtgctacaccggtggcgcagcctnnnnnnnnnnagggtgcaaggccttcgtgcgtgtagctttgctgctgagattaaacctcgcgatatagccactgtgagcggtgcaataagctgttttctagatgcctcaaggacctttttcgtcctacatacactcctcaccatttgcaagcacctcctgtcccacttagagatttcactgcatgcggcactccctggtcccgatggcggggtgtatcatgggaaatcacaacaggcatagtagttgatcatagcaataacattattcatttccaaagcgtgcctgtgctacaccggtggcgcagcctgctgtgcatgctgtgggtcggggtttttgatatcgcagatcggaacagatctgtgcatggagcagagcacgagcgttggggtgtgnnnnnnnnnnnnnnngaaggccaacctcagatgcatcgaaccggcctgagccgatcggctctttgccatgcactccatggtttcgactctccgcactgatgcctcgcggcgcatccgggcttccccaccctgcacacgcctgaccttcgtcaccgggttctgagcatgaaggtgctcaatgtcgctgaaaagaacagtgtcgcccgtgcggtgacggagatcttgtcccgtggcaggtcgcagcagctgcagtcctggtgagatgcaagagtggcaacgctgtacgggatgtctagcaagcttcaccgcgcttttcaactcccactcactctcatctccatcgcctctgccacagcgcaacctggtgcaaggtgtactcctttcccttccagctggccaatgagccggtggacatggtgttcacctcggtggcgggccaccttctgcagctggacttcacacccccccattcctcctggcaagggtgctcgccccaggacctattttccgcccctgttcaaaaacaagtcccaaaggtgcctgaatggctttcaagtggccgattgctgggccattggagcaaattggggctgcgatccgacacctgagcacttgacacatgcggacactcatgattcgtgtgctcgacgtacctcaccccctacggcttcccagggtgagcaggaaaagatcctgcgcaatctgcagacccaggcccgctcctgtcagcagctggttctctggctggattgcgatagggaaggggagaacatcgcgtttgaggtaggcgcacaggcacggccatcatgtagaccatcccacatgccgaagatttaagcgtccccctcctgtcgttggctgtgctgtcttgactgctcagcagtggtccattcaagtcagcagcaagccccccaaggttccctcctaactcatctcccactcccaggtcatccaagtatgtttgaaggccaacccacgtcttcaagtaaagcgcgctcggttctcaggtgggtgagggtggtgcccttgagcattggtacttgcccaggagtccagcatattgtttttgaaaggggaagctctggtggcatgccatcgggtcagtcctagttcaggtgcaagcttggtcagacaagcactgactggccgtttgctaggtgactggcagcagtgagatactcgactgtggtggcggcttctgtcctgcaacagacctcatcccgcagccacactctccttgcatctccagccttcagaccctccccctttcccctcgcagcgctggtggcctcggacatcatgcgagccgtcaactcgctgggaccccccaacgagcgcgacgccatggccgtggacgcccggcaggagatcgacctgcgtattggcgcggccttcacccgcctgcagaccctgctcctgcagaacaagtttgactggagcgggctcctgcccgccggccgcgagcgcatgctactcagctacgggccttgccagtttcccaccctgggcctgatcgtgcagcgcctgtggtgggtggagggagcgggttcaggcgcctggggtgacaggagttgcaggggtcctgcagcctgccagggaggctgcaccctagtaagagggcatgggcaccggacggtcgttggcacagatggctaactcagcactgccatggttctgcagcatggcatgcaggagcgagcgcacgggaggctggcctggtggggcttggctcatccttaatggtcatcacacctcctcaccatgctcagccatcaacccaaggctgcaccctctatctacagggagatccggacccacatcccagaggacttctggagcatagaggtgaaggccgcgcccaccggcgaccagcccggctgcacatttgcttggttgaggggccgcctttttgaccagcctgcagccgccatgctgcatgagctttgctgcgaccaccccacggcgacggtcgccgaggtgggcccctggaacggcaaggctcaggagcagcagtgctcgggggaatgagcactgtgcccaccttcctctgcgggccgcatggtgcatgagcttgtttcatgctcctggtcgtgccaggtgtgcatgtttcccctgaccgccaagtgtcaaaagcagccagcatgaccctgatccccccatctccttgcaggtcaagggccagcagaagcagcggtgggcgcccacgcccctcagcaccctggagatgcagaagcgagcctcgcaggtgactgggtttggcacccggcgcggtttgcaacacatggagtgcagcaaacagtcactcagtatgagcagccatgccccggcctgccagcgctgatacgactggcatggtgtgggcatgcccctgcaagtgttggcagagaggcaagaaacccctcgtccagtgcatggccatgctcccaacaataagctcattcacatgtcccccgaccgccgcagtacctgcgcatgccgggtgagcgcatcatgcggtatgcggaggagctgtaccaggccggcgccatctcctacccccgaaccgagacagacatgtttgacaagcagtacgacctcagggtgagggcgctgggatctgagcgacacggagggaggactcgtgggtgctgctcctcaagggacgtgtgcctggtgttgctgggggattggtacaagatccaggaccctgggcaggccgggccaggctgacctgtgtgcttgcataaggaaagccatggaaaccaggaaactgcctgttcaggagtcatttccccctgacccatgcaggctctcataggcgtccaggcgggcacccgggcgccttgggcgccttttgcccagaaacttgtggaaggcccgctcttccggtggccccgctcaggtcaggctgggggggggcgatagcctggcagtgttgctgagagggccagcattggtgaatggggtgcacgtaaacaggggtctgtgcatcacagctggcccgcggcgttagaagcccgcgccaacccagcggcgagggtttgccatctagcacccgggaggtaatgccacataccccgctcttgccccacacccctcacattcccaggcggccacaatgaccaagcccatccgcccatccaccccaccgcccccttccaagccgacggaagtgacaaggcgcgcctgtacgaattcatctgccgccacttcctggcgtgagtgaggatgggctgtgtggatggtgcgctgtctgtgctggaccagccacatgccgcttgaaggggaagctgccctgaggctccttttgaaggctgtgtgagtcatcgggcaagaggatgacatcccgacgcccgtcccatatacattgtctccattgagatcagaaggcctgttgatggtccaccctccccctcagatgctgctcgctggatgcggaggggcagtccaccactgtgaccatcgacatagctggcgaggggttctgcgcctcggggctggtggtcaccgcccgaaatttcctggatgtgtacccgtaccaggttggtggaggtcggggcatttaagagtccagtgtcgccatgcgctgccatgcacagcgacgagggcgacaggtcgcctcactcactgcttcaccttacctctcactcctatgccgccagaaatggggcacgccccatgagactctgcctcattatgtggagggccagacctttgagcccgcatccatcgacctgaaaccggtgagtgcaatggacccgctgcgagtcattgcgggggtctttcgaccccaaagtgctgccgctgtgtcctcccagcgctgcagacatacgcagcgtcctgacaggccccggtgaacttcgttcctggcgatattcctcccaaactccagggctgcacccaggcgccgccgcgcctgaccgaggcggacctgatcgccaagatggagcagcacggcattggtaccgatgccactgtggcagaccacatccagaaacaggtgtcggggggggggggccctgatgggcaacttccctctttccatccttgggctgaggcagcaggggctgagggaggggcgctgaaggatgcccccgcagggggcatgtctgcacccctcaccatggggtgcggggccatccgggcagcatgtccctccgtcctcacccatccgacagcccactcaccgccaacacctccctccaaccgttcgctcaattcacagttggagcgggggtacgcggtcaaggacgaggcgggtcagtcccagaccttctcgcccacgcccctgggcgaggccctgatctccgcctacagtgccatggggctgaccaacctctggcagccccagctgcgcggcgccattgaggggaacatcctggcggtggcccagggcgcccgcaccaaggcgagtcgggtggcgcgtgggnnnnnnnnnnnnnnnnnnnnnnnnnnnnnnnnnnnnnnnnnnnnnnnnnnnnnnnnnnnnnnnnnnnnnnnnnnnnnnnnngctcgtcgagctgggtcatcagcgcccatggcagacaagggcccgccgctgcggcccgagcgcacttcctcaccgaagctccccgacgcaccccccatcctttgcaggagagcgtgctggcggaggccatcctcgctttccagaccgactttgggtctgccatggctcaggcccacgtgctggaggcggaggttcgcgaggttgtgtttggcagcgtggcgcggggtgctggtgccggggctggagccaggcgcctggatgcaggggagcgtcagggagagccgggcggccctggcctggccccgggatcccaggcgttcggtgggtgcagctgcggcgggcagctggtgctgtccaggtgaggggtgtgccgggtcgggaatcacatgctcggatatcgttccctgggaacctcagcgtcatcgagatgcagcttgggcatctcccgccgtgtccaaccgctcctgcatcagtcgtccaaccaccatccgtgctgttccccgctcctgcacccgggctgtcctctgcatgcaaacgagcccccttccacctgtgcagggaccctggcggcggcccaccccacatcgcatgcagcgcctggcccctgcaccgcttccgggtggaccttccccgcattaccacctccgtgggcgtcagcgaggaggcctgcgccgcctgcggcgcctcgttgctggacctgggcttcacgcgcgcgctgctgccgcccggcttccagccgcgcatgcacacctgcgtggcctgcgaccccgagttccagcgcctcatccagctggtgggcgcggtgcgccgaggtaagtgtttctttttagacctgttgggccgggcgtgctgattgagggcatggcaaaggatggcgttgcgtgtggggttttggcgggccggtccgtgtactcgccgcttgggtcgaattccgccgtccgaggcccactgtaaagccagcggcagtccgctctcatccctccccaaccctccatcctcgcccccttgtgcgcagcaccctcctcagcgcccatgcaccgccaggggccaggcccggcgcctcgccaggcgccccgagggggtggcgcgccggcggcgcgaggccgaggccggggcgtgcgttccagccccgggcggcgcgggaggggcggcagctcccatgacgtcgggcccagggtccgcgggagggggcccacacatgcgcggggcgccgcgtc

SEQ ID NO: 39692 - DNA, 127 bp, Chlorella protothecoides
cgagccagcccccgacgctgcccccgacgctgcacctgccgatgctgcccccgacgctgcccctgccgagccagcccccgacgctgcccccgccggtccctcagagacttgacggcggccctcaccc

SEQ ID NO: 39693 - DNA, 71 bp, Chlorella protothecoides
gagagacgggggtcggcagtcatccaaggctgaccccccggcacgcaccgtggtcttcatcatcaccccac

SEQ ID NO: 39694 - DNA, 61 bp, Chlorella protothecoides
ggcggcatacgcactgaggtacaggtccgcgcctcccagacccagcagggagcacgtcggc

SEQ ID NO: 39695 - DNA, 67 bp, Chlorella protothecoides
gccggggcacgcctagccagcccctgcacctcctgcaatggccacacaataccttctcgacgctgat

SEQ ID NO: 39696 - DNA, 61 bp, Chlorella protothecoides
gctggcgctgcgctgtctgcgtggctgggcccaggcctcggtggtgaactgcgcgacgctg

SEQ ID NO: 39697 - DNA, 189 bp, Chlorella protothecoides
acctggcgcagggcgtcaaactcggcgtcgatcgtggcgtcgtcggccgcgtccccggtcgcctcgccaggcgcagcgccgctcccatcctcgggcgccttcacggacgcctgcgtcgcctcagctgaggcgggctccccgccctcctcctccttcactgcgccctcatccacctccatgggctctcgg

SEQ ID NO: 39698 - DNA, 19651 bp, Chlorella protothecoides
  modified_base (125)..(171): a, c, t, g, unknown or other
  modified_base (14906)..(14944): a, c, t, g, unknown or other
  modified_base (17603)..(17692): a, c, t, g, unknown or other
ggggggcgcgcaagcaaaggtgatccccggcgggtaaaggtgatccctgctgggcaaagggtctgctgggcggctggctgcgccggttggcgaggggggggggggggcccatgccgcccccccgnnnnnnnnnnnnnnnnnnnnnnnnnnnnnnnnnnnnnnnnnnnnnnnctctcaccaacccgcgagtggtccaccgccacacacccactaccctcctcacccaagcacacacacacacccaaaacaatctcttcaggtgtgcgatgtggtcctgcacgccgacgccatccaccgcggtggcggccagatcatccccaccgcgcgccgcgccatgtacgcggcccagctcaccgcccagccgcgcctgctggagcccgtgtacctggtggagattcagtgccccgagcaggccatgggcggcgtctactccgtgctgaatcagaagcgcggcatggtgttcgaggaggcccagcgccccggcacccccatcttcaacctcaaggcctacctccccgtcatcgagtccttcggcttcacctccaccctgcgcgccgccactgcaggccaggccttcccccagtccgtgttcgaccactgggaggtcatgacctccgaccccctcaacgccggctcccaggccaacaccctggtgctggacatccgcaagcgcaaggggctcaagcccgagccctccccgcttggcgagtacgaggacaagctctgaggcggaggagcggggctggcccgctgctgtgcatgtaaacactgtgatgggtgacggaggagggagagggggggggggaggaggggaggaagagaggatcgagaggcaccaggagagccaaggcgttgtgaaggaaggaaattggcagtctgacctctgcaggtgtcgaaaacaccgccaggaggatgggaggggatcctcgttctattccagttcggcaaggggtggaccttcccccttgtgagccacatgagcgagaatgtgctgcatggatcatctcggtggagcctcgagcccataggacgcctgcactgcctcgggggcctggtacatcccaccgtaaccgagggggggtacgatgtatgttttcctgcacatttacaaaccgcgtagtggcttgagagcagcaggcatctgtttctaatgcaaggcctgactctactacatgaaaggaggtcgagtgcccccactcacgcccaccagcccatgacgaaacacgcatgaaacattgctattatactcagaattgcctccgttggcacacctcccctgccaccatcccgacaaccacccatggctctcccattttcgacgccccgtactgtgtaccctcggctccctccttgtcggcctaaataaacaagcagtacatggtgctgctaccatctctcaatctatgtccggaagccacaaacattcccagttctgccacggctagttatcccggtagccaggcggagaagctttcccttggccattcacagcacagggggggaagtgctggggtgggcctcagtgttgtcaggcaatggtaaatgctgccaccactgtctcatgctccaccctcgaccaagctgtgcatatttgctcattaggatgatttccaggcctcgctccgtcctctactgtgagcaaagacctccctccacgactggctgcacccagctgccatggcacaccggagctccacctccgcaggctcctcggtggcaagccacatgaccggggtgcagcaagcgtttgggttgcactttatggtggtacctgaaaatctgaaaagggtttcacaccctccgagtgcggtggccctccgtcttggagaggtagggctcagcgatggatacgggaagctcccgacaacagcgcaggaaggcggctcgcggcctcccattccatcgaagacacctgcatcagatgtgtgtttcatgtgtgtgacccaaggtgcccacataatattcgcgtggcgctgctcactcgctgagcggattgtccaatccgaggatgtcgctccacctaggtttccgggcgaaggtgcaccgccttttcttgcgattttgcagcgtgcgcactgcggccattcacctgtgtggcaagcatctgcggtattactatactctacgtgtgttcctcggcataaaactcgtgtgtattgtagtattctgcagcttgagaccccacaactccgtgaaagtacccctgacattttaatcggtcctaccaccatattcttcgacccgggctctcgatatcccccagctcgttctcgccaaatcaccacggatcctcaccttacgaacactctaagcaagttcttcggccttcatgaactcgacggtcgaccgagatcgtatttgcaacggtgagatctggctgttcatgagactcagaggggtgttgctgcggggactggggtatttcattagggctaaccggagccacctcaggccggcttccttccggccaagtccttcttgcgctccagttgtgacatgcctgtcgggaatccttgcttcctatttttcttcgaagccatcccgggtgccctaggggtggtgcgtattccggtttgtcgccgagattctctccgttcaaggtatgggattccacccttctttctcgaccaagaccagagtgtacgtcaaccaggcatctctccggtttcctaccacaggatctggcattcgttattccgcgccagaaagcttggacacgcattatacgatgctctacaccaagcaaggcggcgacgtgcaccaggagcctggacgtggagtcgcgcaggccggagaggattccgggacgcaaacctcagccgagagcttgcgtggctccttcttcagactgctcccgaatctactgaacctaccaggttgctgtccgggggggatggtgcgtcgtcatcctgctgcttggtgtgtagcgattccgtccggttcattaccgacgcccatccatcctctcgctcgcagctgagctgaatcccgggccgggcccacccaccaaagctgccccgcgttttagaggaattaccaagcacaagtgagctttaggccgttgcttgggaactccggtcaagcgtactgcacgttgaatccccacgtgcaacttcctcggccagtggacacgagcattcctcccccccgaccccacgaacagacggactcagaggtatgaggcgcacttctgggagcagaagaagcaggtacgagcgattcgcgactggtcgcgaatgcaaggctgtggagctagggtcatggttacagcagcactcttcccgacttgtcgggaacttgccaggggtggagcgggcatccggccatagcagagcacgcccccacccacgcactccccaggtgtaccttggcagcttccagcacgaggtgcatgctgcaaagtgccacggtgagtccactcgtctgggtgtgtggcatggggccagaggatgggcatgctgggaatctcacctaacaattttggcacaagacgtggctgccggtcgtttccacgtggctgttgtactgcagccgtttgcaggaccagtcgctggacattgtgccaccttcttgcccattgaatgtggcgaggatggtgccggggccgtgcatcccacgtcgcgtctcccactcacccaatcctcccagacatcatggccctgcgctgcaagggcctcgcgtgcgacgccctgaacttcccggcagagacctaccgctgcatgttccacctgatcgaggccatgacccaggtggggtggctggcagagtgctaccactgggtgagggtacgacacgcccaggcccctactcctgcctggtgtccctttacccttctcctccctgttccctgatttccactcgcctcagcgcgccggtcccagcaactgtctccacaggaatcactccaacccttccctacacctccaccatcaaacccccctcctcaggacgacatcgtggccgagctgcggcaccacagcaaggaccaggctgccaagctgcgcgccggggcggaggccgcggcgccggccaggccggcgccggggaaggcgcgcgccacgccgagccccgcgagccctgcggccccccacacgcccaccgcccagcagcagcctctgcacgccgtgtcctatctcagcgccgacctcctcccacgcacgctggtgctggaggcctcggcggagagcgcccccgcgccctccctcggcgcccacacccacgcccccgccacctcctcgctgctgggcaagcgggggcttgcggcgctgggcgggttcgatgaggcctgggacgcgctggagatggaggagctgtggagcgacatggatgactccgtgagcctggcggggggcctttgggggtggagggggaggagaggggtgaagggggcgtgcaggcctgggtccatggctggcgtgagaccaggggatggtggggcagcgggtatggcgcgggtccacgcagttccggcgaggcgtcctgcccccgaccttcccgccacacccctcgaaacctcccgcgcgttcccctccacccccatcccttcccaccccgcgcacgcagatcctcaccctagactccctggagcagtccttcatgtaccgcggcgggccccccagcctggaccccttggagcacatcgatggcaccgccctgtttctgcccgccgagctgcggcccccgggcgctgagggggccggtggccgcacggggggggtgccgaggctgatgcgtgccgggccaggcggcctgacggtgtccatcgggtcggggcagggcctcaagcggcacgactcctccctgtcgggcctgtcgcagagcgggggtgagggagcatggggtaggaaagcgggaagcaggagggaaatgatgcttgcctctggattgtgccgttgggaccggccgtgctcattgcttcctgcctgggtctgcagggtctgtgagagctcatcatcactcccacctggactcccccacctcgtccccacaccccacgtttttagtatccactctctatcccttcccatgcagagcactccacgcagagcatgacgccatcccaggtgtacagaggcgtgccgttgagcgccagccatgacccggctcaaacctcgtaaatccccctgcgacaacaatttttgaaaggattttttgacccgacgcattacttgactcatccgcattgccgtgcctcttccaagccagttttccccgtggtaccttccaaaacgtagctcataacgccagcttgctcatctcgagcggatcccattagcagggcccttcccatattaaaccccttcacacgcaaccgaaattgtgggtacatccctcccgtttaattgtcctcaggtcctttgtcctgcccagacattgatacggttgccgcaggcccctgcctctgtctactccttttccactgtcacccgtcttgcaccgtactaagtcagctgtgctgccagcagccttgcatgcatggtacgtccatctccattctcgcccatgcaatcctgagatctgacgatctcttcccatgtagcgcatccacaacacagacccgacaccaggatgaaacacacactgttcatgtgagggaagaatctgcccggaagaattggggtgtgaagtaaaaccccgccagattggccatgacacgacgagagtgggcatcccctggaggcccaagcctcccccgaggttgacctggcgcgccagcaagcctgtgcgcccaagcccctgcccgagctcgcgcattagtgccatttccgcgggggtcccattgcgagtgtgcattctcccgctgtgcacatttttctcaggtataaaccggttggctaacacgtccccaccataaaatcgaccccttgacagttacctgcgctgcaacacgtcggacctcccgcaaacaggtgcctcgctcctccgtgcacagacaatctatttcgctctgtcgctcccagccaggggtcggtgatacgtggatcaacccattgcctggtcggctacacccagggcccccccacgatcgcgccgggctaagccatgatccggttcttcctccttctcaatcgatctggcaaggcacggcttgcaaagtactacaccccactgtcggatgaagacaagaagcgactggaggacgaggtgtaccgactcatcgtcaaccgggactccaaattcacaaacttcatcgaggtggggaggcgactggaggtcccgtgcattgctggcgtccttcagaaggacatggtgcctgatcctggccaccagcaccttgatgctgtacacaaccggaacacccttacctgtgccccgcagttcaagacctacaagttggtgtaccggcggtatgctggtctctactttgtgtttgcagtggaccccacagacaacgagctcctgtacctcgagagcatccacctgtttgtcgaggtaggcctgcccatgcaatgccgtggtggccatgacagcatcagcagagcgctgggaagtgggccggcgccgtgcaggtatttgggttgtgaagctccccattcttttccatggccccttcggacccctcgtgttcctgccaggcacccgacctcccacccgtccacctgtgccctgcagatcctagaccattactttggcaatgtctgcgagctggacctcgtttttggcttccataaagtctactgcctgctggacgagtttgtcatcggtggggagattcaggagaccagcaagaaggcaggatggggccagggcttgggggtgggtctggctgagtcgaaggggagtcagccacagcagccttggtgtgggaggaccaccactgttatctaggtcctggatagacctgatttttgcccagatgacgcatactgtggtgccacatgtttcgcgctgagctgactgacccattaaacacggaagcaggcctgtccagttgatgatagccctcgatgttccctccctcatgggcatgcaggtcattctggagcggctcaaagagctggatgcgatggagacctagtctggagccatctgcctggaccagcatccccctgcaatggacggcccgtccatcataagggttgggcgccgagctgacacttgctgtgcatacgaagcacacaatgcattccttgacgctggagcaaagcctttgggaggtttgcaatcatcagcgctgaagaacctgcctgacctcctgtctccattcaatgagtgtcgcgttctggcacaaatgagcaccagactgtcgtgcagtgagggaccctgcaaccagctgtacacggacaaggcttccagaatttgtacaggttgccaactgggttatgaacgtgatggcgggaaagatacgatctgatttgctccacttcccgtggcccgagaaacaaagggacaagagtacatcccttcctcatcattgcggtcagcagtattgaaccagagcagctgtgtgcatgacagcaatggtgaaagcgcatggggtcgggccccccctggaggtgctcaagcccacagcgaagctcagagtcgctcaagccccgcgtcgagttcctgtcgtcttcacgggacacttgactttttattggctcacgagtggcgccatggcatgggctcaagacgtccaagatcagatcatcgttcccgaaatcccggccacggtccatgctggactggacccagcggtgctcattataggcctaggcgcgctggccaccctcccgctcacgcggcagctactgcccacgacatgcaggagcacgacagcggctggggctcgcgacatgctgcgcgacatcccgggggcactgctcatcgacatccggagcaagggccaggcacagggccaggggtctccggacattggtccgggtcggtcacctattcggctcccataccaagaggtgggccggggaggttgagcattcctgtcaccccgcgcacatgtgccgcattctaccttggatcgttgtccttggccctcgagcagcgtcacaaatctttgtgcaggatgtccctcccttgtcagcatcgtctgggcgtttgcgcagcgtgaagagggactccagggcatctgctcaacagccaaaacaggcctggaggagacttggcccgggagccagccccacctcaggtgaagggcggactggcaaggttctgagatcctctggccgtccagcaggagaaaacgtgaaacccaggcaggcctctccactgaagcagcctccatcacaggtgaggacactggccgctggcctgtgctgtgacttgagggcatggggggctgacaaggtccatagcctgtgggctggtggacatttcctgctgcttgcacattctgcacgaatgctgggggtggatcctctctgcaccttgcagctgacttaaacctgactgtgtaagattcctaaaaccgcaaagcccttccatttcgacgcacagactcactccctctcctctcagggactcattcttgaatcccattcctgaacttttcctttcacagaaacccgggcgcttctttgtggaaaagctgaagagcgaggtgaaggttcctaaaggctgcccagtcctcctgctggacgggtgaggtgctgaacaggcagtcttatgtgggcgttccagtgaggctggcctgtggacgactcaaggaatgagattgccatggcggctcgctcaatacaaaaagcccctcacctcattcccctctgcaacccagggacggatccctgtcgaaggccaaggggcctgaggtggcacgcgccctgggcgacgctgtccaggtgtatgtcgtgcagggcgggtttgctggaccccggggctggactgagtcgggcctgccagtccggagcaccccgggccccatccccttccccaacctcagccttggcggcgtgcgcctccccctggccaccctccccgacgacggctattctctggcacccctgggcgccctgctggctctggctgccgctgcctatgccctgcgcggccccatcctgggaggcgccctgcagctggctggagtgctggggctggtccagatcttcctcactctggcgtctgagcgtcagaggcgcgatgctcaggaggaagtcaggtgctgcttgggtgcatcactgggaggggaagaaaggggaggggaggcagtggcgagtgccatgctcctgatggacctgaagagtgcccagacccaacgcctgggagttacagcgtgcaatgaatgcaaggcatccaccccgagcatgcccctggggggtgcatcgattgacccagagcccctctgccaaaaccctcatcatcccaggcaactggtggaggcgctcgaccccgcatcagccaaggatgatctccagcgcctggcaggcagtttgaccctggtcccggcggcgcctgccagcacagaccagggcctgttgagagttgtcggtgggagacctgcgacagagagcgccgcaccttcctctaaaaccgtggagcagcgtgtcacagctccagaacaacatgccatcaaatgacatcatgcggcgaggaatgtgggggtgcaccgtgctcaggcatgccctggttctcatcagagggaagtgggatgccccgttgtgcaggctcctgaacagcatgcgcggcagtcacgcgccagggctcatggccgccacgccggctaccaggctgaacacggaggccccgctgcgacggcacgcacatgacgcgacgggctcccttcatgcggcctgggcatgtacctggtgattggcggagtgcagatggaaaggcgtccagtgcagtggcaccgaccttgctggcatggcccgggagaatgacgccccaggaaacggcgcagagtgtcgctgcgggcttatgcgctctacatcgcaccaagggggttgggaggggcgctccgcgtcccctgcccagcaccttccccatgccccacccctgtaaggcaccttaaagtcattggcagcacctgtctgatcccaaggactgcacatagatcgggccagcgagggacgagaggaggaacatcggagcactccctcatccactgtgctgttccggtgaccggctgccgtctcgccgctccccactgacgcccagccgcgccagctcctcgcctgcctcgcttgcttgcgcctcgcctgaacgcgcgccatggcccagtggcccctggccgccctcatccgtggccgtgctgtctgactcagactcggtgccggaagaatccgaggagggaaggtcgtccgggtccaggtagtcgtcgccctgttcgggcccccgctctgcatcaggagttggcacgtgtggattgaaggtcaacgcgagggagggggtgggggatacatgtgcctttacacagccccttgcggcgcgccccgctctccccagcaaggcggcggatacgcaggtcagcgcccgcatgcttgcaatccgcccagggcacactcacgtacacaccagtgccggccacacgcacctctccggcgagacccctcctgcagggaggccacgtgtctttgctggtactctatcacctcctcgggtcccggacatgctgcgtagccctccagcagctcctcgttcaggctcaggaagctgtggcccctaatgatgggaaaggtggaagcatgttgggtgtgagttcccactggtgcactgaggagggtgctgacgccgagctcaaagatgagattattccgcctcaggcaaactctcagaaatgaccgttgaggcagaattctcctagccaatgcagactccagtgcatgcaccgctcccaaggtgcagggcccgcttggcaccccaccctaagcctgtctggtgcatttcgactggtccctcagcagcccgtggcccaaatttgcaaccctcaagccacgggtcagcgttgcacctgcctccacctttgatcctgcaacagctcactcaccacttgaaccggcccatgacggcccgggcctcggctgggaagccgcaaatgtacagggcggcggccagagcctcggcgcaggagagcttggccggtcgaccgtagttcacggggttggcagccaggagccagggcaggagacggggcgcattgcctttgatcctggcaaagggcacgtcgtccagcctggcccaggagcagtccaccaccgccaggcccctggaggcgatgagctgccggtcggcgcgagagacgcagttgcggcccatgggggagaggatgacgccgggaaacacctgtgtggcgttccagtggaagcccttggatgaagcacccagtgccaagaacctgcactgcaaggtgcgaggaagctgcaaaggagcagtccccatccaccccttcactgagtgcatgaggtccctccaccccagcgcctcaccgtgccgagtcgcagctcctgcacaagtccatgcctgaccaggcgggtgcctgtgcatcgcttcttgtcgcactgccccaggtcccacatggccaggcggatgggaaccagcgcggcctcgctctcatccccactgccgctggagctggcatcgctgctatcctctgtttcattgagggaccgactgtccgctgcaacctcccattctgctctgtcgcggcggggttcccttcggccctgccgtggccgaggcatccccctgccgaggaatgggtgcagacccaaatgcgactacaggtgacttatatatctcaatgatcggatatgaataatgaatacacttgggactttctggagcccactgttcgacatgcactatttatagcttccccgagggggcgcttccctgccacctgaccgccaccccgacactcgaggcgggccaacctatttacctcttccactgccggaatgtatccagcacatttcctactctattgcatagtactcgcggccctgatagaacattagacggaacatgcgccaggacaggccgccgagtatgctgtcggggcgcggggaagatctctttggttggcactcctgggcgtcaaagcagatggatggttcagtgagacctcgagcatcgatctgaagccttgtgtgcttggatgaggttatgaacgagtgttgcacctctgagatgatggctgacgccctgtagaggtgtccactatctctcaacagaaaggagagtcccatgggaacagcccactggatctggggccgccgccgggattagcaaggcgacccgacatttgctggcagatgtgcgagcccatattccggcgacacagggtcaggggtactatggctgtagttttctgaaatgttgtatacctttgggacaaaaacctcctgtggtccggatgtcgacacactcacccaccaaggctgtcaccgagacggacgacttggagcagggctccctgggcaaagagtcgccgaaccctattctgcaccgcgagagacatggtgagagggttccaaacgcttcgtatcttccagaggagtttgtagaggttctagtggctcacagggggagtggagcgtttggctcagggaccgctcccgtacgatacccgcggcccgagatggtgctcgacactcaagccccacccccaccccaaccccctcacctccctcgcagggactttgttcacgacctgcgcgcacatcattactggtgagttgcgctcctcctcggtcccatcgctgacgtcgccacagctccgagggttcccaggaaccatgccagatgtccgactccggcccggcccacccccaacccccctcatgcagccatgattggcgctggcgtgctgggcctccccaatgccgtgtcctggctggggtggatcgcaggactcgccctgatcagcatcttctacgccaccaccatcctctcctccaacctgctggcggccacggtggagagccagggcgtcaagcacatgacgtaccgcggcctggtgctgcacatcctggtgagtgacggccctttgactgctagacagcagcatggcaaggggcaggattccttctttcagtttcgccagcctctgttcacgggcatgagcccatacagccccacacccggcccgaccaaaccccgccccccacaaccaccatcctcagggccctcgtgcttccaaggtcctctggggattccagtgcaccctcctcttcctggccggcattgcctataccattgccgctggagaggccggcaggtgagcatgcatgctgggcggggttgggtggcaggccaatctccttggccctgggtgcgaggtgcgcgcccatgccagcgtcagcgcaagcggggcgcccccggcagcaggctgctctgggctcactccacccgcctctcatcccatcccgtcctccaagggcgctgctggtggcggtgggccactatggcgtggatcagtctgtttggcctatcatcgtcacgtttgggggcatgcagatcgtcctgtcccagtttcccaacctggacgccacctggatcagctccgcggtgggcgccgccacctccatcggctactccatcatcgccctgggcctgtgcgcagccaaggccagcaaccacctgggcaccatccagggcaacactgaggtgaacagcgtcaacaagctcttcaacgtcctcaacgcactgggcggcgtagccttcgcctacaactttgcgcccgtcctcgtggagatccaggtgcggcgccgaggggggtggggaggggttcatcggtgcgcgggcgaggggcgacctgggactgggtctggggtgctgctgggtctggcctgtgcctcgagccatgcagccgtctcggaccccccactccctcactagcccagtccgcgcacctcgatgcaggacacgatccgcatccccccatcctctgagaagaccatgaagaaggccatcaacatctccatcaccatcgcctacgtcttctacatggccattgccatcaccgggtgagatgcagggaggggggggatatgggatgtcccagatccgcgcacagcatgcggatgagtggaagcctgcattgctgctcgtgacacaccaggttgtcaggccatgcctctcgaccacccccttccaccttcactaactgcaggtacctggcgtttgggaacggtgtggctggatccatcctgtcccagccagacgtcggcccaggtgtggtttctcacggcgatggtacttgatggatggttggcctgcatgcacctggcctgaaccgcgacacgctcaaatgctgcaaccgcgaacgaggcttactggttggattccccacgctcccttcccacccttttcatcccggtgcccctccatcccctcctcccctgcagtctgggtgatcgtgctggccaacgccctggtcttcatacacatgctatcggccgtccagctcttcacgcagcctctgtttgccgccatcgaacatggcgtggcacggcgctggcccgccagccccatcgccaccagcccgcgcatcaccaagctggtctggcgcagtctctacattgccttcatcaccttcatctcggcgctcatccccttcttctctcagatcatcggcctggtgggcgccgtcatctactggcccacggccatcctcttccccgtcttcgtctggctggcggtcttcccaccgcgcctcagcgtgcacataggcctgcagaccctgaacgccgccatgctgatcgtggcgctgctggcgattgtgggctcactgcgctccatcatcaacaacgccgacacctacggcgtgttccagtgatgcagcgtggccgctgccaaggtgcctaacccaataagtcctgctgcggcctcggagtttggggcctccacccttcaagctctgcagcaagccaaagagggcatctggtgcaggaacatggaggtcgggagggccaaaggctgctgacgacacttggatcagccgccccccccccccccccccgccccccagnnnnnnnnnnnnnnnnnnnnnnnnnnnnnnnnnnnnnnntattgtttacccttcccctgcctaccttctgacatccacgatgtcactttctcggagggattctttcctggagccgtcccaaccggcttattatttatcaatggacatcgctccagtgtccatccccctccttagctgccttggacctgtaccagtcctacagacaacttggttgcaccaaccccttgatgaggtggcctggagccaaagcgcttgcagctttccatcgaaacccaagcttgatgcgttttcctagcattccttcctggtgtgacatgtccatgtcagcgcaggtgacagctgcggcaagtgctgaagattggtacaaggtaactatcccctgggtatccagatgtgaaatagggtaactgtcagctcttgctttgtcatagattcattgcaagtacaagtacaaaggaattcagaggaaccagttctttttagacacatccgttggtttgtcatcgcataatcttcagccgcagcagtgacttccagtggtggttcccaccctggaagctgggccggccgacagtccttgacgtggatctccgcaattcatccggccggtttccctcccaccggccgatgagcgccgtctcgcaggactgtcgctcttagggttgcgagacggggcctgctgatgcaccttgaccgcattacctgcaaactcattggccgaggcattccctctctggtgtgcactcgccccaggcgctccacgacggggaccaccaccggaatggagggcagtcccagatccagtcgtgacttggagctggcatccaaagaccatggcgatgttacgaaggttctcgtcatagaacgtcatggtgagtggcatgcctgctcgtgcgcggatgggaccggcattgctcccggaggtcattgccccggctgctgtggcctcaggtgccttcccggcccgcgctggttgcaacccgatcccaccccacacccttcattggattcccaggaaccgtattcacctctttcatgcacatcgtcaccggtacgcacgcccgtgaggttgttatggcgtcggcggcgtggcttccctccggccgaggaggaagctcgcagcggggccgcccctagtggcccctcctcccagccccagcccccgccggcccggcatgagccgtgatacctccccccatctcgcccctccccacagccatcatgggagccggcgtgctgggcctgcccaatgcgctgtcctggcttggttgggtgggcgggctggcgctgatgaccacattctatggcgtcacgctctactgcgcccacctcctgatcgagacggtggacgtgaagggcaggaaggcgcggacctaccgggaggccaccgagaacattctggtgggtgggcgggtgtcatcaagccgggggcgcacacgcctcgcgttggcgctgcaccccgttggtcacatgctgtggggggtcatgacttcacgcgttcgccctcatcctcacattgcacgaccctccagggccccctggcaggcaagctgctggccggtctgcagctgagcacgctcatcctggtcagtctggcatacttcatcaccgccggcacatcgggacggtgagacggagacattcaggctcgggatgcaccaggggtgccggggagtgagtgcacgcaaccctgtcgtcgtccaggcggagctgcaggcgcggcatgcgcccttttcacatagcagccctgtgtgacggcctgcacctgggcccctcacaccaaggccacacagcatgtacccagacccctgagggagtggtgaacgggctcgggcactccagacgaggctcgagcccgaccccccccaccgcaccccgcgcccatgacggcctgcagggcagccctcgtggcagtggggcactacggtgtggaccaagccctgtggcccgtcatcctggccttctgcggcatgcagctgttcctggcgcagatgcccaacctggactccacctggatcagctccacggtgggagccaccatgtccatcggctactccatcatcgccctgggcctgtgcctcgcccagggtgcgcggtgtgggcggggagactgtggccggaacaggagagggggagcgggcgaccggctgctcttcacatgaatgagcggcgacgcgggacgccggggggcgggagcacgcaagcctgcggtttgcggctcggcccccatgctccatgcctcacggaccctgctcccacacctcgaccccctgcccaccgcccctcctgcctgcagccggccaccggcagggcacgctcgggggcaactcggacgtgaccacggcggccaaagtgtttggggtcatgaatgccaccgggcaggtggcctttgccctcaactttgcggccatcctagtggaggtccaggtgagctttggacggggggagattggaggaagggacgctgggcgctcatgaggccgggcgcgtaagccaccgggccgtgagccgcaggcgtgccgcgttgcagcactgggctggctggcctgtccgatgcgtggctcttgctcatcccatctcgcctggctgcacctggggggacaagggatccggctctctttcccctctcccttcagtcatggcaagagcccagcccaggacaggatctgacatgcgccatcccccccccccccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacgcgccaccggccttgccatcacctttgtattcctgttctatatggccgtcgccatctcggggtgggtgggtgggtcgccttggagcatggcatgggaggccggtgcatcaaccagcctcaagcgaccactggctgaatgcctgcttcgcatagaccagtctgctcacccctgggactggcaccgagcgaggccctgcgcacaacacctgcaccgcaggtacctcgcgtttggcgacaccgtggccggctcagttctggccgagccggccatcggccccggtgagtcgctgggtggcctggtgtggggagcggcgccgctctggcttgtgcgcccattggcaagggcagtcccaactttcctggcctggtctggccgccgctctccctccccctcctcgcccacatccttcacacttcccccgcctcgcccacatccttccccctcccccgccccgcccacatccttcacactttcccccgcctcgcccacatcctcccacccccatcccctccctccccgccaccacgcacagtatgggtgatcgtgctgggcaacataatggtcttcatccacatgctgtgtgccgtgcagctcctctcccagccggtgtacgccgcgatggagtcagcgttcgcccagcggtcacgccgggcgcgggccagccccctggcggtgcgcatcgtctggcgctcgctctacaccctgctcctcaccttcgtggcctgcctggtgcccttctttgcggacgtggtgggcctggtgggcgcgctcttctactggcccaccgtcgtcgtcttccccgtggtgatgtggctggcggtgtaccccgccccctgggtcaagcgctgggccatgcagggcctgaacgcaggggtgctggtcgtgtgcctggtggcggcagtgggggccatgagctccatcgtccggaacgccagcacctacggcctgttccactgacggccgcccaggggcggcggggaggtgcaaaggccttgggcgggtgggcctaccattttcccattttcctgccgagtggggcaaccatttttaaggactgcgcgcaacgacattcccatgatcccatttttatcgcgcctggtcgagtggatgcctgccacctcgttttgtgtattggttcccatgttgttagcattggcgtgacgactcctaggaccgtagaatcggctagatgttctgcaataccggtggtaattaccacgggtcagaactttctatagttaccgagggtctcaggtggatcccaccaagcattcagggctgggatcctttcgatgggtgtgtgccggcacgtgacgcggccggccgacccagggcgcgagatgctcgcaacccccatttgctggaacgaaacgcctcacgcagccccacgcaaggatcaggcgatcccagcgggatgacacacttcgaattagtgccgcaccaggcccgaattggttttccgtcgaccagcctcatggcattgcagcagccgctgctggccggcccgggcggcggcgacgtggaggacgggtccctccagcccctgcaaccgaagtcagagcccgacagccatcgccatggtgaggttatggtgtgtttaccgcatttatttgtggtgcattggttggaaatgcgtgaattgccgggggcatggcgcgtctccacgcgccggggggcagggagcgtgacccgactgcttgggtacgggtgcaatggagcagcgtcgacccccggccctgccctccaccatgcactccggtgcttgccctcccctgccgcctacaccaccatcattcctgcacccggcagctggcatcccaccccctctctctgacccccctccctcccctcccccccctcaggcaccgccctcaccgcctctgcgcacatcgtcaccgcggtcatcggcgccggcgtgctggccctgccccactccattgcctggctgggctg

SEQ ID NO: 39699 - DNA, 74 bp, Chlorella protothecoides
gcatccagctgccctccacccagtccgactgcagtacagggcgagggctcccattgttgatgagcctccatgca

SEQ ID NO: 39700 - DNA, 115 bp, Chlorella protothecoides
ccgcggtctggcaggttgcttgtatgaattggggagggtgttgtgcaggacggtacagcaatggatggtttgcggcatcttgatgtgcctctctgttggggacgggatcagactg

SEQ ID NO: 39701 - DNA, 75 bp, Chlorella protothecoides
ccagcccagtgcccactcccctgtttccgcgccacgtcctgagcgagcttgcatgtatgagagaaggcaggtcat

SEQ ID NO: 39702 - DNA, 136 bp, Chlorella protothecoides
ctcttgacaagttgttgaactccaactttgaccctctctcttgcaacgcttcaggctggcatcatgcctgaagacgcccctgccggcaagcggcagcgttcagccatcggcgagcaggcggtgttggccagcagcg

SEQ ID NO: 39703 - DNA, 20679 bp, Chlorella protothecoides
  modified_base (424)..(433): a, c, t, g, unknown or other
  modified_base (1789)..(1798): a, c, t, g, unknown or other
  modified_base (2323)..(2332): a, c, t, g, unknown or other
  modified_base (3951)..(3960): a, c, t, g, unknown or other
  modified_base (4018)..(4027): a, c, t, g, unknown or other
  modified_base (4421)..(4430): a, c, t, g, unknown or other
  modified_base (4689)..(4698): a, c, t, g, unknown or other
  modified_base (4866)..(4875): a, c, t, g, unknown or other
  modified_base (5920)..(5929): a, c, t, g, unknown or other
  modified_base (7614)..(7623): a, c, t, g, unknown or other
  modified_base (7959)..(7968): a, c, t, g, unknown or other
  modified_base (8451)..(8460): a, c, t, g, unknown or other
  modified_base (8536)..(8575): a, c, t, g, unknown or other
  modified_base (9037)..(9046): a, c, t, g, unknown or other
  modified_base (9675)..(9684): a, c, t, g, unknown or other
  modified_base (9763)..(9784): a, c, t, g, unknown or other
  modified_base (10535)..(10544): a, c, t, g, unknown or other
  modified_base (11205)..(11214): a, c, t, g, unknown or other
  modified_base (12001)..(12066): a, c, t, g, unknown or other
  modified_base (12210)..(12219): a, c, t, g, unknown or other
  modified_base (12409)..(12569): a, c, t, g, unknown or other
  modified_base (13581)..(13624): a, c, t, g, unknown or other
  modified_base (13828)..(13837): a, c, t, g, unknown or other
  modified_base (13950)..(13959): a, c, t, g, unknown or other
  modified_base (14072)..(14192): a, c, t, g, unknown or other
  modified_base (14510)..(14519): a, c, t, g, unknown or other
  modified_base (15058)..(15067): a, c, t, g, unknown or other
  modified_base (16264)..(16273): a, c, t, g, unknown or other
  modified_base (17434)..(17443): a, c, t, g, unknown or other
  modified_base (18735)..(18744): a, c, t, g, unknown or other
  modified_base (19219)..(19228): a, c, t, g, unknown or other
  modified_base (19581)..(19590): a, c, t, g, unknown or other
  modified_base (20057)..(20066): a, c, t, g, unknown or other
  modified_base (20173)..(20350): a, c, t, g, unknown or other
gcgtggcctgcgcctcgcggccgccgccagccaggcggcggccgcggcctggctcgtgcgccgcgcgcgccaggtggacctggcttccgtcccctccctcaccgcctgctacatggacgtgtggaagctgttctacctccagtacctcatcatccccttcctgtgctgagcggcgacgcgggacggggctggtgtgtgggggcggagcgagccaggcctggccccccctcagcactgggacggcctggcaggcacccgggcccacgtcatgtgtctgcacaagcacgagcctggagcccttggggcgatggcgggactggcttgcggctgactgcatcccacggcctccatcgtcccggcgcccattgcaaaaggaccgcctgctggctcgcgccctccccgatcctccactcccagctgcttnnnnnnnnnngcccaggctcacgtcatgtgtttgcacaagcacgggcctggagcccttggggcgatggcgggactggcttttggctgactgcgtcccactgcctccatcgtcccggcgcccattacaaaaggaccgcctcctggctcgccccctccccgatcctccactcccagctgcttccgagtccccttttccagcgttctattcccatctcgaaaaaggtactgaggttgatgctgtattcctttgccccgacccagaaggggcacacacttgcacggtgcaggcacaccatgctttgtccccagaagatcccttgtttccacggcctgggagagaccggccttgcactgccttccccttgatttgccgttgctcgagtcccctcttggagggaatcgaatcctctccagtcgcaagttgggatggtgtgtaatcgaacactcggtgtgcgcaaaggaggtgggtcaccatgcggaaagtagggatgatgatggagcgccatgggccacccaggtaccctgccgcctggccggcctgccagcgtcagaagcagcactggcagtcaaaggggcagaagtcggactgcccggccttcactccccatcccagctcctcctcggtgtacacggcgtagccctcctccgtcctcttccttccttgaccaggttctgtcccaaacaggtcatccttgctgcccttcacggtgacactgggcatggaagtactggtggtgggtgcagtggccgcgtcagccgtcgccttgggcgcctgtgacccctgcgaattgtggccaaagcatgtaggactgcaggatggcgcctgtcagggctcgatagagccagtagcaatgttctacacgcttccaactcactgactcttgcacattgtgaatcgcctgccatgggcagccgtcagcacaaagcagttcctcgtcacaccttgggatgggcactctgcttggacttcagcttcccaaagaggtcgtctatctcgttgctgtctccatctattgcctttgcgtgcaagggtgcaggggcagcagctggctcccctcccgtcccctggcgttttcgcttcttctcagtcgagttggacggctggtgcggtttagctgtgccctctcgtgcccgctggcctcctgcagctggcatttgagctggcggtatcacttcagagttactcacggatgccgcgggtgtgggtttcctgttgcttcccatcgcgcgcggtctcaaagggagagcgttgtgataggagcccttccggaagaggggacttgccccaccatcaactgaaccgatacccgccgccagaccccgtgcaaggcgagtaaagttctcttcctaagattgtcggctctcnnnnnnnnnnatgataagagcccttccggaagtggggacttgctccaccatcaactgaaccgatacccaccgccggcccccttgcaaggcgagcaaagttctcttcctaagattgtctgctctctgcatgcaagtgtgtgttggtcgcttgggtccgtctcgcctcctagtcgaagtgcatgctacggcactattccgcgcgcgacacatctgctcctcgctaattcagagggtcagacctgttcgtccagttccatctagcaatatatgcaatacgacatcatcaatccgcaggatggctggaagggggcgatcgctggtcatgcctgcctggatgacgtcgggggccttcacagcaccgggtgggtcaagtggcaagcaaggccggtaattgtactatctgcacaacgcacatgaatcgacctgctcaacattacatcataaaatcaggttccgccgtgtttgtagccttggacgatgacagccaagcccagcacgctgcattgagggagacggaggcagagacgcgagccgnnnnnnnnnngttgtagccctggacgatgacagccaggcccagcacgctgcactgagggagacggaggcagagacgcgagccgtcctctccgggtccaagcgtgggcatggggaggtcgacgccgcgcccgagtcccaaccggtccccaagacggaggccgattacaggacggccgtgaagcaggcagcagcagcgctcgagaagtcggcagggtcagtagctccagagccagaggctccccagcgtggcgccggcgactggcagcactaccagccccccagcgctgtgctacaggccgtcaaggaggccaagaccgcccgcgctctcccccctgcgctggccgctcggctggcggcccgcggcatcgtgcagcggaaggatgacacagggggccccgccacgagcagcaccgcgcctgccgccgccgcaggtgcagcaggagccgcgccgggcggcgggccggtgtcgagcctgccgccgggctggtacagcgccgtggacgccacttacaacaccgtctactactacaacccgggcacgggggagcgcagctgggagaggccggcggtccggccccggctgccgccggggtgggaggagacgcgcgaccccacctccggaaaggtgtactacttcaatgctgcggcggggctgacgcagtgggagcacccaggcaaggcgggagcagtggcacaggcgagcggcggcgcaggcccgcagcaggtgccggcggctcaggcaggccccggtgctcaggctggcacaacggtacaggcgggccctgcagtacaggcgggccctgcagtacaggcgggccccgcagcgcaggccgcccccgcattccagcccgcggaggcgtttgcaggcgcaaggccgggggccgtcttcaagcttgggccgatgggcctcgggtactatgccgacgcccccgccccggcgcatgccctcggtgaggactgggcgtgcgttggatgggcttcctgctgtgcgaagcagccgggaccactgcagaggagaatcaatgccctgcacaacatacctcaacgcaccctcatgccagggcaagggtgtgcgcaggcgcctggccaggcttcgaggggcgtcccgcctgccgagggaggagggcagcctggagctggcagggggagcggcgctcgcgcttcgggccgcgatcgcggcccgaagcgcgaagccctcgacccaatggatccggtgagcggcggggaggtgttcaggtggagccggggcggtgttgaggagagtcatgcacgcagtctggtctgcgcctttttaggcaggcctggctgtgcttttatcggcgacgggccacatccttgaacggcacacaccatcctgccgcacacagtcctcctactcggatgctccgcgggggggctggtcgagtgggctggagggtgctcagccgcgggctgcagacaccacggccggaggcccgctcttccagtccaggccctaccccagccctggagctgtgctgcgtgccaaccagagggcgattgaggactgaggacgggagatgcagggggcccgtgcaggcctgctggcatgccgcattatgtgccactgttcaccatcaccattgatcagtgcaccttgtactgttatannnnnnnnnntgtgtccagggatatgggtacctctcaaaaccgtctcaaattctcacatggttctggnnnnnnnnnntggcatgccgcattatgtgccactgatccccatcgccattgatcagtgcaccttgtactgttgaaggcagagatgcctttggaactggcttccaatcatcgtgaatgatgggaccagcagggccgggcaaacacccagtggaagacaaaaacttacgtaagtgtgaacgcggaacccgtgtatgcggcgatgagtccatgctcctcagacgactccgctttagttcatatacaggtgtccaggcttatgggtatccctcgaaaccgtctcaaattctcacatggttctggagtaccacgaggctcactgacatctccgacccatatcacattctaagcactgtctcccgggggcgtcgacatccgagaacatgtctagtactcccaacccgagnnnnnnnnnnttgagcactgtcccccgggggcgtcgacattcgagaacatgtctagtactcccaacccgagacctacgcggccgctcgaggagatgcacgctgcgtacggttggattcaaggtgggtgaccgcgtaaggggggcttgttgaggccggttccgtggaggtctgatgctcacagcacgacaccccggcataccccaggcgagctcctgcaaaagtccctcccggccgggatggaggcgctgagagcaccctcggttgccannnnnnnnnnagaactcctgcaaaaatcccccccggccggagtggaggcgctgagagcaccctcggttgccaaggttggtggagggcctggggtgcctacatgtgggcagacgatgggctcaaggtgtctgcccagtgtgcaccccccctgcagcagtgactggggacaaggttgtcnnnnnnnnnncgggctcaaggtgtctgcctggtgtacaaccctcctgcagcagtgactggggacaaggttgtcttaatcgactgactcacacatttctcttgcacagtgcttgagcaagagacgctgtcgctactgctgagctgacttgccccttcacccgtgccacctgcagctcgttccccaaatcaacagctaccagcccggccagggcaggcagcccctcgaccccacctctgctgggaggcacaggctgcagctccgcctcgacctgtttggcctctctgagcgccctgtggtgggcgacggcgcctgccagttcagggccctcgcagaccagttgtacgggtgagctgaaggcgatgggtggattgagggggtcttggtgacgtgcctgcgggcaggcagggcaaggacctcagcggccggctctctgtcctccgcaggcagcaacctttctggttgcaaaacccaagggatgccgtcatgtcgcctcccacgcccccagtctccctcatcctccactccaccgacaggtcccaggatgcgcatgcgctggtgcgggagtcggtggtggcccagctgcgccgccagccggggatgtaccaggagtatgtgccgcaggagtaccgcgggtactgcgatgacatggcccagccccaggcctggggcgaccatgtgaccctgcaggccgccgccgactgcctgggcctgcgcatcgcactggtcacttccttcccggacaccgcctttcttgagatcgcgccgcggggggttttgaggagctcgcgcgtgctgtggctcagcttctgggcggaggtgcactacaacagcatctaccccaagggggaggcccccgcgctgttcatgggccccagtgctatgccgatgtcccagccaggaaggtcacaggcaaagttcctgggcagcaagaggctccaccacctgctgataggctgaggcttccccagtgtcatgcagagcctggcgacttgatgctttgggcatcctttcatccacattcttacatctctccctgaataagggcttgggaaannnnnnnnnntccagtatcatgcagagcctggcggcttgatgctttgggcatgctttcatccacattctaacatctctccctgaataagggcttgggaaataacccctgcctttcagattccttgtaattactgtaagttgatcgcgacgtactcgctgcacgtgagactttaccatcaatactaacagtgctggcggatgaaacccgaaatgtttcgatgtgtcggtccgagatgtcgtgccgcgtcagccgcgcggcatgttgggcagcgtctcttcgagagatggcttgtaatggggaatcaagggcatcaacattcgactacaaaacctcttcgaccgtactaaatgctgcgccaggcttcttgggccctgcagcgcgcctgccggcagggccgtgtggctgccgggacctgttgggccgcgccccgctccttcaccgaggctgcggtgcagagcagcgctccgggggatacccaggacgccatagagttcagggaatcggtgcgcagctttgcacaggaggtgatcgcccctcatgcagccgagatcgatgctagcaactcattccccaagggcgtgaacctgtggaaagcgatgggcgacatgggcctgcatggtgggtcgggggcagggtgtttgaagtcttttgaaagtcatgcactatgctcggacaattgatgaggcagggtggcatctgggtgagagggatgattgtacacctcatgggctggtgtctcgatgacgccaatcacatggccttgttgatacaggaatcacggtgcccgtggaggatggcgggctggggctggggtatctgtaccactgcatagccatggaggagctgagccgcgcctctggtgagctggagcctgcccgcttgtgtaacaagggcggaggcagggtgtagtgcctgaggtgcaggcgtgaggggccaggggctctcaaggatggcggtctggctcactcacggcctgcatgtgacttggggacatagcccgaacgaatcatgactcatccctccccccccctgcctggcatgagggacacatatcccagcccccccacctccctccacccgtttccctccgccgtccaggcgcggtggcgctgtcctacggtgcgcacagcaacctgtgcatcaaccagctggtgcgcaacgcctcccccgcccagaaggcgcggtatctgcccgatcttatcgccggcgacgccatcggctcgctggcgatgtcggagcccggggcggggtcggatgtggtgtccatgcgcctgcgcgccgaccgccagcccgacggcgccttcttgctcaacggctccaagatgtggatcaccaacggcccctccgcctccacgctcatcgtgtacgccaagaccgacgccgaggcggggccccagggcatcactgccttcatcgtggagcgtggcatgcccggcttcaccaccgcgcagaagctggacaagcttggcatgcgcggatctgacacctgcgagctcctgtttgagaattgccgggtgtctgccgagaacgtgatgggggaggtgaacaaggtgagcgagtgggatggtttggatgcagggggcccctgcacctcggggtgtggaggaggggatcgaggctggatgccgaccaatcggaggatgcctacccgcacgagcccgcggccgtcctttcctcccttccatcaacgatcnnnnnnnnnnaggggccctgcaccttggggtgtggaggaggggatcgaagctggttgccgaccaatcggaggatgcgtacccgcacgagcccgccgccgtcctttcctcccttccatcaacgatccctcccaacaccgaccatcatcacccagggcgtgtatgtgctgatgagcgggctggatctggagcgactggtcctctctgctggacccctgggactcatgcaggtggggcaagcatggtgtgtggctttggttgctgcatgcacacgtggatgcggggggcctgggggaggactggatgcctgtgcaggtctggcaatgctttggaggttggagggacccnnnnnnnnnncgtgctgatgagcgggctggatctggagcgcctggttctttctgccggacccctgggactcatgcaggcagggcaagcatggtgtggctttggttgctgcacgcacacggggatgcggggggcccgagggaggactggatgcctgtgcaggcctggcaatgctttggaggttggagggaccctgcgcctcggatggtcatgtggagtgacatcagccgcttgccttcccaccccttcccaggcatgtctggacaccgtcctgccctacgtccgcgaaaggaagcagtttggaaaggccatcggggagttccaggtgtgtggggtgtgggcagagcagttagagtgactcgtggatgctggcctcaggcatctaggcctgaatctcaggtctgcgcgtcggccagggatcgctcggtgcaggactcgacgggcatggtgcagcagggctcggtcctgccttgggcctccgtccaacccccaccnnnnnnnnnngggtgtgggcagagcagctagagtgacttgtggatgctggcctcgggcatctaggcctgaatctcaggtctgcgcnnnnnnnnnnnnnnnnnnnnnnnnnnnnnnnnnnnnnnnngcagacatgtacgccacctcccgtgccacccgcgccttcatctacgccacggcggccgccgcggacgcgggacacgtcagccgcaaggactgtgcggcggttatcctgtatgccgcggaggcggccacgcgtatggcgctggatggcatccagatcctgggcgggaacgggtatgtgaatgagtatcccacggggcgcctgctgcgggatgccaagctgtacgagatcggggcggggacctccgagatccggcgcatgctcatcggacgggagcttttcaaagacagcgcgtgaggggtgggcctgcaagggcctgtgtgcagagggagggacaggtcccaacattgataggaagggccagagtcccggagccttgctcagcaccccttgccaggagagcaggggaggtcactcgccatgaaccaaagtacacaaaaatgcacaccctgtgcctgctgtggnnnnnnnnnngcattgataggaagggccccagtcccggagcctcgctcagcaccccttgccaggagagcaggggaggtcgctggccatgaaacaaagtatacaaaaatgcacaccctgtgcctgctgtggtgccctgcagcaccgcagcgatcagacacaggcgggcttgctcaatgttgcatggacttttgacacgtcatgtctgtttcacccacatactcactcacgtcgctgaagcaatccaggtcttactcagcggatcgttgaatgcaagaggcaaagtatacacggttgaagcggttttcatggcatgccgcatccacaccagcatgcaacccaccctcttcagcgtctcctgtgcttggccttgctcttgaagacgtggcgccccttcccaccacgtttttgccgtgccagctcggccttagagagcttgttggacggcttgccggtctgggtgcagggttggggtggtcgaggaagtgagggaaccagaaacagggtagggggaatgcgtcattggagcaacccccttcaaacatccagggcttttcagcagtccatccgcaaaagccagtatctctcagaacattggaagggacgccgcacagcccatgcatgcagcatcagcgcgcagnnnnnnnnnnggtgagggaaccagaaacagggtagggagaatgcgtcgttggagcattccccttcaaacatccagggcttttcagcagnnnnnnnnnnnnnnnnnnnnnngctactacgggcaccccctgcgtacacctgggtcttccccgtcggtgctgggccattgttgtcaatgccatcgccattgaagagctcatccttgctctgcgtgcgggttataacagagcgctagtgctgaggcgatcagagcttcctgatggccgctaacaattggcaccaaggagcaccaacttcttggccaccccgccaccacatgccaccgagtatacccacggacaatgaagccccctcaccctttctcctccgtccacccgagtcccctctcaccttcttcttgccctgcttcttcttgaccccggtcaccatgccggccgccatcttccccgtcttggccccgccaatgccggtcatgcgcagggtcttctccctggacttgatggcgcggatggtccggctcaggccctccgtctcttccatcagtcggttaccctgcttgcgctccgccgcctccgccgccgcgcgcgccttcatgtccaccttcttctggtacttgtcgcggttcttctgctgtttgccggtcagcggcgtgtccgccacccgcgccgcctccgccgccgaccgcttctccttttccgactggaaccaggtgcgcgctgggcgcgagaagatctcggactcgtgctcgatcaggttggcggcctgcaggcccaggggtggcgcgtggcgtgcgagagcccagggtcaaagcaccggcacatcagggggtgaaagggtggccaggtgcatcgcccgctcgccnnnnnnnnnnagcctgcaggcccaggggtgacgtgtggcgtgcgagagcccagggtcaaaggaccggcacatcgggggggggaagggtggccaggtgcatcgcccgctcgccagcgcaccacagagatgcttgcccaactttcttcaattcagcatgcgcatttctccccctgagaatccccaaccctcccttgcccccaccccctaaccccctcaccttctgcgtctccatctccgcccggcgcaggtgccgctcgtcgcgctcctcgaagatgacggagcgcacgtcgtcgctcatgcgctccacgcggtcctgccaggccgccacggcggcggccggcacctggcgctgctgcagctgcacccccgtgcccttcaccacggccttgagcagcgcgcggtcctcgtcctccacaaaggtcaccgaccgccccagcgcccccgcccgggcggtgcgccccaccctggattatggaggttgtgtgaggaggttggaatggatgcatcgtgtgtttgcgaatggagagcaggttgtgtggcggcatgacagcgctgtactgatcacgcaaggatgaccaatggatgtacagtgctccagaggaagggcactgtacatgtcatccaagcctcgtagaccaggcagccctccaccaacacgcacttgcctgccnnnnnnnnnntaactcaaacacgcaaatccaacgatttcctgcttcccagcacctgtgcaggtaggcggggagctgcttgggcgcgtcaaagttgatcacggtctccacgccgagaatgtccagcccgcgcgaggcgacgtcggtggccagcaggaaagcggcctcgccacggcgaaaggcctccaggctctgcaggcgcgccgcctgggtcatgtcaccgtgcagctcggcggcggaggccagcccgcccaggccaaacaggatcttcatgcggtgtgcgcgctgcttcgtggagaagaagacgatggtgcgccccgaggcaaaggtgcgcgagcacagcgcgagcagcactgcctccttctggctcgcctggtttgaggggataggcgggagggtgggatggggatgatttggggaggtggaagctcggcaagttgggattcaggcgggtggatggaggggaggatgcagtgtgcgagcacccgatacaagtgcatgcatccacgttacagcagtgacaccccctgcagggctcctccctctgatcacacccacagcccacctcggcgcccttgagccgcaggatctcctgcgtcaactccttgggcgcggctgccgtggcatcggcggccaggcgcacagggcggttcagggacaccgccaccagcttcttcacctcctccgtcatggtggctgggaagagtgggtcgagtaaagtgggggcgggggggtgagaggtggtgaattggctcctgatctctccggcaacgtgcttgacaggggccggacctaggcnnnnnnnnnnnnnnnnnnnnnnnnnnnnnnnnnnnnnnnnnnnnnnnnnnnnnnnnnnnnnnnnnnacggcggaggtgtgtttgggggagggttgtgcgttgcctgcgcgacagctttccaacacaatcccggctctgacacagggccaggcgctacctcacttcctcaacaatgcagaatgacacgcaaaagttgctcgtgcagcacannnnnnnnnncgagggaatgggcgggagggtgggatggggatgatgtggggagttggaagctcggcagaatgggattcagacgggtggatggaggggagagtgcagtgtacgagcacccgacgcaagtgcatgcatccacgatccagcagcgacacctcctgcacagcccctccctctgatcacacccacagcccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaaagcggggtgggggtggggctgaggtggtgaattggctcctgatctctccgacaacgtgcttgacaggggccggacctaggcctaggacctttccctcttcgataccacacatccaatcccactttcaaagtgcctttgaccctcacccgagaagagcatggtctggcgtttccggggcgccagcctcacgatctccttgatctgcggcggaggtgtgtttgggagagggttgtgcgttgcctgcgcgacagcttcccaacacaatcccggctccgacacagggccaggcgccacctcacttcctcaacaatgcaggatgacacgcaaaagttgctcgtgcagcacaggcttgggcctcacctcatcggcaaaccccatctccagcaggcggtcggcctcatccagaatcagcgcctggaggtcctccaggcccacggactgggtgtttcgcacgtgatcgatcacccggccctgggaccagcggcgcgaagtgatgggcatggggtgctggccggatcgggctttggcttcccctgtttccacttcagaacccatggggagcattccagggcgagcacagggcagaacccaccctgcacctccacggtggacaccccacgttctcctcccttccccgtcatctcctctcgatgccctccttgtcaaccctgaaacctctctaactcaccggcgtccccaccacaatctcggggctggtcctcaggctggcggcctgagcctggagcgacagcccccccaccaccagcgcggcgcgaatgtcggtgaactgcgccagcttctgcgtcatggagtggatctgcaccgccagctctcgcaccggagtcagcaccaggacgtacatggcggccaggcggcggcttcgatgcagcaggcgctccagcaggggcaacatgaaggccgccgtcttgccggacccggtgaccgcgctgccgctgatgtcacgccccgtcagggccagcgggatgcacgccgcctgggtggggnnnnnnnnnnnnnnnnnnnnnnnnnnnnnnnnnnnnnnnnnnnntcctcccggcgccatctacctggataggggtggggtgggtgtagcccagcgcctggcaagccttcacaaggggcttggacagattcagctccgcgaatgtctgtaggaggaattcagcagaggggttattggaaatgagctggctggacttgtgctggaattccaagccccggacacctctttgccatgggcagaaacccaggnnnnnnnnnntccggagggagagggggggaggggcatgcacgtttagcaatgtctagggggctagacaggagagctgaacttccacggcgggacgggcggggtcggcatggcatgagcccccnnnnnnnnnngacggagggagagggggggagggacatgcacgtttaacaatgtctagggggctagacaggggagttgaacttccacggcggcacgggcggggtcggcatggcatgagcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcagagggattattggaaatgagctggctggagttgtgctggaattccaagccccgtacacctctttgccatgggcagaaacccagggctctcggtgcgctccaacagcacacaccctcgcacaatgatccaacccacccaccttggctgcaaaggtggtgccctctggcgtcgctgcgtagaagcccccggccttgccgcgcggcactggtccgacctgcctcttggccggccccgctgcgcctgcctcctccgcaggccgcttgcttggtcgggcgggagggtctgacgcagttcccttgggttgtcgaggccnnnnnnnnnngcctgcctcttggccggccccactgcgcctgcctcctccgcaggccgcttgcctggtcgggcgggaggggctgacgcagttcccttgggttgtcgaggcccccccgctccctcgtcagactcctgagactcggcatcctcgccgcttggcccctcgccttcgtcgtcctcggtgtcggtgttcacctcggcatcgtctgagtcatcggcgacgccctcctcctcctcggacccatcgctgtcgtcctcctcccccgggagcggggcgtcgctgtcgctggcaccctcatcgtctgatgcgctgtcgctgtcgctggaggactcctgctcgctgtcgatggcagccactcggcccggctggcgaccgctgcccctcacctcccccacccgcttcctgatcttctggtcgatggtcgttgcatgggacgctggcttctccgcatccacaagggcccctgggtgagggaaggggccgaaggagcatggtgagcggatgatgccggccaagccagtcgtgcactgccaatggctacccgagannnnnnnnnnaggaaggggccgaaggagcatggtggagctgatgatgccggccaaggcagtcgtgcactgccaatggctacccgagactggatggaggagattgagacagcctagagtgtgacagggcgcaccggctgcttccaacgtacacctcaccgctaaattcccaaggagcttggacctcgacagatcctgggcccaaatcgaaggtgaagccggggttcagttccgtcatgaccacatgcgctggtcccgcgagctggaagtagtgcgatttaatgcatcccacgagtatactcgagtaagttaatatgcaagctgcgtgccaaatggtcccactcggcgcctaccactgtccgggcgcgagcttcgcacctaacccgtgctttgcgccttgcgacgaggaaagcccggccccctacccacagagtggcaatgggcgcaatggagagccatccgttcagcatgaaagataagccctgaagaacagctttgaatccagaatgaacgacaatcaccaccacaggagagaagtctgggccttgttacgaatcatttaggctcatgaagagcgtggattgcgccaggaagtattttatggtgagcttggaaagaagcaaccaggctgcatgagcctgtacagaattttcagaaagccaatgaatggatttattcaacgacctggggaagagttgactttctctttaagcagtctgatacgtggtgtctgctcctggggttgtgaaagatgctgctttattctgagacgacaggcagttgatgttgaccttcatcgcggccagcgcatgcggatacacggtatctagcagcgaatactgagagcgctgcaatgctctcatccctctgggtgtcagttaagccaaagctatcggcttagctacgaaactttctgtgatgttgaggaacctgattagaccccattttatatctgcgatgcagcctacacagccttgggggcaatttacaccgttttgactaagaagacgcaagtcatattcttatgttggcaccacagcaatggaggtcgaggacattggaaggacaaaatatgattatgttgctgcatcgctctatagacagctttcagaattcaataggacgacaggcaccgattcatacatgcctctcccagcaagacagcgctacagagcgtagaggcagccacttgcggatgtcgagctgctnnnnnnnnnncgaagtctgggccttgtcacgaatcatttaggttcatgaagagcgtggattgcgccaggaagtattttatggtgagcttggaaagaagcaaccaggctgcatgagcctgtacagaattttcagaaagccaatgaatggatttattcaacgacctggggaagagttgactttctctttaagcagtctgatacgtggtgtctgctcctggggttgtgaaagatgctgcttcattatgagacgacagacaattggtgttgaccttcatcgcggccagcgcatgcggatacacggtatctagcagcgaatactgagagcgttgcaatgctctcattcctctgggtatccgttgagccaaagccatcggcttagctacaaaactttctgtgatgttgaggaagctgattagaccccattttatatatcattacagcaatggaggtcgaggacattgaataaacaaagtatgattatgttgctgcatcgctctggagacagctttcagaattcaacaggacaacaggcactatatcatacatgcctctcccaacaagacggcgctacagagtgtggaggcagccacttgcggatgtcgagctgctgaattttgccactgttgcctaaggtcgcaggtgcatgatgtattggaggaccatgccaggttcttccaacgacatccagacagacaataagtggcaaaccattgctctcttccatgtccggtctacgtaaggtcataatgtgttaccctgccatcattcagttgctcacaggggcaaacatggtttagcagtgtcccggtctggacacctgtgggcaaatgatgcgaaggatcctgggctaccatgcaatcattgtggccgaccgccgtgcctgagcgactccgatggcactgcgctcccaagcatcagccttagctcaactactcctctgtcggctcagcctaagctcaggatctgagttacgggaatggctgtctattgaatggactagtcagaaacacggcactggcattgcaggtgtgcttcgcactgatctgcagccatcatgttttttccattggatgcgcgaccaccatgaaagcgcaaggttcgccttgccagagataccttgcgaaaattcttcagcaatcgtgcatgcctgtatgtcatgcaatgcattgannnnnnnnnnatcatgtttctccactggatgcgcgaccaccatgaaagcgcaagcttcgccttgccagagatacctggcgaatattcttcagcagccatgcatgcctgtatgtcatgcaatgcattgacactctgcccgcagtgaaagcgagctgctttagatcactcgggccgtgtcggatataggatgaaattagttcacagggccctcaagcacgtcggctcagaccctagattcatttctgtgtctgtctgtaccccaaagtatatgttcgggtcaatcccacctgtgtttgcgtggcgtccaagctcgagttagagattcccatcggaaacttcgcaatgcatccatatcccgagaacgctttctaaaatcctgtaacattccagatggtacatgatgtgaggagcattcacgtgtcagtacgcctccagctgtgtactgcgaggacgtgtaagtgccggtgggcaccttttaagaaggtaccctggaccgccggcatgctgggtggttgcccgcccgcgggtgccaggacgggcattcgctcttgagagacaccacctcaagcacgacaatctcttcaaagaatgttcactggagtcttgcgcgagcagaactttcagattccagtggccgggactgtccggccatcgcacgtttcaagattaacacaggtccgggtcagcctctgccacccacgcgtccaccggaccagtgctccggatgccgtaccgcgaccaggcagaacgtgcatcaagctctttgtaaacgcgtaccaaggtttatcaaggagcgaacacatcaatgcccttcttggaatcccaatttattacgaatctgggtgcatgctcaccctggaatcgcatagggcgatgacttcccggaacgtgccgaaggctgttggccacttagtgctggccgccacactcgcgctcttgtggagtgaaggggccttggcggtgagtgttgaggagatcatgggtggtacggggtcctataatatctgcagtgcctaaattcgctgcccatgtctccgcccaggctacctgctcctcgaccttcgtctccttccccagtactatgtgagttttgggttaggtggtctgttgactcctctgcagctaccctgtgggattgcatcccaccatatatctcctcagatcgagtgattttgcatgttacttgcgaatctctcgtgaacggtgcactgtgtgtgtggtcagcagggatattgtctgtcagtatcgttgctcactcggattcttcaccacccccctgcagtgtgagacatggtgcatgcnnnnnnnnnnatctccttccccagtactatgtgagtttgggtcaggtggtcagttgactcctctgcagctaccctgtgggattgcatcccaccatacatatcctcagatcgagtgatttgacatgttacttgcgactttctcgtgaacggtacaccgtgtgtgtggtcagcggggatgttgtctgtcagtatcgttactcactcggattcttcacctcccccctgcagtgtgagacatggtgcatgcctcttgacagcagacagcgccgatagcttctgcaggtgtgaaagccgggatgcagcgcagggaaaggatgcctagccgctgctctggagttgcacaaggggtccaaaaggtcatgagctgctcattgtgcacagaactcattcaccatgagctctacggcccccaacgccccccccaccgtcccatcaacaggctggagggattcattggcgccggatctgttcgcacctcctccctnnnnnnnnnngcccacccaaccgtcccatcaacaggatggagggattcactggcgccggatctgttcgcacctcctccctgaccgccaccggcctgtcggtcggcgtggtgcggctcggcttgctggaggtggactcgtctcccgatgccgaggtcctggtggcagtggagtgcttgtcagctggacagtcggcgtgtgtggctgacgaggacggcaacatcggcgctggaaatcagggcaggcgcaactttggccgcaacaaccagggagacgataacattggtgagagggcgaggacgtttcgctggcaaagcacagcactgagtggtaccttgtccatcccttccatcagggaccggctnnnnnnnnnntattggtgagagggcgaggacgctttgctggcaaagcacagcactgagaggtaacttgtccatcccttccatcagggaccggctatcaacaaaacatctcacactccatggtgcaggaaactccaaccagggctcagtcaattggggagacagctgtgtcggcgacaacttgcgctgcactcatgtggcccagagcagcgtgcctgcgaaggaggccacccatcggtccatcacccagcatgccttggccaggggcagggaggcagctcccttcagcaggcggctgctgcaagccgcaagcgggcaagagcaagctgtgaggctgacgaaggccacccccccatcgcccaagaaggcctcaccatctccagccaagaggatgccacccccatctgtgaagaagcagccgccgccatcccccaaaaagcagccgccaccttcccccaagaagcagccgccgccttccnnnnnnnnnnccaactggggagacagctgcgtcggcgacaacatgcgctgcagtcatgtggcgcatagcagcgtgcctgcggaggtggccacccatcggtccatcacccagcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccagccaagaggatgccacccccatccgtgaagaagcaaccgccttcccccaagaagcagccgccgccgtctcccaagaagcagccgccgccttcccccaagaagcagccgccgtcttcccccaagaagcagccgccgccatcccccaagaagcagccgccgccgtctcccaagaagcagccgccgcctccccctccgcgcatgcagtcacctcctcctccgactgcagtgtcgcccccccctccgtccacccagtcgccaccttcacccatcacattgccgcctccaccacccagtgagtcacccttacctcccacgcactggag

SEQ ID NO: 39704 - DNA, 61 bp, Chlorella protothecoides
gtgcttgggtggccgggaggcagagtgtgccccctctgccccgagtgggtccgggcggttt

SEQ ID NO: 39705 - DNA, 76 bp, Chlorella protothecoides
tgcctgagccagcactccttcgtgcgaggggcacaccagctcgccgtggaatggtcgcagcagcagcaccagcact

SEQ ID NO: 39706 - DNA, 110 bp, Chlorella protothecoides
gtaaccgatggtcagctccacgatgcatgagtcggggccaaagcgccggaatagcagctggcccctggagaacggttgcgaggaaaggagggatcagttggcagtggtga

SEQ ID NO: 39707 - DNA, 75 bp, Chlorella protothecoides
ggctggcctgagttggggctggcatgggagcgcgttgaaatgcttcccccccctcatggaagcactacccctcga

SEQ ID NO: 39708 - DNA, 75 bp, Chlorella protothecoides
ctggaggcggaggcggcggaccgcctggtcgccgcggctgacgcctacgagcgcggcatcagcctgggcgggctc

SEQ ID NO: 39709 - DNA, 61 bp, Chlorella protothecoides
cgtgtcgcgcagcgaggccagcgacaccgaagcccgcgccagcaggaagtctcccgccagg

SEQ ID NO: 39710 - DNA, 130 bp, Chlorella protothecoides
ttacccggagatgaggattgttgcaggtgtttctgaccttgccctgaacaccagtgggttaccctctcgacggagaagttgatgcgttgggagttgccaccttgcatcaccatgatagctgtgctgcaca

SEQ ID NO: 39711 - DNA, 97 bp, Chlorella protothecoides
tgactctgtggcaaggggagtggggcagggtggaatggagagggaaactggaatccagccatagcccagagacggacgcaagtggcctgcaggcaca

SEQ ID NO: 39712 - DNA, 78 bp, Chlorella protothecoides
gcagcagacgcaggtgcgcctcagcgaggcaacagacacccagcgtttggccactacgcacaccctgatccagatgaa

SEQ ID NO: 39713 - DNA, 61 bp, Chlorella protothecoides
cgcgccccgcacctcggcagggtccagggcacagacgaggctcagcaccccatgcactcct

SEQ ID NO: 39714 - DNA, 65 bp, Chlorella protothecoides
gtctcggtccatgatcgaccgggtagagtttttttccccctcctcttgtcaccccaaccttccca

SEQ ID NO: 39715 - DNA, 7114 bp, Chlorella protothecoides
  modified_base (152)..(220): a, c, t, g, unknown or other
  modified_base (476)..(485): a, c, t, g, unknown or other
  modified_base (6040)..(6049): a, c, t, g, unknown or other
  modified_base (6649)..(6658): a, c, t, g, unknown or other
gccagacctcggtgggccccaccgccgcctcacccgccgcggggccggcccggccacggacgtagcgcacggtcagcgcggcgcctctggccggtcctgggtcaaaagcgccgccctcatccgcaccagcgccgcagaggagcaggctctgnnnnnnnnnnnnnnnnnnnnnnnnnnnnnnnnnnnnnnnnnnnnnnnnnnnnnnnnnnnnnnnnnnnnnccgcagtcgaagagccgcacgcgcgtgcaggagagggaggccgcgagctcggcgccggccaggtcgtaggccgccgccgcccgcaggccctgggcctccagcagcgccaggctgcggccgcgggccgccagcgcgagggaggcggcggggatgcgcaggcgcagggaggcgcgaaggcccgcggccccataatgactaacctcgcgtgattcatccacggcgtcaacctccatggccgccagcaggcgggcggccnnnnnnnnnntcgcaaacccgcggccccatgatgactaacctcgcgtgattcatccacggtgtcgacctccatggccgccagcaggcgggcggcctcctcctcgtcggggggcgccgggcgcggcggctgcagggggcagggaaggatcgggaggattgggatgatgctgcaaggtcggcatggcttggcaacaccatgaagcgatgcatgggtggctcaggccaaggtgtgctgatggaacccattgtacaaactcgatcatacataccatgcaagcaccgactcaacacgtgcacccacactgcgagcaccacacaaatttccaggtcacagcacacctgtgcatagcccgctcgtcgaggtagggcgccgaagaagcccgccatggcagacacgccgcgcgagaccacgccccggcgagccgcagcgtgcggggacacggggcgggtggaaagcgcgagcccctgctctggcgtgccctctgaaacgggaacgccgtcgccttctgcacccggacgcggcagctccgagccggggttgccggggcgcagtgcggcctccggcacgctgccagcagcggctgtggccagggcgctggcggccgtcatcgcatcagcgggaggaacagacaacccctcctcggtgcgtgtgtcgtctcttgttggaggggcgccctcctcgggcatggcggcgcctctgagtccagccggcgccagatcaaccccaatcagccctttctcatccgacgcaggcccggccgctgcaaggagaagttgtccgggggaagggacggccttcggccccgttttcttgcgcttggcggctgcggcggccttggccagggacgcggccgccatgcgtgccgccacggcgcggcagagggtgatgtccggcaggcacagcttcctctccgccgcctccagcatggagcagcagggctcctcgacggcgtcgccgccgccgccgcttccctttgcagcgcccactcctgcagccggctgcaccggccgctccaggaccgcgcggtacagccggatgtaccgcttccggcgctctgcacgcttgtgcgccggcacccacgccgtcacgcccgcgtcccaccgagcgtcgctcctcagcacgccattcagcgcaaagacccacatgcgcctgcgaggaggggtggacagcgagggtggttgaataggaggtccgtcgtccagaaaggggggagcatgagtttctgtagaacacaacagcattggcaaccagtggagggtcgagtcagtagcacagagggcgccttcaaccctccacacacaccaaaagagcccgcccacctggcaaacccctcgcgtcccccagacttcaggcgccatgaggcggggcagaacagggccgcccgattttggcgcgagacccgctcggcggcgtcggccaggcacaccacccctgccagcgtcgcgtcgctcagcgacaggcgcagggagggcagcgtcagtgtgcaatctgcgcgcaacgtgccattagaaagcgcggcggtggtgcccaggtgcagcacgccgtcgcagggcggcagcagggggagggatcccaggggggcttgtgtggggtcgatgccgaggctggttgcgcccacttccccccagccgtttgcgtccgtacccacgccaggctccccctggaggagccagacagagacggccgccagggcgacgtccttgtgcaccatgccggggtcgtcgccctcctgccccagtgcctcgtccagggccgcgcccagcatgcgcagcgcgacagacggcgagcatgtgtgcacggagggcaggcgcacctccacccccagccccgtgccagggtcctttggggatggaatttcgagaatgtgaactgaggaagtgggtgtagtttccatagcagggactcaaaaacttgcaggagctgacatcccctgcatgctgttccgcatccaaagacaccctgctcctcgtcctcaccatgaggaccaggctgacattggtgaatcggatctggaggcggttgaccaggaaggaggccaggctggacagcgccccccagaggaggcccgtggagccctgggaaggggcagggaccgccgtcgcgctttcttgggcgccttccggcccagccagggcgctggcctccacccctgccagtcgcgcctccttgccggcccaggctcgggcctcggcgggctcctgccacagttcctctggccccctgaggcacgcctccagcctggcatccgccacctctaggatcaggggggagcgcagcgcttgccaggggatctggagctgcagccggcctatgttccccgcagtgagccggaacggcagctggaggtactccagggcatccaagcggatggggatgttctccagagtcacgcccgtctgccaggctgcatgggggtggaaaagggggattggcgtgatcaactgagtctgactgcaccaaccaatttggcatcgtgtctgcctctgagactcgaaggcagggttggaaatcagggggcccttgaactccgacccaaacagacaattcccaaagccgggcggcacgcaggctcgtacgcccaattcaaagcttgaagctccatctcacccctccacaagctgatgcgcagctgatcgcgctggaggtcgaagaagtggcccagccatgcggacaggtggtccaccacccacccctcaaacaccattgggagtgcgctcaggggcgtgtcgccacatcggtacacccgcagaatgtttctggcccggtcaaggggtcagctgccatgccttctcgcttgctccgatggctcattcgcgctccgtcggtgtcgcaggaaggtctcgtaaatcgaaagattccattccctcgcatcacatcctcacgcggcttgaatactttaatcacaagtctttgcatgctggatcacagtgcccagtcggacttttgcatgagttggtaggatgctctgtgatgcctgattgcaagagtcgaaccgagcgccagcgcgctctttgtcccgacatcacgatgccacaaatctcgccacgacaacaacaaccgaggcaagcagctctcacgtcctttcgaaccttttattagaatcaaatatatctagcttatggtgctcatcctgatacccttgtagtgaagggttccttgaagggatggcgttcgctcgccttctgcgcagcacgcaacgatacctcgagagaggtgatatattgttgaattaggtttgtactgcagactcgtgggaggctatgtgtattttcttttccagaaggcgacagtgcacctacagactcccctggtgccctgcaccatgcagttcgggagcccatccccacatttgagcagcgcctcttcgacttctccacccccgcatccctggcacggtgggcgacgttctccgacacagagctgggtggtcgatcaacagcctccctgatcgcatccacctctcacccggtgagagactgggtggggttggtcctgggagggattgttgggtggagcacagatgcaataatgatgggagggtggatggcacagagggagctgacactggccaggctacaaacgacttcgaccaaatcagcccctgttcctcgcatctacagggcactgcggtgttccaagggaccttcagccgtgaaactggggccgacgcggatgagcgactcaaacgcagtggctttgtgggcatgaacacccgggtaagcgggattgtgattgctatttccaggaatatgatggaggatgtgtggcagctcaacgcaagatgcactccgctgccctagccggcctctgacttcgagtgtctgccccctacaggacacccaggatcggctagatctggatcagtatgacaccatggtattgcgggtgctgggagatgggcggcggtacattgcatccattcgaacggagaactggatcatcggcgaggccagctcccatgacgtgtaccaggccttcttgtttgccaggtggggcgatgaattgccaggctatttggacgaatttgctgatgggatgtggggttggtccacaggttggcaggatacaacatttatatgcttggccactcatcctggattctctttggactctcctcgtgtatgttaaataatgctgtcccaagtcccaaatacttgccttgctgtacacctgccatcgcctctgcccctcacctccagggaaggggagtggacggaggtggagatcccgctggctcgcttcctgctgacctacaaggggcggctggtggagacgcatgtgcagatgaaccggtcccgcattgtcagctttggtctggccctggccgccggggactaccagcaggaggggccttactccctaggcctggactggataaaggtgatcgacagcaggcgactcgaccgatgactggctgagctgcaaggacgagatgttactattatgctagcgccccctcactcgttgctgtggaccgggcttgaaatctcgagcacggctttggccaggtagggtcaatgagtcagaggaccatgacagcgcaggaccatggcacagaatatggggagatcaggaatcgatggagcaggctcgcatgccgggcaagcagagttcgttcagaggcgctccccctgcctcctccatgtgcgctagcagctgcagcgcatgctcgtgtttcctgggcagcaccaaatggtaagccttggcgcacgcgctcatgcctcctcctctggctggatgaaggggttggcgatctcctcggtgcctgcagttggcgccaccagcgtcacactcgtcccacgacacaccaccaggcccagtgtccgtgtctcgtctgtcacgcgcagcgggtcttcagcatctgcagcataaccatgctacgagggtgaggggcaagcggcgaaaggaccaggcagacccccattgtgcagcagccggccaaccagtgcagggtgcccccgggcaccaccgacctcgcaggaactcagtggattcatcgagcaccagattcagcagctggtcgaaccctttgagtactccttccactgcaagttgtggtgcgattgggaacgtcggtgatgttgggtgatatggcaccccatgcaagcaggccaggccaaagtgtaccgatcaagacactcaccgcccagaacctcctcgcacaccttcacgtcccccagcgagctttacacggacagtcttgtccaccagcttgctgagatccagggcattgtccttcttctgcccgcccttgaacatggcggaacccgccgagtgatcaccccaaccggctgctcagctggtctacaactcaaactgcgcaccagcgtatccttgtgagtaatgcaaggggagatttcgtggatacgcctgagtgtgtcatgggcatgcgaagagtgtaagaccctctggctgaagacgctgatgggcaccagccacatcgtctccgcgcgccctctgcccgagacatgatcgatgctcgccaggcacaaccacgaagcgctttttggacgtccaccgtcatcactataaacttttcataacaccctactttgtcagcttcnnnnnnnnnngcaggcacaaccaagaagcgcttttggacgtccaccgtcattactataatcttttcataacaccctactttgtcagcttcacgcattgaatgtgccaggcctgaaggctgccggtcgggcacgccttgagccatggctgggcaaggcgggcaccgaagcctgtcagtcagcttgcaggcctccacagccccagcatgcgtgatccggctgactccagccctcctggcggccctgcgcgctgccagtgactcgggcgatgccgccaccatcagcatgggacccagcaccaatgtgggattggaaagggggggttgggggggggtgaggggacatggcccagcaggcttggaatgctcataaaccagccatacggaacatgaggcatcttagcatcatcccacggactttcgccgctgggaggagggggccctgtagacgattcacgccaccccatggcagccccccatttgtgacgtgcacccttcctgcctgcacccagagccctgcccacaactcaccccgctccccctatcgccacagccttgcggtcatgacgtccccactccactccaccaggtgctgcgcgtgggtgccacggannnnnnnnnncgcacccttcctgcctgcacccagggccctgcccacaactcaccccactccccctgtcgccacagctttgcgctcatgacgtccccactccaccccaccaggtgctgcgcgtgggtgccacggatttccgcttcaaatccctgcccgagaccctctgtgacgtcatcacagttcccagtacaggtgcagaccggggcaacaccccctcccccgcgctctgtgccgcccacgtctgccagaagctggtggtcacgcgcgacctgggggaggagcgggaccgcatccgcgcccggggcgaggaggccgagcgccgcctgcacggccgccggacggtgaagctgggcggggatggggcggaaccgccgcgcgggagtgtgacggccaggggcgcggccgcgctgcggccgggcgcgtccgacggcgcactggtggcgctggccgggggccgcggcgcca

SEQ ID NO: 39716 - DNA, 61 bp, Chlorella protothecoides
taaggtaggaatgttacagaacaagaccccaaatacggtgaggggcttgggtttcaggcac

SEQ ID NO: 39717 - DNA, 117 bp, Chlorella protothecoides
tcgtttggcacattccaccccccttacatctgcagctgacggcctgctatctgcctgtcgatgcaccccataacccttcctttcaccctcccaccctgcagtagggggatgatgtgg

SEQ ID NO: 39718 - DNA, 141 bp, Chlorella protothecoides
ccgcagggcaaggatgccatcccctggatcgagaagctcgtggtgggcgacatcgcagggctcaaggacggcactggcaccctctccgtgctcaccaacgaatctggcggcatcatcgacgacaccatcgtcaccaggatc

SEQ ID NO: 39719 - DNA, 64 bp, Chlorella protothecoides
ccgcgccagagggcccgagggaggagggggatggcgggggaggggagcggggcgccgccagcgg

SEQ ID NO: 39720 - DNA, 77 bp, Chlorella protothecoides
gtggcggcgagcagggggcccaggagtgagtaggggtgggagcttcgctgccacaccccatcccccggtcacgatcc

SEQ ID NO: 39721 - DNA, 78 bp, Chlorella protothecoides
cagggtctcatggcttgcaagctgccagacagcagccatgagatgtatccatgtgctcgtcgagagcgatttgcttac

SEQ ID NO: 39722 - DNA, 86 bp, Chlorella protothecoides
cggcactggccaccacacctccaccaagtattgaacataatgtgtctcaatctccatgtttccccaatctgtgtttggatgagtaa

SEQ ID NO: 39723 - DNA, 61 bp, Chlorella protothecoides
ctggtgaggcatgggagcctgtccggctgggacagcagttgaatgaccatggcgttggacc

SEQ ID NO: 39724 - DNA, 61 bp, Chlorella protothecoides
gaggtccgtctccttcagcagccccaggtccttgaggccgttcaaggggatgaggagcggg

SEQ ID NO: 39725 - DNA, 72 bp, Chlorella protothecoides
cgtccagcggcggcaccctcaaaaatccactttcccccctcacccactgcagggcctttgccgacagcaaga

SEQ ID NO: 39726 - DNA, 9739 bp, Chlorella protothecoides
  modified_base (97)..(240): a, c, t, g, unknown or other
  modified_base (530)..(539): a, c, t, g, unknown or other
  modified_base (733)..(742): a, c, t, g, unknown or other
  modified_base (1320)..(1329): a, c, t, g, unknown or other
  modified_base (1897)..(1906): a, c, t, g, unknown or other
  modified_base (2987)..(2996): a, c, t, g, unknown or other
  modified_base (3629)..(3638): a, c, t, g, unknown or other
  modified_base (4462)..(4471): a, c, t, g, unknown or other
  modified_base (4965)..(4974): a, c, t, g, unknown or other
  modified_base (5364)..(5373): a, c, t, g, unknown or other
  modified_base (5766)..(5775): a, c, t, g, unknown or other
  modified_base (6901)..(6910): a, c, t, g, unknown or other
  modified_base (9428)..(9437): a, c, t, g, unknown or other
cagaagggcatgcctgagtgtacaaggggggaatctgccatcgaggtgggatcagcacgaggtagacgaggcgcatgtcccatggtgccccagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatggcctcgggcgacaacgcccctcaggcttcccggggcaggcgcccataagaccaggggcgatactgatccttggtggccagagaacggaaaggtcttggccagcctcactaggagattcttaattctgttaaggaaaataggacaggccctgttggaagtgggaggggcgtgagggaggtcaagcacggcatgtttacattgttgaggaatccaccgtcaccatcatgtcaccaaggcatcgtgtaccccccacagccctgctcacatgaactcatggcagggtnnnnnnnnnnaccgggaagcctgacgggcgtcgtcgcccgaggccatcaatgtgacgcgctgccatgcagggctgaggtcctttgagaccattgtacgtacctggaggcttgagaatgcatgcattctgatgcaccagactatctgcttgtgcatcaatctccacgacttagggtggactttgcagcgaatgctggggcaccannnnnnnnnngcctggaggcttgagaatgcatgtattctgatgcaccagactatctgctggtgcatcaacctccacgacttagagtggactttgcagcgaatgctggggcaccatgggacatgcgcctcgactgcctcgtgctgatcccacctcgatggcacttttcccccttgtacactcaggcatgcccttctgcacactcaaaaatgaacggtcacggttgtaatttatcggagaacatgatctggaggtatggcttgaggttggctggcaaaataccctgggcattggccctgccgcaattccatgcgtctctgaatttgcgcgcaccccagtcaaaaagtgcgatcttcgacatcctctcgacccggcgtccgatgccgcatgcgaatacctcgattgcgttgctttatagggatctcaagttcggtggaccattccctgccagccgagcgagtgctgggaaagcccaccagcaagtgctacagcacgtcgtcaagtgccgccacgggtctcaggcacagtgaaaccacgaattcaaataccttcctaaggttagcttacatcgctggtgtcgcgtacacgcnnnnnnnnnnacacagtgataccacgaatgcaaataccttctgaaggctagcttacatcgctggtgtcgcgtacacgccctccagcgtaatggacgcgacctatcgacccagccatcacggagcccctccctgacgccatgcacgggtccgatgacccgccagcccccggtcctgggctcccggcccccaccccacccgacatgcccgaccactcctccactctgaatgagctggaggcgttcctgcgccagcccgatgccatcatggagccctccatcgtggacaggctgcgcgagtatgtcatggccaatggacacccccagcaggcggtggagtacctgagtgacagctaccagggtgggcacctgtgattggcgtgctgaaggagcgggcatgtgtgggtgcactgttgtttcatggaagggcattgggagggacgcggtgtgcgtgtggaaatggtgtgttgtgcacatgggcgcgttgcagcgccaaaggacagtgtcctccacgccttggaatggggagattttgctgccaagtatggagtatgccgtctctcacgccctggacccccccnnnnnnnnnngaccccagggacccactcccctgccggccacgctcgggcctgtcctccagcgctgcggcaagctgggacttgagcgtgttcacagtcacccgcatggccgccagctcctcctccagcgcgcagctgtgcgccctctcgttccgcagcgcggcgtgcagggagtctacgctggccaggagcatgccaatctgttccagtagcgggccctggctcgaggattccagctcggcatgcgggctggagggctgagtgcctgtgccggaaccagactcctgcatgtccccggaagccacataattaacctttacaacaccggatgggggctcgcgtggtcgaggggagaagccctccaaagccacactgagcgtgttccgcaagcccgtctcgccgttttcctacacagaatgcccgggtgacgcctcgagtggacatcgtgggaaataaagtgcactggggattgcacaatgccaaaatttagcgcacctgactgggttggaggtacgcctcgggcgtcatggcgcgcggaaggggctcttgcgagtcagggagagacggtgtcctgcatggctcacactgatggtatcggaaagcataatactattgcaagaatgttgcttgttccggagtgaacgcgacattagcctcggccgaggccacctacgccctagcgcctacttcgtagggagggtccgcgcaacattcgcctcctgaggatcggaattcattctgccctgccggcccgcatgctttcacaattcaccaattccttcatccttcactccttcttgttgctcacacaccatttcattattttgcccctgcagtctggcaaggacacaccatggcgctgcacaggccatatgtgaaattcatgcacgacaagcatattgccattgctccctcttggcggaggacacggtgcgtcgccgcacaccctctcgagcacctctattgaatgaggagggcgctgtatcagctcccgccgatatccagccgctgaccgagcacgcacagggcctgctgcgcattaagggccgacagcgtcgccagagcctcgcccttcctggacccttgtccaccnnnnnnnnnncgccattgctcccccttggcagaggtcacggtgcgtcgctgcgcaccctctcgagcacctccattggatgaggagggcgctgtatcagctcccgctgatatccagccgctggccgagcacgcacagggcctgctgcgcattgagggccgacagcgccgccacagcctcgcccttcctggacccttgtccacccagcttagccagcaggtcgccggcttcgtgccgcggcagggtcagcaggctgcacatcgtgacaggaacgaaggttttcggacgggtggtggaacctccagtggccgcacacccagccggcgaccctgcgcgcactgaatcccaccgagtccggtaccggccctcctcgccccaccctcttcccctcaccgacaggcctcccgtgtctccttaaaatgcgcatccgggttggccgtccactccccgaagatgctggtgagtgccccgatgtcggcgtggaagagccacgcgccctgaggtgccaggtgggcatggaaaggtcgcttgattgtatgttgtcaaggaagagtagctcacaagtggcaagcataaacagcatcttcgcgcatacgaccgtccaccatcgccgtagtacccacctcgcgggtgccagcttacaannnnnnnnnngtgttgttaaggaagagtagctcacaggtggcaagcataaacagcatcttcgctcatacatccgtccaccatcgccgaagtacccacctcgcgggtgccagcttacaacccggctcctcttgcgcgtcctccttccctccctccacccacatctcctcacctgcgggctgaaaagggcctcggtggccacctcattgtagaatgcctggttgatggccagcgccacggcgcgccacacgtcggcgaacacgggcgggtccaggtccgagctcagcattcgcagcaggccgtgcacgccgtcggcggcggccagcagcgtggggcagggccacgccgagtcggcgtccgggacctggccgccggggtccgacgctgcccgcccgggaccgccgccagcggcccagccgctggcgaagcgggcgcggtcctggcggtaggggttgaagcgcgcgcggaaggcgccgacagcttgcttggccaggcggtaggcccactgccggcgcagcgcggcaaaggcggcggccaccttcctgagcctgggtgccagggcgtgcgcgggcgctgcgccgccgtcctgcagcgccgccagcagcagcaccccctggggctcgctgtggagggggagagcgtggaggggcggggagcgggaggtgcttggtgtgtcgagtacggggacatcatcaagagctgggcatggcagggccaacaaatgggcgatgccacttgcgcagctctcgattgctgcatgacattggtcgtcattaaagcaataccccccacttgaccgctcagctctctccactccctcccctcctctcctcagnnnnnnnnnnaagttcgggacatcatcaagagctgggcatggtagggccaacaaatgggcgatgccacttgtgcggctctcgattgctgcatgacatcggtcgtcattgaagcaataccccccacttgaccgctcagttctctccactccctcccctcctctcctcagtatcactccaccatcgccttccccctcccatccccccaaactaccccggacctgagctggtactcgaggtagtgcgccgcgcagatggccgccgtcacccggccgcgccacaagtcccccaccaggtcgtcaaaggccgcggcggaggccaggaggcgctccaggctcgccaggcagtcccgcagcgccggcacggtgaccgactggggcatgtgtggaggggggccttgggtgagccttcgtgggtatgtgcggagacagcgcagcgcgggatgggcgattgctcggcgcaggtgcgagcaggccctgcggctgagtctgttccctgctcagtcnnnnnnnnnntcagcgcagcgctggatgggcgattgctcggcgcaggcgcgaccaggtcctgcggctgagtctgttccctgctcagtcttgagctcctgtgggagccacctgggccctctgccacaccacaagcacccatggcccgtaatcaacagcacacccacctcgatgtaggcggccctgtgcgcggcgtcgtgcagcagagacgcccggcgcagctgcgccgccaccagggtcgtcacctggtcggccagcaggggcggccggaactccgcggtggcaggggacgagcccggcgagtgcggccccgtcatccccaggaccccgcctccggaccccagcgcgccgggcgctgcccccgccacgcgttcctcctcctcctcgccctcgctgtccagnnnnnnnnnntcagcgcgccgggcgttgcccccgccgcgcattcctcctcctcctcgccctcgctgtccagaatgccctgcagcaggctgtgcacgggcagccaggcgccaggcgccgccaccagactctccatgtgggccaggacgtccgcccgctccgccgccagccacgctgcgcacgctgcggcgtctgaggcgagcagagccagcggagcctcggccggcgcggcggcggggggcaccagcccgtccacactcatggcgccggggtcatgtgccgggccgcccagcagcaccgcgtacctgtggaggtgggttttgcgagctgaggggcgcgactgaagccagtcgggcccacaagagacatgtgcatatgaagctccatctgcaataaccccacacnnnnnnnnnnagttttgcgagctgaggggcgcgacagaagccagtcgggcccgcaagagacatgtgcgtatgaagctccatctgcaataaccccacactttacactcagtgtgcttttgaacatcgcacctctcctggaagctggccagctcgtccgccaggtgcagccagagggagggctctcccagcaagaccaggcgaggcagaacgtgcccagtcagcaccgggcccagcgcacaggccaggatggcgcggcccacctccacgtccagcatggggaccaggctgtggttttgggaaagcgggaggatgatgggtaggggttggcactgaggagggggttggcctcttgccgagtccagcacccaccagggcacgagcgttcgagacaatgatgccccccctatagtgcacgcaccgggcgtcgtcaccgtcgccaccgaagccagcggcgagcacgccctggagctggtaggcggcggcgcagcaaacccgcgccgctcggagggtggtggccagcagccactcagggcggtccgcgcggtcggtgggcgcggagctcgaggcgaagtggcggcgcagcgcagcacccacgcccgcggccagctcctgcgccacccaggggccctcattctgcgccgcttcgccggccgagcgctgtagcagggtcagctgcagcgcagcgccacgcacgtctggcgagtccaggccgcgccaggcgccgccggcctcgtcgccggcagaaagaaagggcgggggccagccggcggcccccagcgccgcctggaagccggcggacagctggcgccgcagccgcgctgagaggcgcgccaggtcggcggccagcgcatcgctcagcgcgcgcagaacttcatgggaggatggggttgtgtttgtgtgggcggccagccgtgcgtcgtccgcgactccggcagcagcacgcacggcgtgggcgagcgcatccacggcgcgacccaaggtggcgggggcagggtgtgcacacgcctcctccgcctggcgcaggaaggcctgcgctttctggaagatgaattggaaagagggagggggttaggcgtggcacttgaaccagccgattgacagtatggttgggatgccgagctatggcgtgatgtgannnnnnnnnnagcgtggcacttgaaccagctgattgaaagcattgttgggatgccgagctatggcgtgatgtgaacaccttcacacaccaagcacccgggacacccgcccgctctcacttgcagtgctgcaaggtgtgcatgcgccgctgtgagtgtctccagctcggcagccagcgacgcaacgtcggcaggcaggggcactccgctgtgcgccccagccagccgcgcagagtagcgctggtaggcggacgcggcgaggctggacagcgctgcgtgtgccgcctccctctgcccctccaggctcgcgagctcggcagcagctttctccagatcgccgccggacatcgtggtgggttcgaggtccgacaccacggccatacctgcgctgcccggagcgtgcctccctggctacaaagtttgacaaattgtagacggagccttcatcgggccttgatggatcgaaacaaaggcagccaaaagattctactttgaagacgcaatcgggcagtggtgggaaggggtcctgcgtcgatctgatgggcgacacgaatcgtctcagcgataggtttagggcagtccttcccacaaacacggccagcactgctgaaagtaagcgccgcggctgctgtagatgctacatctatcgtttctgccagcacccgggcgtggtaaaagtgaatagcgtcgcccgatcatgcaggttcctccccgtcaccacccagggcgcgcaaacgtgatcacgcttcccctgaaggactaggactttggaaaccccccatcgccaccgtcttgctcgtacaagatgggccgagcatcctaaatgaccctccacaccatcaccgagtgtttgtgagtggtcgcgatgctccgtgcgtccctgcccagcacccgtgcgggacgtgttggccacacgagacgcccgggccggggccctgcccgtatgtcgcccccttccgccagtggggcggtgcccaatggggctcccgcctcccccgagtcgctgcccacgtccgtggctcccaggaagtacgcccttgccaccctgctggtgcactctggtgcgctggaggaggaccccctgggcgcctcctcaccgcccatctaccagacggccaccttccggcagcctggagccaccacggggggtgcctacgactacactcgcagcgggaaccccaccaggaatgcggtcgagatccagtgggcggcgctggaggtgggtgggctgggcgacgggtacttcccttgggaactatctcatccaaacatgcatgacacaggctggccgccagtgctgactctcacacgcatggtcgcacggcgctgtagcccgtgccatcgctgaagctccctgcatgcgccttcccgaactcctgccctgtgtatgtccagcccttcttcctcatcaccatcacaatcctgtccctccccacacccaccctgcgtccgcctgacctccaccccacacgtcccttcacccagggtgcggagcgcgccttcctcttcaccagcggcatggcggccctggccacggtcacccacctgctgagtcatggcgaccacatcgtggcgggggacgacctttacggaggcaccagccgcctgctggcgcgcgtctgccccgccgccggcctggaggtcaccaacgtcgacacctgcgacgtcgagtgcgtggcctctggggggagttctctgtgacccccatcctacccgaggaagtggctgtggtggtcggtgtcctgcacgcctgaggcggacccatcatcctccggtcccactactgtgtctcccaagcattgcccttccccatgctctcacatgaacgcatgcatggaggctgccgggcccccgtttgcacgggcccccttcctccgtgcgcacccgctcatcccgctgcggccctgccacgggatgcccacggtccccaaccctgtcgcccgccgcaccccttcccccccatcgacgccctgaacccccaccccctccccgcttcccacccgcagggcggtggtcgcggcgctgcgccccggccgcaccaaactgctcatgctggagtcgcccaccaacccgcgcctccagatctgcgacatcgcggcgctgtcccgcgccgcgcacgacgccggcgcgctggtgtgcgtggacaactccatcctgacgccgctgtaccagcggccgctggacctgggtgccgacatcagcatgacctccgcgaccaagtacccggcggggcactccgacctcatggccggcgcgctggcggtgcgcgacgccggcctggcggctcgcctcgctttcctgcagaacgcggagggcacggggctggccccgcacgacgcctggctgctgggccgcggcctgaagaccatggcgctgcgcatggagcgccaggcgagcaacgccgcgcgcctggccgcctggctggccgcccgccccgaggtccacggcctagcctaccccggcctgcgagcctcggtggggcacagcgtgcacgtcgcgcaggccacgggcgcgggcgccatcctttccnnnnnnnnnngcggcctggcctaccccggcctgcgcgcctccgcggggcacggcgtgcacgtcgcacaggccacgggcgcgggcgccatcctttccttcaccacgggcagcgtggagctgtcgcgcgcgctgtgcgaggccacgcgcctgttcaagatcacggtgtcgtttggcggcgtggcctccctcatcctcatgccctgcttcatgagccatgccagcatccctgccgaggtcagggccgcgcggggactgccagacgacctcatccggatatcaggtacacgggagggggagagggggggggggttg

SEQ ID NO: 39727 - DNA, 76 bp, Chlorella protothecoides
caccaccaccctgcacacccgccgcaggcgtcgcaagaagcgtattcagggtcccggcgggggcccccgcatgatg

SEQ ID NO: 39728 - DNA, 106 bp, Chlorella protothecoides
cggccagcgtgccactcccagcacggtctggtgttcggggccttcgctccgcatccctcttcgtcgtcgatccgcccgcctcccaccggtgcggagctcgggatgg

SEQ ID NO: 39729 - DNA, 156 bp, Chlorella protothecoides
tggcagggatccaggaagaaagatgggggggccaacaacccccaccttgtccggaatctgcctcctcaaatcccggattcagaagcgctcaggtgccaccacgtggccaacccccataaaaccccacatggacatctccgaacccaaccccatcac

SEQ ID NO: 39730 - DNA, 61 bp, Chlorella protothecoides
gcttgcatggtcatcgacggctgcgcaggggggcctggcatacgaagagctctgagagggc

SEQ ID NO: 39731 - DNA, 138 bp, Chlorella protothecoides
tgcggcattgcagcagaggcacacattgtttgggcgaggcgccagggaccgccatggacgggcaaagggaagggggtgtcgcaaatagcaacagctgcatcttggcagcttggcctgggctcgctccagagacacagg

SEQ ID NO: 39732 - DNA, 66 bp, Chlorella protothecoides
ctgccattcgccgacatccaatccaccgaccaccccaccccggcactccccaggccgtccatcatc

SEQ ID NO: 39733 - DNA, 9725 bp, Chlorella protothecoides
  modified_base (2101)..(2110): a, c, t, g, unknown or other
  modified_base (2532)..(2541): a, c, t, g, unknown or other
  modified_base (3061)..(3070): a, c, t, g, unknown or other
  modified_base (3183)..(3192): a, c, t, g, unknown or other
  modified_base (3351)..(3360): a, c, t, g, unknown or other
  modified_base (3833)..(3842): a, c, t, g, unknown or other
  modified_base (6293)..(6302): a, c, t, g, unknown or other
  modified_base (6401)..(6410): a, c, t, g, unknown or other
  modified_base (6502)..(6511): a, c, t, g, unknown or other
  modified_base (6868)..(6916): a, c, t, g, unknown or other
  modified_base (7172)..(7181): a, c, t, g, unknown or other
  modified_base (7948)..(7957): a, c, t, g, unknown or other
  modified_base (8335)..(8344): a, c, t, g, unknown or other
  modified_base (8663)..(8672): a, c, t, g, unknown or other
  modified_base (8854)..(8863): a, c, t, g, unknown or other
  modified_base (9212)..(9221): a, c, t, g, unknown or other
gccttgggcgccgccgacgcgcccctgccgcggccattggcggcgcccgcggccacgccgttgcgcgcgccctcgccgcgcgagccgccgcccctggaggctccaggcgcgggcttgaaggccagctgctccggcgtggggttggcgatggggtcgtccggcttgggcagggaggccgggatggcaaagggcgggtgcgggaagcggcacttctccccgaactcgcactgaccccgcacccactcccggcagggcggcgcctgcccgcaccggcacgaatcccacagcttgtgcacccggccgcaggagcagtgccagtggcccagccaggtgactatcgccagctccttcgtgccggagccctccgcggccgcggcggccgccgccgcctgggccgccgccttctgcttggcggccgcggccggcgggttggcgatggggtccgcgggcttggggaggccctccgggatcttgaagggcgggtgggggaagcgacatttgggcagcaggcagttaccgcgcacatactccctgtggtgaggtgaggaggagggcagtgctgcatgagagtgggcccggttgtatagcaggagggagggcctgggatccagccttgcacgtgctcacaacaaggtcaggcacatgggcaggcggaggtttgcatgccccaaaacacagatgcccaatgcctgggagagcttcctgtcccaaccacgctgtccagcatctgcaagccatgccattgctcgcctgcagggcgatgcttgcccacaggagcaggtgtcccagagcttgttctggatgccgcaggagcatcgccactccccttgccaggatacgatggctgcgctgccctttgcggccgctgcgcgggcaggttccggcatgcacggcctgtcgtcgccttcaggggtgtgtcgggactgaggctgggctccagggagtggccggagagctcagctgggcactcgatgaaacaaagccctttcataatagagatatgtggtggtatacatggggtagaaatgacaagaagacctctgtatagccagagtgaccccccgacccacctggcgagtatgatccgccttcctacaggcgatgaagcagcgcgtgccctagcctcaaagcgctggacaggagtcaattctgggtcagaatacgcaagtccagtgcgcttgggccacaccgctagctgtcagaaattgtggtctgctgccgatgggagtctcgcagcggggtcctttcctcacgagacatcgtgtccgtgcgagaaggtgcactccctccctgctcagcggcatcgtttacattgaattgcgtcgctggggacatacttggatggtttcacaacctcaaatatcaatgtggacgcatcgtgggaatcagggcccgaccaccgggcagcacaggggcctgggtgtgcgcccctttgaagcgccccatgcagggcctccaagacagtcacagggtgttacagggatgcatgtgtgctgaaagattatgtgtgggtcacagagtacagtcagaaggtcggtgcccggggtgaagggtctccgacgactcattcggccgggatgcaagggccatcagctcgcgtccacgtcgacatccgcggcgtggggagcgggccgcatgcccatctggggccgtgcatgcgccagtgcctcgtccctccagctgtgctccccctgcagccctccatccatcatccagttgccgtcgccgtcgctccgggaagaccctcgggtggcctgggagggtggggtatactctggtggaacccagcttccggcaggtgtcatgtcggtgtcccaagggacccaggctcgtcagtaccattgaagcagcaagccttccccttcccttccccccccctccccctgcctgcagatcgtccatgccaagggtgtccggcgcacgctcgtgaaaggccacgctgggggcggcgggaatgtgccggaggtgctccatgatctgcaggggcgggcaggggtcgccatggtcaggatcgggcctgcctgcatggtgtctgccctccatctgagtcacccccctgcacatgcacctggaggaccctccatcccgtggtacccccctnnnnnnnnnncgccctccatctgagtcacccctcgtcacatgcacccggaggaccctccatcccgtggtacccccctgacccgtggtaccctcctgacccgtggtacccccctgatcccatggtaccctcctgacccgaccacatgctgattcacacccccgaaccacacctgttcctgcagcgcctgcaggtgctcgggcgtgtttttgttggggaacccctcgctcttggcagggacagtcagttggtaggctggcgcgtagtacctgagagcgaggtcgaggcgggggcgcattggtgtgggggcggcccgcggtcctcagcgcgggcacacgctggccgtccgcccaggttgctgaacagcggagcatgtccattcattctcgaccgtttgcttgcccccctccccctccccacccaacccactgtcnnnnnnnnnnagcacacgccggccatccgcccaggttgctgaacagcgcagcaagtccattcattctcgaccgtttgcttgctcccctccccctccccacccaacccactgtctctcctcccttcccctcctccaccccaccccttcccactcactcgtagtactcggtggggggcagggcctccggcaggtccaggcccagggccacacccgtctccttggcccagcagcgcgagacattgacgatcttgtagccgccgccgccgaggaggagcagggggacccccagggaacgcacgtactccacgcaggccgcgtggcctgcggaagaaaggttgaacacgcccagccgatcgccggccagggagtccgagcctgcgtgggtgtcgcggcggggcggtgtaggctgtggtgggcttgggaggtcggcaggtgagtgtgtgacgcggcctcgcagcaggggcggccagccgtccacgtccgcatcgcaagctctctccttctgcacccacacatggccttgcgtcgannnnnnnnnntgggaggatgggtggcagggggcgcggggagcatggagtcgcaaggaagcctgatggtggtgttttgccacagggccaggttcgtgcatgcctttcaccagtgcagggctacnnnnnnnnnncccgtccatgtctgcatcgcaagctctcttcttctgcacccacacatggccttgcgtcgagtcgtccgcctgccgggctcacccaccctcccggccctggaggccctgcagccctgcacccagcccaaaacagcgtaccacactgcagtaccacggccnnnnnnnnnncccgcctgccgggctcacccacccctcccggccctggaggcaccgcagccccgcacccagcccagaacagcgtaccacactgcagtaccacggcctccgggcggtacacctccatgaccttggccaggatgggccggaacagggcctggtaggtctcgtcggtgatgccgtcccgcagcggcacgttcaacgcgtagtacttgccctggcctgggggatgatgggcggcagggggcgcggggagcatggggtcgcaaggaagcctgatggtggtgtgttcgccacagggccaggcccgtgcatgcctttcaccagtgcagggctacagaatctccaggcaacccgacgcgcattcttctccgcggccaatgtccaggctcccggcacgcccctcgatccagtgacggcacactctcaccgacgcgccccctccccgcttccttccccccgggattcgctttccggcctcatcnnnnnnnnnnctctcctccacggccaacgtccaggctccccgcacgcccctcgatccagtcacggcacactgtcaccgacgcgcccccaccccgcttcctccccccgggattcgctttccggcctcatccccacgcccctcctgcccgccccaccacctcaccatgccccacgttcaccacgtcgccggtgcctgggaagaagccgtccccaaacttgtggaaggacagggtcatcacgcggtccgtggtcaggaaggcctcctccacgccgtcgccgtggtgcacatcgatgtccacgtacaacaccctggacataggattcaacataggggtgggcggtgtggcatgcatgctggggggcacgccgcctatgagcaggagcgcatgccgccgcggcgtggggtcgggcggagcccagcatcgactccaatttcccctgcccctccactccacccgcccacacctcgagtggtacttgagcagctccaggatggcgaggacgatgtcgttgacgtagcagaagccggaggcctcgaacttcttggcgtggtgcaggccgccggcccagttgatggcgatgtcggaggcgccggcgttgagctgtgcggcggcggcgatggacccgccggcggagatgcggcagtactcccacagcccggagaagacggggcagtcctcgtacatgttgtactcgcggagtgcggcctggtgcgcgcccacgttgtcgggggtgacggtgcgcaggaaggacacgtagtcctcggtgtggaactggtgcatgtcctccgcctctgcgcgacggggccggaacatctggggggacaggaagaggggaacaagaagttatgcagctgagcgcaggacgggggtgagcatggggcatggtgccgtgcgaatatgagcatgcatgtgcccacggctcgatggtgagcaacacgcaacacccctgcaacatcttcctgcacatgccaggaaggcgccaaaggtatcctgccgatgcccgaagccaggtccaggctcccttgaggcctgagggcaggcctcggtctcgccggcacccccctccgggccccacctccatctgggtgtgaaggccatactggagcacgaggctgtgcgccatggccacgcggtggggcttcatcgggtgcccctggccgtagtaaaactgtccgatgtcggggtcgtagaaatacgacacctggccgggcgaaaccgagagggagggctcgcgatcggggcatcggggggtattgctgggccgtgaggggccctcgaaccccaacagtgcggtacggtgcgaaagcacatggatttcgcacggcaaggcaaatttgcggcttcctacctttcgcttgccgctcatgatgccagtgtcgatgagcgcgaggggtcagagaggtctcgtgtcgttcgggcttcccggtggggaaggcgtcgagggggccgagtgtgccgtgcgaggctcccgctcccttctacatggcatgcatgcgcccagagtgagatcgcgggttggcatcggagtgtgtgggggctgatggccctgtcatgaccctgccaagggaggacctgccgcgccctttcttttccccatcacacccccccaggtgacgaaattcgtgctgatcaagatggatagccgaggccggggaacgtccctggccagagcaatgcacacgatgctatcaggtgttcgaggatcccatattgggccgagatggggggcacatcggccccagccggccaagcctctgcgtcgcaggcacacagtatcagtggtgcgggttgcatgtggccgggccgccagagggtcgggatctgggccatcacaggcctccaagtcattcatggcttccctggcagccctgtgcctggtacgatggtgcatttggggatgtgtctgcagccactgtgcccctagagacaccaaggaacacactattgaattcatgccacctggccatgccacctgcagagcctgccctctgccgctgaggccgccaaggccccagtggagctcacccagcagtcacgggacaccgccagcgagctggagggcatcatccgggcacgttctggctcggaattccgcctcacccgggaggtgggagggtggtgggggttgttcagaggtgtgggcatgggatccaaccttgcgcgctcaccttcctcaacctgatcagtgcgcttcacgccctctccctccaggcaccgagctccccccagcgccagaagaggaggccgtccacggccatggaggcgcaggtcctcagatcggaactggagcagcgctcagaggagatccagacgctgaaggagcagctgcgggccgaagcggtgggttgggggcggggcagccatgagtagtgtggaagtgcccgcgatgggaccctgccctctcctcccccgcaatgcactggtcttgttcctgtgatgagtctcaagactgttacctcnnnnnnnnnnctgggggttgttcagaggtttgggcatgggattcaaccttgcgcgctcatcttcctcaacctgatcaatgcgcttcacgccctctccctccaggcaccnnnnnnnnnngatgtggagccctcagcgcacgtcggcagaccatgcgtgcgcccatcaatctgatggagacctgcctgacgtccttgagtcgcaggcatgcnnnnnnnnnntctctgatctgacctccaacgaccatgtgatatggcagatgcgccccgctcccagcgtgtctgcgccaaggtcggagcccatgattgtgaggcaggaggagccccagaaggacatgcttgggtctgctcctgcagcctccctggccgtggcagccaccagcggcttctcagtgctggtggggaaggcgggataggaggtgcaggaatgtgaagccatcagcgcacgtcggcagaccatgtgtgcgcccctcaatctgatggagatctgcctgacgtccttgagtcgcaggcatgcctcctgatccaggaccccacccgctcaccgcagaacgtcctgggagtctttgcggcaggggnnnnnnnnnnnnnnnnnnnnnnnnnnnnnnnnnnnnnnnnnnnnnnnnntctgcctcccaggccgaagcatcctaccgtgccaagctgaaggtgggctggcgctggcagagcatggtgttggagtttgtgctggcagtctcgtgtctccgtctggcggcgtgtcctgggttcagggggctgtgtggctcggcactgcccctgtgaaggatgcatggctccctgtcgtcctcgctcctcagcccgctgtgagtgcctgacacccccaaacaaatacaggccacgcaaggcacggtggatggcctgnnnnnnnnnnccggagtttgtgctggcaggctcgtgtctccatctggcggcgtgtcctgggttcaggcggctgtgtggctcggcactgcccctgtgaaggatgcctggctccctgtcgtcctcgctcctcagcccactgtgagcgccctcccccccaaacaaacgcaggccacgcaaggcacggtggatggcctgcggaccaaggtgcacgagacgcagcagtcgctgtcgcgggagcaagacctggcccagcggctcaagcgggaaagcgcgcaggcggcctcggccgctcagcggcaggtgagggcggtgcctggcggctgggtgccggtggggttggggcgctctgtgtgggaaaggaggggagaccgcgaccctgccggtgcgatgcggggcgtgaagtgtccagcagcccttgggaggcaccaattccctttgctgcacgtctgcccaacatcaaaggcaagctgtgcacagcaaagtcaccacctccgtctgtctatcaccaccacgtccagatcgagattgggaaggaatcctccgagcggctggagaaggagaaggccgccctggaaagagccatccaggccgagcagaggcgcaacgaggccgccacccggtgggttgctgggcggtgctgtcatgttcacgcctgccggccatgccccatcagggacgcagcgcgcctggctgtggccccccttcgcgagaccatcctagccgcaggcgctcacgctgccacctaaccctgcggcgaccgtccccaagcctaccctnnnnnnnnnngggacgcagcgcgcctggctgtgccccccctcgcgagaccatcctagccgctggcgctcacgctaccaccatgccctgcggcgaccgtccccaagcctacccttccctccacccctcgtctcggtagggaggcggctgctgtgtctgaggccctggaagctgagaaggccgccaggttcactgcggatgccgaggccaaggagctccagcggatcctgtctgaggtgggtgggtgcatctgagcattggcatgctttttccgtgtgtgcagaagtgccactcgcgcggctcctgctgtccttgcttcccagggggggtagtccactcctcctctgacaccgctgccgacgaggtaatggctcctcgggccgccctccnnnnnnnnnncgggggttgtccacccctcctctgacaccgctgccaacgaggtaatggctcctcgggccgccctccgcatacctggcccctctccacaacatcatgacagaggaacgccgcactggagcgggagaagagcctggtggcacggctcggcaaagagtcggagacgctcaaggccgagctggaggcgtcccgcaaggtacagctggcgtgatgcgaacgaggctgtgctttctatgtgtgggaggtcccttgctgcctggcgtcatgggccatcagagagatcaggctgccggggcttgggagtcgtgggtgccagtcaccnnnnnnnnnngcggaggctgtgttttctatgtttgggaggttccttgctgcctggcgtcatgggccatcagacagaccaggctccaggggcttgggagtcgtgggtgccagtcaccatcacaagtcccccaaaatgactctcctccacccatcgcccaatccaggcggcagaccagctgcaggagagggcannnnnnnnnnccacaagtcccccaaaatgacactcctcatcccatcgcccaattcaggcggcagaccagctgcaggagagggcatcggggctggacgacgcgctgagccagcgggacgctgacctgtcggacctggaggcggcgcgcgccgcgctggagtcccagcttcgggatgcccatgaggccgccgagcggcaggaggaggcctatgaaaaggtgggggaccgaggatgtggaactggtctacacagggtgtgaagatgccggtgcgcccctttcgacggtaactgttgcagtttggccgcagctcgtcgcctccccccgacgtcccgcgctccccgaaccctcaccccactccnnnnnnnnnngaggatgtggaactggtctacatagggtgtgaagatgccggtgcgcccctgtcgacggtgactgttgcagtttagccgcagctcgtcgcctccccccgacgccccgcgctccccgaaccctcaccccactccctcaatccctgcctcccgtgcatccagtcaccccccttcattccctcctttccacccccacaccctgcccagctggacgaggatcggctgagcctgtctgaagcgatgaccctgctgcgccagcagacggaggacatggcgcggcgcgcggcggaggaggctcgcgaggccggcaggcggctggcggagacggaggaagacctgcgcgccgcccagtcccagctgggcgatgagcgctcccgcatacaggcgctggcggcggagctggagagcacggcgcgcgcgctggcggcgtccgaggacgaggcggccgcgctgcgcgcggggcttgaggaggcgcgggcgcaggccgcggcgcgcgccgaggaggcc

SEQ ID NO: 39734 - DNA, 61 bp, Chlorella protothecoides
catgtccatggcagcaggcaggggaggcgggggcgcaggaggagctggcgcccaaggagct

SEQ ID NO: 39735 - DNA, 61 bp, Chlorella protothecoides
cttcctggcgggcggctacgacgccgacccgggcgaggaccgcgcggccagcgtggccgcc

SEQ ID NO: 39736 - DNA, 69 bp, Chlorella protothecoides
ggggggcagtgatgcatgcaatggtgtattgcacgggcatccagagggggctgaacagcccagtgcagg

SEQ ID NO: 39737 - DNA, 61 bp, Chlorella protothecoides
ccaatcaacaccttgctctattgacgcacagacccccgtgccatgcttgctcctcatccga

SEQ ID NO: 39738 - DNA, 101 bp, Chlorella protothecoides
gggccagagaaggtgcgccgctgtggtgggaagggggtgcagtggggatggggccctgagcgacctctccgggcagtctgggtgtgagcgtgggaacacca

SEQ ID NO: 39739 - DNA, 71 bp, Chlorella protothecoides
atactccgctggcagtcacggagcagggcgtggacccttcagatcccttgggaaaagacctccctctctcc

SEQ ID NO: 39740 - DNA, 61 bp, Chlorella protothecoides
ggcttcctcatccaccacatcggacaggagaccctcctcgaatgtcgtggagacccggcgc

SEQ ID NO: 39741 - DNA, 83 bp, Chlorella protothecoides
cagcctgggagatggagcgatgagggtgtgggagttcatgtctgcataccaggcctcaagatgcgcaggcatgcgccgcctcg

SEQ ID NO: 39742 - DNA, 61 bp, Chlorella protothecoides
ccacatgcaagccgtgcgtgagtatggctttccgggcagtaccacttgccccacagtttgg

SEQ ID NO: 39743 - DNA, 67 bp, Chlorella protothecoides
ggatggagagcgaggaccagaatctttgcaatgttgacattgccgcaggtttcggttctccatgcag

SEQ ID NO: 39744 - DNA, 61 bp, Chlorella protothecoides
gacggcggggagcaggggcggcgggggcagtgggcgcccgctgcccagccggcgcagcacc

SEQ ID NO: 39745 - DNA, 66 bp, Chlorella protothecoides
cttctcggtgggaagctgcagccccgtcagtctcttcacgccgcccggatggtacttctcatgccg

SEQ ID NO: 39746 - DNA, 106 bp, Chlorella protothecoides
tcatgcacatggcctgttgcagcaccaccaggaggggtgtctggagcctcagccagcccattgggccaggccacggctcccactggcatgagtcgaacaagctgcc

SEQ ID NO: 39747 - DNA, 74 bp, Chlorella protothecoides
ggagcgtccctgaagcccgagttcgaggacatcatcaaggcggctgccaagtgagctgcctttacaatacccac

SEQ ID NO: 39748 - DNA, 76 bp, Chlorella protothecoides
gcgctcggcgctggaggacgtcgggggcggccgtgccgcttccacacgcctccttccgcccggcgcccaggcgttc

SEQ ID NO: 39749 - DNA, 97 bp, Chlorella protothecoides
ccaccaggacgcagagcgtgtcgccggggatgaacttgccgccgggcccgggccccggctcgacgccgcggggcagcagcgtcacgcgcgccagtgg

SEQ ID NO: 39750 - DNA, 61 bp, Chlorella protothecoides
gacatggccggcatcggtcagcgtctccccactcagtcccgagccgcaacccagatccagg

SEQ ID NO: 39751 - DNA, 38525 bp, Chlorella protothecoides
  modified_base (505)..(634): a, c, t, g, unknown or other
  modified_base (1295)..(1304): a, c, t, g, unknown or other
  modified_base (2455)..(2464): a, c, t, g, unknown or other
  modified_base (2705)..(2714): a, c, t, g, unknown or other
  modified_base (3316)..(3325): a, c, t, g, unknown or other
  modified_base (3530)..(3539): a, c, t, g, unknown or other
  modified_base (4278)..(4287): a, c, t, g, unknown or other
  modified_base (4808)..(4817): a, c, t, g, unknown or other
  modified_base (4970)..(4979): a, c, t, g, unknown or other
  modified_base (5630)..(5692): a, c, t, g, unknown or other
  modified_base (5936)..(5945): a, c, t, g, unknown or other
  modified_base (6074)..(6083): a, c, t, g, unknown or other
  modified_base (6212)..(6325): a, c, t, g, unknown or other
  modified_base (6495)..(6543): a, c, t, g, unknown or other
  modified_base (6650)..(6659): a, c, t, g, unknown or other
  modified_base (6728)..(6737): a, c, t, g, unknown or other
  modified_base (6943)..(6952): a, c, t, g, unknown or other
  modified_base (7185)..(7194): a, c, t, g, unknown or other
  modified_base (7697)..(7706): a, c, t, g, unknown or other
  modified_base (8140)..(8149): a, c, t, g, unknown or other
  modified_base (8212)..(8221): a, c, t, g, unknown or other
  modified_base (9163)..(9172): a, c, t, g, unknown or other
  modified_base (11982)..(11991): a, c, t, g, unknown or other
  modified_base (12083)..(12271): a, c, t, g, unknown or other
  modified_base (12556)..(12565): a, c, t, g, unknown or other
  modified_base (12709)..(12718): a, c, t, g, unknown or other
  modified_base (13311)..(13320): a, c, t, g, unknown or other
  modified_base (13797)..(13806): a, c, t, g, unknown or other
  modified_base (15451)..(15460): a, c, t, g, unknown or other
  modified_base (16008)..(16017): a, c, t, g, unknown or other
  modified_base (16714)..(16723): a, c, t, g, unknown or other
  modified_base (17226)..(17360): a, c, t, g, unknown or other
  modified_base (17454)..(17463): a, c, t, g, unknown or other
  modified_base (17557)..(17566): a, c, t, g, unknown or other
  modified_base (17743)..(17798): a, c, t, g, unknown or other
  modified_base (18237)..(18246): a, c, t, g, unknown or other
  modified_base (20100)..(20109): a, c, t, g, unknown or other
  modified_base (20966)..(20975): a, c, t, g, unknown or other
  modified_base (21184)..(21193): a, c, t, g, unknown or other
  modified_base (21839)..(21848): a, c, t, g, unknown or other
  modified_base (21959)..(21968): a, c, t, g, unknown or other
  modified_base (22068)..(22077): a, c, t, g, unknown or other
  modified_base (22800)..(22809): a, c, t, g, unknown or other
  modified_base (23060)..(23069): a, c, t, g, unknown or other
  modified_base (24053)..(24062): a, c, t, g, unknown or other
  modified_base (24505)..(24514): a, c, t, g, unknown or other
  modified_base (24584)..(24596): a, c, t, g, unknown or other
  modified_base (24713)..(24722): a, c, t, g, unknown or other
  modified_base (25548)..(25557): a, c, t, g, unknown or other
  modified_base (27433)..(27442): a, c, t, g, unknown or other
  modified_base (28168)..(28177): a, c, t, g, unknown or other
  modified_base (28633)..(28642): a, c, t, g, unknown or other
  modified_base (28703)..(28712): a, c, t, g, unknown or other
  modified_base (29018)..(29074): a, c, t, g, unknown or other
  modified_base (29510)..(29519): a, c, t, g, unknown or other
  modified_base (31135)..(31144): a, c, t, g, unknown or other
  modified_base (33978)..(33987): a, c, t, g, unknown or other
  modified_base (34387)..(34396): a, c, t, g, unknown or other
  modified_base (34529)..(34538): a, c, t, g, unknown or other
  modified_base (34653)..(34662): a, c, t, g, unknown or other
  modified_base (34777)..(34786): a, c, t, g, unknown or other
  modified_base (34871)..(34880): a, c, t, g, unknown or other
  modified_base (35580)..(35589): a, c, t, g, unknown or other
  modified_base (35804)..(35813): a, c, t, g, unknown or other
  modified_base (36517)..(36526): a, c, t, g, unknown or other
  modified_base (36852)..(36861): a, c, t, g, unknown or other
  modified_base (37933)..(37942): a, c, t, g, unknown or other
tctgatggtctggggcctcaggcgcggcggcctccgcgctggaggggcgctgcgaggccagggagttggcacgggcgggcgatgccgcctcgggcgccttgcccttggagcggtagctgtccgaccaggggtcggacgcgtcgccggcgccggccccgccggccgcgccggcgtcgccctccagcagcttggcggcgtccttctcgagctggcggcggtacagctgggcggcgcgggaggtgtacttggcctcgatcttgtcggaccccacctcgtcccagccgtgctgcttgaagaaggtgcgggcgcggccgttgccccccgccgccatcaccgccagctgctcctccgtccaggagtccagggtggtggaccgcacgaagctgaggtgcacacccaggctgcggtgcacgcccgcgcagttcaggcagatgagcacgccgtacggcaccgaggcccaggccgggttcttggccgggcagtcaaagcacacctgcgggcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaggaaaccccgtcgacacgacagtccttcaccgtgtgagcccggaagtgcctaacgacgggcgcctcaccttgttttctggcttcatgcgcatccgtctgaacagcgggtcgcgctcaagcacctgctgcgccatggtcggagatgctccgggcgggacgggcaggagctccgaaggccggatccctctgaaactgacgagcaggggctggggtggagacacctcaaaacagcagcaccatgtgctcttctcaagcaggaaagctgtgcaatcgctgctgcctgttgctcctcctggaagagcacttggtggaggaacaaaggtgacctgaactttcccgcgcccaagaccaatacgatttcccgtgaccgacagcgtggagcctccagacttgaatgacgcgagggcgagaggcatgtggaaggacaggacaaatggcgatactcgtatcagtggcgcagcgtatatattcctagggtacaagaggcagctgctggagaagcttgaggaggcatggccgaagccaagtgcctggccttgctggcggacaccaacaagccctacaatgtccaggtatcgcatcgcgagcgcaatcggtgaatgaatgctgagtaacctcattacataacccatcggtgcgcacatgtcgcaagcagnnnnnnnnnngtcggtcaataaatgctgagtaacctcattacaaaacccatcggtgcgcacatgtcgcaagcagggggttgccgacatgctggcgtcgcaaggattcaagaaggcccaggttgaaaaggcactcatggcgctcgccgaggccgggaaaattagctgcaaggagtttgggaagcagaagctcttcattccttctcaagagggtctccctgagctcgatgcggcggtacgatagctgtggcggaggaggcatgggcctgggcgggtcttgggagccaccaagagctgtgcaaggaagttgaggtgccgtccctcggtattaggcgctccattcctccacgtcgcactgcaggagaaggacgccaagctctcgaggatcagccaactgcagcagagccgcaaggagtttgaggccgaaatctctgctcagcgaaaaggtgaggggggacgttgatcactgtatggtggatgtcctcatgcgaatgcattaagggggggataatgtgtgggtgtctgacaggctgctgattgatgaagcttgctcacacgctctgtcagcagtcacttccctccaccctgtgcaccttcccctgtcgacagagctggctcagctgaactccgtcctgacggtggaggagctgcaggctcagatcgccacccgactgcaacaggtgcaggaagccgagacgaaactggcggcgcatcggggtggtggcattgtggccgtgtctgctgaagacgtggcagcagcggagcaggtgagatcatgcctgtggggcacaaggtgcctgccggggttgagctgttcggtgcacaggatgcagactctaaaggggccagtgcatgcctgccctgatcgagcatgtattctgagtttgcaaaggtcatggtgctgtacacactgcgccacattacgccgattaaatgcacctctctctcatcctgcgctccccaaacagaggtttgccacgggactgaccgcatgggagaggtatcgccgcatgttccgcgacatctgggacacagtatcagaaaatctggaggcgaatcaggtatgggtgggggtgtcgattgtattgcacttgtttaatccagacctgctgatcggccatggcaaggggcctcttcgagtcacatggtcacgcccctctccnnnnnnnnnnctgcttaatccaggtctgctgatcggccatggcaaggggcatcttcgagtcacatggtcacgcccctctcctccctcatccaggctgacgtctttgaggacatgggagtggagacagatgaagccatcggcgagaccctggcagcataccagcacctgcttccaggcaggaaaaaggccaaggcctgctgagattctgtggtggtagattctgagccggctacacccttgtgcatgcacannnnnnnnnnaccaaggcctgctgagatagatcctgagccggctacacccttgtgcatgcacagatctgagatacgaagagaccaaagggtcaagaaactctgccatgaagatcgttacaggatcaaaaatcatatgcgggtcaaggaccttgcatggatgcacgaagctgatgctgaggaatcgtttgaaaattttgatgaggtgatggggttcaacagagctgcagaggggtgtgaggtgcgcgggtgctcaagcgacgccgcaagagagaggcaatgttgaggaggagagccctgggtttggctatgccatagcgcctcatttggtgtcagtgtgggagcggggcaacaaccccgagatcgctgctgtcagatgaatgaggtgaaaggggctgctgtcaccactccagcaataccacaacggcagtcatgttgtcacgagtctggagcgcggttgccctatggatgagggcggccgcagcctggcctgccagagcgtctgcagaggggtagttgtgtatgaggttaggatcatgatcttacagcggggcctggaatgatcctggtgctctgcaccaggctgtccagtgatcaggtggcgtggccacgannnnnnnnnngcgaagttcagatgtaaggaatagcaatggcttcttcgtgagcctctatgggctgggctgggattcgagcacggctatcttccacccactctgcctgattctggatgcccgtcaatcccgggcccccatcgcagcaccagagaaaagcccctccaagacctgccacgcagtcttcccccacctggccaagatgaagaactggtcnnnnnnnnnnggggataattgtgtatgaggttgggatcatgatgttgcagcagggcctggaatgaccctggtgctctgcactagactgtccagtgatcaggtggcgtggccacgacagattcgtttgtgtcttaccaccaacaggatggcattcacgctcaccagagggcggactgcctgccacagtcctcttcacgatgtcaatggcctcatcctcgctcatcacctccagcacaccatcgctgcgagggggatagggttgagaggtgggtcgggagaggggcacgaacgaagttcaaatgtaaggaacagcgatggcttcctcgtaagcctctatgggctgggctgggatttgagcacggctatcttccacccacactgcctggttctggatgcccgtcaatcccagggccccatcgcagcaccagaaaaaagcccctccaagacctgccgcgcagtcttccccccacctggccaagatgaagaactggtctcggtggggccggagggccaccctcaccacatccggcgtcgcctccaccagacgctggggcgacttgaagttgccgtcccctaaggccctagacatgttgagtcgcgagatgcgggagccccgcggattgctcagcacgcgatcctccttgtacatgatacggccacctgagtcgtggcaggggaacttgtgtggtcaggctggttccagattttgcacacgggcgacagacacaatgacatacaatcagcctccnnnnnnnnnntgtatggtttccagactttgcacacgggtgacagacacaatgacatacaatcagcctccccgcaggctcccacctggacactcccctccctgtcccagcacagcagcgccagcaccatatcaacaatcaaaccacccaacacacaccctcaccctggccctcgatgcgagcgcgttctgtgggcatggaggcgggcttgtggtcctccgtcagcctgaccagggtccccccccggcacagcagcgcgcacgagtccccggtgtgggcgatgtacatgaggcgaccgatgcgcagggcgcacacagcagtggtgccgtactgctgtcccgcggcgctggccacatccaccatctcaaggtccatctcgtggaacgcgcgcgcaaaggcgcgctggatggccgtgtcgtccacctcgcgcatgccctggggggaaggggggggaaggggggggaggagtgaggtaggatgatgggagctatgacatctatgctgcacattttcacccatttacactcagtacnnnnnnnnnncagctggaagtcgggaaggatggtatgccggtcctccatgtggaggcgccggcctgcatggggcagcaatgggaggtgcctggccggacgttcaaaaacaccgcaggtggaatcagatgctgtgggacgttcggtacgcccacagcagggcannnnnnnnnntgggggggaggtgggcaggggggggaaggagtgaggtaggatgaggattattaaacatggctgggggtggcaggggctggtccgtggccaatgatgggagctatgacatttatgatgcacattttcacccatttacactcagtacccgcctatgcagaccattaccaacctccccagtacctggcatgtctggatctcgggctgctcggcgagcagctcatgcagcctgtcagccgcgtgctctgagcctcgagcactgcagtggccgtcgtacacggccgcaaactgatgagggatgcccgatgtggtgggggaaagttggaagtcgggaaggatagtatgtcggtcctccatgtggaggcggcggcctgcatggggcagcaagacgggcgtcaggaggcgcacggtgcctggccggacgtcaaaaggcacctctggtggactcagatactttgggacgttcggtacgcccacagcagggcatatgtatttcactcatgccacacatcgtacctttgcagtcggagacaccaatgaacgcctgggcacaagcggcaatgcacgtctccgaggccgcgcctgcagtaagggtcgagggtcgcgaaggtgtgaacaggagtggaatgtatctacaaattgcatgtaagggcnnnnnnnnnnnnnnnnnnnnnnnnnnnnnnnnnnnnnnnnnnnnnnnnnnnnnnnnnnnnnnnggcataatcccaaaacgttgctccctactgtgcacgccatcaggtgcggtgcaacgccggtttacgtcgtggttcgcagagttcagagttaggggaatcagcggaggccagatcttggacgacggtggggcgcgccccgtcaccgtaaagtcctgggagtatgcgtttcttccggtatccacgagttggcggtctgtgattgcctggaatgatatattgcattccaaggttgttgatatctttnnnnnnnnnntggtcatgaattggatgcgtgtgtgcagcacagatagccggcccattttcatgaagatattttggaagataccggcatgagaccttcgcaacagccgtacaatcctgggcaacgcctcccatactcacnnnnnnnnnngggtcatgaattggatgcgtgtgcagcacagatatccggcccatttcatgaagatattttggaagataccgggcatgagaccttcgcgacagccgtacacaatcctgggcaacgcctcccatactcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgcagagttcgggggggatcagcggaggccagatcttggacgatggtggggcgcgccccgtcaccgtaaagacctgggagtatgcgtttcttccgatatcaacgagttggcggtctgttatagcctggaatgatagatattgcattccaaggttgttgatatctttnnnnnnnnnnnnnnnnnnnnnnnnnnnnnnnnnnnnnnnnnnnnnnnnntggggttagcgacctctttactactgttccaatcttctgaaaaccatcctctcagtctgcatgctcactcactcctttcaggcatctaccagcccgctgtcgtatgnnnnnnnnnnaatttctatgtgcaaatcatgtatgtactagtccgctttcctcggatcacaacaccaagctactagaannnnnnnnnngcttcacctaccaaggactcctattcgatagggaggcgaaaaaccaattggttgataagggcgaccactgcttggcgttcgtgtagtaccaggctcagccgtcgacttacagagtttcctggcacttatcccatcatgctgcagaaaggtcaaagtaggtgctactaggacaaacttctagtagcttggtgttgtgatccgaggannnnnnnnnntagtggtcgccctaatcaaccaattggtttttcacctccctatcgaataggaatccttgttaggtgaaggagtcgattgccgtacaagtcggcaagtcgaatccacccagtagctggagctggtgcgaaggtgcagattccatgtggacaaagctccactaccgataattgtattgcaccttgatgtgccgcattccatttcaaagatatcaacaaccttggaatgcaatatnnnnnnnnnntgccggaccggtacatacatgatttgcacatagaaatagtagatatggtctgggctcgtgcaggggccgccccttcagcaggagcagacgctgatcggtagagctccaccactcctggggtccctgactccatacgacagcgggctggtagatgcctgaagggagtgagtgagaatgcagactgagaggatgattttcagaagatttgaacagtagtaaagaggtcgctaatcccgagtctccaatcagcctgagcaagtcgtgaagggcacactacattctgttccctataccacactacacataccctgacatactgtccgttctgacaggtttggggggcagcgctggtgcagcagtttcgggcaacaatagagttgcacttccttgcgatggggctagggttggtggggctcgggggcgaggcgcgtgaactgtggtggcagcagggagtggagggatttcagggtttactcttgattcatgggcacgccctggatttnnnnnnnnnnacgtgaactgtggtggcaccagggagtggagggatttcaggattcactcttgattcatgggcacgccctggattttgacagaggtactgggatcttgtactgcagcgggcgtgccagactgtcagcacctagtacctggggctggcggacggcgagttggtaggacttgttggggaaggtccactggagggactggtcgggctgggggggatggaggagccaggggagttggagcactgctgcagctccgcaaatgcagacgcgagggcggtggcggtggccgtcgcctgtgattgtgggagtggaaggggttcttgtgtaggtcgccagcatgtcaaggatggccagtgagagagttatggggcgaaccagccacctgccccctggcagagatgtggaagggtcacagcaatgggcattgtgatggaacccannnnnnnnnncctgggggacggcgagttggtaggagttgtcagggaaggtccactggagggactggtcgggcnnnnnnnnnnggagaattatggggcgaagcagccacctgccccttggcagagatgtggaaggctcacagcaatgggcattgtgatggaacccaaaacctgcctccctcatcccatcgtactgtggcttcggcggtggcttcagcagtggcctcggcagtgcctccatctgtggcgcaggctgatgcagctgcagcagcggtggcgacggaagtctcgatactgttggcagtggcctccgcaatggcttcggcctgggagggacagcagccagcttgggcgatggcagtggaactggcttccgcgatggccttggccacagcagtggcagacgctgcagcgctcccgcacgcagaggcccctgggccggatgtcgaagcgaacacactggcgtacgctttggcagtggcctgagtgtgggagaaggaagagcagtgagggattctagtcgatcctcgtgtatagtttggatcattcatagcatttcagttgcatgcagcacagcaggcaagacaaggtacttcttgcgctcggcaaatgactgagggacgacctgtgcatgcgttccaacctaatagtttacgaggatgcccaccctcctcattggggctcaccgtggagacagcctcggcaacagcctcagcctgggcctgagcggccccaccaccacacacttgggccacggcagtggaaagcgcggaggcagtggactcctttatctcgctgaaagcggcggagttggcaatgacaatagcctccactttctttgcctgaccgttgttcacagcttgtgctgtgccctcggcactagtgattgtgctgggatccactgcagtaccagtgccattactgatagcctgccagaaaggtaagggagaggcgcacgggatgacagacgagattagagtacggccaagcccgcgccaatgagaaggagcttttgaaggtgaatgnnnnnnnnnnactgaaagcggcggcgttggcattgacggtagcctccactttctttgcctgaccgttgttcacagcttttgctgttccctcggcactggtgattgtcccgggatccaccttagtaccggtgccctcactgatggcctgccaagaaggtaagggaagaggcgcacgggatgataaacgagattagggtccggccaagcccgcaccaatgagaaggagcttttgaaggtgaatggcatatgattggcgtacggcaggccaagcagagcttcattaaactacgcgcatgtcaatataccatgccaattcactgctacaatctagcacatcaatcaccgtagcagcggcttctgcagtggcatcccctgaagcgaccgcctccgctgctgcgtttgcaagggcggttccgtttccgctggcggtcgcgatagcggcggcctggcatagggtttagcacgggacggtagaatgatcataatgggttcgacaaggggaagtgcgcatccatagcaatcctaaagcccacattaagccaattacctcggcgacagcgttgccgttgccttcggccagagcctgcatattagtgaaagagtgccaccgaggtcggtgaaccggatggtgccagcgatggaccacggaatgtatcaggctgatgacaggagtcacactgcacacattaccatggtatgcatagagaaagcatcatccgttgccttactgaagcgatggcgctggcagctgcagtgctgtcaccagaagccacagcggacgcaatggccgttgcggttgcagatgccttcagattccgaaggcggaaaacggccgagtctcgtccatgcgcgagcatgcacagggccaacaggccaatgaaagtccaggaaaaggtcttcatggcctctgcgtgtgaggagaaacgatactgggcgaccgacttcaggggcgcacatcggaccggaactgcagattcatccgaccgtctcgtcactcactcaaaatgttagcttaacccagctgcagtctgtcgaggaggcacctggacaatattctgtacgcttaagcctacgtttttcatacttccgaaggcaaggaatacatatatccttacgatagttcctgcttccgtgaaggcgtaggaaggcgaaagcagcggcagacaaagacgcgtcggcgagattgatggcgatgcgaacaggtcagcagggcaccgttctgacagtttggacgatgaagtaccagtgaacgcgagctgaatgctcaatgatgtggcatgggatgggttgagaaggccaccaggaggtggtagtgttttagggggaggctgaagaaaatcggaagcaagtacaaagtgtatgagggctcaaacaagaatctaaactcgcgccgagggggtgcgcttgatacataatcctgcggatgtataatttgcagccaaacatgctagcatgatggccgagacactgtgcgactattgactggggatgggtgtgctagtacatccttcatgcacatgctctgcctggttgcgtaggtctccaaagttgttagtcagtgtgacaaggtgcaggtcggcctcattttgtccttgagcagtcagctcggcggatgaagtgcaagatctcattcttcaagtatccagcgcaagactcaggagagcgtagatgcataattactgagggcacatgtgtacaatgacacttgctggcctgagtttacaagaaaacaggcacatgtctcagcgtgcatgaagcaacgtcagtagatgccggtcaaaagaacaagcacgtgctctttcagggccaaggcagttcacaggcagggcgagatgtctgcaatacaggcttggagtacagtgataaggttgcttttcattttgtaacattggtgacaacctgacgcctgtaaaacaagaaactgctctggtcgattccaagccacggacagatgcccctcctcagcaaagacagatcgtctgctggataaaaacaccagccctagcgtccttgattccatatgacaaggggtcaggtgatgcctgagggacagatagggacttccatgatgatgtcgctatcatggtcctgacgtgagccccaccacatgcacgtcagccctcccacacgccgctcctgtctatttactcatgcttggagcatgcgcacccttgcatcctagcacccctcgacgcaccttgaagtactggccattctgacaggtttcaggggcggcatcagtgcagcagttacggatcgtgacgaagttgcacttcctgggttggatttctggggcattgatgctggggtctgcgtcgccttcgttgtcgggagacctgcaggacaacaggagtccacgatgtgctgattcctgagatgagtacacttccaaatgagagctccttcgacctccaagatgtcatcgtcaccccttcagagggcacccgagctattaatgctgttcaaatccatgcctcataccctatgatggcggctgggggtccggatggggcatctgattcgctggctgggggcgcggatggggcctctagttcgctggctggggttacgaagggggcctctgatgtgctcgaggggctagataccaggacactggagggagaggcggcgccagagcactcctgcagcttggcaaatgcagaggccagggcaattgccgtggatgtcgcctgcgaggagtacggcggtgggctggatttgcgtatactcaaggatgcggattctagttttgcaaaggccttgtgtcatgtgatgccacaaccaatgaatccacagatgtcctgagggtggagacactcnnnnnnnnnntgtcagccctcccacacgcctctcctgtctatttgctcatgcttggagcatgcgcacccacgcatcctagcacccctcgacgcaccttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacgatgtgctgattcctgagatgagtgcacttccaaatgagagctcctttgacccacaagctgtcaatcgtcaccccttcagagggcacccgagccattaacgctgttcgaatccatgcctcataccctatgatggcggctgggggtccggatggggcctctagttcgctggctggggttgcggatggggcctctagttcactggttggggttgcgaagggggtctctgatgtgctcgaggggccagatgccaggacactggagggagaggcggcgccagnnnnnnnnnntcttgtgtcttatgatgccacaaccaatgagtccacagatgtcctgagggtggagacactccccgcaggcaacttaaaaagcctgttctccagggtccacctcccattgccactcgcaccgcagctgtggcggcaccattggcnnnnnnnnnngttaccaagcctgttctccagggcccacttcccattgccattcgcaccgcagctgtggcggcaccattggcgatggtggcaggactctctccgtctgggttgcactcaagtgcagcagaaggagcaagcgcagtggcaaccgattcttcgatgctggatgcggtggtatccgctatggcctgggcgccgtcagcacagcatgtggcgctgccaatcgccgtagcactagcctctgctatgggttttgcaacatccactggcgtcatgggtggactcgcacaggttcttgctccggatccagaagacgtggagagcttgtcagcatagactcttgatgtggcctgtgattagaggttgtggaagttgttgggtctttgatcagtaggtggaatgacaaaagaagtgcaactcatgcaggtgtgcagtgtagcccccgcaggagcgcacattcccacacatgcatactggacatcctcgagaatttctcgcacggtgccgcggtgctcatgcccataatcttctcacatgaccccccatcacacatctcaccgtagcgacagcctccgccactgcctctgcctgggcttggggannnnnnnnnnaataatcttctcacatgaccccctatcacacatctcaccatagcgacagcgtccgccactgcctctgcctgggcttggggactggcacccccacaaacatccgccacagccatggcaagggcagaggcaatggactccttgagctctgtgacgtcaggagccgagggattgatagtcatggaagggctggactgtgccttgccttgcagcgctgcgacgatggcattggaatcggtgatctgggctggagggatctcggccccggaaccctcgccgagggcctgtgggaggggaataaagggtaggactggggcgatggcttaatggagcatgttgggggcatggagacacgagcagtgctgcaagtctccaattggcagcaagactgtgcatgccatccaggtgtgaccggtgcagcggataccgtacgagtcccaaacactcgtggtcagcacccatggtcggaaactgtgcttnnnnnnnnnnagtgcagtggataccgtacgagtcccaaccactcgaggtcagcacccatggtcggaaactgtgcttgcctgagcggtggcgtcggcggacgctccccccgatgtgactgcttcagccgcggcaacggcaagggcattggcgtttccatcggcaatggcaatcgcagtggcctgacatttcagggaaggagaggaatggatggctgtttattacttgctcagacatggcggcatgcaaccatgcgttaacccggcatgcctgacctttactctacctctgctacggaattgctgtcgccctgcgccagggcctgtagggtttacaaaggaggaacctcgaagactagatcgaaatgcatggtgagcggaatccgttccataaaaagatcagccccacgctggtgcatccagatggcgacgaaaacaatattcgcatgtctcatctgaactcgatcccttctcaccgtcgcgatggcttccgcagctgcggcggtgtcgccggaagccaccgcggtggcgatggccgtggcggtctcagatgccttcagattccgacgacggaaactgctggagtcccgaccgtgcacgcacatgcacagggtcaacagacccacagcggtccaggtagatgtcctcatgtttcctgtggcggggtggaggctgaccatgattcatgcatgcatgcgacatcgaaaccgcgggcgccatgggagccgggtacacaacgtactggctctgagacccacccagaaatgaattgccttcctggcgtgcactggatgggagaacagaatgaagatctagcagcgcatatctttgatttcaggttacgtggaccccgcactaaccgtgccatgaggagtttattgccccttccatgtgaaggtgcatgtaggcaaatccttcacaccggggcgagaccgcatggagtcaggggtctcggcctcggtggcgcgaacccaccaggcgaccagcgtctcgcgcccatacgaatatcttttggctcgtttactcccgagaagaacgtccagggaggtgtgtagggcagctgcggacaccatcgacacggcggcacggggggggcgaacagcatggacagacgattgatcatgggacgtgcagagataggaactgccatacataatacttggaactgcatcgaggaacaatcacctctcaggtgtcgagtatcgtgtattcccagcgcattgctgctgatgcggatcttcatttaacttcgcgagttcatgcgctttcagcgcgtgatggccagtccccctgtgctcacggagggagcagtatccgcgaagctcggacactctcgctcgatgggtcacatggcgacgtcacaccccttgaatcgctcgtttgttgtgggttttgaacttcagtcccttgcatgctcgactcaaaccacgttgcgcgatttccggggctggcagtacagccgcaggacaggctggcctgcccatgcaaacagtgacgcactgagggaaaggattcacaccccgagtgatacgcagtcactgctggatgacatgcaacccgtgacgcatcatgtagtgttctcctccattggttggtaacgatccacgacaagaatgcaccaggagcccttaggatgctaggtgattgggccgtaaagnnnnnnnnnnttagtgttctcctccgttggttggtaacgatccacgacaaggatgctcctgaagctcttaggatgctaggtgattgggccgtaaagacagatgccgatgttcaggcccagccagcttacaaatctcacaggtcaattatctgactggttcgcaacgtagtacttgaagtagtaggtggctttccgagttttggtgacgtgggaaagtgagttactttcttagcaaattatgtaggggaggttctggctgggcaactcaacaccatctgggacgatcttccgttcaacaagagcagacggtggactggatggccccgccattgatgatgtccttgacaccgtacgccagggggttggatgacgcctatgagggttgggaaatcgtggcgagatgtggaccattaagcatccgctgccgatgcatcccaaccaagcgttaggaccatgcccggacccccaccctgacaccctcccacaggatgctgcaggagttgaaaacatgcatttcaagggaccccgctgtaccttgacccactgcccgttctggcnnnnnnnnnnagagcgtcaggaccatccccgggaccccaccctgacaccctcccacaggatgctgcaggagtcgaaaccatgcaatccaagggaccctgctgtaccttgacccactgcccgttctggcaggtgtcggcgccgctggcgcagcagtcctgtgcgacaaaggtgctgcacttcgaggagggcgcggagccgtttgagggatttccggtgcctcctccggtggtgggggacctgggtttgatgggtgggggtcggcggaggggtggtggggtccgggtggtggatggacgagggcgcgtcttttgtggcggtggagggtattgctgcgaccctggggaacgcgtggaggatgcttttgcagcgggtggtggaggagagtacctgggagtggcggttggcgaggcggacgggccagaggtggtggggccggaggtggtggggccggcggtggggccggcggtgccagagcactgctgcagctgtgcaaaggccgtcgcaagggcgctcgcggtggcctttgcctgggagtgtggcgagagaggggggctcagaggcgaggccagggtgcgggtcagggttgagccatggcatccccatgcactgcgcggtgttacgagccccattgattcagaaggtagcgggctggaaccgcaggccataagctccaagtaccatgctgattcttacttctgtgccctcnnnnnnnnnngatccccatgcactgcgcggtgttgcgagccccattgactcagaaagtagcgggctgggaccgcaggccataagctccaactaccatgctgattcttacttctgtgccctcccttgcccccattccctcgcaccgtggcagtggcagaggcctctgcattggcattggcggtgcccccatccgaggcgcaggcgtttgcactggccgcagccttggcaaccgaggtcttgatgctcgaagcggtggcctgggcgatggcctgggcgctggattggcagcagccggcctgggcgatcgcggtggcggtggcgtctgcgatggcggtcgctacggcggtggcggcggcgctggcgtccccacacgccgtcgctcccttgccggaggtggtggcaaacaccgaggcaaaagccttggctgtggcctgccggcggagatgagggggggagtttggagaggggagaaggggttgcgcaaggtgcgagtatcccagcatgcaaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgatggcccccacttccctcgccccacactatcccttcgaccatcacgtatgaactcccctcacgccctcaccgtggagacagcctcggcnnnnnnnnnnctctgatgggccccacttccctcgccccacacaatcccttcgaccatcacgtatgaactcccatcacgccctcaccgtggagacagcctcggcnnnnnnnnnnagagatgagagggggagtttggagaggtgagaaggggttgcgaaaggtgcgagtatcccagcatgcaaggatcgatcaggcaagtgcagatccacgaaggtgttctgcttccagcacaggacgatgagagaagaccacattgtatgacgcccacgcacggtaaaccatccatagatnnnnnnnnnnnnnnnnnnnnnnnnnnnnnnnnnnnnnnnnnnnnnnnnnnnnnnnncaccgcgttcgcctgggcctgggcgctgccggcaccgcacacgttggccacggcggtggcgacggcagaggcagtggccttgttgacctcgctgaaggccgcggagttggcggtgacggaggcgctcacgtcgccgccggagccgtcgttgaccgcctgggcgacagcattcgcgttggtgatggtggcagggtcgaccttggtgccggccccctggctgacagcctggaatggagcaaggggagggtaggaacatgttcagatccagggctgcgacgtgcacggtgcatgccttacaaacgctgttgtgccccttgcgctgcagcacttgcttgccagatcttcagagcccgcagccacgttttgcatccccccaaccgtacgtccactgcgacgatgacttggtataatgcattcctttcacctgagcagtggcctnnnnnnnnnntcaaatcttcagagcctgctgccacgttttgcatccccccaaccgtatgtctactgcgacgacttggtaaaatgcattcctttcacctgagcagtggcctcggccgaggcatcaccggaggcaactgcctcggcagcagcattggcgagggcattaccattcccattcgcctgagcgatggctgtggcctggcgaaggtcattggaagcgggggggttgacacgagggtgacaccagccaggatacaaggcggtggtctcctagaatcacttgtcaacaactatgcttacctctgcgacggcttttccattgccctgcgccagagcctgcgcgaagcgagataaggatctcgcacggtcgggaacaccaaggggtcgcgggatcgggcgtgttgaacagaagctctcccagaaaccccaacttgagatgacctcctacagcaaattattgaatgaccgcctttcaagacctcttaccgttgaaatggcgttggccgctgctgtggtgttgccggaggcgaccgcgttggcgatggccgtcgcgctggcagacgcctgcagctcccgacgaattacggcggagtctctcccatgtgcgagcatgcacagggccaggaggccgagaagggtccaggtaattgtcttcatggtatctgtggggggatattgggccaggaatgagcagagtatgggatccagggggaatggcgaggcgaccacaagagtctagggtcgaaaaccctcccgaactcactcaggaagagttcagtaccgcaaattctcgaacaagggagattgtaatgagttttactgtcgcattgcccgctttaaggtacacggtgctcgagattcatgggttcgccacggggcaatcaaagtggtccccatgcgaaggcgcaggaagatgcggggctctcgggaagacgcgtgtatgaaggtgccgcgttgggagtttgaggcacatgagacatgtcgatggttcgtgattcgtccgctggatgctgctcgatgttaagacggacacacatgggctcagggccgctcgcggcgcctcccacagctgtcgacgtcctgcatgaagattggcacactgacgtggacgaccgtactcggccaccgtcaccagacatttaccgtcgctgacagacagacacggccccccgcatgctttttggaggtctttattttcccggtagcctgtccagccacaccgcatgccgatactagagaatggcacaagaggatctgtcccgcctttgatcacctgttttcttggacttgtcccaccagcgacagcttcgtcccgacgcaggacgatacacagacaggccgcagcagggtcgctgtcgcgaatcggaacacgaagccgcggcgcaattgataaagtcccgcagcttaaaagtgcagttcacaggcaactccaactccttcgttagcgggttcgaattgcgggaggtttcaaatcccctcacaagaggcaattggcctgttaatgacctgtgtcagccctaagacattcttcatccacataaaccttgggattttgtaatgttgaagttgcaaaagcataattcgagtgccgcgccttaaccgctcggccaaagccgcagatacattgttcgcggcctacaggattcgaacctgtgcgggttcccccacggcatgaatcgtgatagaaaaaatgccattaaattcagtgtatgtaccgtaacaagactttgcagcagaaacacgggcgactggtcccgttgacacttcagccactttcaataggggcaccttattctgtcacgcacgttcatgtcgacgcgctatgcctgaggttgaagcacctacatcctctcatttgcagctnnnnnnnnnngaatgccattaaattcagtccatgtaccgtaacatgactttgcagcatcaacatgggcgactgctcccgttgacacttcagccactctcaataggtgcaccttattctctcacgtacgttcatgtcgacgcgctatgcctgaggatgaagcacctacatcctctcatttgcagctggtcagccatgacatgcatggccttattacatactgtcaccaaagaaacgactgctcaacgatcctgccggtccttccgatcatctgatccaaccagacttggcctgccggataacctcgcagcgtacatttggaacctcaatgggaggtaaagtcaagcttgttgatccaggaaaagctgctgccccgacgtccatcaccacgctgggatacaaactccatctaatctatgcacagcattggggaatacagcatgcgctgcataagcccctctctcactctcgtggtttggtaggggtcggaaccacctttgaagtttatgactccatccatgggcagcgacgtgatcccattgcagtgtgtgtgtattattttgtactgcccctcatggccgtctttacacacagacaaggaacattgataccgcaaggcaacttcgtttgtatttcatatttcaccgcaaaacatcctgcgtatggttcgttcataccatccagaacacattcgatctcattagacctcggtaattaagctggattgggcgggaatagtactgcggtgggtgaccacgtgggaagtccccgtgacgaactgttttttgttctttttggttctgctcatattattgaaaccacatgcacccgacacctacctcaaccatcattatccttcacaacagcannnnnnnnnnttttttggttcttgctcatattgttgagaccacatgcacccgacatcttcctcaaccatcattatccttcacaacagcacatagcaagagatcaaaacagtttccgcccatagcaccggattaatcaaactgaataataggggtaaacaccagggggagacacaagtcatacactacaacgctgcagggtgcacaggagatgatagatnnnnnnnnnngttgatcaaactgaatattaggggtaaacatcagggggagacgcaagtcatacactacgacgctgcagggtgcacaggagatgatagatagttccacgacgacgatgatgagaacgaggcagtcttcggagcaacagtttctgcaagggagacattggctgcaggcacggccctgatgtacaaggggtgggaaaaatcgaagtcgagtcgtggtggagcgcgtgtacttatccagcaccaggatggagacccgaggggtgtcgtggaggcacccatctgctgtcgtcgcagcctcccatggactgttgctgcagcgcccccacctcagctgatgcagcacccacccatgatcttcttctgcgcggcaaacaagaggctggaggccagggtcaggcgctccagcgtgctctccatctccatgatctcccggcgatacctggcagggttgtcggacagccggaccaccagtcccgcctgcgccggggtcgaaggggagggttgaaacgcagggtcgtgggaacaggcaggcccatgcaggccggacgcggcaaagtccccccatgcatggatgaggaagacagaccagagacggacaccctggcgacgcaggagtagagctggcctgacagacgcaccgcccagaagnnnnnnnnnntggccagatgcagcaaagtccacacatgcatggatgaggaatgcagaccagagacgggcaccctggcgacgcaggagtacagctggcctgacagacgcaccgcccagaagnnnnnnnnnntggacaagggccccggcgagtgctgggggcccagaggtcagggtggcagttgcgggggggcatgagggtggcagtgggtggtgcagaacccaggtcgctnnnnnnnnnngagagggcctcgtgatctccgggctccggtctgtctgacgccgcgtccagaagtgcccgcagaccaggcttgctctgaatggggttggacaggggaggcaaggcagggagtgagggtattgtgagcgtccgaggatgagagtacaagggacccggcgaatgctgggggcccagaggtcagggtgtcaggtgcgggggagcatgagggaggcagtgggtggtgcagaacccaggtcgctccatcagaagaagaaagcaaaaggcacaaagagcagctcctccaccctctcccctctcacctcaaccagctcctggaggcggtcgatccaggcctgcgcccgcctctccacctccgccacgcgggcgcggagctccggcgagggtggctctgaggtcgcgccgtctcgcaggtcggatggagtggtgtagaggaggccgtcgatgtcctgcacgccctggaggcgcaggcggcgccggccgaccacgtggatgccaaagcggccatccggctgcgccacacactcagtgatctccacctcgcaggcagcggagcagagctcgtccgaggcgcggcccgggtgccggcggctggtcatggcgaagcggcggctgccctgcatgcagcgccggaccatgaggcggtaccgcggctcaaagatgttcaggctcaggtgctcacctgtgggagtgaacaaggcgcgggggggggggggggggggggggnnnnnnnnnngctgagtcactgggagccagggatctcaatcatccctgcaccacaacccttctttgctccttccattggcgtcctgttttgtggatccaggaaggctgtgcccaggcctccagagcaggagcctcgcgacgatgtctcatctctcaaaacccgagcgcctcactcccagacacccctcttcccaacccccaaagatacccatcaccctcccccaccctcctgccaggtacctgggagcaggtaggacatgnnnnnnnnnnggacgacgtctcgtcccccaaaccccgagcgcctcactccctgacacccctcttcccaaaccccaaagatacccctcccctcccccaccctcttgccaggtacctgggagcaggtaggacatgacaaacaggggcatcctggactccagcgccaccctctcctcctgctcctccctcgcccgctcggccagctccttggcgaagcagcgctccagcagcgactgcagggtgatgctgatggccggggcgtgcgttgcattcattggctgcgcggcgggacgggggcaaggggttgagggggctcggccgtggcgaacgccatgcttccatgccgcccagaccctatgacatcaacagccccctgtgtgccaaccagtgagggttgccggggcagcccgcccctccctcctttccaccctttccccgccagagggctcacggtgcggcaggtggggcagcggctggtgtggtctaggcagcgcggcaggcaggcctggcagaagctgtgcccgcagggcgtggtgacggggcggtacaggagcttgaggcacagcgggcactccaggtccgacagcaggtcctggggcaggggggtggagtcgctgccccgcatgtcggccacagcggcggccgccgaggctagcgaggaggctgccaaggacacggaggacgcggcggaggagggccacagggtgccctgctcccgtgccggggcggggtgtggggggtcgacatgcgcagcctcctcataccgcctcaccagctccagagcctcagcctgcgcgggggttgggggtgcagcacgtcagccgccaggtgcagcaccacgtcagccgccgggtgcagcagcgtcacgctcggcaggcgagcccttgctgctgccgaggaagccttgcccgggcagctgcgtctcagggattgtgcaccccgatctcacaaacaaccctcccgctgcgcaagaagcgcgagcgcaccctgagcctnnnnnnnnnngtctcaccaacaaccctcccacggcgcaagaagcgcgagcgcaccctgagcctctgggcagcggcgcaggtgggtgccagcttgagggccgcctcggcgtcatgcaccgcaccctcggcgatctccgacgggtctggcgccaggaccgagtactcgctcttctgctcagcatgggaatttgtttggagggatggggtctgtggtgtgcggcagggacagctgggaattgcaggagttcgaataaactcaaacctactgctcgttgactctgagcagctcctgggcccagaatatgctcccctctctcgcccggtcacagccagcacccactggggcttgcgtgaggaggaggtgggagaagcggacttgctgctccgccctggcacacagcgctgcaattctttcgccagacgggaggtcggcgctgagagactcacgcatgnnnnnnnnnnctgctcccttctctcgcccggtcacagccggtacccaccggggcttgcgtgaggaggaggtgggagaagnnnnnnnnnnnnnggggtggggagtcgggcagccagagttccaaggccagcaggccccacgcagaatgcgtaccagccacccatgacgtcaacccctgatggccgccccttgagcctgccgtactgcgcnnnnnnnnnnggggtggggcgtcgggcagccagagttccacgggcagcaggccccacacagaatgcgtgccagccacccatgacgtcaacctccggtggccgccccttgagcctgccgtactgcgcgcacgcacatctcggaaaatggtggtgtggtccaggcagtcctcgtcgtcggtggagtcaatcgagcccgccgtggacccccccaccccgctaccggagtccagggttctcgatcggtccctccccgagggagggcacgggatgcggaaccaaaagggcgaggagtttgcattcatcgtactccgaggtgtggagagggagcgcgtggcctgggcgtggagttaaggggcttccaggggttgggtccccgaatccgtgcgaggccacgtcgccgcgcgatctcaccactcgatgcgcccagcgtggaggagaattcagctccagaagtgggtaagagcgtgagcttgggggaacaggtgggttgtcaactcgagattgaaggaggttagcaatgagtcgacgcgccaccgtgaatgttgcgaatccgggatctttgcgtgccttttcttggatcccctctttgtctgatttgatgcaagcagcgcgcgatgaagtgccagccacgcaattgacaatcaatgtctgatgtagcacctgtgcatggattggagagaatcccattggcccttcaagagtgactgacaccccggaactatgttttcgtacaggcctactcaaaggatcccacgtttaagacatccccagtgcagccacagaaccgggaaccaaggcgcacccatgtcgccatcaacagcctgcaggagatgtgnnnnnnnnnnggaccccaggttcaagacatgcccagtgcagccacagaaccgggtaccaaggccctcccttgtcgccatcaacagcctgcaggagatgtgcaccttctttggcgtttcccttccatttgacatgacgcaaacgtcttatcgcggcacgcatcattgcacgggctttagggccttctccacatgatattcggatctgaatgtgcatacaatctcacaccgcttcgatgagcatcgtatgcaccgcacttcatggatcccacccgcgccggatcccctgggccccgtgcgagggaacgccccatgctgcaacgaaacaacgcactgcacggcagaaataccgattcaggtccagactggcttcgtcggcccctgttccctcgggagacgaggaccaggaggcaattcagtcggcatacaacaaggcgatcaacacgagcaaccctcccgatgtcttcatacaagacatgcgagacttcgcgacgtcggtgcgggccatgcatgggtggtgatgtgcaaagatgcctcgcgcaagagcgtcttcatggataatggaagagagaccaacagcttgtacctgagcctgctgcactggagactcaacaagcaacagtagctgttagggagcgtgcttataggttgacacagtcatccttgaccctcccaccatcaagcacaggtgctgaggggggcggaccccaagaatgctccctcgcctgtagcggcagagcagtggtttgctgagtacgacctgaatggctctgggaggctcagttctgcggaactggctgcaggcctccgtcgttccggagtggagattagcgatgcccaaacgctggcattcatggaagctgcagggatatcagcatccccggaaggggacctagcagtcagaatagaggccttccagaacctgctccagtgcatggcaagggctgaattttatggccagcgcgctttcagcgcaaacactccgacggcaggggttcctgcgccgcagccacccaagggtgaggacctggagataatccaggtaagctttggtttagggtggggtggagttcccattctgcaggacgaattcttggagaaagttctctgactcgcgacatccgttaaggttttgtcattctggtaggggtgtgtatccgtgttggagaccctttcatttcatactgaatattccacatccatacaggagaggcttgcaaagctgggtaacgatgaacctattgtgtaaggtggtcagatcctagagaggaggttatcatggcaaacatttcaacagcgctccgagagagacgctccacctaaatgcgcgccataaacagaaggggccttcctccaaagtcgtcatcggaatttgggggtaattccataagcttcaatacatcctgatctcgatgacgcggggtaattcctcctgactgcgtgagcttgatagaggtgatgccacggtcgcccagtcccgagcgctcctcggagcggtatcgccagaaacgatcctacagccgagaaaggagccgtagatcaccgtcgccacggcgctcgccccggcatcggcgtgagagcgagcggagcagggaagagtacactcgacggtccagccctcttcaggggagtcctcctcgccgggaccgctcagaccgtgggcgggactaccctccttcctcgaatggagctccacctcgtggattcacggcgcggtgggtgcctgggcttcgcatgcatctgcacagggccagggatagaggttcgggtctgcaggccacttgcaaagcctgcccttgggggcagtatggacccttcgcgctgagcgtgttgacatcaccgcaacccattgttcaaagcgctgttgccatgcacacaatgcaggggnnnnnnnnnngtaggggttcgggcctgcaggccacttacaaagcctgctcttgggggcagtatggaccctttgcactgagcgtgttgacatcaccggaacccattgttcacagcgctgttgccatgcacacaatgcaggggagacagacgtccaccggtggaggatgtgagtgacgacgacattaaagctgagagctaccaagacctgtgagctgcactccctggtgaaggcatcctgctttggacatgtgatctgtatacatgcctcagaagatggatgatgtttgccttttttcttgactggagtccctgccactactgccgctctgggcggcacgcatggaaagcttctccggacccaccctgcctgtgtcccgcaggcggcggctgaagcggatcaagctcagggagcgtaatgtggccagcatctggcgagtgaccccgtccccgcctcccgaggagcgcgcgaggctggagagggaaatggcagaggcggcagaggcgcaccatgccatgcaggcgcagcagcaccaagcgcattcacatcatggtagcaaaaagtgagttcaaagcagattgagcatgaagatgggcagttgcttcggggcacagctattgctctggactgttggtggtgcttaacttgttgccagggaacttcgaccctcatcgccctagcttcccctgcgagtttcctcatcaaagggatcagcactgggactgtgcaatgctgtcnnnnnnnnnnggggctgttgcttgggggcacagccatcgctctggactgttggtggtggtaaatttgttgccgaggaactgcgaccctcatcgccctaggttcccctgcgagttgcctcatccaaaggatcagcactgggactgtgcaatgctgtcaggtccccccagttcctgattactccacccctggcgctcaggcaaggagccagtgcgcctgtcgagcccccagccgagggtttggctgtcccggaaactgatgcaggcactcctgccctgcccgagctggatcccttggaggcagagctgaaccagcgcgaggcctcgctgttcacggtgaggtctggcggcggggatgacacggggcaggatctttacacgtctgacgaggagcccctgcgaatgcagccgccctctcaaggcgtctgcatgctaccgcccggcacatggcggatgcggcagcggtcannnnnnnnnnggtacggctgtcgagcccccagccgaggggttggctgtcccggaaactgatgcaggcactnnnnnnnnnntaggagcctctgcgaatgcagccgccctctcaaggtgtcggcatgctaccccccggcacatggcggatgcggcagcggtcaatggccatcatcccgctcatccggtcactgcccaatgcgacttttgttcgtcagcgtgttccagcgcctgcatcgctcgtccattctcacgatccggaaccctcccatgcagtcctggctggagacgcagcgcgctgcggccgcggacgcggcggccgccgccgccgcggcggaagaggaggatcgcctggtggggcccgaggcacctgcgggggccggcgaggnnnnnnnnnnnnnnnnnnnnnnnnnnnnnnnnnnnnnnnnnnnnnnnnnnnnnnnnncggggagggcaccgctatggccgcctttgtgcagtccggccagcgcatcccccgccgtggcgaggttggcctgaccagcagcgagatcgacaacttcgagagcgcggggtgagatgggatggatgttagggggtggggcgagaggagggtgtttgtgcaaggggcaaggcatcagctgtctgcagccgaggagggcagtgggcttgcaaagcccggcaaacccccaggcaggatgcctgtgctggttccccggcgaagactggagttccaggcgcctgtgccgcccggagcgacccatggtgcactctgccgcgtctacgcccccactcatcccgcacaccggcctgtcatcgtctcaccccctcacgctccagctccctcccttcctgcccttgttccccccgcgcaggtacgtaatgtccgggaacaggcatgnnnnnnnnnnatcgcgccccagctccctcccttcctgcccctgtcccccccgtgcaggtacgtaatgtccgggaacaggcatgcgcgcatgaacgcggtgcgcatccgcaaggagaaccaggtgtacacggcggaggagaaggcggcgctggccatgttcaactacgaggagaacaagcgcaaggaggccaagatcctggacgacatgaagcgcctggtgcacaagacgcttgggcccgacgccgggctggacccggtggaggaggagggctgacgggggtcggagggctaggatcggggccgggcgtggccctctgcgcctggccatgccagcctgctgcctgtgaccctcacccgctggagggggggggcggtgctgccggcacgcccaaggtgcaacaggcatggggagggcggcacggtggggcactccggttccagtagctcgaggactctcgaggggcctaaccctgtcaaggtgcaacacgacctccagactgtacaaactagatccatgtcaatgtcactccgtggtgacttgacctcagatccgcagatggctggatgacccagcgcgggagcctgagccgacgggattgtgctgcgcatgaggaacggcctgctgcactgaacgggacgcgatccagattgcacgcttgacatatatctatcggcatgcaactacctattcaccacagacaaatcagacaggactcccaggaatgcaccgcatgagccagcgaaaggagctttgctgaggtgtgtgcgcccacattctgcccgtcggtctacgcggcatgcggtccaccgtcacattacggtcacccttatgcattcgggggtgagtcatcggaactcacacaagcagagcttcggcgtggagggtagctccggagcgcaaagcgcgcagcagggggtgctctccatgacgatgactcacgtgctgagtaggaatgggttgacgtggggaatgcagcctgtcatcccctggcctaggagctatatccccgcgggtccagaaagcaaaactccatacgttcgattccttccagattcaaccgtacactatcccttcgtatttgtcaatacaatcggcagcgagcaccccggaccttcacccactacccgtccccgatcaatactcaggtgagccgctcgggaacccttgcctctgtcacgccttgacccgatttctcaccggcatgccatggtcacgggaatttggtgcatcaatgcatcgtgggctgcctctgagccctcccagctcctcctcaccccatcccggaagttgacgtgcaggccggctcccccgcgatgagtgccaacggcgagtaccagacctcctacgaccctcccaaggacctgcaggcccaggcacatgtcaatagcctggatgagtacaagcgcatgtacgaccagtccctgaaggaccctgaggtgggttggggttagagtgaagctccgtcgtcacgtggtcctccgggcagcatcccttcagagagatttcgttgggctgccaattttacgcctgctgtgggacgggggcgctaaaataaaagggcagcagcccatccccacaactcgatccatctacccacccgtccactctcttctaattcgtgcccnnnnnnnnnnaagatttcgtcgggctgccaattccacgcctgctgtgggacgggggcggtaaaataaaagggcagcagcccatcaccacaactcgatccatctactcacccgtccactctcttctaattcgtgcccctcaggcattctggggcaagattgcagaggacttctactggaagaagaagtgggatgtgatcgagaagtgagttcagggggaaatcgggagttgggttctgtggctccaatggtgcaaggagtctgggcgcatgctcgttgccctctctgcatgcctcggagtcacggtatctagccggcctttcttgcgtcctgcttcctcacatatcgtgcagtcaatgtatccctgcttcctccctgtcgtcctgcactctgtgtccattccccttgacctatcccactccacttttccatcacaaacagacctcccacttgactccccaccccatccttccccccacccctccaccccctaatctccaggcacaacatcgacaccagcaagggcccggtctctatcgagtggttcctgggcgcgcagaccaacctggcctacaatgccgtggacaggcacgttgaggcgggcatgggcgaccgtgtcgccttcttctgggagggaaacgatgtggaccagtcgcgcaccgtgacctacaagcagctgcaggaccaggtgtgccaggtggccaacttcctgctgtccaagggcgtgaagaagggctccgacgtcaccatctacctgcccatgatcccggagctgccggccaccatgctggcctgcgcgcgcatcggcgcggtgcactcggtcgtcttcgccggcttctccgcggagtcgttggcggggcgcatcgaggacagccggccctccgtggtggtgaccacctcgggcgtcaagcgcggcgccaagcccatcgagctgaagaagatagtggacgaggcgctggccctgccagggacggactcggtgaccacggtgctggtgtacgaccactccatcgcgctgccgcgcgacaaggtggccttcaccgagggccgggatgtgtggtggcaggacgtggtgcccgggcagtccaccgaggcgcccatcgagtgggtggacgcggagcacccctccttcaagctctacacctcgggcagcacgggtaagcccaagggcgtgctgcacaccaccgccggctacatggtgggcgcggccaccaccttcaagtacgtgtttgaccaccgcgcctccgacgtctactggtgcaccgccgactgcgggtggatcacggggcactcgtacgtgacctacggcccgctcttcaatgcggccagccaggtggtgttcgagggtgtgcccacctaccccgacgccgggcgctgctgggacatcgtggacaagtacaacgtcagcctgttctacaccgcgcccaccgccatccgcagcctgatggccgcgggcgacgagtttgtcacgcgctccaagcgctcctccctccgcgtgctgggcacggtgggcgagcccatcaaccccgaggcctggcgctggtacaacgaggtggtgggcggcggccgcgcggccatcgtggacacctggtggcagacggagacgggggcgcacatgatcacgcccctccccggcgccatccccgccaagcccgggtcggccacgctgcccttcttcggcgtggagcccgccatcctggacgagtcggggaaggaggtggagggccccggccagggctacctggtggtcaagcgctcctggccctccatgctgcgcaccatcgcgggcgaccacgcgcgcttcgagcagacctacttcaacgtctacaagggctactacttcaccggggacggcgcgcgccgcgacgaggacggctacatctggatcctggggcgcgtggacgacgtgatcaacgtgtcggggcaccgcatcggcaccgcggaggtggagtcggcgctggtggggcaccatctgtgcgccgaagcggcggtggtgcccgtggagcacgccatcaagggccaggtcatctacgcctttgtcaccctctacggcgacgccacctacccgcccccggaggagacgcgcaaagccctgattgcgcaggtgggtgtgttgggtggtggtggtcatgatcgaggtggtggggccctgggcgactcgtgccgtcgaggtgggagggaggccgagtgtcctcccgacaccctggcgccctgatgtgcaccccgccttgccccctcgcgagcctccaccccggcaccgagccactcacgtcacccaaaccctcgacccaacccccaggtgcgcaaggccatcgggcccatcgccacccccgacgtcatccactgggcgccgagcctgcccaagacgcggtccggcaagatcatgcgccgcatcctgcgcaagatcgcgtcccgggaggaggaccagctgggcgacatctccaccctggcagaccccagcgtggtggagaccctcctcagcctgcgcggaaagtaggcgcgcatgcgactcgaccgtgccagcggggtcggggaggaggcgcagaggaggtgcggcggctgcctgccacggcccgcgtcccgggggcgtgctcccctctttcttcccccaaactccgacgggcacccatcttgggggcccgcgtcacaaacgactgtcccagcaagttttgtgccgacgccacagttttccctggcccctgtgcccaaacccgtcccttctgtgaaccccatgccatcgcaccctcttgccacgggggcggggggtggggcccttctcgctgcgccgtcgactgcccccagccgtgagccagcgaagccggtctcccatcctggagcctggtctnnnnnnnnnnacgggtgggtgtcgtgtcgctgcgccgtcgagtgcccccagccgtgagccagcaaagccggtctcccatcctggagcctggtcttgcaccgtcagtgctgcgtgtggcctttttgcttgctctgtgaagacccgacacatgacagatggagcaaggcttgaatggttgggggggttgcaggggagagtgtggtgccgcagcatgaagaaggctgcagtgagagcttgcagtggagaacccctggtcaccgggggaccaaaggattttgcaccagcacgagcttcaacgactggggccacagatcggagatcctctggttctcactcatgcagcctgcctgtgctcaagtgtatgcggtctggccacctatggcatcacacaacctgcccgtcatgcccannnnnnnnnngcaccagcacgagcttcaacggctggggccacagatcggacatcctctggttctcactcatgcagcatgcctgtgctcaagtgcatgcggcctggccacctgtggcatcacacaacctgcccgtcatgcccannnnnnnnnngaccgctgggctgaaggcagtcagaatcctcacccagctcagtcctggcagagtgaggtggctgggccaaagcgcgtgcactttggcgtgatcagggcagcttcgcacatgggcnnnnnnnnnncaccgctgggctcaaggcagtcagaatcctcacccagctcaggcctggcagagtgaggtggctgggccatagcgcgtgcacctgggcgtgatcagggcagcttcgcacatgggcnnnnnnnnnnagtcttcagtaccctgcagacctcctagcctcagtagatgtactctgggatcgacaggtgcacagtggggcaggctgcctcgatnnnnnnnnnnttgggtacgactgcaaatcgcaggcagggggtgggggggggaccatgcaagctggctcaaggatggatcagggctcgttccaggcaagccacagtggtagaacaggcctctcatgaggcatgacaggaacaaaaatggcctcctatcctccgccgcccggtcttcagtgccctgcagacctcctggcctcagtagatgtactctgggatcgtcaggtgcacagtggggcaggctgcctcgatgaagcgggtgccctgcgcctcggcgtcgccctccttgaagccaaagctgccggtcatcctgcccgtggggcagggcatctgcgtgcacgaggtgtaggtcagggaagggccccccgcactgagctgggggaagagtcccaccacgcctggtcccgacgccaggatggggtcatggtctgtggggaggaagtgccaggtgcggttcaccagctggacggccagcaggggttggaaggtgccgagggaaccgtcccaggcagcagcctgttcctcctcactcaaaagactgaaggtgatcctgcagggccaaggggatggcaggtggtcggatggcgtgcgagtcccttcatctcttcctctggccaatgcctcgagcaccctctgaccctgccacccagcctcatctagcgcaagggggaccccaccaggccgccgtccctcccacgccacaccagccnnnnnnnnnncgccccccagcctcatcaagcgcaagtgggaccccacacggccgccgtccctcccacgccacaccagccccttcccagccctctccttcccctccctggagcccggccggaggcaatgctcccagccgactcactggtatgcaaaggtgtaggcctcggtgccccgcgcctcatcctgtgggttgctgcagtactcggggaggaagagcacggannnnnnnnnngggtaccccgcgcctcatcccgtgggtggctgcagtactcggggaggaagagcacggatgcgtgcaccctgatgccctgggtcacagcgacctgggcggggccatggggaccgctgctgcgcacggggtacaggcacggcgtgctggggctgcgcttgagggggaagatgggggaggcggcgtacacaccgtcccgcagccgccgcgcgtactcgcagaaccagcgctgcacggcgcagcacgcggcacctgccgcggggttgaggtgagtgtgacagggatgtcacgccgtggaatctggccggtcgggcgctgcccagcgagctctgcaggggccggactgctggaattcagcagcatcgcctcgctcacgcggtacccggacggccatgcagcggaggcagggggcggcccaggggagcagcccatgtccctgataccaagtaccttctggagccgcaggaaaggccacagcctggccgagtatcgacgccacggccccgttcactttgtcaatgcagatctgcttgacactgccttgactgcatgcaaagatgaggctgcgaggggtattcaggggggtcgagggatttgggagtggaatgggatgggggacgcattaaaccgcatgagcaggtggcatgtatggggcatggggagcaccggtgctgcaccgtgcccagatgccaagatcctgttggccnnnnnnnnnnaaaactgcatgagcagggggcatgcatgggacatggggagcaccggtgctgctccgtgcccagatgccaagatcctgttggccatgagcctgggaccgcacatggatgcagcaagcccagccaccagagggctctccagacaccctcatctggctgaaggtgcctgcgaggcagggcacacccattccctcgcccactgcctcacctggaactgtcacgtccaccttggctgttgcaactcgatgacagagccaagatttcacgaagggacaggaggcccatcgtgacataatcatcatacagggagtacctgtggatggggggannnnnnnnnnccaactcgatgacagagccaagatttcaccaagggacaggaggcccatcgtgacgtaatcgtcatacagggagtacctgtggatggggggatgggagcagggagggctcttgggacccagaaaaagactgtggctggcccattcgggacccctccatccccactggccggagcagatgtccctgcagcctgctcacccaccaaagacgccacaaaaggcatccaggctttgccatctgcctcgggggcgaagaaactggccatcatgaaccctcaagatcatgcgaagcccaggaggcagggggaagccgagtgtggcctctgccgcgcgcagctgcctctccgtggcaccaggtctgcccaggggcaggagggggcagggatgtgagccgacctgcaccagcgatgcctgcagagccccgccctggatgactcaccgcaaggtcctgatgatttgggggcagttcttgctcagccacgtctcgatatccttccacgccctgacgacggcctgtgctactggacagcagcctcccgcgaacatgacccactcgcgatacaggcaatgcggcggctgtcctcggcacttccgatcgggaggccctgcggcggtctcatccccccagtctcgaccaagtgctctcagccataggtgctgggcagtggggctggacagagcatccctccaggctcgctgcacgcagctgatcttcgctagaacctttgcatccaggtacctagatttggaagggacagaggtggttttggaggtttacgggttggaccgtgggcctgcacagggcaccccacacccagggctcaccccactcgtcacccactcgacaacgatcaacagcgcatcggcgtacagggacgggtgcacgtcggtattcatttgggtattgtgagccgagatcgctgcggcgatcctgcgtgcgcaactatactcggatgcagtcaagctgcggtccagcctgttgttctggggtttcggacccggtgtgtcccggagagatcggatgccagaccccctggcctcgcgccaggaggcagctgccctgtcgatgctgaannnnnnnnnntgatgcagtcaagctgcggtccggcctgttgttctggggtttcggacccggtatgtcccggagagatcggataccagaccccctggcctcgcaccaggaggcagctgccctgtcgatgctgaacccaacaaccctgcaggtgaccgtgacactcttgcgacgttcctccctcgccccaccagcatcccttcctgtctgtctcccacggtgtccctgcccagacgaagcttctgctttacaccggcacacatggccctgcatgcgacacgtcatctccacacgggcccttcagatcccggggccccgttgccctgcctcaggcgtaggcatccagcttgacggacagggtgcgtccctccagctcggtcccgttgaactgctcgatggcggcggcggcggcctccagggtggtgaagcgcacggtgccgtagccgcgggagcggccgtcgcggccatgcacgatgtccgcgcgctcgatctcgcccacgccctcaaacagcggcttcaggtcctgccacttgtaggcgaagggcaggccgtgcaccacgatctgcagcccgctggacaccgcctcctcgccgtc

SEQ ID NO: 39752 - DNA, 79 bp, Chlorella protothecoides
ccccttctgggatggcaggacacctgtcagtaatggattcggaactcgagcatggcgccaagatatgacgacacgcagc

SEQ ID NO: 39753 - DNA, 61 bp, Chlorella protothecoides
cggtccctatactgtatgcaattagcataaccatcacaatagtgtgtctcaaaaggtccgg

SEQ ID NO: 39754 - DNA, 118 bp, Chlorella protothecoides
tgatgccaggccctggggagcgccgagttccccccctgccctttgggaggtcacctgcagctccccatctcaagtcttcatcttccactccgactccccacaggacccgatctacacc

SEQ ID NO: 39755 - DNA, 78 bp, Chlorella protothecoides
gtgggcgggtgaaggggagggtccttggggcggacttccctcgagtaccctccgatgcattggcggggcagaggggcc

SEQ ID NO: 39756 - DNA, 61 bp, Chlorella protothecoides
tggcgtcagccgcccggcccagatgccgggtcccagccagtcacgcagggcggagacgcac

SEQ ID NO: 39757 - DNA, 135 bp, Chlorella protothecoides
ggtccgggcgacgcctccggatggtactgcgaggagcatgtgggagaggttgttgaggagagtggtcgacagggagccctccgggcagtggaaaatgcaatttacagagagaaaacgccatcgcacaacccatgt

SEQ ID NO: 39758 - DNA, 61 bp, Chlorella protothecoides
gtgactaaatggctatgtcgtcgtggctgggtgtaagatcttgacatcaagattgctgatt

SEQ ID NO: 39759 - DNA, 61 bp, Chlorella protothecoides
tgtgatgtgaattgggtggagtagcgggggggaattaaggcagtgccaagggtgaggcgcc

SEQ ID NO: 39760 - DNA, 62 bp, Chlorella protothecoides
cttgttgacacaccgcttcgtgtcccacacgcccaccagcttctcctcgccgttgcgcaccc

SEQ ID NO: 39761 - DNA, 71 bp, Chlorella protothecoides
gcccggctgagcggctgctgccccgaagcctggctgcgcgactgctgttccgaagccctgctgcgcggctg

SEQ ID NO: 39762 - DNA, 61 bp, Chlorella protothecoides
cacgcagctggcttcctggcggacgccatcctgggcaaccagaccccctcggcgctgcgtc

SEQ ID NO: 39763 - DNA, 61 bp, Chlorella protothecoides
tggccgacacctctgtcggcccccacccccaccgccactgagggaatttgtgggggggtgc

SEQ ID NO: 39764 - DNA, 69 bp, Chlorella protothecoides
gggcacgatgtctagctcgcagtcgagatcaatctgagctagggcgcgacgacgtccgggcaccgccca

SEQ ID NO: 39765 - DNA, 61 bp, Chlorella protothecoides
agaacctggatagggtagcgtgtgtctcgggatgagccgcctcattgcgtgatattgcttt

SEQ ID NO: 39766 - DNA, 98 bp, Chlorella protothecoides
gctgaagcccccatactgagctgctccccgccgcatgggagactacccagccccatcagctccgccaccgcctcctggcactcgcgcccgggagcggc

SEQ ID NO: 39767 - DNA, 63 bp, Chlorella protothecoides
tactgtcctcagagcccctcatggcgcatgacgagggtccgcagacagagcgcgaggacccaa

SEQ ID NO: 39768 - DNA, 74 bp, Chlorella protothecoides
gcggcgccgaggacgggggtgggggcgccgtggcggggcctggctgccagggcagggcgggcgtccccgcgccc

SEQ ID NO: 39769 - DNA, 5984 bp, Chlorella protothecoides
  modified_base (264)..(273): a, c, t, g, unknown or other
  modified_base (1117)..(1126): a, c, t, g, unknown or other
  modified_base (1774)..(1783): a, c, t, g, unknown or other
  modified_base (2591)..(2600): a, c, t, g, unknown or other
  modified_base (4303)..(4312): a, c, t, g, unknown or other
  modified_base (4817)..(4826): a, c, t, g, unknown or other
  modified_base (4994)..(5003): a, c, t, g, unknown or other
  modified_base (5305)..(5314): a, c, t, g, unknown or other
ttatggtttggggattggggaagggagtccccttcagggtgggctcgcagtggaatgtgaggagggagcagggggagtggtgcgaagggattgcccaggttcaagagcatcttgtaaaggagtcggggcagggatgtcgtgcgctggagtgccgccccaactcttggaaaagaccgcgcagattgtctggccctccaacacccccgcccttgcactcctcgctcctgcagaccagctacgcccacagcattgcgtttgtgatcnnnnnnnnnnagggggcgacggcgaccaccgcggcgccggcgccgcggcccggcgcggagcgcgcggcgctggtgcgctcgctggtggagaccgtcatccgcgagctcgtcagcagcaagagcaacgacgcggtgcgcgccggggcggccgagtgcctgggcgtcttggcccaggcccagggctccacggtgtcggaggtgctgggctccatgatggacaggctggcgggcatcagcgaccgcaggctgctcccgctccgggccatcaacgcgcaggtgctcgagcggggggggggtgacacaggtggtggttatggtttggggattggggaagggagtcctgttcagggagggctcgctgtggaatgtgaggagggagcatggggaggggtgcgaagggattccccaggttccagagcatcttttaaaggactcggggcaaggatgtcgtgcgctggagtgccgccccaacccttggaaaagaccgcggagtttgtctggccctcctacacccccacccttgcactccctcgctcctgcagactagctacgcccacagcattgcgtttgtgatcgagcactgccccgagcagctgccgctgacccaggaggttgtcagcttcctggcagacgcctgcaccatcatggagacggacatggccaaggtgggtgccagggagggaatgagccgtcggaggctggggagcatgctggatgttggagggtttggaggtttgacggcatggctgcagaggctgccaacgcacaatcacaagcagcccatgtccctgctggccgtccttcgccaacgccaaccacgccaactctgcaggtgacggcccgggtgacagtgnnnnnnnnnncggccttccttcgcccatgccagccatgcccactctgcaggtgacggcccgggtgacagtgcgtgggcagcccccccgcgcggaagtcgtggggaagctgcaggtggcgtgcgtggaggtgctggtggcggcgctcggctggcgggccttcaggtgggcagggcaggggctggggggcgtataggtgggagaggagagggagggcaaatgggtgttttcttcgcccaagattcgagtgttttgccgggacgggggaataggcccccaaacggttgtgatggacgagctcagcatgacatcgggtctgggtccatagtatggagctctgccttcccgtagcccctgccggcccctccataacgaccacgctctgccccctctccgttctcagggagccagagggacccgaggctgtgcagcgcacgcctgcgggagaggtccgcacgacgctgccgaagcttcgggagcgcatcaccaaggtactgcagaggttggggatatcgagggtcgcagcagcagcaggtcttgaggagcagggatgaggacagatgcccaggcgtgtggccctccccccttaagcccatagccaagcagctcaccacttaccctctccgccgtggcgaccccgctctgaccaggtcttcatcnnnnnnnnnntcaggcgtgtgcccctcccccttaagcccatagtcaagcagctcaccacttaccctctccgccatggcgaccccgctctgaccaggtcttcatcaccgagctgggctcgcccaacgagcgggtggtggagctcagcgcgcaaggcgtgaggctgtccatcaagcacagcatcatgcaaaagtcggtgctgcaggaggcgctcaggcgaggcagtgcatgggaagaagatcgatgaaggatagtggtcgccttgctctgtgtcactggcatggtgctgatcatccccatggtgatgtgcgctggatggtcaggcacagcgtagctgatgcgtccctctgtatgaacctcctttgtccctaggcccatcctgacggacctggccttctaccacaagctgaccctgcagctgctcacccacctccaccacctcctggtgggtgcacgcaatctatgtggaggcggtgtggtgggtgtcgattccctggcggcgttgtacatgtctgcgggagacccaccttgtgaagtgaccctctcaacaccctcccaggacctgctgtcgggtcagttcaatgtcacgttgggcgagaagatcacggagcacctgaagaagtgggtggacgcggagaagtggatcagcccccagccgccacagccggtgggttgctatagtggggtggggtggggagggatgcttgatatgcgcagggcatggtaggcaggggggaagggcagactggtggcatgtggcacttgcggtcatgcgctagtttcccatcccaatccccccccacttcacgcttccaggtgnnnnnnnnnncgcgcacggcatggtaggcagggggaaagggcagactggcggcatgtggcacgtgcggtcatgcgctagtctcccttcgcaatccccccccacttcacgcttccaggtggcctgggagccgggcacggagtgcgaggtggctgcctccatgctggacatcttccacaagctgccggcgcaggccaagcgtttcctggagtcccagggtgcggagcgttgggtgttgagggctggtagattggatcatacaatcctgtgaaacgcctgggcagttttgtggcagacactgcattcttgaaaaggaatgaggggcagcctggtcgcgataccgtgcaaatgtgccctactacaatccgggtaaacagtgcccaaggtttcccaactcccactcgcgcccccctctgcctccaccctgcttccctccccagcccctttttccccctttctcacatccatcgtcctcccaccttgtcgtgccaggggaccggcccggcatcgtggtgctgacaatcgggctggagaacgcgctgcccaagctcccgggcccactgcagccctcgcgcctgacctcgccctaccgccccgcgctgacgcgcttcctcaacgtgtacccccaggacaccgtcgactacttcctggatgtgtcgggtgaggacttctctgtgtttgtgggcgagggggggggggccgatcactttgggggtcaggggaaggggggcggtcacaagggcggtgcatgatgccgtacatggtcgacaggaagggactctgatgccctctgcgacgtccaggaccacttgcagcgcctggtttctataaacgtggcagggcctggttgacctcacacgcctgcccctcccagacgaacacccaaccaccccaacccctgtcccacaggtcggctggccaacgccgagtacttccggcggctgctggacgtcatccgcacgcctctgggtcggcccatcctggacgccctggccgggcaggccactcgcctcgcgctgctggtccgccccgaggcctctggcggcgcggacggcgtcgccggcgaggccgcaccagtcccgctggaggctgccctgcatgtggtacacctcgtgcgcgccatgatcaaactgctcccggactggctgccgcacgagctgtatgccgtgctgctcgcaaggtggcgctcgcctggccgactggagaggtgggttttgtgtgttgttttggaggggggtggcctggaaggtctctggagggagggccgaggagtgctgacgctccgcccatcaacgcaatcgcatggcatgatgcgcaccctgcaactccctcaaaacacccacggcccactgccgtctcagggcggaaaacgggtgcggcacctcgcgcgccgcggagcgcgagagccgccggctgggcaagtgcctgctggcctacgtggacgcgcaccacggggagtacgccgcgctctttgacctcctcaccatcctctccaccaagccatgtgcgtgggggtggctggggtgtcgtcagtgggatggatcgggatgccgatgtggatgctgaagttctgagtgttttcatggtggggccctgtcttggagatgagccctgggtcattgctcgccggtccaggctcttttgggccagcatactccgtgtaggactccatgcactcaaccctcctgacgcacacgcctcctctgcagccgtgnnnnnnnnnnattccgagtgtggtcatggtgggaccctgccttggagatgagccctgggtcattgctcaccggcccaggctcctttgggccagcgtactccgtgtgggactccatgcactcaacccccctgacgcacacgcctcctctgcagccgtggactttgggtttgtgaaggagtacctcacgactaccgttgccaagacatacaacaccgaggagaaacgcacggtgggtagggtgggtgagggtaaggtctgagagggcggcgctgccttacatattgggatgtgtgcagggcagtctcgccgctccaattggcccagcgcctctgagcctcaggtgcgcacataggtgcagctccatcctttcctcccttacgttatctctccagatccttgtgcactggatcaagctgtacaaagagagggcgctgtcccccgacgatcaaggtgggaatcagcgggggaggtcgagacgcactctgtgtgccgatgctggcccatccgatgcagcnnnnnnnnnnggaaagagcgctgtcccccgacgatcaaggtaggaatcagtgggggaggttgaggcgcactctgtgtgccgatgctgggccatccgatgcagcatcttcagctcaacctcccatcaacccgctacgaacatttccatccccgcagtgaacgcgctgcggcacttcatnnnnnnnnnnggcttcagttcaacctcacatcaacccgctacgaacatttccaaccccgcagtgaacgcgctgcggcacttcatcaaccccctgatgaagtggacgctggccagcgagggccccggcatcctcaccaaggacatcgtttcttccctggtggcagacgtcttccagacccctgaccagggtaaatggggtgtccagggtctggctttggatggctggtggacgggcgacccgcatgcttctggcaagcatggcggccatgaaccgccctttcccccctcccgcaggccgacccagtgagcagnnnnnnnnnngatggggtgtctagggtctggctttggctggctggtggactggtgacccgcatgcttctggcaaacacggcggccgtgaaccgccctttccccctcccgcaggccgacccagtgagcaggcccagcaggagctcaacatgctgtgctccacgctcatccagcatgcgcacacgctattcgtggaccaccgcaaggagctgatccactttggctggtgggcgaggggaggggaggctgtcgaggggggggggtgtaaagaggcgtggtggtggacaacccagtggtctggagagcatcggttgggcagccacgagtgcaccggctggatgggcatgtgggtgcggttcagtgtgcacatggcccccagccactgaaacccccctccctcctttctaaccccccttgctgctgtctccaggtgggcgctgaagtttgacaacgtggccaagccctccgccttcctcttcctggcccacttcctgcgcgtgttccccacccccgagaagatcatgctgcaggtgtacgtggccctggcgcgcatgacgcagcaggaaagcgcggcgcgcgacgtcgtgcgccaggcggtggacacgctgctgcccatcttcaacgcggggcgcgcgccgggccaggagccggagacgcccccctccggggacgcgtcgctggt

SEQ ID NO: 39770 - DNA, 77 bp, Chlorella protothecoides
cccatgcacaccaccaacctcgcctcattcttcaggtgctattggagcggctccccccccccccccccccccccccc

SEQ ID NO: 39771 - DNA, 64 bp, Chlorella protothecoides
gggccccgggtttgggcggtgttcgtccagcagatgtggcagagtgcatcccctccgacccctt

SEQ ID NO: 39772 - DNA, 76 bp, Chlorella protothecoides
tggcagctagccctgtgtcagtagatgaccagggacgtgagtccaggatctggagacaatctggtgcacagccgtc

SEQ ID NO: 39773 - DNA, 9138 bp, Chlorella protothecoides
  modified_base (87)..(174): a, c, t, g, unknown or other
  modified_base (304)..(313): a, c, t, g, unknown or other
  modified_base (673)..(682): a, c, t, g, unknown or other
  modified_base (861)..(870): a, c, t, g, unknown or other
  modified_base (2307)..(2375): a, c, t, g, unknown or other
  modified_base (3568)..(3577): a, c, t, g, unknown or other
  modified_base (4154)..(4163): a, c, t, g, unknown or other
  modified_base (4355)..(4364): a, c, t, g, unknown or other
  modified_base (5575)..(5584): a, c, t, g, unknown or other
  modified_base (6486)..(6495): a, c, t, g, unknown or other
  modified_base (6606)..(6758): a, c, t, g, unknown or other
  modified_base (7395)..(7404): a, c, t, g, unknown or other
  modified_base (7478)..(7487): a, c, t, g, unknown or other
  modified_base (7694)..(7703): a, c, t, g, unknown or other
  modified_base (8280)..(8289): a, c, t, g, unknown or other
ggccgcaccctgtacggcttcggcgcctaatcctgcgaccgtaccaaaagaatcatctggtgttattaaacaccaccataccacggnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgctgaagtaatttggcaaatcctggttacaggcatcagtcaaaaggggttgctggattgtgaggtggatccagttgcctggattcatactgtaactgtggtcaactgcacagtgatctccatcttgnnnnnnnnnnaaatacatatattgagaccaaaggaatcttggcattctatagtcactggcaacaaagcgagtgctgaagtaatttggcaaatcctgggtacaggcatcagtctaatggggttgctggattgtgaggttgacccagttgcctggattcctactgtaacggtggtcaactgcacagtgatctccatcttgtactaggttgtcatacttgattgaaaagatgttgagtggtgttcctttgcaatgaagtaaaagagtaatggacatactggtggtttttgcccttcagctcatctcggtcgcatgagtgcggaggcgcggccccgcgccttaagttcgcaacttggtgttagttccctctctnnnnnnnnnnagtttctgcccttcagctcatctcagtcgcatgggtgccgaggcgcggccccgcgccctgagttcgcaacttggtgttagttccctctctgtggcgcaccatatgccctccagaccgcgatgcatgtcgatgcacatatgctaaaaatgcgatactttcagcttgccagttgatacgtnnnnnnnnnnaaccgcaatgcatgtcgatgcacatatgctaaacaggcgatactttcagcttgccagttgatacgtcgcgactaggatacatcaccacccaccccggtctgtgaggaacaaatactcgtacggagtttgccacagaggcgtccctgtcgactgtgttggcactcgtaccctgccgcatgtctaagaacaaggggctgtggggcagcaaaggctggaagcgcgtgaatgtggcggatgctctcctggacacggacgaggacggcttcgtggagctggagcaactcgacggggcatacatgggtgggccgtggcacatggatgcatgcgctgtggtttttttgcagtgcatcttgaactcagtaggagtttgcattgctgaacaatgccgctttcccctctggcaacaggcaaaatcttccaggcacccagcggcccagatgtcctcatcccgccggaggcgccggccctggggaccagcaagaagcggaaggcatcgttggcgaccaccaccactgccttgccggtggaggacatgcgtgcccagctgcggcggctgaggcaagagcaacgcgccctgtctgcgcagctgaagcaggccacccgggcagtgggcggcgccgggtctgaggctggcgccgaggcggggagcccagaggggccgagcggcaatgacgacgctacggcgctggcggccgcgaagcctgtcgccttgccgtcatcctcggacaagaagaaaaaagcaaagaagacaaagaagaaggccacttctgcagaggctgtggcgccgtcctcccagaccaccacacccactcccccagtggacaccagggcctgggaaggcctgggcctgcacgaagaaatcctcggcgttctcagcacctgcggcttctcggcccccaccgcggtgcaggtggcctgcctgccgtccgcgctgcgcgatcgccgggatatcatcggcgcggcgcagaccgggtcggggaagacgctggccttcggcctgccaatcatgcaggccctgctgaatgagcggcacatgcagacgccagctgcggcggaggagggtcccagcgaggggccgagcgaggagggccacggagacgaagctccggcccccgccgccacgggtggaaagcgccgcggcgcactgcgcgccctcatcctggcgccgacgcgcgagctggcgctgcaggtctgcagccacctggaggtggttggccgggcactgggcgtgcgtgttgcgcccatcgtcggcggcatctcctcccagaagcaggagcgcctgctggcgcacgcgcccgaggtgagggatctgtggggttggggttaagaagggggttgaaacctgtctctctggctttccctgcaagcgccggcattcaggatcttagtctcgaaatctcagcctggagaatgaaaagatggtatccaacccccccnnnnnnnnnnnnnnnnnnnnnnnnnnnnnnnnnnnnnnnnnnnnnnnnnnnnnnnnnnnnnnnnnnnnncgtccttgtccacccccctctccacaccccaaaacaaacccacctccctccctaggtcgtggtggccacccccggccggctgtgggaccagatgcagtcgggcgccgcccacctcaccgacttctcgcgcctcgctttcctggtggtcgacgaggcggaccgcatggtgcagcagggccattactcggaactgggcgagatcttggggcgggtggacggcggctcgggcgaggacggcggccccgcccccggcgcgccgcgttccatgcagacgatgatcttctcggccaccctcaccctgcctgccaacctgcgccaccgcctgaaaaaggtgaggcgcgccgaggaggctttggaggggggatgaaggggtgttctttgtcagatggtgatagaattgttgtaccggagggttgtggcatgcagttgtgcttatcgggctgatcaagcagctgccggccccttgcaaggaaggccatacttattcctcaccccccccccacacacaccttacaaacacccgcctactacagggtggcggcggcagcagcggcagcgccaccctggactcgctgatggaccgtgtgcctttccgcgggcgcaagcccgcggtggtggacctgaccacgggcatgcgcgtcgcggcgcgtgtctccgaggcccacctttcctgccctgaggctgagcgtgacgagtacctgtactgcctcctgtcctgccacccgggccgcaccatcgtgttcgtgaacgcggtgtcggcggtgcgccgcctggcggccatcctcaagctgctggccctgcccgtgcaggcgctgcacgcgggcatgcagcagcggcagcgcctcaaggccctcgaccgcttccgcgccgacgcggcgggggtgctggtggccaccgacgtcgcggcgcgcggtctggacgtgcgggatgtccgctgcgtggtgcactaccagctccccgcctcgctggacacctacgtgcaccggtccgggcggacggggcgggccagcgcagagggactcagcttggccatggtcacgcccaaggagcaggcgcgcttcctggccctctaccgcggcctgggcagggaagtgcccccggagttccccatcgtgagcgtggaggagggggctggcaatgattcgggaagggaaggaggaggggggtgggaaaaggacgcggtgggcagccgnnnnnnnnnncctggcgatgatttggggagggaaggaggggtggggtgggaaaaggacgcggtgggcagccgaacactgggcctggggattcgggcacggagggcgggcaacggcaagcagcagcctgctgctcaacgctggcggtcaccaacccccgcgcatgtctgcgcaccccacctccgcacctcccctttgcgtgggtacccagcgtctaccactcacccaacgtccctcctccaccacaccaccccccatccaggacctgtcgctgctgcccgccgtgcgcaagcgggtcaggctggcagtcaggctggacgcccacgagcgcaagcactccaagagctgcgcggaggccgcctggcggagccagcatgcggaggagctgggcatcgagctgagcgacgaggagctgagcgaggacgaggcggccgcgactgggcgcaggggcgggcggagagggcaggcactggaggcgggggaccgcggggttgacggcgtgatcgccgcacaggtatgtttattggttgttttttatggagggaaggggagtaatggggataaggggggggggggggggggggggggnnnnnnnnnntggagggacaggaggggcccatggctgaggaaggggggtggaggtcattgatgaagcgctgagcagtgcttgtttcggaggtgtcggcgcacaccaggacattggcacaaccggcttgagtgcgcctgccaggccttacgccccccccccaccatcacttgaaaaacgcagaggctgcgcgccgagctgggnnnnnnnnnnacgcacaccaggacattggcatgaccggtttgagtgcgcctgccaggccttacgcccaccccccaccatcactaaaaaacgcagaggctgcgcgccgagctgggcgcgctgcttgcggagccgctgcagcccgcgtttagccagcgctacttcaccgctggccaggcctcggccgtggcggcgcacgccgggcagcccagcgcgcacagcgtgaccacctcctccgtggcgctggcgcagtccctcgccgacagccgcgccgcggcctgtgcggccgcggcgggcccgccccgggcgaagaggaagaagaaggtcggcgtggatccgcgacaagcggcgctcgccgccgcggtggccaaggctgcggcggggcgcaagaggtcgcgcatgctggtggtccctgcctcgggggccggcgcctttggccggagcaccacagggcccgacgcgctgcaggcgctgcgtgcctcgcggcagtgagtctgggaagcgtgaatgggcccggccgggtgccaccgcagaccctcctgttcagaacaattgccttgttgtagccagtgatcccatgtcacaccccagccagatggcgttgtgccttgcaaaagtgggacgcggctgggcacgccggcgtgccaacaaggtcgaggagaagggcaggggcagactcgaggggagtgcagcagtgtgacgcgtgagcgagagcaggcaagtgtgaacaagcgcaagggggggattgccaggggggtcgccgctgtcgtcgagggcgagacagcgggggcgaatgtggcggcttattgcgagggaaggtttcttcatgagggggggactcccaagcttgcacgcggaaaaaactcctcatgcggctgccgccctgggtcggcgtgcgtagaagaggatgtaggcgtactgtgacatgacctgcagtggtggtgtggaggggtagggtcctgatgagcaggaggagggccccgactggacatgtccaggctcctaccttgccctgccagcacatgtgcacatctcaaaatgggcgcgtgccttgcattggttcggtgtcacacagaagtacagacaccgcccctcattccctcgcgctgctcatccctgggagtctcttcaactaccctcccctcccaaaagggaagaccctgcctcaacacttcatccaaacttcagaccacccccccaacacacacacacacacacacacnnnnnnnnnntgcgctgctcatccctgggagtctcttcacctaccctcccctcccaaaagggaaaaaactgcctcaacacctcatccaaacctcagaccacccccctcacacacacacacacacacatgtgtgcgagcataaacacacctggtcctccgacacgcgattcacaaggtcgtcgttgaagcaataccactcgccctcgggcgcctgggggctctgcacgcggcacatggcggtgtagtgcccccccgacaggttgccgtagtggttggacacggcgtagaggtcgtacagcgcgccgccctcccccgccaccagcgcctcaggcgagaggtaggtgtccagggacaggcccgccagcgggtaggacacggaggccgtcagcttgtcggtgaagaagccgcggtacttgaagcgcttgatgtgcagcaccaggatctggggcaggcgctgcaggcgcaggtgcttggtggcgggggttttggccttgcaaacctcgcagctgaaggcctcggccccctggggaggagggggatttgggggggggaggagggagttggtgggtgggagggtgtgggttggtgtgaatccagcaggccatagtgtttggtgcgccgaatagagacgtgcgctggtccatccgggacggcgaggaagccacggcatgtacagacgcctgtccggcaaaagtacatccaccagggcacccacctatagcttttcgtcggccgcaaagacggtgaggcagtcgctgatgctggccggcgagcccttgatccccagccacgacaggctgctctgcttgcctgcagcgggtgaagggagcgaggctatgctgaagagggatggaaaaggggcggtgcaggatgcgcacacttcagcagcaaaatgtacagatcatggatctnnnnnnnnnntgtgggttggtgtgaatccagcaggacatagtgtttggtgggccgaatagagacgtgtgctggtccatccgggacggcgtggaagccacggcatgtacagacgcctgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctgaagagggatggaaaaggggcggtgcgggatgcacacacgtcagcagcaaaatgtacagatcatggatcttaccacagtcaagctcagccccatgtgaattcaggcaagagcccgcggtatgctcaacatactcaacacaagaacgcagccaagatcatatgtaccctgaaagaaccaccttctttggccagaggaagtgacaggtcccagaagggctcgtacatcgtgaaccggccgttgcacttgtggcatgtaatggaactctgagggggatagagggtgttgggatgggtggcggcaggtgggttgccagtcatgcccaagcgagtccccagcgtgtgcggcagcgtggagagcgcagctccatcctactggtctcgagctgcacgccgcgcggcgcccatgcctgctcccacaccgatgctcgctcgtcaaatccatccacagcaacccaccaacctgcaactgccccccgaacagctccgtgacggtgctggaatcgcgctccaggtactgcttccagtgcctgtccgccttctcgggctccgactccgggaagagtggggaaggtggcacgggcgggaagccgggggcaacggtggacggcgaggcaggcggaccagcctcctcnnnnnnnnnnacgcgcggcgcccatgcctgctccgacaccgatgctcacgcgccaaatccatccacagcaacccaccaacctgnnnnnnnnnnaccctccgcaggcgctggcggcggcagcggtttctggaggtggggtgaggcgagtgagggaggggtcggggcacagggcctttccctggcactcgtgagccccggcaacggaaacctcccatgaccccgcagcaggtgcaccagagcacgcgcctccgtttgcacccaacctctcaagcctctcaccaggtcgtcgtggaggagatnnnnnnnnnngccctccgcaggcgctggcaacggcagcggtttctggaggtggggtggggcgagtgcgggaggggtcggggcacagggccttccctggcaactcgtgagccccggcagcagaaacctcccatgaccccgcagcaggtgcaccgaagcatgcgcctcccttcgcacccaacctctcgagcctctcaccaggtcgtcgtggaggagatccatgagcacacgcagcacctcctggcagtcatgctggccgccgtccaggaattcggcggccatggggaagctcttcagcgtgcggatgaagtgcatggggtccaggccgccggccccactctgcgcgggaattcgtggctgagacggtgagcaggagggcgggtgacagggggcacgagctcactgggcgggcgggtgagccgctcatgcccgagtgtgctggcagcccagcgagctgccggcgaccgagcagggtcatgccccgtcacagctgcacgacccagcgcctcagaccggggactgcaggcggcatggtccaggcggcatgcatgtccatcgagaaacagtctgcggtcacgcgacccgcacnnnnnnnnnntccagcgcctcagaccggggactgcgggcagcatggtccaggcggcatgcatgtccatcaagaaacagtctgcggtcacgcgacccgcacactcacgtggaggtagagcttgaggaccagctgcaggaaggaggccaggagctcgccccgcgggggccgttctgtggccttgggtgcgggcgccgacggggctgcactcgcttggagcggccccgaccctgcggctgcttcgccagcgccggcgggcgcactgggtgtcgcctcctcctcctctacctggggctttgaggaggggggcaatgcgccgtcaccctctcctcgtcgtggcgctcgagcagcctcgccgccaggccctccgtcctcggccagggtttgcgtggccacggccaagtcgacatcctggccaccgccgggcccctcctcatcccgccccgtcgcatccgcgtctgtcacggccggccccgcccccggctcgtcagctgcagtcgcgtccgccgccggctcctccgccacgcggaacagtccagcatgcacggcgctgggttgctcccctggcgatgcgtcggcgccagccccgccgcccgcatcggcctgatccccccccacatcggcggggggctccgtcgcccgactccctgccgccgcggccccctcctcgcgcgccagctgcgcttgcgccacggcaagcgaggccgcggactccagcgcaccgctgcgatccgtggacgcgcgcgccagggcgtgcacgtccaccgaccccggggcctcgccgggatcaaccatggccgcgcccccgccgaggcccgcggcacctgccgcggctgcggcgccctcagcggcgacggccgc

SEQ ID NO: 39774 - DNA, 123 bp, Chlorella protothecoides
tgatgcggcacctggggcgcaaaacacggcgcagtcccccatgagggtgaaacacgagtggcctttggccgccgtgcacacacaccccacgttgccccagtcctcctctgcagccctcacctg

SEQ ID NO: 39775 - DNA, 317 bp, Chlorella protothecoides
tttgggtaatgcaggggctccctatatctggtatagctgatccgaacataatgatggcatgaaggtataggaaaataagagcaatcccaatgtccccgacagaatgctttcggggcactccctcaggtgtcatcccaccactaccacttgagtgattcctggtccacgacgtgctgacagaattgctgggatgtggacctcgcgggcatcctcactttgtgaatggtaaagctcccagtatataccacggacaacagcgtccaggtgtaaggcataggagtccttggctactatttgccaagattttgatgtgagga

SEQ ID NO: 39776 - DNA, 61 bp, Chlorella protothecoides
cccaggagcatgccaccaggccccctggtggcaaacttctcctgcagccagtcgtctcatg

SEQ ID NO: 39777 - DNA, 97 bp, Chlorella protothecoides
acgctacactttaagacctcatcggctaaaattgagttccacggctttcattcattctcgtggccgacgatctgtagtgaaacaccagacctggagc

SEQ ID NO: 39778 - DNA, 73 bp, Chlorella protothecoides
ggcacccaagcccgatgccaaggtttctggccacacatgtgctcccttcctcccgtcctaagatccctgcgcc

SEQ ID NO: 39779 - DNA, 61 bp, Chlorella protothecoides
tacccctggctgtcttccctcgtgttgggcacctgcccctcttcctgccgtccgtatggtt

SEQ ID NO: 39780 - DNA, 61 bp, Chlorella protothecoides
ttccgtttgttagtccagttttgtggaaggggggatcccccgactttgatctatcacatgc

SEQ ID NO: 39781 - DNA, 61 bp, Chlorella protothecoides
tcgccagcatctgcacacgattaccctcctactcccaaacgcctccgcaggtcctccaccg

SEQ ID NO: 39782 - DNA, 53149 bp, Chlorella protothecoides
  modified_base (300)..(309): a, c, t, g, unknown or other
  modified_base (693)..(702): a, c, t, g, unknown or other
  modified_base (1111)..(1120): a, c, t, g, unknown or other
  modified_base (1494)..(1503): a, c, t, g, unknown or other
  modified_base (1870)..(1879): a, c, t, g, unknown or other
  modified_base (2357)..(2366): a, c, t, g, unknown or other
  modified_base (2623)..(2632): a, c, t, g, unknown or other
  modified_base (2984)..(2993): a, c, t, g, unknown or other
  modified_base (3198)..(3207): a, c, t, g, unknown or other
  modified_base (4095)..(4104): a, c, t, g, unknown or other
  modified_base (4379)..(4388): a, c, t, g, unknown or other
  modified_base (4590)..(4599): a, c, t, g, unknown or other
  modified_base (6006)..(6015): a, c, t, g, unknown or other
  modified_base (6616)..(6625): a, c, t, g, unknown or other
  modified_base (7472)..(7481): a, c, t, g, unknown or other
  modified_base (8153)..(8162): a, c, t, g, unknown or other
  modified_base (10973)..(10982): a, c, t, g, unknown or other
  modified_base (11502)..(11511): a, c, t, g, unknown or other
  modified_base (11801)..(11810): a, c, t, g, unknown or other
  modified_base (11896)..(11905): a, c, t, g, unknown or other
  modified_base (12098)..(12342): a, c, t, g, unknown or other
  modified_base (12428)..(12437): a, c, t, g, unknown or other
  modified_base (13836)..(13845): a, c, t, g, unknown or other
  modified_base (14107)..(14116): a, c, t, g, unknown or other
  modified_base (14466)..(14632): a, c, t, g, unknown or other
  modified_base (15115)..(15124): a, c, t, g, unknown or other
  modified_base (16011)..(16020): a, c, t, g, unknown or other
  modified_base (16917)..(16926): a, c, t, g, unknown or other
  modified_base (18072)..(18081): a, c, t, g, unknown or other
  modified_base (19421)..(19430): a, c, t, g, unknown or other
  modified_base (19984)..(19993): a, c, t, g, unknown or other
  modified_base (20677)..(20686): a, c, t, g, unknown or other
  modified_base (20862)..(20871): a, c, t, g, unknown or other
  modified_base (21240)..(21249): a, c, t, g, unknown or other
  modified_base (21849)..(21858): a, c, t, g, unknown or other
  modified_base (22614)..(22623): a, c, t, g, unknown or other
  modified_base (23528)..(23537): a, c, t, g, unknown or other
  modified_base (24541)..(24565): a, c, t, g, unknown or other
  modified_base (24781)..(24790): a, c, t, g, unknown or other
  modified_base (24873)..(24990): a, c, t, g, unknown or other
  modified_base (25736)..(25745): a, c, t, g, unknown or other
  modified_base (26600)..(26609): a, c, t, g, unknown or other
  modified_base (27082)..(27091): a, c, t, g, unknown or other
  modified_base (27941)..(27950): a, c, t, g, unknown or other
  modified_base (29022)..(29031): a, c, t, g, unknown or other
  modified_base (31177)..(31186): a, c, t, g, unknown or other
  modified_base (31891)..(31900): a, c, t, g, unknown or other
  modified_base (32122)..(32137): a, c, t, g, unknown or other
  modified_base (32510)..(32519): a, c, t, g, unknown or other
  modified_base (33022)..(33031): a, c, t, g, unknown or other
  modified_base (33812)..(33821): a, c, t, g, unknown or other
  modified_base (34999)..(35008): a, c, t, g, unknown or other
  modified_base (36104)..(36113): a, c, t, g, unknown or other
  modified_base (36501)..(36510): a, c, t, g, unknown or other
  modified_base (37174)..(37183): a, c, t, g, unknown or other
  modified_base (37584)..(37593): a, c, t, g, unknown or other
  modified_base (40050)..(40059): a, c, t, g, unknown or other
  modified_base (40217)..(40446): a, c, t, g, unknown or other
  modified_base (41092)..(41101): a, c, t, g, unknown or other
  modified_base (41760)..(41769): a, c, t, g, unknown or other
  modified_base (42776)..(42785): a, c, t, g, unknown or other
  modified_base (43746)..(43796): a, c, t, g, unknown or other
  modified_base (43929)..(43938): a, c, t, g, unknown or other
  modified_base (44004)..(44013): a, c, t, g, unknown or other
  modified_base (45272)..(45281): a, c, t, g, unknown or other
  modified_base (45840)..(45849): a, c, t, g, unknown or other
  modified_base (46490)..(46499): a, c, t, g, unknown or other
  modified_base (47482)..(47491): a, c, t, g, unknown or other
  modified_base (47784)..(47793): a, c, t, g, unknown or other
  modified_base (47913)..(47922): a, c, t, g, unknown or other
  modified_base (48142)..(48198): a, c, t, g, unknown or other
  modified_base (48990)..(48999): a, c, t, g, unknown or other
  modified_base (49282)..(49291): a, c, t, g, unknown or other
  modified_base (49676)..(49685): a, c, t, g, unknown or other
  modified_base (50843)..(50852): a, c, t, g, unknown or other
  modified_base (51662)..(51671): a, c, t, g, unknown or other
  modified_base (52179)..(52188): a, c, t, g, unknown or other
  modified_base (52693)..(52702): a, c, t, g, unknown or other
cggcgccgctgcgccccgcggacgcgcacccggccgccggcgccaacggcgccgcccggcccgccacgtccagccgcgcgacgtctggcggcgaggacgacgacgacgacgaggtggaggaggacgaggaggacgaggatgtgctggcggagggtgatggcgacgacctggacgagggcgaggagggggacagcggggccggcgaggaggatgacaacggcgagggcgtggagctgccgcccccgctggacccgctgccggggcaggagagcgccgactccgaggccacccagccctcgnnnnnnnnnnacgaggagggggacagcggggctggcgaggacgacgacaacggcgagggcgtggagctaccgcccccactggaccccctgccggggcaggaaagcgccgactccgaggccacccagccctcgggcgacggccaggccggcggcgtggaggtggtgccctggaggtgggtgccagggaaggtgggggggcggtgtgcgcgagggggcgcgcacaggatgtgcccgggaggggtgtccggcaggctgggccctgggcggcatggcacggagggcgcgagcggggcgcgaagctcgcgggcgtccacccaggcgtgtgtgcgtgcactgttcaagacccggcgtccccacccggcgccaggtcccagcgcggtcccctgaagacgtnnnnnnnnnnacggtgtgcgagggggtgcgcacaggatgcggccgggaggggtgtccggcaggctgggccctgggtggcatggtacagagggtgcgagcggggcgcgaagctcgcaggcgtcgacccaggcgtgtgtgcgtgcactttttatgacccggcgtccccacccggccccaggtcccagcgcggtcccctgaagacgtgcacggaggccgagttctacgcagacctctccgccttcctgaaggagcgcaaggtgaggcggaggtgtgctgccgggctctgcgcggtggggacgggcctgaggggcctggcgcctggctgcaacgccctgcatcacgcccctgcctcctgtggcggcgcatcacgcgcgggtctggccgacacggccaccatggtgtgggcatgtgcactgagnnnnnnnnnngcgcacgggtctggccgacgtggccaccatggtgtgggcatgtgcactgagggatccgccctgctcagccgccctgcaccccttccctcccaccccccacagggccggaccagcgggttcttcccagtcctgaatgccctgcagcttgacctcttcaacctgtacaagtgaggggtcgggggtgtgtctgtcgcaattgcttgggctcgccatgaaccctccctggccacagaggtttgggacactgtcggtgcagtggcttgcatcattttcaatgggaaccatggtgggcgcagcggggctgtgacctgcggtgagcctgctcccccgccccctccccttcccccagggaggtgtgccagcgtggcggcttnnnnnnnnnnctgagcctgctccctcgccccatccccttccccagggaggtgtgccagcgtggcggctttgccctgggcaacggcatcaactggaagggccaggtgttccccgccatgcggaacttcacgcaggaccaccgcctgacgggggtggggaacgcgctcaagcgccactaccaggtctgcctcctggattacgaacaggtgagcacctgggcgggatggacaggagaggggcccagggtgagaaggatctgggcttgacaacaggcgcatgctctcgtggttttgtgcaagtatgggcaggggccggcgcaggggcagcctggtctgcttcacctgtcactggtcctcctgcgacctgtcaaacgtcgcnnnnnnnnnngggagaggggccgggggtgagaaggatctgggctcgacgacaggcgcatgccctcgtggttttgtgcaagtatgggcaggggccggcgcaggtcagcctggtctgctgcacctgtcgctggtcctcctgcgacctgtcaaacgtcgcacaacaccgtcccaggcgcaacccccttccctcgatgctcctggcccccctcattcgcaggcaaaccccgacgacgtcaccagcggcaactgtctggtgtgcgggcagggcgcaggggacgactggatctcctgcgacaactgcgaccgctggctgcacttctcgtgcgacaagcgcccccacccaggtgcgggctgtgagcctgcgacttggcgtgccgagaggcacgtgacgtttggtggtgtgtgcccacctccatggccgcccgttcgctggcgagtgtcggtgccggcggggcacgtcactcgcggcacggcgggccccgggcaannnnnnnnnngggcacgtgacgtttggtggtgtgcccccacctccatggccgcccgcccgccggcgagtgtcggtgccggcggggcctgtcactcgcggcacggcgggccccgggcaagaccgccgcctgatgcagtccctccatcgatcgatctccggcatgcacctgcccacgcacaaagcatgcacacctccgtgcgcgctcgcaccgcatggagccacctgtcaacgccgcaccccgtcctctcaccaccaaccccgacaggnnnnnnnnnnagatcgattgatctccggcatgcaactgcccacgcacaaagcatgcacacctccgtgcgcgctcgcgccgcatgaagccacctgtcgaccccgcgccccgtcctctcaccaccaaccccgacaggctccttcaaagactactccaagcgccacggcctcaagtttgtgtgcggcccctgcaccgacggcatggagtcggacgctgcgcagccctcctccgccggcaagcccagcggccccagcgggcccaacggcactgcccaggatcatggggcgacttcctcaccccaaagccacccgggaacgaaccttgcctccgcttccaggaccggatcgacctacctcccctccnnnnnnnnnnagcccaacggcgctgcccaggatcatggggcgacgtcctcgccccaaagccacccgggaacaaaccttgcctccgcctccaggaccggatcgacctacctcacctccgctgacgtgccccagttggggccccagtgaagtcaaaatgaacacataggaggtgtggggctgagcttccctgctacctgaacgctgccccaagaatnnnnnnnnnncagatgaacacatgggaggtgtggggctgagcctccctgctacctgaacgctgccccaagaatcccacaggaacgaacccgccgtgaccctttctcattccttggaatgcatgctgcccctcaacaggtcaccataccgggtgcttggcttcccaatccagcagcccagaccttccttcctgctgccagcactgcctgtgacccgtgtacgcgtgccctgcacctgatttcatgttggtgtgagccacagacacagtgccagatgaagcaggcagggcttcctcacggcgcatgcgggagcctgaccacgtggtagctgcggctgctggccccaaaccggatcacatcgccctcctgcagccggcgagggaccttggggcgtatccacaccccagagatgtttgtgccgtgcgctgcatggggtggtggggggaagatggggcttgggtgatgcatggttggagggacgagcccatgtaatgagttgggtgcaaggtgatgccacgccctgtctgaattgagctgcgggcctgcatgctgggcagtccaagcaaatcctcgcagaaatgtcgcccaccccccgcatgcctacccgatccgaggtctgtcagcatcgctcgtgagccgccttccagggtgatctgggcatgcgcgcgcgatatggacggatgctccaaggggacgtcgcagctgggcatccgcccaaaggtgcaggcctggcccggggctggaaggtcgactgtcagcgtccccagggtctcgtcatcgcgcagcactgtcagcagtatcgatagcgagggtccgagcgcagggtcaacaacaggctcatgcgctgggtgtctggcatctggcgactcctcccgcctcctcccactcccgcggccctcnnnnnnnnnnctcattgcgcagcactgtcagcagtatcgacggcgagggtccgggcgcagggtcaacaacaggctcatgcgccgggtgcctggcatctggcgactcctcccgccgaccctgctcccgcctcctcccactcccgcggccctcccggctcctgctcctagacctccctgacttcgggctccaggatcttctgctcctgggactccgggatctcctgctccttggactccgagacccattcctcctgtctctgctcctgtctctgcgctccccgcccnnnnnnnnnngggatctcctgctcctgggactccgggaactcctgctcctgggactctgggatctcctgctcctgggactccgagaccctttcctcctttctctgctcctgtctctgcgctccccgccccctctcctctcctctgccctcccacacctatacctcaagtcccctccccctttgggcggggagcctgcgggcacaaaggtggnnnnnnnnnngcccatacctcaagtcgcctccccctctgggcggggagcctgcgggcacaaaggtggcccgcgagcccaccccgacgccgctgcccgctccccgcgccggcgcagccgccggctcgtccccggcgtccgcgcccctggaccccgcaaacttgtcaggatcgctgcgctgcgccaggccgaggcgcgactccagcgcgcacacagcgcgccagaagccatcgttgggcgccgccacggagcgggcggctgtcacgtgcgccagcgcgcgctccgccgaccaaccccgcgagcgcatgaggtgtgcgatgaccagggtcgcggagcgcgagacccccgcgccgcagtgcacgagcacggcgccgcccctggcccgggccccggcgatgaagtctgccacggggtcgaaccagggcgcggggtcggccgtcgtcacgtccgcaagctggatggccaggcgggaggggccggccgccacggccaggttctcggggttgttgtggatcgtgatgatgctgtgcgaggggagtgaggcggggggtgggagggtgcaggagaggcagggcctacgatgtgcatgcatgcaacccccccaggtgcaccattcaatgcttgccgtgttcacccccgtgctcttcattcctctgagctcccaggcatccaggaccttgcagccgccacccacctccgcactcccagctcctgcagcctgtcggtggcctcggcagatgcccagtcccccaggtaaagccccggctcaatcagggagggatacctgcagggatacaagagcgcatgaggggggccctgcaccacagcgccaccatccatgatgcctttgagaggtccatggcagtatgggccctggagcagcccctgggcgcgcgaccagccacaccagtaccttcggctggagctgggcctgacagaggcagtcgtcaggtaggggtacgcctctgccagatcaccaaatctggagcattgcatgatgagtgggagagcagcctttgggcaggatactatgccttgaagccctccgcaggccacttgtcatccagcccggcagaatgcagagcacacgcttgcccacttggggctgcgggcctgtcctcctcagcaatcaatcaccctcacggtccctcaacctcggcctcacccgtgcgggaaatattgcaggctcctggctcggccttccttggccaggaaggcgaccacagggtggtcctttcgcagcgctggtggcccaaagaggatcactggtttgtcccaccagcacccagtgctccacttgacgtcatactcgttcttgctatagtctgcgggggagatgtgatttttcgtgtgcaggctcattgatcattgccacgagccgttcagcagcacacacattgctgatactctgttacaatnnnnnnnnnntacattgatcattgctacgagccattcagctgcacacacattgctgatactctgttacaattcccctttctgccgtagcgctcaccaaccagggcctggccattcgatgttagtcggatgcagtaggacagtgcgatgtggcgcttgaggaattccttggctggccggagatccaccagcagtgtcagtgggtcctcgccgcagcgggtaaaggttcgaaagatggcatcgtgagcacaggaccgcacctccatcgcctgacaagcacacagggagtgtatcagtcagacttaagcacagatcttgtgagcattcaatcggattggtgagcggcttgcatcactccgagtgccggaggatggccatgtgggtggatcgccaaggaccgatcgatgagctgacacaatggatgctgtgaggttgatgggctgtgattataagtgagatgtggtgcgagtgcgcaaatgtgcgtggtcggtgccttcaccaggttcctcggtccaacccataatcggatgttgacatcgcgacgcgaggcctgcaacatatgggtcggacggcgcaagtactggtatggcgtcgtagatacgaacgagttgcnnnnnnnnnntgcgacgcgaggcctgcaacatataggtcggacggcgcaaatttcggtatggcgtcgtagatacgaacgagttgcaattccgccttttactgaatcgcaccgcgtatcttcgacacaacgccacattaagaatttttagttgacgctttgcgtcttaaacccacccccaaccacacaactcaacactccaaccacccccaatcatacatacccacacctacgattatcaatcatcacccccacccgtccactccatccaaacccgcgcaaagcctttgtgcccacatcatctgctgctcgatgcaggcacctctggctctcaactcgctcacagactgtgcatgttgtaagtcacatagttgtcgaccctgagggcacagcagggaggagccacgagagcacagcggggagaacctccctcgcctcacagctcgggcgccatgaaggcacggcgctgcgcgtgctcccccaccttcatgtccagcaggcggcggaacatgggcgcgtccagcacggcgtccttggagccgtagaccgccgcctgcaccgaggccatgaacttggccagctcgcgcccggagaagccctcggtggcggccgccgcctcgtccagcagcgcgccgtccacgcccttgacggcgatgcggtccacatctccgcggcccctgcgcgcgcgcggtggtgttgtggggggtgtgatggggggtccaagacgcgtggtgcaggcctctcatttcattggcagcgtgccggaagccccatgacccaacgcacgcacccaaccccgttttccccctccacacacacacaccaacaacgccagctcacctgaaccaggctcccagcnnnnnnnnnncggcagcgtgccggacacaccatgacccaacacatgcacccaacccctttttccccctccacacccacacaccaacgacgccagctcacctgaaccaggctcccagcctcgcaaacgccccggtgttgctgccagcccccgcgccgccctgcgcagtgcccgccttgaggatgtagcggtcaaagtagatgtccaggatgcgccgccgctcgtcggcggcgggcagcgcgaactccagtgcctcgtccatgcggtcgatgacggcggggtccaggtctgcggggcggttggtggccaggaccacgacaaagtcgcgggactggtcgccggtgcggaagagcatggcgttcagcgcgccgcgcatgccttcgctcatccccgcaccgcggcgggctgcgtgagtggaggcggggaaaggggggagggtccccgagaggtgagcagaaggaggaagggggtcactgtagagaggaagggcaggggctgggcgcccaatggggtgtccgcatgggagcgatgggggctgtgcccacgagatggagtgaggccagcgaggtgcagaggatgcagaggtgcgggtgcccgggtgattctagccccgcagcaggggatcctccccacacaccccacgctccaagtaaagaagaaaacaacaacaccctggcactcacnnnnnnnnnngtggggcctgtgcccacgagatagagtgaggccagtgaggtgccgaggatgcaggggtgcgggtgcccgggtgattctggccccgcagcagggggtcctccacacccaccccacgctccaagttgagaagaaaacaacaacaccctggcactcacagaggaaggcatccgcctcgtcgatgaagaggagcaggcccttgccggagcgctccgcccagtcaaaggtgtcgtggatctgggtgacggcgccgccgcccaggggggcgacgtctccgccggacaggatggcgtagtccaggccggaggtgcgggccaggcgcttggcggccagggtcttgcccgtacccgggggcccgtagaagagcatgtggcggaagggcgcgccgtggcgcttggtgttggcggtcaccgccgccagcgcgcgcacgtggtcctgcagccgcggctccagcacgatgtcggagaagtcgcggcgcacggcctcggcggacttggaccccggcgcggcgcgcaggcccagcagcggacggcgcgaggtctcgcgcaccaggcgcggcgtgccaaaccagcggtccaccgccttgcccgccacgcgcgtgccctcccgcgcgccgtacacacccagcgctagcaggctggcgccgcccaccgcggccagcaggcggtcgcggtcgcccagcaggcccgccgccgcggcgcccaggttgccaaacacggtgttgatgccctccaccaggcgccgccgctcctcctccagcttctgcgccagctcgctgcggtacaggtcggcgttggcgcggcgctccgcggtgcgcccctctgcctccgccagagcgcgctcgcgctgcacctccttctccagccccgccttgtaggcctcggtcgcgcggcgctccgcctcgatctgggccgcgatctgcgcacgctccgcctcctggcgccggtgcgactcgtcctgcagcgccaccagctccgcgttacgcgcgcgctgcttctcgtgctccgcctcggcgcgcttccgcgccagctcgtcctggtactgcgccagctgggccttctgctgcgagtcctgctgcatggccttgcgctgctcctcccaccgcacccgctcgtgttgctgcgatgatgtggaggagggggggtgttgggggggtgtcagggagggggtgcccgggtgccaaacagcaaggtcggggccagatctatcgcagcagcgacagtgcgcaggggctctgcagaaaacacaggctacacgtgagcagcaaaggaaccctcacccaaacaatgccatccccacaaagccccattggctcacgatggcggccttctcggcctcggccttgaactctgcctccttggccttcagctccgcctgcttcgtggcctcctgagccttgatttgctcaaacacctgtggcatgggaggggcgaggagcatggatgggtggacttcgggcggcgccacaggggaggtcttgcagacagatctgatgatggttctgcatgacagtggctacgactgccaggtaatcatcaatgtgatgcaaggtgcgttcctgaccgtgacgccatttcccacgcggcccaacatacccaggcccacctttttcgcatagggggactggttgatctcccgtaaggccttggcacctctctccagggcctcgggatcaaagtacttgctgtcaggctcacagtaggccacggtcccgagacccgaggccacggccaggccgcccaggaccccggccttctttgctgcggcgagcatggccatgcttttgggtcacggggaagacagccaagcgcgggagaaagtgatgcggggcctggacccttccggatgcaaaataccgctccagcgaggacctgaaggtgagtctccacctgggaacaaaaaggtgtcgatggatcccagtcgataaaaaggaatggttgggtccattcatgcagagttgttgtcatcgctcctcacattgggagggagtggcgcgttcagggccgtccatgagccgcgtgctgagcccaccaccgagctcgatcacggtggatgctgggccctccccacccgcaccccgcccgcctgtaaggctgacgggagctacaaggctcccatggccgcacaccatgccggttgtaacttcacagggtggcccatggacctgcgcctcgtacatcgcctgaaaggggtggtgcaattggcgttccccgttgccgtggtgctggacaccctccattcattatggagggtccgacagcttgcagccgcccaactcaaggtgcgcgatgtgactgagtacatgccactgtacattttgcgccacctcacgcgcgagcggtgggcttaccgatcggagggctgggtccatgtttgacctttcccccccaccctccccaccctcctctgcacaggagtgggaggccgaggaagaccgggaagtcctcgagtctgtcgtgcctaagttccatcgcatgatccggcgctgcagacgggaggagggcgagctgtggctgggggtggcccatgccctcggttcgagcgggcacctgcccatgtcggagcatggcccggtccgtggctccgggtccccgatcccggcggccttccccccaatcccacacaccattcatggcgcgggtccagcggctccctcagcttccacagcccctgccgcggggttggagcatgcgccagcggcctctacaaggccacccacgcctatgcacgacggcccgaccgaggccccgcccgccggcgtcgagtacgtgacgctggaggacgcctgggcgcacacggtgtcccgcctggtgnnnnnnnnnntcatgcacgacggcccgagtgaggccccgcccgccggtgtcgagtacgtgacgctggaggatgcctgggcgcacacggtgtcccgcctggtgcccaagctgcccgacaccgtggaatacgtcaccctgtcagacgcctgcagcctgggcatggagctggcgacgggcgcccactcccagtcgccgttggccctgagggcggcgcgccgcctgtcccgccgcgtggccaacaaggggtcggaggcagccgacgccgccctggatgccctgcgcgcccgcctgccctggccgcaggcggtgctgacccggaggtcggcgctgcgctggagcctggagtggcacggcgtgcggcggcccgggcaggccgggcggcagcccctggagcgagatctctctagccacgcgtgaattgtgcacccgtcatatacccacacccactgatatcccctgatgcgcggcggcggtggtgaggccacgccagacccggcgaagtctgagtcagcgcgtgccccatggcccgnnnnnnnnnntcacacccactgatatcctctgatgcgcggcggcggtggtgaggccatgccagacacggcgcagtctgagtcagcgcgtgccccatggcccgcctcgccctgtactgtacatgttcgtgtggccctgcgcccctcccacgatccccatcctttcattcccgtgcccttctggcatgatttacatgttgctataagcttgcttccccttctggccccacgcttgaatcgtgggggtgctccctgggacgagcttgacccaattactcccgctccttgaccgatctggtgcnnnnnnnnnnatcctaattgtgaaggtagagtgggcggtgcgaggcagttgtgggagggggggatgacgagtcaccggaccatgggcaagtcggcnnnnnnnnnngtcctagttgtgaaggtagagtgggcggtgcgaggcaattgtgggagggggggacgacgagtcaccggaccatgggcaagtcggcccgtcgggcaggcaagcggtgtcatcaacgctggcaacgcggggcctccccacctgccccactaggacacctgacaccagcgaaccgatccatattccctctcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaccagcccgtgttcgcgtactttccgcccgcccactacgccactgcgctccccctctatgccattctcgtgctcctagcctgtnnnnnnnnnnacgacgcggggcctccccacctgccccactaggccacctgacagcagcgaaccgatccatattccctctcgtccccagcttgaaaacaatgcgaggcttgcacaggccatgaagagtatgggacagcgactcctgtcctggtcgctgctcctcctcctgctggctggctatgcgtactacaccgtctggatcctgctgacagtgagccatgggatgcatcaccatttcggccatgcaactttacctctggtattccggcatcgacgagcatctctccccacactccacagccgtttgtggacaaggaccagcccgtgttcgcgtactttccgtccgcccactacgccactgcgctccctctctatgccattctcgtgctcctagcctgttccctgctggcagtggggtacatcatctgctccgaacaactgaagaggtgcgcgcgcggtgtggaaatgtggtgaggggctgcgagcatggtggtgcccttcatgtgcgacgccccacacccggttcgcctccccctcccccgacaggatgcggacctggggcgccctccgccgactgccccgagaaagaaccggcgaagccaagaataaatccgggtgacgatgttctcgccttccaactggcgggaggtggtggatgaggtgcaggccctggacgccatttatggcaccgacttccgggtgcagtctctcacccgccctgggtggggtgacgccgcgtgcacccatgggctcagctcggaggagctgatgcagatggaggacccgggccccggcgccacctggtccctggcctgcgccgtcaccctcgacctgtccctgcctgcgcccggcctccccctctgcgtggaggccggggaggggcccagcagctcctccccatccgccgacgacccccccccccgcatccagtacttaccccccctggtactgcgcctgaccctgcacgaggcctaccccggcctcgccccgccccggctggcgctggaggcgtcctggctcgccgccccgctggcggccaagctggccgcggcgctggaggccctgtggcatgccgacctggccacccagccggcgggctacgcctgggcggagtggctgcgcgagggagtcctggatcggatgggcgcggggtccggggcgctcaggctgcaggtgcgcgacgaggacgaggcgcagacgctgctggccaacctgctgaggtgaggcgagggggctggctagaaacgttgcctttctttttgggggatggggggacagaggagaggtgcatgccagctgcccgatggtataggcagccccgcctcgtgtgctcccctgtgcagctttcgggccgaggcgccgcgggccgtgggccagtgccccctctcgcccaggtgtgcatgcccagnnnnnnnnnncacgttgccttttggggggggggaatggggaaacagaggagaggcgcatgccaactgcccgatggtacaggcagccccgcctcgtgtgttcccctgtgcagcccacgggccgaggcgccgcggggcgtgggccagggccccctctcgcccaggtgtgcatgcccagccagcgccacctccctcgtccatcccaaacccacttgaacaccctcccaaaactcgcaaaacaaccgcaggcacgacgcggggtgccgcgcgcgcnnnnnnnnnnccccaaacccactcgaacaccctccccaaactcgcaaaacaagcgcaggcacgacgcggggtgccgcgcgcgcgcctggctggccgtctcccacccctgtggcatctgcctggaggacctgcccggccccgccttcagccgcctcgcctgcggccacgccttctgctcgccgtgcctgggcgccgcggcggagctggcggtgcgcgagggcgcgctgggcgcgctgcgctgcccccagcccggctgcggcgtggcgctggacccgggtgcgctccgcgcgctgctccccgccgacctccacgagcgctgggaggcgctgacgctggaccgcgcgctggcggccatgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgcggcgaggggtggcacccgggcagcgcctgcgtcagcgcgcagacgcgcctggccatgctgcgcgccaaggcggagggcggcggcgccgcggcgcgagaggcgctgcgccgcgccgagcaggaggcggccaccgcggcgctgctggcgcgcgacaccaagccctgcccgcgctgcggcgtggcctgccagcgcgacgagggctgcaacaagatgacctgcggcgcctgcggcgccttcttctgctaccgctgcggccgcgccatctcgggctaccgccactttggtgacggctcctgcgtgctctttgacgaggccgagatcctgcgctgggaggaggactgggaagcgcgcgtcgccgtgcaccgcgccgagcagggcgggggggaaggcgtggggcaaggggcccatgatcccgggcgggggcagggccccaggccccggcgcgtgcggccgggcaggccgggcatcgcgccctgnnnnnnnnnnggcgcgcgtcgccgcgcaccgcgccgagcagggcgggggggacggtgtggggcaggggccccatgatcccgggcgggggcatggccccaggccccggcgcgcgcggccgggcaggccgggcatcgcgccctgcccccagtgcgggcagttcatcgagaagcagggtgagcaggggatggcattggttggttattcgttgttcttttggggaggaggaggagggtgtcgcccttgatgtgtatgatcaagaagagggccccagcaagctgcccgaccaccacaatgactccccgcgctccccgccacccccttcctgcaggcggcaacaaccacatgctgtgctggtcctgcaccagccacttctgctacctctgccgccgcctgctcctgcgccgcggggagggcgccacgcactttgggcccagcgggtgtcgccagcacagcgccgactgagatgcggagacggggtggaaggaggtggtggtggggcgcccaggcttgccgacccgggcgcctggccatgcggccccgctcctgttccagtctggggcctggaggccctctcagcgcaggccatccgccctcttctggcctgctcagcaccacccctcgacctgaccacaatagtgatgccgtgccaacatcaaattcatgttttcttcaaataatcattgtagcgtatccaggccctgcactggcccattcaaacactgttccctttctcgcccagacatactttcttgcagggtaccctcctctgcagaatgtgcttgccctgcctccgggctaccatgcaactgtacaatacatacaagcgacactgtacaggcaggtgcatgccagggggggtcccgtcgcggcggtggagccccacagtcccccggcannnnnnnnnncgccgacccgggtgcctggccatgcgaccccgctcctgttccagtctagagcctggaggctctctcagcgcaggccgtctgccctctcccggccagctcagcaccacccctcggcccgaccacaatagtgatgccgtgccagcatcaaactcatgatttcctcaagtaatcattgcagcgtatccaggccctgccctggccccgtcaaacactgttcccttcctcgcccatacatactttcttgcagggcaccctcctctgcagaatgtgcttgccctgcctccgggctaccatgcaactgtacaatacatacaagcgacactccacaggcaggtgcatgccagggggggtccgttgcggcggtggagccccacagtcccccggcacacatcacctgcgcagcgcgcgcagcagcgagggcaaccgccgcgcgtccaccccgcccagcgcgtcctcgacgccgcccttctccggcccgcccaccaccgcgcccgccacctccgccagcacgtgccacatcacctccttctgctcctccagcggcatcacggcaaggggggggacatgcacgaagacgacgtggacgcggggccgcgtctccagcgccaggcgcagggaatggtagtaggtccagttgcaaacgaaccgcccggcgtcaaaggactgctccacgggcaggccctgggccttcagcagacctgaaggagttgtaagcggtggggggaagaggggtcgatactttttgaccggggggagggggaggggggcccgaggtggggagtgaaggacccaggcacttcatgaaatgtcgcaggattgtagagcctgaatgcgctcagacggttgcacagtttcaaatccagttcgggctgcctgcgctccttgcaatgcaccccnnnnnnnnnnatcgcaggattgtagagcctaaatgcgctcagacggttgcacagcttcaaatccagtttgggctgcctgcgctccttgcaatgcaccccccacccgctccaactctccaccacagctccctccgccaccgaacctgcgatgacgctgacgggcaggtccgtaagaagcttgctggcaaagggatgggagttgtcgatagactcctggctgggctgccaaccggcctggtcggggcacctgaagctggcctcatttgcggcgtacgtctcgagccggtactctgtggcctccttgtccactcccaggtgcaccttttccgatgggagggtgagaggaagggggcctgagacttgcgcagaggcaggttgggatgagcataacacgagtgtgtgcctgctcaggaagaatggttaacgtactgatccagagaaactagaccctcggtcctccaagccatgcaagatgtctagcagataccaaggtgaatcagagcctgaaggaatcatccttatcgtccctgaaaacataatccccaaccgggatctcacaacaacagggtgagagtagttgttgctcagtatctttccatacagcgtgtccttaagccaggtctccacctccttggctgccacgggcagcactgtgtgcccgaccaacttccacaagtctgggagctcggggggaagcaggcttggagggaggagcaaaactacggcctggcctcacacagaagtatacatgaaatgcttgcgcttcgcaccgttggtcttgctgtccttgcagcgaccgacgacgtcctccaacaggtcttctgtggggtttcggctcactccctggaaccccccgaaggcagttatgaagagctctgccatgcgatcaggagagatgatgacgtcttggaagccgtaagcttccgatcaggtttttatgatggccctgaccagccatcacactctcgtgatgtgagcaccgaatctcggtaccgacattgaggcgcccgtacgggcggctaccccctgggtccctgccttcctcgtttcggcaacattgggagtgctacgcgcgcgggtgctgccctcctgcattggccacaatcaaattgttttgggtagtgttcataatacgtgttcttgtgcagctgctccnnnnnnnnnnactacgcgcgcgcatgctgcccgtttgcatgggccacgagcgaattgttttgggtagtgctcataatacgtgttcttgtgcagctgctccaagtggcagaggtagccacgcccatccccacacccgccttgcaaggcccggtgaatggtgccatgccggccctgacgctgtaccgccaccgatggtaaggatagatgagggcatgatacaaggcttgcattgtataaacgaggcatccaagccacacgcgatagagactcctttgtggcgggttttgagatgacgtcaccaccgatcagctcccttgcctccactaacacaggcatttggcctcggacgccctgccatttacgggcattgtactgggctggattgcgctggctgtcctgctgtccctcatcattgtcatgagcgtgactgacaggcctcacgagtgtggcccccgggaagagaggatacatgatgctgtcgtctatggcacaatcagttttctgggactcaacctcatcacggcgatattgactgtgtggattggcacccgaggtagggctaaagactcaagggcgtaggtcacagtattgaaccggcaagcgactgctgaagcggcccactctgtacttccttgctgcaatcttccaaagcaatagatgcagaatatgaggggcagcactggggccatgcattggtctctgaaaacctttcctttgtccacgtcccgtgcaggtacaccgtttacaccctccaaaagaaaactgatggtcccgctgctatacttccagaccgggaaatgggtgctcggcctaggctggctgggatttgccttctgggctgtgtacaatgtgccaggcgggtgcgccaacaatcagagggtcagagccctgcgggcgatcctctactcctttgtcggcctgtttctcgtcatcgtgtgagttgtgtggaggggtggagggcacaggaagtccggcgtgccatgttgaagcctgtggggttctcgtgtgtggacaatcatccccacagctcacctgacggtgtgcatgctgctcccatcaacagctcagcgtgcactctctccccatcccaggctgatgttcttgctcggatacaatttgctgggctcctacgagcccaatgctcgctggcagagccgccttggtttcatttccaagtgcctcgggtgctacgacgtcgtgaccgactccaacctcatgccagagtgagttttggattgcggtgtagggttttgtcagtccctgcccatcatcataccgggcctgaggagcagacattcagggttgaattgacttgcgttagtactgcccaaggccggctgcctgaccctnnnnnnnnnntatcataccgggcctgaggagtagacattcagggttgaatcgacttgcgtcagtactgcccaaggccggctgcctgaccctgccctcaacgtgcacaccagcgaggcacccacccacaacgcctttcccaaccagtgaccacgacgccccgctggaggagctggcgtccacctttgcgcgcttcttcggctgcgtggatctggagaagagcgacctggtggcgggcgtggtgctcacgggcctcctccagacgcaccagcgccggtcggcgctcgagcgggaggcgacgcgccggcgcggtgtgtctggcggcaaaaaggcgcaggtgccggggcccatgcccgctctgccgccaagctcacactcctgggacgaagtgcagggcctcgtcgaccgctactgctccagcgtagcgccggggtgtccccgctgccaggtggaccagtcacagagcacatccaacgacgacgcccttcaagaatgcatggagcatgctgatgacgagcagcttccacccaggggcgtgcaggccctgggcggcatcccggcggcgnnnnnnnnnnagagtgtccccgctgccaggtggaccagttgcagagcacgtcgaacgacgacgcccttcaaggacgcacgcagcatcctgatgacgagcagctgccacccaggggtgtgcaggccctgggcggcatcccggcggcgccggtgcaggatgtggcagaggcgggcggggattcagacttccagggtcgcagcggggacggcagcgccggcggcggcggctcgacgccctcgtcccaggcccccagcagcgaggcggaagggggggtgctgcgggactgggacggccccttcctgcgctgggtgacggcggtggcggcggggtgcagcacctacgtcaccccctcccactgggcgggggaggaggcgcgcgcggcgggggtggacccggacgaggcagcgcgagcgtcggcaggggccccgcaacccgccagccaggcggaggtcgacgacgcggcgtactgggcgcgccacgccatcgccgcctacggcagcaccgcctacatctggaccaccacgaggcgagggggggttctacttgtttggagacaggaggctggcggtgggagttcccccttgcagcatgctgcggccttgcggacctgggctgctggattctcttgaagaaaggcaccaccccttccatgcacccaggttcgcgtggtggttcacctggagctactggcgcnnnnnnnnnntgaaaggcaccaccccttccacacacccaggtttgcgtggtggttcacctggagctactggcgcaatcggatcgcgctggccctatccctgtaccccaggaagaaggtggcggctgcggcctaccctcccgtccagaagaagattgcggaggacaaggaggccctcaggcactacnnnnnnnnnncgcggctgcggcctaccctcccctccagcagaagatcgcggaggacaaggaggccctcaggcactacgtaggcgcgagaaaggtaccttgtgtttttgctgattttgagtctggtggaacttgggcggtacagtcagccaagggaaaagcttgcggagggactttgattgctcactgaagtttgggggccccgacagtgctctgactgggagatacagcccatttgctggctccgacaatgaccgccgcccagacaaggaggagtgcatccaatgcacatcctgccccaccccacccaacactcaccgcagacgctggacatccccgacgaggactttatctactgcaacttcacagaccaggcgctgnnnnnnnnnnttcccccaacactcaccgcagacgctggacgtccccgacgaggacttcatctactgcaacttcacagaccaggcgctgggcaccacgccctacaacattgtgctggaccggtgagggggggtgcattgagctgctgtacgcagcaggggtttgcttgggttggaccaagggcatggctgcatggttttgagtcccttgcatcctgttctctggcgattctcgggcatgcattgcgcaacgctgcacgcatctctcccctctccacaccattcacatactccccccctcccccaccaatccaccagacccaccaggacagtggtgctttccatccgcggttccagcagcgtggaggacctgctgaccgacgtgatggaccgccccgtccagatcaacgactggctgcccgccgacctcaccgccgcccaccccgacctgggggaggtcagggcccacgtgggcatgtactccgcggccaaggcggtgctccgcgaccttgactcccaccgcctcctggacacgctgctgacggggcgcccgccccccagcgaagagcgcgagcgggaggcgggacggtatgcgcccgacgcccgcgaccgnnnnnnnnnnacccgcgagcgaagagtgcgagcgggaggtgggacggtatgcgcccgacgcccgcgaccgcgcgttgtgccatgcccagcaccgcctgcgcgccgagggctgggtgccggggtcaaagcggggtggcccgggggctggcggggcctcgggccgcgcagcggccgtcctgggcagcccgctgcatgcctggctggggcggggcctgagggggcggggccacccatcccctggccaggcccccgacgaggcgcagctggcgcggctgcgcgcgcggttgcggcgcggcgggccgctggaggagcggctgggccccgaggactacgccacgctgctggcggcgcggcgcgtggactgccgcggctggcggctggtgctgacggggcactcgctgggcgccgcggtggcggtgctggtgggcatgcgcctgcggaccctggcgccggggctgcgcgtctgggccttctcgccgccgggggggatggccacgcccaacctctcgcccctgctggaggactacgtgaccaacgtcgtgattgggaaggacgtcatcccacgcctgggcaccatcacctttgagcggctcatcgaccaggtctgggctttgtttctctggggcagagagtttgggggatagaggaggggatggagagagcacatcgatcgtgcatcacgaccccggcaggcagatgtgatgaaggacactccgcacaccactgataattcagtgcgagagcgaccaccccctccctctgtccnnnnnnnnnnggagagcatcgatcctgcatcaccaccccggcaggcagatgtgatgaagggcattccgcacacccctgataattcaatgcgagagcgaccaccccctccctctgtcctgcgcagatggtggttgcgctggcgtccacgcgcctcaccaagctcagggtcctgacgtcggcgaggtcggcggccctgcggcggctgccgcggaacaaggtgttctaccagcctcgtgacattccggaggaggcgctgcgatacgtactccagtgagtggtgggggggtgaaggtgggctgcaagtgtgcagacgagggtggcagcctcccaggccctctcccccgccatatgaacccacgcaggtactttgagggtaagtgcagctacaagcacctgtacctgcccatgtaccctgccggccgggtgatgcacctgcgccgtgtggagcgagagaagggcagccgggcctgggacgcggtgtgggtgagccaccgctgcctcatagacgagggtatcctggtgtccaggcaccagagcagcgaccactccatcgccaggctgcgcagcgtgtttgctgagctggcagggaaggatgttcctgagctagctggggcagacggcggtgaagacctggtttgatatttgataatcgcactgacctgacctgggatgtataggatgcccaggtcccaaatacgttgcatgtatttatgctcgcacgctgcccctttccactgagatcccttcctctcattgtatggtagaagtcgaggcagcggacaccgtgcgccactgaggtgtcggagatctgtcgtgatacactcttgtatactcttccactgtccggcgcttgatcacaatcacggaaccggtcatcgagttgcaaatatcatgtttcgcaaccacagcgtgctnnnnnnnnnnttttccactgagaccccttcctttcattttatggtagaagtcgaggcagcggacaccatgcgccactgaggtgtcggggatctgtcgtaatacactcttgtatactcttccactgtccggcgcatgatcacgatcacgaaacctgtcatcgagttgtaaatatcatgtttcgcaaccacagcgtgctttacaccacgagatcggtgccaatatccaaggtagcccaaccctactccgccacggtgccaaaatgatcaggagcacggcaccgcaaacgctgaagagtcctcgaagcctactcaactgatccattcgagctgtttcatagctgtgctggttcatcatgctgcatttcgagcccctccaggttagcaagggagcaggctggccctgcactcctgcagagatcatgcccgacagaaggagcggagcatctcccaacccgtgcagccacaaatgtacctcgaaccccatcatttctccagagtgccatcgatgtggccttctgggcgcagctgggggagaccaagctccacgacctgcgcttggacgaaggccccatctcatttgcacccaccctgactgccagccagtttgcgggcattcctggcttcgtcacagcctcacccggatccctgagcttgcctcccacgatgtcctctcgtggactggcctgcctgggccaggcatttgtgtacaacactgtggagaaggtgacgcagtctgaccgcaaagccctcacggcccaggtggggaagaggggttggggacatggagtatcaaggcagcagcatgttttgcgtcgccgtctgtctgtcagacagggcagtcgcgtgccaccccgttcacctgtgcaggccgcctcggacatctgggcctgcatccaggacggcagtgccgtggagcagccctccctcatgctgcgccccattctcctgacgcactgcgacctcaagcactccaagtacatctactggtttggcatgcctcacctacagcctgannnnnnnnnnnnnnnnnnnnnnnnncccgtgtaggcaggtagcatgtttgcgtgtgcctgtggggctggcttgggtaagcctgcaatctccagctcgtaacaactctggtgacatgtgagactgcagtcgagcagcggccactgcctcagtacatctggcaaatcacctctggcaggtgatggcagcatgcgatgagcacctgaagacaggcggtcactttgcacaccttgtgacgatagnnnnnnnnnnacgaccattcacgctgtcttccactgcacggcccgcagccgaagaatttgcaggaggtctcgcagatcaggcaagggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccactgcctcagtacatctggcaagtcacctctggcaggtgatgacagcatgcgatgagcacttgaagacatgcggtcactttgcacaccttgtgacgatagctggcctggaggatgcagcagccgacgcaggggcagcaggcccggctgtcagctgccaccccctgacggagtggtccagcctggcaattgcaagccaaggcccccgcacctacctggccctccaggacagcagttgcgagacggagcgccccagcgcctcgctccgacccctgcttctcctggcggccgcgagatggaaagtgcggagcctcgacgtgctgtgcctgcggcagcgccaggggcgcagcagcgcccagggctcgatcgtgctgggcgtcgacctccccggggtagatctcgagggttctgcccccgctggcgcgggcggctgggaggtgaactcgcgcggcaagcccggaccgcgtgtcgccgatctggctgccgccatggaccccaagcgcctggctgcctcgggtgggcaggcgtatggcctgggaggaaggtcgtgatggcaggctattgtcttgagatgggaactttgagccatgttgctccaactccctctgcattctcctgggcgtcggtgcacaggtcgcctgccacacaggagagacccatgggtgggttgctcgactgagccccagcacgttcaacaacccctccctcacccttgagtacagcggtggacctgaacctgaggctnnnnnnnnnngtggatgggttgcttgactgagccccagtacgttcaacaacccctccctcaccctcgagtacagcggtggacctgaacctgaggctgatgcgctggcgcgccgtgcccagcctggaggttggctccctctcctcccagcgctgcctcctgcttggcgccggcaccctcggctgctccgtggcgcgcacgctgctggggtggggcgtgcggcgattgaccttggtcgacaacgcccgcgtttccttcagcaacccggtatggtggcggcgctggtcccagagctggggtcgatgtcggatctgagtgaggtgcattcgcacacctcaggcctgagggcagggggaccctggctcttggtcccgcgaccatgcgccgctgccagaaatgcgttgttgcggggctgtggtccgtggccagggtgtcaccacttcgacaagaaagcgtcacagccccccacccagacatcaatacggtaccccccttccatcatcttttcccccattcaggtgcggcagtcgctttacacctttgaggactgcctggggggcggggtgcccaaggcccaggcggctgcagaggcgctgacggctgttttccccggcgtcgatgcgaggggcctggccatgagcgtgcccatgccggggcacgtcgccactccggacgaggaggccgaggtacgagggtccgtgcgaggattgctgcccactgcccagctcctctgcactggtgtctgtcggggacgctgacaatgcaccctgagcccccctgccccccgccaaccgtccaatgtctgcaggcggcggaggccaccgaggagctgaggaccttgatcgaggagcacgacatcgtcttccnnnnnnnnnnggctgacgattcagcctgagcccccctggccccccgccaaccgtccaatgcctgcaggcggcgcaggccaccgagcagttgagggccttgatcgaggagcacgacatcgtcttcctcctcatggacactcgggagtcgcgttggctgcccacgctcctgggtgcagctgcccggaagctggtggtgaacgccgccctgggtttcgatggctacctggtcatgcggcacggccttcccgcaggcgcgggatgtggtgtggggcatgaggcggtggcctgcagggagtgcccggcggtgcctcaccccaggatcctgtcgcagctgggcaccgatcacgacgtctccctcccgtgtccaatccgcagccgccacacccgctgcaacggaaggcgacgtcaccgcagcttcgccgccggagcgtggcgggctgcctgcgtgcgctggcctgggctgctacttttgcaacgatgtcnnnnnnnnnngacggaaggcgacgtcgccgcagcttcgtcgccggagcgtggcgcgctgcctgcgtgcgccggcctgggctgctacttttgcaacgatgtcgtggcgcccgtggactccaccgccgacctctccctagaccagcaggtcggcctggtgcgagtacctcgctgcgccagcactggcgtgtgcacccccacgcgcgcacatgccctcgcctcgcgagcgccctccatgccccactcctgcattccgcgcagtgcacggtcgcccgccccgggctcagcgccatcgcaggggcgctggcggtggagctggccatggccgtggccagtcaccccctgggccccgccgcccctgcggcggggcgggctccagagacgtcacaggccgccgacccggcggtgctgggcagcccgccccacatgatccgcggccagctcaccggcttctcacaggcgaggtggttggggtgatggtgctgcaaggtcacggcagggtcctctcgccctgcatctgcctctggcaggtccccggctgtttcatgcctcctagcccattccctcacagcattcccactgcttggccccccccaggtgtgcatgaccgggtcggcctccaggtactgcacggcctgctcccccgcggtgctttcctcctttgccaggaccgggacggcgttcgtcatccaggtgcagggtagagctggttggtgatgttcgaggaggtcgtgtgccagggaggtcccgtgaggagcccaaccctcgaagcctgggcatgtggcgctgtggatgggtgcacaggggtccgatccccggcccacacatcccgcagagcctgagggcgccgtcgacgctggannnnnnnnnncgcccaaccctcgaagcccgggcatgtggcgctgtggaggggggcacaggggtccgatccccggcccaaacatcctgcagagcctgagggcgccgtcgacgctggaggacctgacgggcctgacccagctgcatgccgacagcgaggcagtgctggcgctgcagggcagcgagagcgaggaggagggcctggagcgggccgacggggaggaggatgactggcatgagatctagcctgccctgacttctcttgcattgatttcactgcgccaaaggctcccagcacgccaggggaattacatggggggtgacctgccgggacaggggaaggggagtggcaccctggagcgggtcgtgttctgcgcaaccagggcgcagtccatgcccgaggcccatgcaagcaggtttgctggtggtgttgccggggggagcatttcaggcacaaaacagcggggacgggtggccggtgcggccatgcgcgaggcaagcatgcgacatgctcgtgtgcacgggcgtgcagccccgcaagacgaaaacagtccggaaggagagtgggattgacgggggttcgcaccccgggggggtacgatgccgcccacacgcattcaaaaatgggagcagaaaacgggcgcaggccaggaccaggaggctggtcgggcggtgcagggaattcagtgggcacacgccccgcccgggagtccgaggcgggaggatggatcggggttctgttgagagagaagccggcaaggggagcaggctgccctcgcaagcgggccaagctgccctcgccagggcaggcgcgtgctggggggctgggggccggtggccaggccagcatgggcattcaaaacgagttcgcggggtgggatcaggcaggttcccaccgcccgcggcaatggtcagtttggttctgggcgttgcacaacggagcgcagcgcaaaggatgtcagcgcgacagaaaatcctgcacgtgtgattgtggggggggggagaggaagggcgtgagaggagagctcaagacgtctggcgatgcttagggcgaagtccccagcctgatagaggctgcgcttggnnnnnnnnnngggaatcaggcatgttcccaccgcccgcggcaatggccagtttggttctgggcgtcgcactacggagcgcagcgcaaaggacgtcagcgcgacagaaaatcctgcacgtgtgattgcgggggggtggggggggaggaagggcatgagaggagagctcgagacgtgtggcgatgcttagggcggagtccccagcctgatagaggctgcgcttggccgggtccgcagggtcgcaccagcgactcccttgcaggctcgtccagcagatcgtgaggcccaaagggcggtcttcgccgcccctgacaccccccactccttcccatgacccgcagtcctcggcggctcaccaggcacgaggccagtccgtcctgcttcccctgccagctgggcatgccctgcatcccctgctggcccagggagggcagcggggccgaggcgacggagacgagcgggggcgcggagtggcgcgggatgcctccccccgccccccgctccggcatggggcagcggtcgtgcagggcaaagggcccctcgccgtggccctgcacctggaagctgacggcctccacgctggtgcgcgcaaactgggcgcgcatggcctccagctccgacacggccttggcgcgctccatcatggcgtgctgcgcgatggagttggagcgctccagctccgccgacaggcgcgccacctgcgcccgcaccccgtccagctcctcctccagccccgacacctgggtctggcgccggcggcgcgaccgccgcgccgactcgcggttggacagcatgcgccgcatgcgccgcacctgctcggggggcaggtccgggtcgatcagcgcgtcgtactccttcttctggcgcggccggcccgaggggcggggctgcaggcccgcgcgcagggcgccgccggcgcccgcgcaccccccgccgccggtcacgctgccggcgcgctgcgcgcagacagggtcggggccgtcggaggcggccggatcgccaaacatggagccgtcggccgccaggcagtcggcgccgtgggagtcggtggcgtgggtggagcccgaggtgccgtcgctcaggctgccgcgcaccaaggcggagacggaggaggcagggaggccggaggaggccgtggcacccggcgcgccgcccagcagcgccagcagatcgccgtgcatcagtgcctcggccgccgtgcgcggcgtgcgctgggcggcggcggccgggtgggcctgcgcgccgaccatgctggaccccacgtggggactctccagctgggcgtgaggcgtgtgcgcggcgcggggggagggcgcgggcgggccccgccccggcgcggcgcgagtggcgatgcgggaggggagggagaaggcgggctgcccgcccgtcttggcggccacctcggcctggagctgggcgatggcggagaagtcggcgccgggctcggcgtacatgaagccggtgaggtcggaagggaggaggtagctgtgacgctggccggaggccgggaggcgggaggggtccggcaggtcggccaccgacatcaggtccaggtccaggaagtgctggtcgatgtgcatcatggggaggggggggcctacaagcaaggagtggtgggtcacaatgtcgggcaggggaacggcgcggtgtgatgcccagcaggtgggcccacgcgggggttgcggtgcacgctccgacaggaaccgggcgcacccatgtcgttcgatgggagctcgggctcgatggcccccttcacacccatgtgccgctcggaaatgtcatcgccaaacaaggtgtgcatgtcgctacgaaactggactgactgagttgggcacacgcgctaaggagcaatctcagctgtacagcttcctgggcacatgggccgggggagtggtctccctggcagcacgagaaaacgtcggatgcagttctcaagatcaatactggtggacagagcgatgatgacggcttccattcccgcattgtcccggcttgcgagtcggcaaggtgtagaacctgggctggggtttacgtgtaaggattgtgcggtaccactcgccataccatcgcgcccacgaacgtacacagaactcggaagcaatgcaatatgcagggccgtcgctccatcacagtgctcttcagacacaattcaatatcnnnnnnnnnngcgtatacagaactcggaagcaatgtgggcaatatgcagggccgtcgctacaacacagtgctcttcagacacaattcaatatcttgcagataatgaatttaatggacgaagaatgagacgtgcgtcgaatgggcctgccctggcccttcgctggttgctgggcggggcgggcaccaccccatgtgcgggacccagcccccactccctagcgcggggcatggccgccgaggcccagttgtccccggatgtattatctatcccgcaacagaaggcctcgcaagcgattgcctcgccggtgggggacctgctggcgacgctggagaccatgggccgggtgctgagcttccaggacacccctcccccacctcccccgcccaagtacccccgcgccttcagccccgtgatgcaaaccatggcgtaccacgagcagttcatggacgagactccagagggcaaggccctgcgcgacaactggcgccgccaggtggtgctggagacgcgggcggtggaggcggcggcggcgcggtaccggagggacctggccgctgcggtgcagcggggggagggcgccaacctgccggcctcgcgccgactcctgctgcgctggtacgcgccgctggtggacgccatcaaggaggagcagcgcaaggtgcggcggtgccgctggaggcgatgggtatggctgtcgagatggcgacgccctgnnnnnnnnnntgcgccgctggtggacgctattaaggaggagcagcgcaaggtgcggcggtgttgctggagccgaggggtatggctgtcgagatggcgacgccctgagggcaacagcaagcatgggtgtcttaccgcatgatgcgctgtgaccggtgtcagcctgatcactctgctgccggaggcgcagagccagtggctctggaaagagggttgctggcgtgccatacatgnnnnnnnnnnnnnnnngtccgcagatttacatgcgcgaggtgcaggtggaccgcacagtgtacggccctttcctcctgctgctggagccgcagcagctggcggtcattgccatgcactgcacgctgcacgccatcatggagcttgggggcaccaaccccgagatcgtcgtgcccgggcagacgcgggttacacgcctggcggtcacaataggcagggtgagctgtttggggggagggcgatggaagtggggcgtggactgccgtgggaaaggcccggctgggaggaggtgggtgcagtcgaagcagggactgaggcatcgcacaatcctgggtggatttgacgcattggagttggatcatatgccggtaggcaatcccatcctccggcnnnnnnnnnnagtgagggggatggaagtggggcgtgcactgccgtgggacaggcccggctgggtggaggtgggtgcagacgaagcaggggctgaggcatcgctcgatcacgggtggagttgatgcattggagtttgatgatatgccggtaggcaatcccatcctccggcggtgggatgccgggccgctgtctgcctcacagggcctgtggatggtgcacaggatcatttacttggtccccaagtccatggcaaacgagcagcccccacatctcccgtccctcccttgcagatgatcgagaaccaggtgaacctggagaaggtccagtccatctgccgcaagcatgccaaggccaaccgcgaggtcgcagcgctctacgccgaggtacgggtgggatgggatggcatgcatgagctggtggccggcgccctcccgtgggtcgcctgcgacgctcaatcctctctgtcgacagttctgctgccggagcggtccccaacaccgcccgcgcactcgnnnnnnnnnngatcctccctgtcaacagttttgctgccagagcggtccccaacaccgcccgcgcactcggcccctttgatcgggccctctctgccgctcgctcctgcgcgcccgtcctcctaggcgcagcgctcgagccatggtgcggtcctgcccctgtcgcccatcctcgcacgcactcccaccccctgcagggcgaggatctgcgtgccaagctgacgcagggcgggcggctggagccggaggagtggtcccgctggcgccagctgggcgccatgctggaggagctgggcgaggtccagcccctggaccacctggactggtttgttcccggcgagaagctgggccagcgcctggagcgtctgccggccatgtggtcggggggcgggcccatcggacagggcacgcgacgcctgatgtcggcggtgaagaaggcgctggacccggaggacctggaggcgtggcggggcgagacgcacgccaaggtgggcgccgcgctgatcaacctcatcctgggcacctgcaccgtggacctgccgggccgggggccgggcggcgagccgcgcgcggtgcccgccttctggcacaggctggagctggcggccgacggctcggccagcgccgccagccgcggagcaggtggggagctgttggagtttgggggttcagttccttttctcgtgtatgttttgtggacgcagggtcacggccaatgcggcaatgaggagggccaaggcacgggccttgtgcagggatcgagagagcccagcgcctcggcgccgcccggcgannnnnnnnnngtgggggttcggttccttttctcgtgtatattttggggaggcagggtcacggccaaggcgggaatgaggagggccaagacacgggccttgtgcagggatcccaagagcccagcgcctcggcgccgcccggcgacgcgaggacacggcacccgggagtcatgtccacccctgggcaagtccactgtgcgcaaacaccagttctttcgccctgattggaccagaccatccctgttcccccccaccgcccccaagaagcacccccaatgcccgactcatcaccaggctccctgaagcgctatggcgtgctgtgcgcgcatgaggaggtgctgaagcgcgtgcagcccagccacatggtagaggccttcatcccgcagtacgtgcccatgctcatcaagcccgtgccctggcagcgccacgaccgcggcgggcacgtcacgctgcgcaacaacgtgatgcgcctgcgcggttcccacctgcagagcgagatgctggcgcgcgccgaccaggacatggtgaacgggcgagggccgggcctgtccaaggtgaggaaggcagggttgttggtttgcggcggggcctggcaggggctggcggatcgacggccggccagcgcggcgacgccagctcagtcttcccgcaccgggcatcgactgtcagagcgctgcagatgcacgcgcgaacacccccgcatccccatgtcctcactcaagcaagccccccacctcactccctccctcgcccgtcaccgctgtaggtgtatgaggcgctgaacgcgctgggcgagacgccgtggcagaccaacgttcccgtgcaccgcgtggcggaggcgctgtgggggctgggcggtggcgtgtgcgacgtgccgcggcgcatgaactacaccgtgcccccgccccttcccgccggcttccggctgcaccgctccgagggccccgggtcggggttcgcggtcttcgactacggccgcgacgcggcgcgcagcagccgcgtggccgcgcgccagctgcgccgccgcaacagcgagctgcacgcgctgcgctgcgacatggagtacaagctggcggtggcgcgcgagttcgcgggcgagccgcgcttctactacccgcacaacgtcgacttccgggggcgggcctaccccatgcacccgcacctgaaccacctgggctccgacctctgcnnnnnnnnnnattctactacccgcacaatgtcgacttccgggggcgggcctatcccatgcacccccacctgaaccacctgggctccgacctctgccgcggcctgctgcgcttcgcagaccgcaggccgctgggcgagcgcggcctgcgctggctctacgtccaggccgccaacctgtggggggcgggcgtggacaaactgcccttcgccgagcgcgccgcctgggccgaggcacacctgggcgacctggtgcggaacgcacgcgaccccctggacaccggggccgggacgttggacgacagcctggcgcgcgcggacgcggcggcgctggcacgcctggtcgagcgcgccgcggaccgcgaggatggccgcgccttctggtgaggcggggtggtggggaggctgccacagcagccatgcacctgtcccagcaaacacacatgccactgcccctcccccacaacactcccgatcccccaccacgccatagggtgaaggcagaggagccgttccagttcctggcgacgtgtatggagatcgcggacgcgcacgccagcggtgaccccgcctccttcccctcccgactgcccacgcacatggacgggtcgtgcaacggcctgcagcactacgcagcgctgggccgcgacgccgcgggcgggcaggcggtcaacctgcgccccgcggcccgcccccaggacgtctactcacagatcgcggcgctggtgcgcgcgcgcgtggaccgcgacgcggcggcaggcgtgacgcacgcgcgcgcgctgcgcaacgccacgcccatcgaccgcaagctggtcaagcagacggtgatgaccagcgtgtacggcgtgaccttcgtgggcgcgcgcgggcagatcacctcgcgcctgaaggagcgcgggttccaggactcgcgcctcatgtacaaggtctcctgctactctgcaaaggtgggtcggatgtcttgggctgtggcgggacacattctgtcctggggcaatgggctgtgggttgggggttcaaggagggatccccggtgatgctggacattcctcgtcccatacccctcacaagcaaccccctcttccaattctcattcccccaccccccccnnnnnnnnnngtgctggacattcctcgccccatacccctcccaagcaaccccctcttccagttctcatccccccccccccgccgcatttcccccttaccccccaaaggtgacgctggagtgcctgatggagatgttcagctgcgccaaggacatcatgaactggctggcggagtgcgccaaactggtggcggggacaggggccactgtgcagtggaccacgccactgggcctgccagttgtacagccgtaccgcaggaccacacggcaccacgtccgcacactgctccaggtgcccgggtggtatgggagggtactggatgcgcgtgaggggggagttgcgaggatggaagaccccggcacagggcgtggagggctgccctggagcttggagggctgnnnnnnnnnnagagtgcgccaagctggtggcggggacgggggccactgtgcagtggaccacgccgctgggcctgccggttgtacagccgtaccgcaggaccacacggcaccacgtccgcacgctgctccaggtgcccgggtggtgtgggggagtactggatgcgcgagaggggggtgggtgcgaggatgaaagaccctggcacagggcatggagggctgccctgaagcgcgggcgccgtgctggagctgtcagaattgggtgaacactgcatgctcctctgtcactcatgttccccttgccacctcccagctcaaagtacacacacacatttcctcacaaaacctgccacccatacaaccacagaggctggtggtggtggagaacaacgacgagctgccggtgatgaagacgcggcagcgcaccgcctttccccccaacttcatccactccgtggactccagccacatgatgatgacggccatcgcgtgtcgcagggcaggtgtgccgcggtcgggcaggcctgtcttggggcgctgggccgggctgagcattgtgaaggtggcaagcatcagccgcgtgcctcaggaacatggaggcgtcggtggtgcgaggcgcccaggtgaatcacatccctttcattcgtcgcagggatgagttttgctggcgtgcacgnnnnnnnnnnccgcagggcaggtgtgccgcggtcggacaggcttgtcttggggcgctgtgccgggccgagcattgtgaaggtggcatgcatcagccgcgtgccccaggaacatggaggagtcggtggtgcgaggcgcccaggaacgtcgcatccctttcatgcatcgcagggatgagttttgctggtgtgcacgactccttctggacgcacgcgggcgacatcgagcagatgaattccatcctgcgcgatgcgtttgttgagctgcactcgcaggtgagagggttgcaaagaggacagcacggttgccatgtttttgaagtgcagactgcttgggcaggggcgctggcgtccctcgaggagaatgatggccgctgtcattggtcggccctcaaggctcatctgagatggtnnnnnnnnnngaaaagaggacagctctgttgccatgtttttgacgtgcaggcttcttgggcaggggcgtcgacgtcccttgaggagaacaatgtccgctgtcatcggtcggccctcaaggctcatctgagatggtccctctggcatggtcatggggatcaactctcacttgcatccgggtcccaccacccttgcccgtgcctgtgcacacttgctgcctccgatggcaaagacgtccagatcaacatccctcactcccacaccttgtcgcagccgttgctggagaacctgctggccgatttcagggccagcttacccgaggtggagtttcccgagctgcccaagaggggcgacctggacctggaggaggtccgcaaggcagagtacttctttagctgagagcatgctccctgtacactttccctcctttcccaatccttctcataccactgctcccccccttcctgcttggtgcatgcacacgagcacttgctgcgggcatgctgcccaacccctcatggccgcctggatgggacctccccatctggcttctctgtttgaattgaacacgaatccaaaacatcctgaaacatgcatacacaagggggccgctgggcggggtcaagggcagcagtctgggcgaggtgggtgcgcagagcatgtgcagcggggtgagctgggcgggcgtcaaatcacgcaaggtggtcctcatcagtgcagttcttgccattcacgagcagggatgcctggggtgttgcgctgcggtttcagcggtccattcccaggcagggtgggtcacggcgagcaggcggcgctcagcggacaaggcgtgtgggcgtgcggttggtgacgtcgcccaggacccggcgagggactgcagtaagccccttgctgcttggtccgatggtgtggggcaggggggcgacgtgcggctgagcatctgcctgggccatcagctcgtggggaggatagcggctcatcacgggcaggaagatgtcgttgtaatactgcgatgggccgaggtggatccagtggtgcagtctgggtccctgtaagcttgccagggcacgcagcacaaggtgcgtcgccatcccatgccatgccaaagagcggcatgcaaaacttgctggcttgcgcaggggggaggagggtgtcgctgcaggcgatctgaagcaaccccagccctctcctccgcacaccacccacctgcctcgcccccatgcatgtcagagcatcctctgcctctgctccagccgtgaagattggcacgaggacctgtggacagggcaccgtcagcattttgggtgacccaggttcgagaagggaatgcaaggcccagcaatgccactgcctgccactgcctacctgctggaagatggacgcttcatggtttgggagggtgccctccagcacccccaccagctttccaaagggcaccttgaggccacacagcttgatctgaccattgtcaagggcgaggagggggagaaggggagcccggtcaggccctgggcgtactgttcaatgcaaaacatgcagggctgcatggactgtctagcgccccaggcagcaggggcagcctgcgtgccggcacccccacccacccaccaggaggtagagcgccgcgcaaaccacgacgctggcatgcacgccaaagaacagctggagctgctggtccagcacgagacctaagcagtgcgcagcgcgctgcccaaaccctgccagggccggttttgggaggagagaggatgcggtcgcatgctgaggtgcgtcgggggtccacatgtgtacctgtggaccacccagcctccctcccctgcctcccttcacacaagacccacgaccgacggccctggtggcaccgcaggcatgtgtcccgcaagccacccacccaccatccactgcctggaggtgggggcactccaccagcagggctcgggcagcaccttccagcctggccaagcacatgctgcggtgctcgtctaagaaactggccagaagctggccttccaagtgccctacgcagggacattctctctttacgggtaaaacaacttgtgcaggggagcacttcgacccagattgagcagatttgagcgatttgcctcctgctgcttcccacctggctgcagcctgggagaagaagcaacgagcctcagaatggagctgccgggcaggaacgcaagctcctcctctatcctgacctacaccacatgatggcggcatggctgcgtcgtaggcacatcctagctggtgatgtgtgcgagctgcattgcttccaagtctcaaacaatgctcaaccaggcaaggagcagcctcccagacattgtatcgcgctcccacctgcatgcctgccagaaactcctggacatccagtggcattcctgcagggcgcaaacaggaggttggggcggtgctgatattgcaaagctctattctttgatggatgttccctgaattgtggcatnnnnnnnnnngctggccagaagctgaccttccaaatgccctacgcagggacattctctcttgacgggtaaaacaacttgtgtaggggagcacttcgatccagattgagcagatttgagcgacttgcctcctgctgcgtcccacctggctgcagcctgggagaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcaaacaggaggttggggtggcgctgatattgcaaagctctatcctttgatggatgttccctgaattgtggcatacgactgagaagttgcacagcaaggacaccaaactcttgctgaacaaaaggcgtcatgctgttcacctggcagactgctggtgtagtcgccatctgtcggtgcagtcaacgccccacaaaaggcctcgatggcatgccacagctgataggtcttgttggtcaaccccagcttcttcgtggcagcagggaaaccaatgcctgggcgactgcccagcagcgagaacaccgcaacctgcggagcagagaaatgttggagtatggactggcattcagaaaaggagcctagccgtgagaaaacttccaagcactcacctcgatacagcagttcagcagcgcatccaaggcctccatgtctcctgctgcagcctccaccctctgccctttgacgtttgggtgtcccccaagggatcggccctcggccctggccacaagggacagcaacctctccaggacactgtgaagagagtataggatgagcaagcagagggatcaacgcatgggcaatcatcagcaaactgtgttggggagtattctgccccctctcttccccccccccccccccccccccnnnnnnnnnnggcaagcagagggatcaacgcatgtgcaatcaccagcaaactgtgttggggaatattctgcccccctctcctccccccccccgccgtccctcaccagtagtacagcgtgaggcagcatctgtagtgaaatgggtggcagccgccacgatcagtgggcttgccccgatggttctgatttatagggaaaacggccgagatccgacttcgggctgcattgactacattcacctgtcattcagtcatgtaagattaggggatgaggttgcatgagcagctcaatttaaaacttcgagtcacgtcgaaggatgcggatggaaagcgacatcgactacagcaactcaccgtcagctctgcgcgtttcggcacctcctgaaagtgcgcaaagagtgcctcggtgctcgtgttctcatgctgtaagcagattcgctttatccaggctccagcagcatcgctgacgccagagggccgggatgcaagctccggctcttggggcatggtccagccatctgttgcatccaccgatgtgtcgtcagcatagacatgcaaggcgggagatgtcgtcatgatgctcgtaatgacatttatcgagtgggcattttagtccaaagtgctggttcccgaagacattgcgaccttgaactcggcctgtcgcagagcgnnnnnnnnnntgtcatgatgctcgtaatgacattaatagagtgggcattttagtgcaatgtgctggttcccgaagacatcgcgaccttgaactcggcctgtcgcagagcgggcacctaacatggccgcagcggcatcccgccattgttaacaccttgcccactccgcattgcaacttgcacagcgtaatgatagagagggtcatctgcaatgtgtgccctgttctttgcgggagcatggcggtggagctcgagagcttcatccggctccatgctgtcgaacacgaagcaggactctcaaacgagttcctcttggcacttaggaagtgaccaccaacattcaactcaaacctcccctgtccattattatggcagctctgggcgttcactcggcaacattgcacccctacactctggtcgcgcggtggcagcccttggcaatgggacccaagccagccaaggagtggcgccgatggcggcccagtgaccctccacgcgcctcccgctcgatgttccctcgtgtaaatgcatctatggatactgcgaccgtggactgtacgacggcacgggacctcagtaacgtcctgtctctcaacaacatccggcagacgctcatccggctggaggacacgattatcttcggcctaatagagcgagcccagttcgcacgtaacagtgctgtgtacgaggagcctggagtggaagtgcctggctgctcccgaccgggctgctcgttgctggagtacatcctcagggagaccgagcagatccatggccgcatccggcgctacacctcccccgatgagaatgcctacttccccgaggccctgccctccctgctcctcccgcccatcacctatgagcaggtgaatgcatgcagggcgtgggaaattcctggtgcgaggatggcggtccgacgcagcgcacatctatgctgccagtgccggatggttagcaggaggcgttctcagcctcgttccaaggctcagacccacaccgcccgccaccccaggttctgnnnnnnnnnnaagtgccggatggtgagcaggaggcgttctcagcctcgttccaagcctcggacccacaccgcccgccaccccaggttctggctccttgtgctgcatccatcaacctcaatgaatccatcctcaagctgtaccttgagcacctcatgccggagatcaccgagcctggtgatgatggcaactatggttcagctgccatgtacgatgtcatgatcctccaggtgtgattttagagtcattgttgtggcgctggaggctgggggagaactatggcccacgtgagcaggtgccctgagtccctatatccagtacctgcattctctgagataggtgtgtatatgaggcttaccacttctcccctggcacgatcccattgccaggcactctccaagcgcattcactacggcaagtttgtggcggagtccaaattcctgagccagaccgagaagtacacacggctaatacatgcacatgattcagagggcctcatggcagcaatcacagatgctgtggtggaggccaaggtgaggagctgcatggattgcagagtgccggagtgccctgtgctgctagtgattttccataccttgcagtcaccaggggtctcaggaagccagtcactgccacctgcgcaccggtacaaatgaattctatcactctgctcctgacaggtcatccagcgggttgcgcgaaaggctgccatttttggacaggatgtgggtgctgcaggcgacgtgattgtgggcacggactcggaggcggcggagcagaatgccaaggtgcgaccacaggcggtggcgcagctgtacaaggactgggtcatgcccctcaccaagaaggtggaggtggactacctgctgaggcgcctggaagactagtgcatgattctttatgaagcctggatgccccacagaggcacacaggcagggatggcctgatccccaaacaccccgaactgaacctnnnnnnnnnnnnnnnnnnnnnnnnnnnnnnnnnnnnnnnnnnnnnnnnnnntcgcagttggacaccctcctcctcccgtgcgttcacatgcatacaatcgcacgcatgtcgcatgcactcttacacacgatacaatttctgttaacccacgcagtagctcgtcggccagcaaagtaactcggannnnnnnnnntgtgacgtttcgagcacaatctagagtgaagttgaggggggtgcagagcgcgcgcgccaccactcnnnnnnnnnnaaaatactgttaacccacgccgtagctcgtcggccagcaaagtaactcggaaggcctgggagccgagacgccttgggccctgacggggccgtgccaggatgcgacaactgaagttccacgagaagaagcttctgaagaaagtagactttcttcaatggaagaatgaacacaacctgcgggagcttcaggtgggtagccggaggtacttctagggccgggtgtttcgcgacggtgctacctccagcagagccacctgcgtgacgtgctgggctccatttcacaagctaaattacgttccgcaggtgatgcgccggtaccacatccaggaccgggacgactacaagaaatacaataagctggtgggcatggtgaccagcctgacctccgtgctgaagaaactggcccccaccgaccccgcccgcatcgagctcaccgagaagctgctggaccggctgcacgacatgggggtcatcaccaccaaaaagagcctggtccagctggagaagctgagcaccgcgtccttctgccggcgccgcctccccgtggtcatggtgcgagccaagatgtctgagaccctgaaggaggccatcaccttcattgagcagggccacgtccgaataggaccagacacaggtttggggtcgggctggacatgcgcgtgtcgttctcatgcatgtggctgacgtgctcaggaggtcattttggctggctggccacccctctaactctcactttcctcctcgcacgcagtcaccgaccctgccttcctcgtcacgcgcgccatggaggacttcgtaacatgggtggacacgtcgcgcatcaagcgcaaggtcatgcagtacaacgaccggctggacgactacgacctcatgcactgagcgtggggcctgggtacactcacggctccgtctcatcattgcatcggcgccgtcgctggggttcccttcccagcagcagtggcttgccggcatacattgcaccatctgttacccagatgcatgggagagatttaagatactcaggcttctagggtgggcattgcttctggtgtgtctcgccgtgcgctcgacggcgctgggccgctttggttttgaaagccgccgttccagcaccatggccacccaagtccacggtgtgagcgccgttgcgccgcctccccacagcccgtcccggtctggtcagcccgtctttgacgctcgccagcggcagccttccttcaagccggcgcggatgggggccagaagtggaagggtgcgacnnnnnnnnnngtgggccgctttggttgtggaggccgccgttccggcaccatggccacccaagtccacggtgtgagtgccgctgcgccgcctctccacagcccatcccggtctggtcagccccgtctttgacgccagcggtagccttccttcaagccggcgtggatgggggccagaagtggaagggtgcgacctcggcgtcgaagctctccagcggctgcgaccggtcgtccagcaccgccatctggaaggagccgtgcatgctgccaggcgcctcgtcaaggtccgtcccgctgtagtactggaagcaggtcccgggcttgatgatgggcgtgcagccgatcacgccccgtgttccccgtgggacctcggtgacggtcaccccccgcgagtcctggatgatccagtgccgccccaggagctgcactgtctctgtgctgcaagaggaaagcgtgaaagggtggaatggggtggagctgggtgggtctaggggggggggggggggggcgggctgggggggggggggggggggagtgtgtgtactcgcagatcaaaatgcacttgtcaggcnnnnnnnnnnaagcgcgtggcggggttgaacttgttggagagacaatcgagactgggaaaggtaaacactcaaattagcagtgatcgaaggaaatctggagaatggtgggtgtctgctcagggtcgaacccttcttcatgccagtgccatgccatcagtcggccttttgtggtctccatgctcagaggccaccgaggccccactcctcaaactggcaggcatagggaggtggccacccggcaggacaccgggcagaccgccccctcatccttgcaagtgaccgggagggtgcctggcaaccctgtcagcagtacctgtttgctctatgctctcttcatctggtatggctgtatggtaccatgtgcaccacagtctgagcccagagctgcctccctcatgcacctcccgccctgaccccgtccaatctccccacacctacccgacatttgccacacggacacgatatgtgtagaacagcttcgagccccctgcctcctcctcctcctcctcgtcctcgccttcctcaattatttggagagtctgaatgtcgtcttcatgctgcagtgtgtttggcaggggattggctgtggggcttttgttagctggtgcaggcatggatttcgcaccactcgccacaatgacctaggcaannnnnnnnnntttttgttagctggtgcaggcatggatctcgcaccactcgccacaatgacctaggcaaacagatcagggcatggctccacatgcatgctgcatcccgtggccgagtaccatgtatggctcactcgactcacttcccgcgctcacccccacaaagtctgcagtgacctccacttgcactccacgagtggtggctgagctggacccccgtgctaagtgaatctggtcactcagcactcggatcccctggatggcccggtccaggtcattcggctcggcatctggcgggaggggttgtcggaattgatctcgtactagggtccgcaggctggaagccgtcagtgtctcgatgccctgcagggtctgcacatggggggcgtcattcacatttgtcagccaactggaggcacgccgagtcggtcgccattatgtccgagttaacattgccaacaacaaaataccctgcatcccctctcgccccatctgagcctgcatccctcacctcagccagccagggcaggagcaggcgcgccgtctgcgctcggtgctcggatccaaccttggcccacccgtgaccaccgccctgtcgcagccatgcatgcttgtctaatggagtctgtagcttgaaagctagaggtgtccgctccaactcccagatttgtcggagcaaggctttgtaacaggcccgcagcggacgggacagcatagcgccacctgctccaccacaagcgatccgatgccttcttcccacaatgccagattgattctgaggggtcgaaggaatgcggtatccctgggttcattgcgaggagggggcatttctcacctcgatcaaacatgacgtggccgcatgagcgcgcgggcgctggtcggtgggcgaacaccctgtgaaatactactaccgctaaaagtccaacttaacaatatctccatctacatagtaccattcaattgaacatacagcatgccgcgggagtccgaagcgnnnnnnnnnncgaaatactactaccgctaaaagcccagcttaataatatctccagctgcatagtaccattcaattggacatacagcatgccgcgggagtccgaagcgttcctgcgtacgtggcgggtgcccgagactgccgagtacctcgtcgcccgcaaatacacccgagcgacgctccagtttcccgaccacttactgtctgaggcagccaaggtggccgttagtgtgcaagagtactgtgcatcccgcgaccatgaagtgcaggtatgccgatgtcattcaatgcgggacgaattgagcnnnnnnnnnnccccagtaatagccccctgctggtctatcgaattgcaagatgggaagcttacgtgtgactggaaggagagcacacgcccatatcccacatgcatcacaggtccactatgggcgagcatcnnnnnnnnnnatcagagctgccatcgaaggccacctctgaagacctgctaaatcttacatcggtgccccctccgagcaggcgtacatccttgcagatacgacatacaatagtctgagtgtggatgaagtcgcagctgcccacgtcgatgctgactgtgtggtgcggtgggttgttgtgcaaccgtggggaggggtgcagattggtgaagtgtgcattgcgagccatattnnnnnnnnnnnnnnnnnnnnnnnnnnnnnnnnnnnnnnnnnnnnnnnnnnnnnnnnncatgaccgccctgtcacgaatccccgctttctttgtcttccccacccaagacctggacgtggatgcggtggcttccaacctctcctcgtccacgctctcctccctggacactcctgtcctgtgcttcttggaccagccccatctgcaccagcggcccgagcttgccgcagaagttgcacggcgaatggaggccgcagggagtctatcaccccactggacatggccggatgtgcccatccgccaactggaaccagaagctttgactgcttccggcgccgggctggcctcctgtagggctggggatgagcatgcgcagacggattccgctggcggcgcgacgcgaggcacctgctgtgcgaatcaaggcgactgcagcgcgaccgcccctgcagattccagtgtcggggagctgcgagccgcagggtaccgctggagcggcactgagatgggtgccggccccgtgacctacatttggataggagcgccagatgcacctgcactccagctcctccaactcacccgctccacgctgccctggtggacccttgatcccacgacgtgcaccctggaggagggcctgccggtgggagtgcggcgcctgctgcggcgccggtacgcgctgatggagagggcacgggatgccagcatcgtcggtgcgtggactggacgggtaacaggggtttgggggagagggatgattacggagcactagtgctaccctgcgcgcgggaagcatgtcggcatacattcatgctttgcttgagcagtgcgacctggatcccagctcaacgnnnnnnnnnnggggtaacaggggtgtgggggagagggacgattacggagcactagtgctgccctgcacgagggaaacatgtcggcgtacattcatgctttgctcgagcagtgcgacctggatcccagctcaacgcccctggcatggtcctgcatctggctgctcgctggtatgccctcttcgtacattgtgccgtccaaatcggatcgtcaagtcaccttttaactcctgacgaatcaccatacctgatccaacctacctcaaccctcgcccacaggcgttctggtggggacnnnnnnnnnnccaactcctgacgaatcaccatacctgatctaacctacctcgaccctcgcccacaggcgttctggtggggaccctgggagtggctgggtatcttggagctgtcgagcagctgtgcaatgctgccgaagccgccgggaagaagacatacacgctgctcatgggaaagcccagcccagccaagctggccaactttccagagatagaggtggggttgtagtgtgtagagggagcactggattgggcattaaaccaccgaactcttactgctaccatgacaaggagactcatgagaaggaacaatcgtgcccggcctccctgctgaagcggccgttgacctcctgcttcccacctgcgcaggtgtttgtgctggtagcagaccctcagnnnnnnnnnnccactcgtgcccggcctccctgctgaagcggccggtgacctcctgctccccacctgcacaggtgtttgtgctggtagcagaccctcagggccagatcctggactgcaaggagtacctcgcccccatcatcacacaccatgaggccatgctggccttctccccagactcggagtgggatgagtcgctgtaccggctcgactttggaactgatgggcctgcacaggtaggcttcggggtggactgtcctgcatccagggtgtactgggtgagcacagggcctggggtgcagcgcacataggctgcgacgaattctcatcgctcacctccccttcccctgccaacctaggcctcgcaggagaccgacgccacgtcagaactcgcgctgcgcgccgccaagggcctgcagctcactccggtcgcgacgacgggcgcgcacgccttgaccccggcctcggccgcagactacctggtgcacaagcgcagctggaggggcgtggaggcaccgctggcgggggcggcgccggcggtaccccgggccgcggtggagggaaggtctgggcgggcggcagggtaccagggcgagccgtccaatctgtagcgcccctgcccacggctcccggcctgctctctctggttcctttgtacaagcaggtgcacgatctcagtgtgtgtatgcgtggtgggcgagtgacagccagcagggaagtctgtgcagagcgcaagtagtgctcattcagcgtgagggctgctagggggggtgagtttgaagagcgatcctgcgaggatctgcgagcatctgcgagcgtcctggctggccaagcgtgcgccggccaggctgctgcggaggggaagggcttcaaggagcagcgacggggcagcgattctggcccaggcgctctcaaaggtatacgcatcccagggtcttgctgccgcagaaggggcggggggtcgccgtccagtcgaactcctgcagcaccagggggttggtcccaaacacctcctggaacgtccttaaatactgcagtggaagggttggtggcctgggtttgtttctttgagggtggttgagattcggaaggcagatggcagggccttggggtgtgagtgagcgtggagcgggctcaggccggcgtgctgcatctgcactgcgagcaaagnnnnnnnnnncagggtggctgaggttcggaaggcagatggcagggccttggggtatgagcgagcgtggagcgggctcaggtcggcgtgctgcatctgcactgcgagcaaagcagcacgggtgggggctgcccgattcccgcagcaccagcatggagacctccatgtcagcgccctgcacggcgccaagaaatgcgctgcccgctcacagtttgcgtcgcgtccaggaactttgcaaagttgtggctgatgccgacgggagacagcttcgagatgtccactcgccgctgcacgggagcgggaggtggaggtaggcgaaggggacttggcacgggcttcagcctgtcaaacaggagtgaaagtgctgtccctgcacagatcgacggtgccctgtgccgctgcgactccaggaatccccccacaacctgttcccagcggaccttggggcggaggaaggagatatagcggactggcgcagcgttcgaggcaccgcgctgcagcgccgccgtgcggttggccagcacgaaattcatcagcacgtcctcgccgttgaacaggcggtcgactgcagggatgagagggtgcacgtgtgtgtgagtggaggtgtgggttcgctgtataccatgccacgctgctgcaggggcctctagggcacgcttgaggtcggcatgcagcgggccctgagacccgccggctgtcgagcgccacctccacctctccaggtctggtgggagggatgaggtccaccgcgcaccctcctcccaaccctcccaccagaccagcacccggcagcgcaccggtggcacgggcaggcgcgacggnnnnnnnnnntgcgcaccctcctctcaaccctcccaccagaccagcacccgacggcgcaccggtggcacgggcaggcgcgacggcgtcggcccagtaggcggggaaggcggtggcggagtccaggaaggcagcgccggtgaggatgacgttgtacgccccggcctcgatggtgtccctgcggcggcggcggcgcgacgggcagggcaggcgtgaatgagcggcggcagtccgcttcttcctgtcgcaaagcgtgtcagagcgtgcctcgtggcggccagcctgcgtcaaccgcctgccctccactgccatgcggccgccagcgtgatgggctgcccctggtagacaccccccactcggctgtggtccaggctgcctgcctgctggcaagccctgtgcccgctccctcgctcccacccgccccatgtgctgtgcattcgaccacactgaagcaagcctcaccctcgggcccccagccagccacccccgtgcgcccacacgcacgcaagcattcacaccnnnnnnnnnntgaccacactgaagcaagcctcaccctcggacccccatccagccacccccctgcgcccacacgcacgcaagcattcacaccagccacacttcccccccgcccaacccccctacctctcgccgtggaaggtcaggggctcgcccgccatgcggcgcgggaagaagccgtgcatggtctccggcgcgcggcgccaggccgcgaacccggcctccacgtcggcacaggtcaggcggatgtcgtcgtcgatggagagcaccgcccgcgtgcgcagcgccgggtccacccggaagcgattgttcagcgagttggccgcctcggcgcggacccgcaccggcaccgcgcggtcgtcgtagtccacgcccggctcgggaagggggcctggtgtgtgtgtggggggggagggggtgggagagggcggatgctgagaggtggggcctgcctcggtcgagggaggtgggggccagctcaacagcgcatcgccgacgccgccacaggcacctgcccnnnnnnnnnnggggagagggctcatgcttagaagtggggcctgcctcggtcgagggaggcgggggccagctcaacagcccatcgccgacgccgccacaggcacctgcccggctctgggagcgctgcacaagcacaccacccctcccacacgtccccttcccttatcggccccttcacaacccctcccccatcctccagccgcccttttggggtgaaagactcgtgcccatccccaccccaccccctcctcacccttgttccagaccacgacgacctcctggacggaggggcaggcggcgtagtgcaccacaaacccggccagcatgggccggcgcgccgcgtaggtcatgaccaacaccgtgaacctgctgagctggccgtcgacggggacgggggcggcacgctccagcaggggcccgacgtagagccccgccgccagcgccgcggcgcccagcgt

SEQ ID NO: 39783 - DNA, 105 bp, Chlorella protothecoides
tgagatcaggtgatggtctgcgggtctccctggactgaggtgcaacgggttaacccatcgatagtttgatcctctgcccaaccagaaacagatgatcccgccaga

SEQ ID NO: 39784 - DNA, 79 bp, Chlorella protothecoides
cttccgcacgacctcagcacccaccccacctcaccccctccccacacacacaccgcccagctcacgcggcgagggcctt

SEQ ID NO: 39785 - DNA, 61 bp, Chlorella protothecoides
tcggtcatggccgccgtgtatggctgcaggggagggctgctgtgaattcaagggagggaag

SEQ ID NO: 39786 - DNA, 63 bp, Chlorella protothecoides
ccccccccccttcccccagcagctcctgggctgtgtaacccctatcactcctccatgcaatcc

SEQ ID NO: 39787 - DNA, 65174 bp, Chlorella protothecoides
  modified_base (297)..(306): a, c, t, g, unknown or other
  modified_base (376)..(385): a, c, t, g, unknown or other
  modified_base (454)..(463): a, c, t, g, unknown or other
  modified_base (632)..(751): a, c, t, g, unknown or other
  modified_base (1000)..(1009): a, c, t, g, unknown or other
  modified_base (3290)..(3299): a, c, t, g, unknown or other
  modified_base (3383)..(3392): a, c, t, g, unknown or other
  modified_base (3582)..(3591): a, c, t, g, unknown or other
  modified_base (3726)..(3735): a, c, t, g, unknown or other
  modified_base (4367)..(4376): a, c, t, g, unknown or other
  modified_base (5649)..(5658): a, c, t, g, unknown or other
  modified_base (5751)..(5760): a, c, t, g, unknown or other
  modified_base (5868)..(5877): a, c, t, g, unknown or other
  modified_base (5985)..(5994): a, c, t, g, unknown or other
  modified_base (6059)..(6068): a, c, t, g, unknown or other
  modified_base (6343)..(6352): a, c, t, g, unknown or other
  modified_base (6722)..(6731): a, c, t, g, unknown or other
  modified_base (7036)..(7045): a, c, t, g, unknown or other
  modified_base (7486)..(7495): a, c, t, g, unknown or other
  modified_base (7611)..(7620): a, c, t, g, unknown or other
  modified_base (7879)..(7888): a, c, t, g, unknown or other
  modified_base (8322)..(8331): a, c, t, g, unknown or other
  modified_base (8660)..(8669): a, c, t, g, unknown or other
  modified_base (9215)..(9224): a, c, t, g, unknown or other
  modified_base (9871)..(9880): a, c, t, g, unknown or other
  modified_base (10431)..(10440): a, c, t, g, unknown or other
  modified_base (10645)..(10654): a, c, t, g, unknown or other
  modified_base (10984)..(10993): a, c, t, g, unknown or other
  modified_base (11230)..(11239): a, c, t, g, unknown or other
  modified_base (11488)..(11497): a, c, t, g, unknown or other
  modified_base (11576)..(11585): a, c, t, g, unknown or other
  modified_base (11659)..(11668): a, c, t, g, unknown or other
  modified_base (12005)..(12014): a, c, t, g, unknown or other
  modified_base (12749)..(12758): a, c, t, g, unknown or other
  modified_base (13246)..(13255): a, c, t, g, unknown or other
  modified_base (13620)..(13629): a, c, t, g, unknown or other
  modified_base (14224)..(14233): a, c, t, g, unknown or other
  modified_base (14355)..(14364): a, c, t, g, unknown or other
  modified_base (15064)..(15073): a, c, t, g, unknown or other
  modified_base (15651)..(15660): a, c, t, g, unknown or other
  modified_base (16218)..(16227): a, c, t, g, unknown or other
  modified_base (17434)..(17443): a, c, t, g, unknown or other
  modified_base (17989)..(17998): a, c, t, g, unknown or other
  modified_base (18213)..(18222): a, c, t, g, unknown or other
  modified_base (19228)..(19237): a, c, t, g, unknown or other
  modified_base (19720)..(19729): a, c, t, g, unknown or other
  modified_base (20331)..(20340): a, c, t, g, unknown or other
  modified_base (20904)..(20913): a, c, t, g, unknown or other
  modified_base (21127)..(21136): a, c, t, g, unknown or other
  modified_base (22499)..(22508): a, c, t, g, unknown or other
  modified_base (22714)..(22723): a, c, t, g, unknown or other
  modified_base (22913)..(22922): a, c, t, g, unknown or other
  modified_base (23179)..(23188): a, c, t, g, unknown or other
  modified_base (23577)..(23586): a, c, t, g, unknown or other
  modified_base (23993)..(24002): a, c, t, g, unknown or other
  modified_base (25086)..(25095): a, c, t, g, unknown or other
  modified_base (25733)..(25803): a, c, t, g, unknown or other
  modified_base (25893)..(25902): a, c, t, g, unknown or other
  modified_base (25996)..(26005): a, c, t, g, unknown or other
  modified_base (26220)..(26252): a, c, t, g, unknown or other
  modified_base (27221)..(27230): a, c, t, g, unknown or other
  modified_base (27583)..(27592): a, c, t, g, unknown or other
  modified_base (27848)..(27857): a, c, t, g, unknown or other
  modified_base (28717)..(28726): a, c, t, g, unknown or other
  modified_base (30695)..(30704): a, c, t, g, unknown or other
  modified_base (32025)..(32034): a, c, t, g, unknown or other
  modified_base (32720)..(32729): a, c, t, g, unknown or other
  modified_base (32992)..(33001): a, c, t, g, unknown or other
  modified_base (33340)..(33349): a, c, t, g, unknown or other
  modified_base (35489)..(35498): a, c, t, g, unknown or other
  modified_base (36239)..(36248): a, c, t, g, unknown or other
  modified_base (36591)..(36600): a, c, t, g, unknown or other
  modified_base (37743)..(37752): a, c, t, g, unknown or other
  modified_base (38421)..(38430): a, c, t, g, unknown or other
  modified_base (38906)..(38915): a, c, t, g, unknown or other
  modified_base (39093)..(39102): a, c, t, g, unknown or other
  modified_base (39364)..(39373): a, c, t, g, unknown or other
  modified_base (40609)..(40618): a, c, t, g, unknown or other
  modified_base (41120)..(41129): a, c, t, g, unknown or other
  modified_base (44086)..(44095): a, c, t, g, unknown or other
  modified_base (44381)..(44390): a, c, t, g, unknown or other
  modified_base (44997)..(45006): a, c, t, g, unknown or other
  modified_base (45629)..(45638): a, c, t, g, unknown or other
  modified_base (46201)..(46210): a, c, t, g, unknown or other
  modified_base (46753)..(46762): a, c, t, g, unknown or other
  modified_base (47661)..(47670): a, c, t, g, unknown or other
  modified_base (49094)..(49103): a, c, t, g, unknown or other
  modified_base (49516)..(49525): a, c, t, g, unknown or other
  modified_base (49995)..(50004): a, c, t, g, unknown or other
  modified_base (50654)..(50663): a, c, t, g, unknown or other
  modified_base (50739)..(50748): a, c, t, g, unknown or other
  modified_base (50950)..(50959): a, c, t, g, unknown or other
  modified_base (52085)..(52094): a, c, t, g, unknown or other
  modified_base (52708)..(52717): a, c, t, g, unknown or other
  modified_base (53518)..(53527): a, c, t, g, unknown or other
  modified_base (53855)..(53864): a, c, t, g, unknown or other
  modified_base (54872)..(54881): a, c, t, g, unknown or other
  modified_base (55337)..(55346): a, c, t, g, unknown or other
  modified_base (56900)..(56909): a, c, t, g, unknown or other
  modified_base (57788)..(57797): a, c, t, g, unknown or other
  modified_base (58210)..(58219): a, c, t, g, unknown or other
  modified_base (59455)..(59695): a, c, t, g, unknown or other
  modified_base (59755)..(59764): a, c, t, g, unknown or other
  modified_base (60190)..(60287): a, c, t, g, unknown or other
  modified_base (61181)..(61190): a, c, t, g, unknown or other
  modified_base (62149)..(62158): a, c, t, g, unknown or other
  modified_base (63273)..(63282): a, c, t, g, unknown or other
  modified_base (63733)..(63742): a, c, t, g, unknown or other
  modified_base (64357)..(64366): a, c, t, g, unknown or other
  modified_base (64697)..(64706): a, c, t, g, unknown or other
  modified_base (64919)..(64928): a, c, t, g, unknown or other
cggccgggcctcgcgcggccgcggccgtcctgcggcgccgcggcgcaatgttgagagcgctcgcgtgccgggcaccccttgtccccttgtctgtacggatcctcagccagcgccaaccagggctggttcgcacgcctcggtaccagttgcggggggggatattgggtaggaaggtacagggggagtggggtagcagcaaagcaagggggggtccaagcgggcatgagccttgggagaaaggaggcatggggttttcagcaagctcagaacaagccagtaaaagaaggaccctacagnnnnnnnnnngcggccccccccctcgcccacacatgcaccaagcagcccgcctcagctcttggcgtgcttggtgagccannnnnnnnnnacgcccccccccccgcccacgcatgcaccaagcaacctgcctcagctcttggcgtgcttggtgagccannnnnnnnnnttccaagcgggcatgagccttgggagaaagggggcatggggggtgcagcaagctcgaacaagccagtaaaagaaggaccctacagggcctatggcatgcgccgtgctgacgtgacagcaatccagcatcagcggcacactgaaagggtgctcggggtgggcggatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcagggtgacgtcgatgttggactggcgcttgcaggatatgctgtacacgcacacctcccgccccttgatggcctgcagggtgtgagtgtgcggggggggaggggggcgggggatgctggggtcagggcaggagtggtgggaggtgcaggcccaggctccaaaacgtcaggagccctgaagccttgctgcaagatttctctccccttcctccccaaaacaaaaagccatacctccagttccagcttnnnnnnnnnnctgaagccttgctgcaagtcttctctccccttcctccccagaacaaaaagccatacctccagttccagcttggcggtgagctctgctgcggacagggcctccggcaggtcgttcttgttgcccaggactaggagcgggatgccggccaggctgggccggcccagcagctcgtgcagctccacgcgcgccgcctccagcccatccacgtcgcccgagtcgacgacaaagacgatggcctgcacgccacggcagtagcgctcccacatggacctgaaccgggtctggccacccaggtcccatagcttgatggtgatgccgccgcgtgtgaccttgcgcatgttgaagccgacggtgggcaccatgtcctccgcgaagctgccggtggtgagcacgttcaccagggaggtctttcccgcgttctgtagccccaccagggagagctccatctccttggtgaagaagaggctggggggagggatgggagaggcaaggggggaggggaggggtgggatctcaggcggccaaggttgtgtcaccctagagccccatcaagccgtgatcggtgcatggaggacgctgtgatcggtttgaaaaattgggtgaaagggagtcacgatgtcataccccaggagtacgccagaaaggaaagtctcccgccgagttctcagaaccaacaaaaaggaaccccgcacggcccctccctcggccagtccctccacacatcgccgactccgccaaccttcggatccagtccatgagaccctgccaccagctcgccatcgtgcgtgcacgtctcggaggcccagtaagtgtgggaatgtgcagtatgggacggactcaatatttcgtaagtcctacccaccttcctacaccctggggggcggtgatcagtggatgcagtttataggtttgaacagtgttcggtggatgttatctggcatcgaccatgccagcgcaagggccgggagggacgtgctgcttggctctcccaaacctgtgctgtgtcgaatgtcacaatttcttccgggtgaatcaaaacaggaatctgctccctcgcacacttgtgtcgacagcaaacctcagctgggagatgtaatgtgttgcagccgataagctaggggcacttatgtgctctgcggtggtgtacgggcaacgccccgccctggctgcaacacgaccctcgagcaagtggaccatccgcttgtccacccttggcgcatcaatggcccagacaggccaagtttggcggcatggcagtctctctaaacttttgagagacgcccatggtgagaaggggagcgtgcatgagttccaaacctccatacccgacacacgggttcggagtcttcaaaggactcaaacctgccacgctctgaataaacgcttgcctctttattacacatgcaggccatcccaggctcttcggttcgcaggttcctcgatcagggcgtgcagtgacgatgagagcccggggtgccgtggcctctacagacatgcaagccatgggcctgcccgcccctcccaaacgcatctgcatcctggtggagccctcccccttcacctacgtgtgtggttacatgaaccggtaccgcaacaccatccggtacctgaaggagctggggtgtgaggtgctcattgtcaccccgggcaaggtgaggcctggagggcgcggggacttccaggacgtgcggcacgtgccgcactgtgcttgaccgagtgtttgtccagacggtgcctgggcttgcctgtgcatccctgcagcgtcacatcctcacccgaggctcccattgccacctttgcgcagagcgtcgcctccaccgacgactcccagcgccagcctgaagagttctgcggggccaaggtggttgaggccatgtcctttgcctttccctggtatgcaaagctgccactcacctttgggctgtccccacgcatctacaaggaggtcaagtgcgttccgcgggcaattgtgtgtgtgtgtgggggggaggggttgtgagagtgagagcagtggggaaggcagtcgcttgagctaccagacccctgaagcgcttgaggtgtgcactgtgtgctggcgaccactgcgcatgtggttttagttcggagtctgtccagaccatgctttgctgtagcttccgccacggcctctcctggctttgccgatcccgattcactcgagccttcaactcccacccggtaacacgcaggtccttccagcccgacattgtgcactgcacctcccccggcaccatgatcctggccggcctgctttacgcccgtnnnnnnnnnntgggcaattgtgtgtgtgggaggggaagggttgtgagagtgagagcagtgggaaaggcagtcgcttgagctaccagacccctgnnnnnnnnnnaagccttcaactcccaccctgtaacacgcaggtccttccagcccaacattgtgcactgcacctcccccggcacaatgatcctggccggcctgctttacgcccgtctgctcaaggtccccttggtctacgcctaccacacccacgtgcccgactacatgccaaggtactacggcggggggggggggggggnnnnnnnnnngtttgcctcgggaccctgggcgagccctgaagaagccgcttgctctccgcctcgcaccctggcgtgcaagtgcccctgcacggacaccctgccccacctgcgccgatggcgcaggtacaacatgcagctgctggnnnnnnnnnncgacaccatggctgtttgcgggccagggtcatgggggggtggcatccccgcaagcctctgggatttgcctcgggaccttgggcgagccctcaagaagccgctggctctccgcctcgcaccctggcgcgcaagggcccctgcacggactccctgccccacctgcgctgatggcgcaggtacaacatgcagctgctggtccccgcgctgtggcgggtgctgcagtacttccaccgagcagcggcgctgaccctggtgacctccggcgtgatgaagggggtgctggagcgggctgcggtggcgccccccgccgccatccaggtgtggaagaagggcgtctgctgcgacaccttcaacccgcgctttgccagcgaagaagcccgccgaaagatgctgggaagccatggcgaggggcccctcctgctctgcgtgggccggctgggtgtggagaagaacctcaccttcctcaaggtgggctcccatgttgaggggcaagggagggggtggggagagggggatgagcgctggtgatgccggcgggcctgtgcaagggctcgtcgacttgcatcctttgcgacgtgagtcgaggaatcctgaatgttgaagctctaccggctgacagccccttctgcccnnnnnnnnnnccctttgcgacgtgagtcgaggagtcctgaatgtttggagctctaccggctgacagccccttctgccccctcacgcctcgactcacctctgcctcacccccgcactccacacctgacaggacgtgctcaagggcgtgcccggcgcacgcctggcgctcgtgggcgacgggccggagcgtgcatcgctggaggcgcactttgccggcaccgccacgacctttgtgggcatgctgcacggcgcagagctggccgccgcctacgcctcggcagacgtctttgtcatgccctccgagagcgagacgctgggtgagtgagaggtggtgtccaggtggaggaactggatggaaaggggtgcgtgctgatgcggctcctgacaggctcgggcaaggggccatgacccaaggccaatgcccatgcgagtgtgtcaggttccgcagccaaggccaacccctgtctctcctttgcactcatgatcgacagggtttgtggtgctagaatcgatggcttcggggacgcccgttgtggcagtggaggctgggggcatcccggacatcctctgcaagcctggggtgacagggttcttgtaccgatctggggacgtggcagcggctgtggcggctgtgcagaagctagtggctaacgaccagctcaggtgcgggccttgtgggccacgtgtagggaatgtgcggtgcccgcaaaggggtggacagggtggggcaaactgtgatggtgaggagatgaggtctgttttcaaaagacactgacgagacaggcgcccagtacccctcaccgctgtaataccaacaccccttccattcatgcatgcagggcccaggtggccgccgccgccagggaggaggtgggcctgtgggattggagggcagccacgcagtacctgctacagtatcagtaccccatggccatcgccgctgcggcagcggcgggcctggggcggaaacaagccgcgctggctgcgggcccgacgcccgcactcgcttgacccagtgctactgctctgtatactgaccttttgttatcgaggccacgcacttgtttgccgtgcaaatgttggtgacagtgtttcgacgcctttccagcgctcctcaggccccttttgcgctctgacgtttttcggcctgaaccttgattcagctgttgcaataccagtttgacactcaaagcaaatggaagtggggtatttgcatgctttgggtcatcagacaatgggagtgcagggatttcataacaatcaaggaggattcatcggccgtcnnnnnnnnnntcaaatggaagtgggctatttgcatgggtggggtcatcagacaatgggagtgcagggacttaataacaatcaaggaggattcatcggccgtcnnnnnnnnnngcgggcatgggcgggtccagggtggatcacacaatgcagccagcactgtgctgtcccaaccagcctgaaccctggggaagcaagccagtgaccgcaagaacatgcagnnnnnnnnnnacggtcatgggtgggtccagggtggatcacacaaagcagtcagcactatgctgttccaaccagcctgaaccctgggaaagcaagccagtgaccgcaagaacatgcagnnnnnnnnnnagccacgcctcctgtccccattgcgctgtcccctcgcaggcgcacccttctcataggggatggtnnnnnnnnnncgccacgcctcctttccccatcgcgctgtccccccgcaggcgcacccttctcataggggatggtcgaaaaggcgtcgtcggggtcgatgccgcctgggcagggcaagggagggagcgagggttaggggcctgggctcctcgccgggtgatgtggcggccgtgccacaccgccaagactgacagggcctgcctgtcaggcggcatgcacctgagaggtccggcaccagcgcagtgaaagcgtggcctgtaccccagtcggtcacggcagcctgcannnnnnnnnnatgatgtggcggccgtgccacaccgccatgactgacagggcctgcctgtcaggtggcatgcatctgagaggtccggcacgagcgcagtgaaagggtggtctgtaccccagtcggtcacggcagcctgcatcctcaggattcccaggctggcggctagctggtagcgctggcgggcaggggcgggggaaaggaggggcatcgtgaggcggcaactgacctgacaggtcgggcacgagacaggtgaagtcgtggcctgcgccccaggtctccacggcctcccgcaggtccaggtaccccagggaggcatggaactcatacgtcttataaaggggagcggtacgaggagcgcagggcgcagggagcgtgggcnnnnnnnnnnaaggtctccctttcccatttttcagcaggcccagccaggatgttccatgtcctccggcccaaccccccaattaaacttgctccttgcctggggcaactgccgatccgtccccgtcagcctggcaaagcacttttcgcagaagaggtggatctcgctcttctcgctggaggaggtaaagtccagcgtctgaggggtggtgtgcagcagctaggtgagccgggtgggtggcagggggctgttttcagcacagtggactgctccctgcccagcaggggcaggggtaaagagcctcctcgggctggttnnnnnnnnnnatccatgaccccagatgcgcatcagagggacaccgccttccacacagctcccggcccggtgacactcccgtcctcccatgccacgacctctgtgaggagcgtttccttgacacagctgccatcctgctcatacaccacgctgtgctgccctgtagtgccatatgacatagcagcgcttgagcagagcaggcctcacagtggagacatgatacgctcttgtccctgcaattccctgatgtacggttcccctttccctctcgatgtacaaacagtcaaaaatcccgaactcatccctctcaaacactggcacccaccgcttgcagcgtcgtaggcgtcgatgcgccccctgtacatgctccccttgctgctgccggcctcctccacccaccacacccacacctgccgcccgacggccgccgccgctgagcagggcgccatttnnnnnnnnnntcctgcaatttcctgatgtacggttcccccttccctctcgatgtacaaacagtcaaaatcccaaactcatccctctcaaacactagcacccaccgcttgcagcgtcgtaggcgtcnnnnnnnnnngacaccaggcctccccaccgcttcgccgtagagcttggccaggatgcgccgctcgagccacatggtccagccctcattcagccagaagtgctccctgcatgatggtccgtggcagtggagtgaggcccagcaggagctcgcccatggtacctgtgccttcaaccctgaccacgcagcacctcaaggtcttctcagctggcgctgtcgggcccctgcctgttgcactcgccctctccccccccccccccccccccccccnnnnnnnnnngcccgtgccctcaaccctgaccacgcagcacctcaaggccttctcagctggcgctgtcgggaccctgcctgttgcacttgccccccccctccccttccgctacagccaacagaccacgaggcgttggtgaccaggttccccgtccaggagtgcgcgatctcgtgcgccacgacgttggccagcgatcggtccccggcgagcagcgtgggggtcacaaaggtcaggcaggggttctccatgccgcctggtgtgtgggaggtggcgtggtgagcggtctcacatgtgagggtggcctgggagcatggcatggtgcatcgaggttcgaccaagaactggcctacgaaggcatgcacaggtaaccccagcacccataccgtaggggaaagaggggggcaggaggagcagatcgtaccgcccccagacgtagggccccnnnnnnnnnnaaaccccagcacccataccatagggaaaagaggggggcaggaggaggagatcgtaccgcccccagacgtagggccccgccaccgaggcggcggcctgcaggaaggcgtcggtctccgagaactcgtacgccccggcagccaccatgctgggctcggagtagacgcgcgacacggggcccagctccctgctttccagctgccccaccgccagcgccaggaggtagctggggatgggcacttgctgtgcgaagctgaacgtgcgcgtgccgtccccgctttcctggcccgtgcgccctggctcgtccacgggcacggcgctcatcagcgcnnnnnnnnnncaggtagctggggatgggcacttgctgcgcgaagctgaacatgcgcgtgccgtccccactttcctggcccgtgcgccccgcctcgtccacgggcacggcgctcatcagcgccgtcatgacctctggcacgcgcacgcgcgcggcgtaggtcagcttggcaccgggcgtgtcctggcagggcaccagcgagcgggcgtggatggcctggcactgcgtgaagaggtaggggtgcttgccacccgcggtctgggcgggggacagccactggagcgcggtggaggcgggggaggtggcaaagcggacccgggcggagccctgggagccggcgccggcgccggcggggagcgggatgctcagcgccgagcccagcgcctgcgttgggggggggtgggcggggtgccagggcgaattgaaggcagggggaacggatggagtactcagggaggggtgtccagcagacagtgcgggcaggttttcagatgaagcggggggctgccgaacaatccaacgtgcagagaaggggccagtgcctcccgaagcaccacnnnnnnnnnngggggggtggggcggggtgccagggcgaattgaaagcagggggaacggatggagtcctcagggagggtgtccagcagacagtggcgggcaggttttcggatgaagcgctgggctgccgaccaatccaatgtgtgtagaaggggccagtgcctcccgaagcaccacccaccttgtgaggcgaggccagggtgaactggcaggcagctccgtccacggagacttcctggatggccaagtcccgtgtgtccaaaatcagcgcatcgcagcctgaacgcttgacctcgtacttgagctgcacagggatcgacatggggtgggatggggagtaagcagggacccttttgctcccaagaggaatagcctaggggcatctatgcgtgatttaatagcgcgatcacccgtgctgcaacgcccagattgagatgtgtatttgtctggcgcgacacacacctgggcagtgccactgatggtcttggcagagaaatcgaccaccaaatctgtggcatgggcagggcacggcgcatcgctgagcgcatatagccctcttggtttcgcttctgagaagaacgcaagcaccatgcaatgaccagatcaatcggctcacagcagccttgcactttgccagcgcaccgaggtcagcgtgcgtnnnnnnnnnncaacgcaagcaccatgcaatgaccggatcaatcggctcacaacagccttgccctttgccagcgcaccgaggtcagcgtgcgtcacagtgacagcctcgtagttagactgggtggagtgctccacagaggctgccctctttcccattggcacagatgacgtggattctgtggaagagagtggtgactgagctgcaaagagtagaatctgggttcggctgtggatgggtcttgacgaaggagaccgcgggtgggatgttacgacacggggagcccgctgtctggctagatgtacgactgcaccgatcaggcgtcctgtgatgtcgatctgagctttcataagagtgggctggcgttacttggatgggtgaggaagcctaccgtttttgttcggaatcccagctgcataacccatgacgcgcgccgatggcgccccatgaacagggcgcgtggtgctggtgatcaccagcaagaggacgccctggactggaatattgatacatcatatcgaagatacaccctgacatcaggctcacccgaatctacaaccgaannnnnnnnnncgacgccctggactggaatattgatacatcttatccaagatacaccctcacatcaggctcacccgaatctacaaccgaagggcgctcggctaggcacccccaacccacatcgatggggaaaaccaatggcagtgaccccccccttaatggatagaatccctgatggacgagctgaataccaatattgtcctgatgcccagaacgnnnnnnnnnntcaccgacatcgatgggaaaacccaatggcagtgaccccccatcaatggatagaattcctgatggacgagctcaataccaatattgtcctgatgcccagaacgcaaaaagtaatcaacgtaacagccacacgctctaccggctgagctatagcggaaggttgcggatgactccgccagacaggctcgaactgccgaccttgtggtgcgctgttgaacgatgaataattcgatcgagttttgcattatatactgcgagcgccccctcctcagagcttctttgcccgaatgacacattcaggaatcactcacagagaaaatcggtttcctcnnnnnnnnnngcctcagagcttctttgcccgaaaaacacgttcaagaatcactcacagagaaaatcggtttcctcaactagtgagtaccctattccacagaccatacgctgtcaacaacattgtctgtactggagaggatactcaaagtgtgggctgcaaggtacctgtgcttcaagcgaatccttggcttgctgaccatgctgtgtcactcattgcaattccagctgcatgggttagtcattgcannnnnnnnnngaggtacctgtgtttcaagcaaatccttggcttgctgatcatgctgtgtcactcattacaattccagctgcatgggttagtcattgcaataaccagttgtaaaattcattgctgagcgttgagcttcccaaaaattacacacttcagggtgagagcttgcccacccccctcatccgatttggttgttgccatgcatgctccggtgcgacatgaatgcacaccgttgaagagtcactgcccataatgcannnnnnnnnncccaattgtaatagtcattgctgagctttgagctccctaagaagttatacacttcagggtgagagcttgcccacccccnnnnnnnnnntatcgtactaggttcgaaccagtaaagtctgaaactccctagaatatacgagtcgaagcgggtggtgccggtgnnnnnnnnnncatcatactagggtcgaaccagtaaaatctgaaagtccctaggatatacgagtcgaagcgggtggtgccggtggtctcgactggcctggcaccggcggtgcggaatgagtcgagttgcctcctgcttcctcccagcccggtgcttgcccctcgtgcgcgctgcatggctgcataacagcagcatatggtataggcctcccatatatgattggtgcgcgggggatatcctgaatgaggccggacggtgtgctcgcacccgcttctcacccaccctgggactcttgcctttgggcagaggcccgtgtaaccgcccgcggaatccgcgaaggcgttcccnnnnnnnnnnctggtctaggcctcccatacatgattggtgcgcgggggatatcctgcatgaggccggacggtgtgctcgcacccacttctcacccaccctaggactcttgcctgtgggcagaggcccgtgtgaccgcccgcggaatccgcgaaggcgttcccagcggcatgacacgtcatcctcatccgctttacttcctaatgcaggtgtttcagaggccacagacccctcaccagcctgagggccgtcggggtgggcgcccagggcctgcaggtgcgggacggcggcagcaccccctcccccggccccactgacgctgccgcggagcggcggtccagcctgctcagcgtgctgcgctcacggggtctgctggccgacgtggcgggcggcgccgagggcctcacggcggctgcggcggccggccctttgcgtgtgtactgcggcttcgaccccaccgcccagtcgctgcacctgggtaacctgctctgcctcatggtgctggcctggttccagcgctgcggccaccaggccgtggcgctcatgggcggcgcgacggggcgcatcggggatccctcaggtgggcggttgagggcgttggaggggggtttccctggggcgcctgctggcatggagctcggggcgtgcttttgcgatgctcaggccaccgtgggctcgggcgacccgccccaccgcgcaccgcccacccccctcctcgtgcgcaggcaagtccagcgagcggccggnnnnnnnnnnctgagggcgttggaggggggatccctggggtgcctgctggcgtgcggctcggagcgtgcttttgcgatgctcaggccaccgtgggctcgggcggcccgccccaccccgcaccgccccaccccctccccgtgcgcaggcaagtccagcgagcggccggtgctggacgaggccgaggtggcggccaatgcggccagcatcgcgcgcaacgtcgaggccctgctgcagcgggtgccagggtccacgggcgaggcgcccctggtcctggacaattacgagtggtggtctggcatgggcttgctcgatttcctccgggacgtgggtgaggcgcatgggggctggtgaggggtcccagagggtggaaggtggcacagggtgcacccgtgatctcgcacgccatgcgcctgcaacaagcagccggcgtttcgagcaggccatgcagccagccctcgtcaattgaaccgatgatcttcatgcaggccggcacgcgnnnnnnnnnnggagcaggccatgcagccagctctcgtcagttggaccgatgatcttcatgcaggccggcacgcgcgagtgggcaccatgctggccaaggacagcgtgcggacccggctggaaagcgagaccggcatctccttcaccgaattctcctaccagctgctccaggggcaggactttgtgcacctgcgcaagacgcatggcgtccgggtgcaggtgggaggtttgggtgggcgggtgctttgctgcagctttgtgcatcggtatgtgcggtgtgcgctggtcgaggtgcatggagtgagtgagctgggcacctgctggggtgagagcccactgctgccgcagacagaccttggaatcggtgcttgaatgnnnnnnnnnnggctgcagctttgtgcatcagtgtgtgtggtgtgcgctggccgaggtgcatggagtaagtgagctggggcacctgctggaattagagcccactgttgcctcagacagaccttggaatcggtgcttgaatgcatgcgatgcaggattgccatgcccactgaccctctctcactcaatttccggccatcaggtgggcggcagcgaccagtggggcaacatcacggcggggacggagctcatccgcaagaccatggatgccgacgcatttgggctgacggtgcccctcctgctcaagtccgacggcaccaagtttggaaagtcggagggcggcgcggtgcgtgtaaggggcggtgtggggggttcaggggcgggggggttgaaatcgtttgtgatggatccatacggacttagtagcctgccatggggtctccagcgcaatcctgaaagggggcgcaagtctggaccctgatccaaccgttcagaatgcggccatgcttttggcctcatgtgcgcaagttggtctgcgcaggcagcaccatctcagtggcacgctgtctcacgcacaaaggcgcttaccccgaaccctggctccaacnnnnnnnnnngggggtggtgtggggggttcaggggcgagggggttgaaatcatctgtgatagatccatacggacttagtagcctgccacggggtctccaatgcaatcctgaaagggggcgcaagtctggacnnnnnnnnnnccagtggcaggctgccccatgcacgaaggcgcttaccccgaaccctggctccaaccccgccttagcctccccctccacatgaccaatcctcacacagatctggttgtccccggcgaagctgtccccctacgccttctaccaggccctgctggcgacggcggacaacgacgtggcgcgcatgctgcgagccctcaccttcctgcccctggaggagattgacgccctgctggcgcccggccagccgcccgcggcggctcagcgagcgctggcggcggaggtcacccgcttcgtgcacggcgaggagggactgcgggacgcgctggccgccacccgggccctcgcccccgggtccagcgagggcagtgtggacctacagaccctggaggcggcggtggcgggcggggcgcccaagttcgccgtggaccgtgaggcggcgctgggggggccgctgatagacctgctggtgcgcgtgggagcgcagcccagcaaaggcgccgcgcgcaggctggtccaggtgcggtcgatggggggggggttctggtgtggtgtggacgcggccgtcggagggggtgtggacgcggccatgtgggggcgggggcgggcacgaggtggccttattcccactgcgaggctttggaggttcgggtggaggggcctgaggaccttgcaatgctcccggacgcattgcacccgcccggtnnnnnnnnnngtggtgtggacgcggccaggtgggggcaggggcgggcacaaggtggccttattcccactgcgaggttttggaggttcgggtggaggggcttgaggaccttgagatgctcccggacgcattgcacccgcccggtgcagtgcgcttgtcggtcgcctgccgcgcgccagcatcccccaggcgcacccacccctctccctctttggactgcagggcaggggcctacgcgtgaacaacaaggttgtcacggatgaggggcggggtctggccgccgatgacctcgtcgacggccgcctggtcatggtgtccctcggcaagaagaaaaagctggtgctggagctgggcgtcgcgccgtgaggcacaactggagctctgtgtgcacggggtggcctcgtcttcctgtatgcatcgcaccaacgctgcccagcgcattgtgtgaatggattgtgcctgctggaatcatgcctggctgagccttcttggttgacaaaaggcagtactcacatgtcgaacaccgagggagtcattcaggaatgggactgcttcagcaagccaccctagccagcagccatcactgcagnnnnnnnnnnctttggttgacaaaaggcagtattcacatgtcgaacaccgagggagtcattcgggaagaggactgcttcagcgagccaccctagccagcagccatcactgcagaccaaaagccttcagcagctccggctcggccccgggcaggccgccacagccgtccaaggcgttccgcagcgcggcacactgccgcggcgccagacccatggccagcatgggaaagcggggaacggagcgcagcgcccgcagcaggtccagggcgagcgagggctgcctgcgcgccacgctttccagcacgcgcatcgcgacctcggccagcagctcaggggtcaggacgtgagtcagcaggtgcggcaggcgggcagggggtatggcgcagagcagggcggcctgcgccgcgggatcgcgcttggagccacgccatgccctctcaaactccacccctggcatggacagggcaaggggtggggcttggggtggtgcacatggtgtggaggcaggctgtgcatgcatgaatgtcagcctcttgcctacaaagagttccaggctggtggaggtttgcnnnnnnnnnngtggggcttggggtggtgcacatgggtgtggaggcaggctgtgcatgcatggatgtcagcctcttgcccacaaagagttccaggctggtggaggtttgccagagcatgagatgttttccggcaaagccaaagactagggtagtctttctgacaatcaacccatacctgaggatggcacccggccctggtaggaaggcagggcgccaagggattgcttctctaccgtactagggtcacgagtttcattttgcagcccaggggcaggacatgaggaagccgcctctgggcctgcggcgccttctctcagcagcttttccgcggttgtgatgactctccttccctgctcctcttgcccgtctgcctgagtgccgccctcctgagcggctgtcccattcctcacacccctgtcatcgtcaaccactgtcaccagcgatcgaggcaaccctgtggcagtctccacggaatccggaccaggcggcgcgtggctgccaggcagctcgtcgtcgagggcgggggggctgccggacccgggactcaaacgagcctcaacctgctgcatccctcctgctggcttgtagctggtggaaagcgggaccatctccgcacccctcccttccagacccagagcggccgcgctgccgccggcctcctgctccagtagcaggctgacacctgggctggggcctggttcgcagccctccagggacacggaaactcgaagaggcccgctagggccctgactgccgggactcggcgccccattcgacggctgggaatccaggaacgcgcgcaggcagcgggccctgctttccacggcttgggtggacgaggggtcatggcagaagacctgctcaaagtctgccgctgcgccgtgcatgtcccccagggcctctcgcgccgtggccctgggaagagtgggcaaggaggtgttgagtcaagaaggatctttgtgctggagcccgaggctgtagcgctcggtgctgggcaaggtgccagcgtgtcggccggggcagcaaccacaaagggcaaacgacacccagtggggcagatgcggggggcccctggccatgaaaccacctgcgatggtacgccttgacaaacccggcatccagctccaggcaagcgctacagtctgcctctgctcggccccactccctcgtcttcagatatacagcggctcgattggcaaaggcggctggcgtgggcnnnnnnnnnngcagtctgcctctgctcggtcccactccctcctcttcagatatacagcagctcgattggcaaaggcggctggcgtgggcttcagcttgaggctggcggtgtagctggccgcagcctcgtccaggcgtcccttcctgaaatgctcgtttccctcctccctcaagccctcggtagagcatgtggggggcgtgtgcctcgtgctggcgccaccagtagagccattgcgggctcctgctcctcccggcacactcccacgcacggggggcagctcggcagcaggggtggtgcgtacccttggtttgacctccacgtctttctcccacttgaggagatctttcatgtaggcttgcagctcctgagcctgctgcctggctcggcgctgcgcctccatcaccgagcctgaggccctccagccgaggccaacctgggcgggagaacgagtgcccaatgcaaataaagacaacacatatcactccataagcatgaatatgatatacgatcgaaacaatgctcggcgcagtctgctgaagtgccagtcgcgatccgnnnnnnnnnntcgagcgcccaattcaaatagagacaacacatatcactgcataagcatgcatatgatatacgatcgaaacaatgcccgttgcagtctgctgaagtgccagtcgcgatccgccccacagtgtcgtttcgagcgcgccatgccaaaaaaatcctcgaacaagctgtgggccccgggataaagttgccccctgacctctgtgcatcgcgcattcagcnnnnnnnnnngcagtgtcgtttcgagcgcgccatgccaaaacaatcctggaacagtgggccccgggataaagttggcccctgacctctgtgcatcgcgcattcagccccaaacattgtgaataactcgtaaattgtgtatcgccacaatgcatgcgagttcgctcgctcatgccgggtctccagctcctccatgtcatgcgcctggcaggcagccatgccagaccccaccccacgccacccgccggatgatgctgctcctgccatgccccctcctcctggcgcgcacacccatggcatgggctttcggtcctgagcaggcgacccagggaaggcccgctccctctgggacctcaatcaccgcaacaccgacgatcacgacagacggcggatcatggcctcgattcactgggcgggcttactactttagctaccctccaaccctgcaggcccgtgtcctgcctgcccctgtccgccccaggccaggtgcagtttgttgacttgccttacaataggactctggccagacctgcccagtgcatgagacctctgccaggagctggcaatgccccccatcagtccggtgagtctgcatgagtgcacccctcctgtcaccttactttgcccacaggtcagacagcatccagcggcgtgatcaaggcctccttcttccgtccagacaccaagcagcagctggtggtgttggaacgagcaacctcagagatcaagcagtccctcctgcagccaaccaccatggatgagctgggcagtccggccgacacggcccgcctgctcctgccccggaacaccctcctgagccgtgcctggtcccagacgtatgagcagccagcccccgccacccccggcctacccttgataggggccctcctcaagagggagccgctggtcattcaccggcacgaggcacggctcaccgacggcacccggctgtcctctgcgtcgggcatcatgtcagggctagtcatcagtctgatcgccagcggcagcgatgggaatnnnnnnnnnnttctgcgtctggcatcatgtcggggctagtcattagtctgatcgccagcggcagcgatgggaatggggagtcatgggacacctccctggatgaagccgtggactccttcagactcctgcctaggcgatgagtcagatgtcattgtgcgggactgagaaagagtatctggtgggccgagcagcaatgcaaagtggtgtaaaaagccctggtatagttttgtggagcagctgggggcacctgccaacaggttccaagctgcaaacagttggagtttatggagtcagtaacgtgcatatacttctggtcatccgttttgacattggtaatggagcactagaaaatgctgcacaccagccggaacccacgacgtaagtctgggaagtggggttggcctctctggatcacacccgaaagttatgagattcggccacatggaatgcggcgatcccagatgggcaggggtcggatttggcgattgatgcnnnnnnnnnnccatcggtcttgacattggtaatgcaacactagaaaatgctgcacaccagccggaacccactacgtaagtctgggaagtggggttagcctctctggatcacacccgaaacttatgagattcggccacatggaaaatgcggcgaccccaggtgggcaggggtcggatttggcgattgatgcgaatatcgcctagattcaactaccagttttgaatccggtccctgcactgatcgactgggtgggtgcaaccccaggaggtgggagggccggcaagtgatccttggccaccgagccccacccacagcgcatggcgagggccgtcgtccgatctctgaagctgtgcatgcgcctcctccctgctgatacgccggctgcaggcggagcgaggctcgcgacgacccatcgctcgggtgcttccctgcaaatcagttcccggccagcgcctaggtgtttgaccttgtatgccgggacaagcatggagggtggctggtgagcacccagagcctccatcccgctccccatcttttcatccatgtgctcatttgcctgctctctccccagcgaagccctgcccccctgccacaggcagcctgacaggcacnnnnnnnnnnattttcatccatgtgttcatttgcctgccctctccccagcgaagccctgccccccctgccacaggcagcctgacaggcacgtcgcatcgtgccaccgcccgtgcgcgcccccgacccagccaccagccgccaagctgggtgccaggaccgccatgagcgtcgtcttccccccccctccccctttggccagcgagaccaatccgctgtggactgacgacgcggcggaggagccctgcatgcccccctctcgccgcatcttctgcaaccgcagcctgaacatggcagcggtgagggcggtggggttcgacatggactacacgctggcgcagtacaagcccgagacctttgaggtgctggcccacgatgagacggtgaagaagctggtgtccgcctttggctaccccaaggtgagggtccttgttgttggttctgtgtgggagagggtgcctgtccagggctgcacgtgcatggatcacggataggtggtccgcactacatcgtgcgtcgcattcaggatgttgaattgtgtggctgtggggctggagtgtacaggctgacggagtnnnnnnnnnntggattggtggtccgcaccacaacgtgcgtcgcattcaggatgttgagttgtgtggccgtggggctggagtgtacaggctgacggagtcgtgctggaaggtgtccttggggtgccgcccgcttgacgatacaccccttcctcgatcggaggttgggagtctcacattccatcaatctcttgcaacgcacacaagcccaccaacctcacatgacnnnnnnnnnnaatgcacccttcctcaatcggaggttgggagtcctgcattccatcaatctctcgcgacgcacacaagcccaccaacctcacatgacctgactcatacccctctctcattttctgcgtttccaattccaccccaatcctcacactcgcacaatctccgccgccgcagtccctgctggacctggaattcgactggcgctacatgagccgtggcctggtgatcgacaagcagcgcggcaacatgctcaaggtggaccggcacaagtacgtgaagctggcctaccacgggttcagcgagctgccgcgcgccgcgcgcctggcgacgtacaacgacgcgccgcagcggcatggctacgacgagcccgcctacgcgctgatcgacacgctcttctccctggcggaggcccacctcttcatgcagctggtggagctgctggacgccgggggcagcgacctgccccccggcaagcagtacgccgacctgtaccgcgacgtgcgcggcgcggtggacctgtgccaccgcgacggctccatcaagcgcgaggtggcggccgacccggcgcgctacatccacgccgacccctcgctgggccccgtgctgggcgcgctgcgcgccagcggcaagcgcgtgttcctggccaccaactcgctgtgggactacacccacgtggtcatgaactacctggtggaggggcgggtgggcgcggcccgctccacctcctggctctcccgcttcgacgtggtggtgacggggtgtggcaagcctcgcttcttcgcggagcgcaaggacctgttcgaggtgcaccccccctccggcatgctgtggaacaccgagggcgggtcgcccatggtgcccatcggcgaggacgacctgccctccgccgcgctgggcagcaccgcgccctccgcgcgcgacgtcgcgccgccgcgccctgggggggaggcccgcgtcttccagggcggctccttccacgacctgcacaagatgctgggcgtggccgctgggagcgaagtgctgtatgtgggcgaccatatctacggcgacgtgctgcgcagcaagaaggcgctgggctggcgcaccatgctggtcatccccgagctggaaagcgagctgcaaggcctggcggagcgggggggggacatggccgagctacggcgcctgcggcgaatgcgcgacgccgtggacgaccggctccaggtgtggctgttgtagggggggggaggggatgttctttggttgcgtattgcccattgggctatggaagaacatgcagacaacggcggacgcacatgtggttgggcggacgggttaggcgggcatggcaagctggcacgggggggcggcacgggcacgcccagccgccgnnnnnnnnnnattaggcgggcatggcaagctgggaggggggcggcacgggcacgcccagccgccgctcctttgaatgcatgcatgctgaggaccgggggcctcccgacaccgcgcagaggctgcagtggcgggcggcgcggcacgccggtggcacggcagaggggcacgatggagtggcaggagatcaggcggcagcagcggaggtgcaggcggcnnnnnnnnnnatggacaagctgcagcaggaggtgcgttggtgtgggcgcctgcctgccctgcctgtcgtatggggtgcaagggacggtggggggtgatgggccccgtcccatatgagctctgctccgtcacgcacggcgcaagggaggcggcacgggaggtggcatgacggggggcatgaatctggtgcaagaagactgnnnnnnnnnntgtcccatgtgagctctgctccgtcgcgcacggcgcaagggaggcggcacggggggtggcatgagggggggcatgaatctggtgcaagaagactgggtccctggatgggcctcacctgcgtgcccccagccaacatggagggcgacctaacagagcctaaagtcacctggggatcactttcctgagtccccttccccctaaagtgctcacgaatcccccgctgtgtagagggataggctgcggggcctgcaccagtnnnnnnnnnntgtcacctggggttcactttcctgaattcccttccccttaaagtgctcacgaatcccccgctgtgcagagggataggctgcggggcctgcaccagtcgctgctgcagcgacaccacgagcacttccaccccgtctggggccaggtgctgaagaccgggtaccagaactcacgctacgcgcaccaggcaggcttgcagtgcacgcggtggcagggcggatgattgccggcgtggaggacgggccgtcgagcgccggctgtggctgcccggctcgtggaagatgccggccggcctgcgctgcagctcggtgctcgtgtcgtacagagtcattgccaaacgatctctcctgcacacccttccccaacctaattaaccccccacccacccacnnnnnnnnnnagtgctcgtgtcgtacagagtcattgccaaatgatctctcctgcacatccttccccaacctaattaccccccccacccacccacataccactacagatcgagaggtttgcatgcttatacaccagtcacgtggcaaacctgatgttctactcgcctgacaagagctacaaggcccgaccggacacgatgtgccacgaggacgaactggcgccggcctccgagctgcctcccccttgcccctgacggcagccccctgcactcccctgagtcgtgggtagtcgaacctgaatcatcgtaatggacacggtccgtttgacttgcaagtatctggggttcccagaaaccgagattcgatgtagatcatcgaggccaaaccagaggggaaagcgcgaactacccacatgagnnnnnnnnnngtcccagaaaccgagattctatggagatcatcgaggccaaactagaggggaaagcgcgaactacccacatgagtttcggttttcggtgcatgccggtagatatacggcatggaaggcatgcatggcgtttgaaatacccttctacatacgcatggaggctgcagggtatttactgggataaagatcggcaatcctcggtggatcgcgttatgccgggcgccttcaccatgcagacgcatggcatgtgcggtgcctctccacagtccttgccgtgcgttccactcgccaagcctttcgtcgcacacacgtctgtgcatcgcggcgcctcaggccggagacccgggtctccccgcgcccatcgcccccgccgtggggctcgcccccagtgctccgcacacagccccaccctcgcgcccgacgcgacgccccagcccagccccacgacccccggccccaccggccaggactgggagctggacttctgctcccgccccatgctggatgagcgcgggaagcgggtgtgggagctgctcatctgcgagccgggccccgggggctggcgccacgtccaggtgttccccaacaacaagatcaacagcggggagctagggcgggtgctgcaggccctgctcaccgcccctggcgcgcgcaagccggagcgcgcgcgcttcttccgcggccagatgcagaccatcatcagccgcgctctggcggaccaggacatagtccccctgcccagccgccgctgctacacgctgtatgactggctggcgcagcgcgccaaggaggtgtaccccgcccacccgcgcttctccccgctcaaggctggtacccgcctgcgctccgactggggccccgtggcggagctgccgccggcgctacgtggcgaggcatggtcctttgtgcagctgcccatggacgtcctgctcaaggcatgcgggctttctttttgtgggagtcctctttggttgtgtgggtgtgggtggggtggggtgggaggtaagtggaggaaaagggaagcctgagcgagcagcagaaggttggtgccccatgtgggtatttcagacctgagaacagcattggnnnnnnnnnngaaatctgagtgagcagcagaaggttggtgccccatctgggtatttcagacctgagaacagcattgggattggctgccctccacagttcgatgcgatgggggagcttgttgcccaggttcccagtcgccacgatcacccattcaccaccctcacccgctcaggagtacgaggacgtggacgcggggcgcgcctttggcagccgcgcgccggtgccggagggcacggggcaggacacgctcgtccccggcgtggcggtgtacagccgccgggcggggcccctggcagcctggaccgcgggcctggagctgtgcggcgtggtggccgacaccgagcgcgcgggactggtgctgcaagccggggtgagccaacagtggcggtacgggcggtatggccggagcgaggagaccagcgccgaagcagaggcctggcaggccgccaaggcggacgcggggtgagtgctggggggtctgcgggcgcggcggaacgcttgtgcaggagattggcgtagagtgcaggccttttgttgtgggcagaggaccacggccctatccctggactgcattgcctgcgattgttgtgccaggggtcagagctgtgcaccagccgtgctagcaccccgcacatgcccaaccccgcnnnnnnnnnnnnnnnnnnnnnnnnnnnnnnnnnnnnnnnnnnnnnnnnnnnnnnnnnnnnnnnnnnnnnnnaaaaacccggtgccctgggatgcgggaaaagtgtgacctgtaattcgaaacccggttccgcgcgcgcccagcaccgaggggctcgtcacnnnnnnnnnngaaaaacctgtgccctgggatgcgaccggggaaagtgtgacctgtaattcgaaacctggttctgcgcgcgcccagcaccgaggggctcgtcacnnnnnnnnnntacagccctatccctggagtgcattgcctgtgattgtcgtgccaggggtcagagccatgcaccagccatgctagcaccccgcacatgcccaaccccgctaccaccttgcgcagggggctgcacttcctggcgatcatggcgtcggcggatgcagagacctgcagcggcctgtggatcctgtgcgatccaggagaccctgcggcctgagcgtgggnnnnnnnnnnnnnnnnnnnnnnnnnnnnnnnnnctatcacataacgtgcaaaccacaacattgtgttcctccgaccgaacgctgtcgattgaagtttacccaatctgctcggaccgcgagtgttgggcgcaacatgtggaagttccgaccctccacggactttgacggcctgggccggtccagcccgctgctgcgcagcgtgaacaagcactgcgggcgtcaggtctggtgctgggaggagaatgccggcactccggatgagagggaggccgtcgaaaaggcccgccaagtattcacagagaaccgacagcaccagaagcatgctgccgacgagctgctcaggtgggtgctggcgtgggcacctgatcggaggagccgattgcccagatgtcgcccctctttgctaacaatgccatgtgccttgcagatcacggcatccttggttgcgggccgtcctgtctgttgagaggtggtcggcgccatgctttgcaggcgtgagggatccagggtgcctcgccccaccctgtccccactccatgtgctccatgcaggctgcagtatgcaggcaggcgctcccgcggccccttccccgtggacaagcgcggcctgtctggatcgggcgcgccggcctcggctgccacggtggaggcgagcctgcgcaacggcatctccttcttcgagtccctgcagtgcgacgatgggcactggcccggggactacggggggcccatgttcctcatgcctggcatgctcattggcttgtacgtcacctccgcccttgactccgtgctgaggtggggcgggagtggcacggccggtctgggggtttgtgggggagcggagggtgctggctggctgggcgctgccccagaggtctgtgggccatcatcgggaagtcctaccgtagcccgggtcgcctcttcgtcgctctgtagcattgagattcttgggccacgccacccccgcgcagtccgcagcacaaggctgagatggtgaggtacnnnnnnnnnncgaggcctgtgggccatcatcatgaagtcttaccgtagcctgggtcgcctcttcgtcgctctgtagcattgagaatcttgggccacgccctccccgtgcagcccgcagcacaaggctgagatggtgaggtacctgaacaaccattccaacccggatggagggtttggcctgcacatcgagggtccctccaccatgtttggcacggtcttctcctacgtgtccctgcgcctcctgggtgtctcgcccgacgacgccaccgctgcggcggcccgtgcctgggtgagtgcgcccggtcagggcattgatgtcaggtcgctgtgggttggaaagagcccaggctgagatcaggatcnnnnnnnnnncgcctgggtgagtgcgccggtcagggcattgatgtcatgtcgctgtggattggaaagagcccaggctgagatcaggatctacatgcgactgcgtgtgggatacctatggtcgcatctgatgcatgggctaagaattgggtacatggccaacaaggctattttgacacactgagagtcaatccttgacttactggtttccccacccctccggacccccagatccatgagcacggcggcgccacctggacgacctccnnnnnnnnnngcgtgcgactgcatgtgggataaccatggtcgcatctgatgcatgggctaaagattgggtacatggccaacaaggctattatgacacactgagagtaaatccttgaatcactggtttccccacccctccgacccccagatccacgagcacggcggcgccacctggacgacctcctggggcaagttctggctgggggtgctgggcgtctactcctgggatggcatgaaccccatgcccccggagatgtggctcctgccctactccaagtggacggggatcggctgggcacacccggggcgcttctggtgccactgcaggatggtgcgcgctgaggcctgtgcccgggcgggggtgtgcactgggatgcgtgttgagctggctgctggaacgtctcttggcccagaccagccatgcactggcgcagcctgcggggcgattggcacgcgctgggcctgcaccagtcagaggatacagaaatccactcttctcgagctcagcatcaatccctgtgccatgtccatgcccctcgcaggtctacctgccgatgagctatctgtatggcaggcgtgccaccgggaagctcacccccctggtcatgtccctgagggacgagctgtaccccggcccctatgccagcatcgactggaatgcagccaggtgattgctgtcttaatgttttggataattctggtctcggatggccgggatcgagggttggtgagggtgagctggctcaactttggatgattcccgaactcatcacccctcacatcctcaacacgttcatcggtacttgcacaccaaagactcttcggactccctcccccccccaccccccaaatgctgcgcaggaaccaggnnnnnnnnnntgttaatcggtattggcacaccacagactcttcggactccctcccccgccaccccccaaatgctgcgcaggaaccaggttgcagcagaggatctgtactacccccaccctctcatccaggacgtgttgtggtggaccttgtacaaggctgagcgtgagtcatctaagaggggtcacggcttacgatatgtgacctggatcacagaagagaagtgctggggtgtcttgcttgttacttcctccagtacactgttctcttgcccatctccccaggtgtgctgaatgggtcccgcctgcgtaagcgtgccttgaaagagtgcatgaagcacatccattatgaggtaggcgcaagtggagaatgaatatagttggtgactgctactgaaaggcacctgctcattgtttgccgtgtaccgcagtgtgcaaccccgcataccacgcagccctgtatttcaaccatgggtcagagaactcagaccggagcctcctctccgcatccctcctgttgcacacaattacttgccgcacaacctcaacacccgactgcacccgaccccaggatgagaacaccagatacattgacattggaccggtcaacaagatcctcaatatggtgtgctgctggtttgagaacccggacagccaggagttcaagctccatctgccgaggtgaattgagttggtggagggaaactcgttatcgtctcgtgtgcgattctaaacccggggggggcaagaccattttgaaagccagcaagtgcactgacgaggacagcgcccagccgccaagcagctgctggtgttaggctgaagtgttgccagtgcctcatgagtgccaagtcaggtgatctaggtgaggtgaacaaacaatgctacagatttgcaatctctgtccacccccatccctcccaacacaaactcccccccatcaggctgtacgactacctgtgggtggccgaggacggcatgaagatgcagggctacaacggcagccaactgtgggacactgcctttgccgtgcaggccgtcgcctccaccggcctggcgggggaggccggcgcgtgcctgcaggcggcggcgcgcttcatcgacgccaaccaggtggcgcaggaggcgcagcagccgctggaggagtactaccgccacatcagcaggggggcgtggcctttctccacgggggaccatggctggcccatctccgactgcaggtgggatggaaagagagtggggggtctacgtttgggggggtgagaagggggtgctcatggtggctggtaagtgcacagggggggccagggagtgccgcagagtatgtgaagaggagaaaatccctgtgtgcttctgccccaggggcctggcaccaatgcagcccagccccatgttcttgatcccaacagccgctgctcccgatgcgcagtgctgaggggctgaaggcggccctgacgttgacgagtcttggccgcgagctgggcgggcccccgctccccgccgagcggctgcacgactgcgtcaacgtcctgctttcctaccagaacccggacggcgggtgggcgacatacgagaaccagcgctcctaccccatcctggaggtgtggggatggctgggcgccgtggatcggaacgatgagtgctgctttcggtggtgtgtagagagcacgagcctttgtctcgacagcacctcgccacaccaacaccacacacgccaccctgccagctcatcaacccgtcagagacgtttggggacatcgtcatcgactacaactacgtggagtgctcgtcggcatgcatcaccgccctgctatcctttgcggcccagcacccggagcaccgcaccaacgaaatcgagatgtcggtgcaccggggcgtgcggtacatcaagaggtacgcatgggcacccatagctttgctgtgtggagcccaggatggcgtcgctagcgtcgggccttgggggtgccacggtgtgcaggtgnnnnnnnnnngtagctttgttgtgtggagcccaggatggcgtcgctggcgtggggccttgggggtgccacggtgtgcaggtgggccgctggactgcacaccagccaccgccaccagcccacgcaccaaactcccacccctctcccccgctggcgcacagcatccaacgccccgacgggtcctggtacggcaactgggcggtgtccttcacctacggcacctggtttggcgcggtcgcgctggccgccgcgggcgaggacgtgcacggctcggcgtgcctgcgccgggcctgcgcgttcctgctttccaagcagcgccaggacggcgggtggggggagagctacctgagcagccagaccaaggtgagggggtgggggtgatttcatgaaggggggggtggcggggcattgcatgggatcgggggtctgcaagcgtaagacttgcacatgctgccgagcctgtggccgagggcgaggacggctgcttgcatgaatctccttgaaaaacgaaacagggacaagcatgccccaccgcatctgccccacccgcctccatactcatcctctctcacaccatgaaaacaatgcccacctgcgctcaggagtatcaccagtcggagggagaggcgagccacgtggtgaacaccggctgggcgctgctggccctgctggcggccaagtatcatgagatcgacgccgcgccctgccacgcggccgcccgctgtctcatcctcgctcaggcaagggtgtcagaagtgaagagggaatgggaggtgcacgcccctgctgagtagcgtgaagctgatgagggctcacagagaaggcactacagatagtggtgctcctctgttgtttggccgcgcaaagcgtcctccagctcacatgagcagaaagggggccacactctgtcgtcctgtgactgggtgcagaggtttccttgccaaacattcaattcaagcacgactccccagctcagcgagtccatgttccacactccccaccacctcgccaggaggcgagcggcgactggcctcagcagagcatctccggcgtgttcaaccgcaactgcatgatccagtacgccaactaccgcaatatctttcccatctgggccctgggagagtaccggaaggcgctgctgggagcagggacgagtgcgtgagcctcagagcatgtggagtgtgccagccggctgccactcctggctggagggtgccttttccggcactgtcagcccgccctgtgtgtgtgtgagagcctgtggtgcaccacacaccttttttgatgagcattgtgcgagtctgttacggagggcttcctgaggaaaggttgnnnnnnnnnnccgccctttttggtgagcattgtgctagtatgttacggagggcttcctgaggaaaggttgtaacggggcaggcccggcgtagaccctgcctgtgaaaggcgaggagggagcccagatgcttccctgccttgttttctttctgagcgcttggccacacccagaaaagcatcctgggcagctgaatcatgcagcggtttgagggcatctcacccttcacccatcccctgccatccccatctggcctttctccatataaaaagaatggtgcggtgcctccaatgggtatgtgacaatgggttcatagatggtggtgctggtgggggaaaagcaggggcccacgccccgctcggcgggcggtcacagctgcaggtgccgcacctcgcagttgtacatgcgctctggcttgacgccgcagtaccccgcgcagaagtgcttccagaaggagctgtgcccgaacgccacgatgacggtctcggggcgttcgtacagccagcgcttgaaggcggcgatgcgtttctgcgcaaagcatggggagtgggcttactgggctcaaagctgatggagggttgcagaggcgggctgggacccactcgcatgcacccccgacccctgcaggacatgtgggcgattcgaagcctcccctgcctcccacacaaccacccgccccggcccacctggacggcggnnnnnnnnnngatgtgggcgattcgaatcctccccttcctcccccacgaccacccgccccggcccacctggacggcggcctgcttctcccgcgactggaaggtgcgggtgatggtgcagttgggtttgtccctggggcagtgccaccaaatgtccggcagctcgtccaactgggcggccacttccgggtactgcagtttcagtaccgaggcgggctggccgatgtcgcccgcggtgaccagtttttccctgatctcgctgcaggtagagcggnnnnnnnnnncgtccggcagctcgtccagctgggcggccacttccgggtactgcaatttcagtaccgaggcgggctggccaacgtcgcccgcagtgaccagcttttccctgatctcgctgcaggtagagcggggaggggtgggatgtgtggcgctggggcggggatgcttcgatgaaactattaacgggtggtacacggttggcacgcagtgtctcccagcctggccaggctgcgacgtttggggcaccctgtatcgccgcgcttcctagagcagccgcagcctccatccccacccagctttcaggggggaatcttcggtacacccgagcaccagagggtcctctcacnnnnnnnnnnagctggggcgggacacttcgatgaaactaccaacgggtggtgcacggttggcacgcagtgtctcccagcatggccaggctgcgacatttggggcaccctgtatcgccgcgcttcccaaagcagcctcagcctccatccccacccagctttcaggggtgaatcttcagtacacccgagcaccagagggtcctctcacccacctcctgatgtgcaggctggcggggaggcggacctcgcccccacccccccgctccttgccggtgcaggccagcaccagggtctcgatggcgcgctgcagcggcgaggtcacccagcacgcgtcggcggggaggcccagcgcggccagcgtgttgcgcagctcgcaggcctgcgcccgccctcgcgccgtcagcggcgcgtcgaagatgagggggtcgtcccaccccgtccccgccgccgccgtggcagcgttgtactccgattccccgtgtcgcacgatgtacaggtgctgcgtggagggaggggatatgacgggggaagggtttcttggggggcgttctgaattccttgttaacaaggcgatgaggcacaccacgaccaggctgggggggggcggacaagactgggcttcaaaggcactgccccgtacattgggcgacatgcgttccataacgggtcctgacctcacaagggaggcccccatgtgcaacagacactcgactcccctgccagccccacatctgccactcccttcctcctctcccccaccttctccgccgcgcccacaccccccaaacaaaacacaccttgtagtccttcttgggcttgaagatggggaacagcttctgggtggagtcggagacgcagccgatgggtgccgccaggtctaggaggggggtgttccccgcggctgcctctggggcgggaccctggcccggggcggagaggggcatgggcgcgtcctgggtgcagccaaagctgaagcgggtggagccgccctcgtcggagggggtgcggcaggagggcggccccggcgcgcagtgcgcctggctcaggctgcgctcgtaggcgggctgggagtgcagcgtgaagccgtcctcgctctcctcgccctcgctcccagactcaccgccggggctgaggtcggcgcccgcggcgggcaggcggcccaggtccagggtcagcacgggcgcgcccaggcgcggcgtggccagggtctgcgccgtcacgaagcggcgctgcagactagccagcgtctcctcagccacccgcgggcccaggcgcgtggcgcagcccgtggcagaagccatcacggtgtcgggcgggtgcagggggagccgcgcagcagctgggtgagggtggggagggggtggggatgggagggtgagggactgcaggaaaataaggccgtcagccatgccagacagacccaaacagctgcaggggcttgggatctgccaaggtacctggcgtgatggccggcaggaggtcgatggcgggtgagccgggcgccgagtccgactccttggggcgccatgccggggcatcctggttgggtaagagtggagagggagggtgggcgggacacggtggggggctggctgttgggcacgcccggatcctatgatatcccctcaggagctcactgctgaggtttgggggcagaggtagtggaggatgctggacttgcggcgcttggggtccgggacctcctccgacagacccggacgggaggggggtacggcagcgcagctgccgcgtttgcttgtcatgtggcacgccccgacagcgcgcccgcgtcgagaacccttggatcaggcccttacaaggcgcgaggagccatgctgccccctcgtctgccctctgtccacgaaaccaggtgggagcggtctggcagacagcccggccgatgccgcccggtcacggctaggagcgggcagatggggccaacatcggtacaaggaactggggaggggagctttagcgcagtacggggagcgatgcggcactgtcggcccctcgaggcgcagcgtgtgatgagggggaccctcccagctgcaccccccgcaatcgaatggtgccgggaccaggttcccgccctcgccgggcggggtgggtggtttgcctctgccccttcccgccacccactgccttgattccnnnnnnnnnngccaggttcccgccctcgccggcccgggtgggtggtttgcctctcccccttcccgccacccactgccttgattccggatccgtccgtccctctgccacctcttctcctcctcctgcccaatcacagtccaccgtcaccagccgtatgcatacacggtgcgtggcatggcctccgtcaccgcccaccccagtgcaaagtaggagaagtagcgcgccgtgatctccacgtcccagggcacccccgccgccgtgtgcggcagcgccgccagccgcgggtcccgcttggcccccggcgcgcacatgtccgccaccggaggctgccacagcgcgcgcagggtggtggggaagaagcggtacaggaggggcagcagcatcgcgcaggcaaccctggccgctgccttggccgccgccaccatggccagccccagcgcgacgcggcgcgcggcggccggcgcgcccgcggccgccacgcgggacaggaggatgccgggggcgtggtgcgccggccaggtacgggcggaccccgccacgaccccggacgacgcgcccaggaaggaggccgtgaactcgtaggagggggtgtactccagggggcgcgggtgcaggcgcagcgccaccagcgagacgagcagtgtgcagggaagtgtgtgggggccactcaggatgctcgccaccacctcgtctgcagagtagaaaacaggggaagggggagatggtggtgaggacttcgatgtgggtgggnnnnnnnnnnaggaagtgtgtgtgggccgctcaggatgcttgccaccacctcgtctgccgagtagaaagtaggggaagggggggatggtggtgaggacttcgatgtgggtgggtggggatgccggggatgggatgcacgacgtcacctcctcttgctgtgcctgactatacctagacctgcaggcaattgcctgtcacagcagtgcctcaatgttatcagcctgagcaccaggcacacacctctagatgaggcaggccagccaccccatcccagtgcccgaagcaatccggagttcagcagcacctttccagcagatttgctcaagccttccacgcacaccttccacatggannnnnnnnnngtgaggctggccagccaccccttcccagtgcctggagcaatccggagttcagcagcaccttttccagcagatttgcccaagccttccacgcacaccttccacatggatgaagcagccgacaatggtgagcccggcgatggcccccgtcaggatgtctatcgggctgtgcaggcccaggtacaggcgggaggccgcgatccacagcgcccacaccaccaccgcggcatacagcccagctgcaggggtgaatgggtggcatgcggggtcatggaggcgatgggagtggaacgagagcttgcagggacgcacgtgcgtttggggctgcacaggttccaacatgctagtgcggccggtcttccagcagtggccgggattcccgaacaagtactgcccgacgacagcttgcccatagggaaagcacgcgcttggtggtttaggaccccaacccatcacgggggcacacctgccgtttcagggccgaccacatcattctccaagaggtagtgcacagtgaagaagttgaagcacacagaattcatgacatgcgacgaggggaggccatactcctgcacgcaggggtgtgatctcatcggggtcattggcattgccaagcttgctggcatgtgggcagtagataaactgtgttggtggtggtggaggaccccaagcaacaagatggcgggatggagtgtcccatccctgcaagagccggttgaatggacgacaaccagctggccctgcaagcccaccttggcattctgctcggcttcctcatgccccttccccaggaagcgaatcgtggagtcccggtgcacaagcccgatgggacggggtccgcacaccaggtccttcatggcgtttccaacatacatagacaatgccatctgccggtgagaggggtgaagcggggcaaaggtgtgaggcatcctggggagcgctgagggagggatccacacatgagcagcatgtggatgggagcccagaagtggggtgaccggtcctgtgtgacacacttgcagaccaaactgtagcccccctcaccggcaactcgcatgcctaacccttctgctccttggggtgaacaccgtcctctgaatcatgcacccccctcgtcccccaagcctgcctcaccaagatacatannnnnnnnnnggccggacccttctgctccttggggtgaacgccgtcctctgaatcatgcacccccctcctcccccaagcctgcctcaccaagatacataggcggagacccagatctgggagccccatccatatcactatcggcaaagcggttgcctgtccatatgggtggcatgggttgtcgcgtgctggcactacagcttcattcagaagagctcaagtcccctactcctacatctcagacggtgcgtccccacttgaccagaggagagtgaggactcttgaactcaaacccacatagaaagtcgtagatacggaggtggaggaccactcaaacagtttcgtgagccatgggcgctcaaagtcctgagcagcccgggtccacactaggccttcgtggacgtggtgcactacccagggtctcacaacgctacgcacgcgctggtgtagccacggaatgcagcagaatacgagaaagagcgtcaccaggaaggcggacagaccgccgaacaatgcgggggcaaggtggtgcaaagcgatccagagtggcagggcgaatgccggtgggctagacaagccgtttatcatattggtccatcaccaggagaaactggaatggctgagttgctcgatctgtgccgtatgggcaatcaagtgctagacgcacgcaagatcgcgatnnnnnnnnnngcatcatattggtccatcaccaggagaaattggaatggctacatttctcgatctgtgccgtatgggcagtcaagtgctagacgcacgcaagatcgcgatgcatgacatgcagggacgcgctgcccatacaatgcagccggctggtggaacgccagcgagaagcagagctgcccttcaccacttcattgggtgtggcttcgtgtatgtgtccttgcaataccacggcagcgtgcatcaaatgatccccatgcaatttgtagaaattcatggtgcaggtgaggatgcgcataccagaggagcaagagagctacctgaatcttacatcgagtccttgagatcttgggcctaagaagcatatgatgacgcacgtctcgggactccgaccacaaaatcatgggcttaagctccatgatgaattctggagagactcctcatgcaagattgcgcgcgcgccgcgaagcccacgtgggctcgannnnnnnnnngtccatgatgaaatctggagaaactcctcatgcaagattgcgcgcgccgcgaagcccacgtgggctcgaacggaagagtgccttcagcacattgcactgcctaggaccaggataatgctccacgcttttcagaaatcgtgcagttttccccagacccgcaacagtggcgtgcagtcgnnnnnnnnnntcaggatcaggacagtgctccacgcttttcagagatcgtgcagtttcccccagacccgcaacagtggcgtgcagtcgctgtcgctccagcagagggacctgccgtcatgccggtggtgtccgtcaaccgtgaccggctgttcgaagccctgggccaagtgtactgtgagtagactcgagttataaaatgtggtgtgccgcagggataagccgacacaggtctgagaacctctactgcctcacttctccctgcagccgatgannnnnnnnnnggatgtggtgtgccgcagggatgtgccgacacaggtctgagaacctatactgcctcacttctccctgcagccgatgaggagtttgacaagctatgcttcgagtacggcattgagctcgacgatgtggtgcgtgctgagggcacaataatgaaagtgcaatcccgtgtttcaataagagctcaatatcctgtagggcttctcctcacaacgggggttgagctcaggccacccacccctcccccgtccccagacctccgagaaggagatgctgcgcaaggagcaggctatcaaggccgactcggcggcgctggcggaggccagcgaggaagtcatctacaagatcgacattcccgccaaccggtacgacatgctgtgcctggagggcatcgcccgcgccctcaacatcttccgggagcggctgccggcccccacctacacgctggctaacaacggtgtgctgcacctgcatgtggtgtgctgttcgggggcggcgttgaagagcgcgggactcggctcttgatagtgggttgttgacggttcatggctcccgggaaatccgatcgctggctggctgcatgcgggtgggcgcgtgaggtgacgcagcctgagctctgggtccgatgtacaggctccgctgagccgccagcgctgtagtgccacgtctggccagcccagattcccatgcgttccctcgcttccctgcacctgcccaggcgtccccaccgagcgcctgaccatcaggcctgcgaccgcgctggtgcgcccctttgcggtggcagccatcctccggggcgtgaccctggacgcggcgcggtacgcctccttcatcgacctccaggacaagctgcaccagaacctgtgccgccagcggaccctcgtgtccatcgggacacacaatctgggcgtcatccaggtgtgctgtttctagagagaaagggggaagctttggagggacaggacaggcacctggagggctctgtcaacctccttcatcacgcactgtcagggatggcgccgcgatgttgtctcgcgcgatgctgcagtctttgatgcagttttcgattgcccatgggactccctatgcatggtctgttgtctgaccacagacagacgcctgctgtgtgagggttcatcaagcaggaggtggttgtgaatctttgccattacctacccacgcctgctgaatctccatgcctacacacaatatgtgcaggggcccttcacatacgaggcgcnnnnnnnnnnatttcgattgccaatggggacccctgtgcatggtctgctgtctgaccacagacagatgcctgctgtgtgagggttcaccaagcaggaggtggtggtgaatccttgcccttacctacccacgcctgctgcatctccatgcctacacacaacatgtgcaggggcccttcacatacgaggcgcaccctccccagaccatccgcttcgtgcccctgaagcagacccgcgaatttgcagccgatgagctcatgcaggtgggacatgtgggaggctgtttggaagacctcacagacaggagtggaggggatgcatgtgccatcggcgggctcacatttcaagcgttacaggctggctgtcgcataccttgcagtgcgcatgagtgcctggcccttgccaggactgcgccgtcgacccacccaaccaccactcactcatacttgtgccgctgaacacgcttgtgcctgacccccccccaaaacaactccccctttcctcactccacacnnnnnnnnnngggactgcgccatcgacccacccaaccaccactcactcatgcttgtgccgctgaatacccttgtgcctgaacccccccccaaaaaaaacaactccccctttcctcactccacaccccagcactacctagccaacgaccagaaactgaagaagtttgtgcccatcatccagagcagccttgtttacccggccgtgtatgacgccaaccgcgtcctgctctccctcccgcccatcatcaacggcgagcactccaaggcaggctgaagggatgagaaaggggggtgattgctactgccgtgcacatccaatgcctcccagaagccccctcgcccagccacacagtgggcatgttgttcagccgcccccagtactttcccccaccagatcctcatcgacgccaacaccccgcaagacatcctgatcgaggtcaccgccaccgacctcacaaaggccaacgtcgtcctgaacaccggtgcgcactggatattggggaaagtggaggtttcctgagcaatcaatgctcgagtgcctggatcgcggtcgagtgaggtggcacctgggttgcgattgtgggcacatgcaaagtcctggcgcatcacaaggtttccttgcttagactcgctggatgagcctgagggtctccagattcacatgcggcaggctgcggtccgagtcggtgcatgccgcagtcccactcctcactcctcctccccccccgcagtctgtgccatgttctccgagtattgcgccgtaccctacgagatcgagccggtggaggtggtggacgcctttggaaagtccacaggtgcatggcggggggtcaggctgggtgtgtggggatggggtgcagggccaggcgcatgcgctacgcgctattcgaacgcacacccctcctcgttctgaaggaggaagtctctcctggccatgatcaagctgtccttggcgcccatcgagcatggcagcaccccgacgcatggaacacccgcgctcgatgcccgccacccagctcatctcatccaccccttccccaccctctgtcagtgacacctgacgtgtcgccccgggagatgcaagtggagctggcctacatccgcagcaccacggggttgaccctggacgccgagcaggcctccgcttacctccgccgcatgcagctggaggtcagggctctgcccggcggccaggcactcggcatccgcgtgcccgtcacccggtccgacatcctgcatcgtgagcatggggattggttgtcgttggaaagctctgaacaagaagggaatgtcgtcgtttcttttgcggaaatttgaggtcctggcgatggctcctgacgcaagatggtccaggggggggggccaagttggttcctgcaacccaacagtcttcccacctgctgggctagcctgtccgtgcctcacacctcccacacgggcccccatctgcttcccttccctcctggccagcctgtgacgtggtggaagacgtcgccattgcccacggctacaacaacctgaggataacccagcccagcgacgcgacgacggggcgggagctaccgctgaacgcgctgtgcgagctgctgcgcggcgacgtggctgccgccggctggactgagatcctgacgtgggcactctgctcgcgggaggagaattttggcgcgctgcggcgtggcgacggcgcgggcggcgcggtgaccattggcaaccctgctaccgcggagttcgaggtggtgcgcaccagcctgttgccgggcgcactcaagaccatcggtgggttgggttcaggctttgggccgggtgggtgggtggaaagggggaggatgggaggggggaggcatgtatgcacatggcagtctgcagatgggagcgtctgcacttgccgggacctgtggtcgattcggatcacccctcgattgagccccctcctccctctgtatctgcggtccctcgttgcaggtgccaaccgcgacgcgccgctgcccataaagctgttcgaggtgtcggacgtggtgctgccgtccgactccgccgcctgcggcgccgtcaaccgccgccggctggtggccgtgcactgcgacaagacctcgggcttcgaagtcacccacggcctgctcaaccgcgtgatggagagcctgagggtgcccctggtcgcccgcctgggcggggaggagggcgagcgggcgcgtgcagcctacggcggcggctatgagtggaaggcagaggacgacgccaccttcttcccaggccgttgcgctgccggtgaggcgtggcattgtggactgtgggaggccagggggtttaagagtgggtatgggaggcgcgggggacgttgaggagggaagcacgagcacctgggcctaagaatcccatgccctgcacacgatttgctcttttgacaaccctagcacatgtggccttcatccaccatgcgccctttcccaaagtacattcccatcaggtccccatgagttcgtgatctcaagctctcattgcctctcaccctcaccgtgcagtgtatgccaagggtgagcgggtaggccagtttggcatcgtgcacccgcaggtcctggccgcctttgacatcgctttccccgtgtctgccctggagctcgatctggagcccttctgcttcgaccagatgtaccggcccctctcctgcgcccccgcttcgtgagcactggcccgctgcaatatcttgcatgttacaatcatcatggacagaggcagagcaggggtgcaagggtggatgaggggggttgagatggcaacagggttgtagccttattccaggaataatcatggagagagagtcgcgggcaggctatatctgggggccgtgcgtgctgcggtgaggcaggcttcgaggctttggggcctgcacttatttcaagagtgtccgagagataagagcacgtgcagcgccaccgtccgattattggcacacattatcgctggtgggcannnnnnnnnntaaagagtgtccgagagataagggcatgtgcagcgccaccgtccaattattggcacacattatcgctggtgggcatggtcagtcgctgaggacatcacatgcctgcagcccgcctacgctttggctgaggagtggccggacgggctgcgacatccagtgactacaaaatatgcgaagggggggcgggtgaagggggtatttgttctgacatctgcagagcaggaagtttgctcaccaccaatccccaatacccaggagcaaagctgcctgggtttcagagcctccnnnnnnnnnnttgcttaccaccaatccccaatacccatgagcaaagctgcctgggtttcagagcctccatcggctcgatcttgcctccccatgtacctgtctccgggatctgagtctgcagcttgtcctccttctgtcatcagcctctgcaccttcagattccactggaataagtggctgagtctcctgagggcgggggaagaagggttttgtaacctcaggagtacatgggcacagggaactgctcgtgcatgatgcactgccagcgctggtctgcagtgtgaaacagagtttgtaaaaagggcatgagggagagccgaggtgaacccacagcatacccaaacgtaccgatccaggagcgtcttccacatcgatggcaggctggataagctcagccacctgacgcacttcagtcagaggcaatggcttggagaccaccacaacgggctctggctcgccgggggcgtatttgtcgccctgtgcctcccgccgcgtcaggggatcgttgcagctccccccagacctggttggtacagggaaatatgaggttcagaccacaatgcgctccacacacctcatcacggctcggggattttggcgagagcataaccagtgannnnnnnnnngatgaggttcagaccgcactgcgctccacacacctcatcacggcacgggggttttggcgagagcataaccagtgagccgcgaagaatgctcaagctgttgtcatagccccggagaggaccactttcttccccaccctccgcacctgagcatggtgcacttccaggcagtcgcgtccttgatgccctgcaactgctcatagtcaacgatgcgccagcgcccacatgcactgcatgtcggggtggtggaagggatgggcggcggggcaagtggcagggcagggcgtggcgacaagcaaggctgccccaccatgggggcctacagccggtgtcccatgctgactcagcatgcccacctgcacatcgcccagtgatcgcggtggtgctcgtcagcatactcccgcagccggcccaggagctcagagaactccccggaaagcaggaatgtacggtcgatggggatggagggctccccaaacctctgcggtggggtcccggagtggggaaagggagcattggaggtcggctgcggcatgctggatgcattctttcagacgaacatggtaccaaaaccccccttcactgcagggcagctccagctcccttgcagactgccccacctcgannnnnnnnnnaaacatggtcccaaaccccccttcactgcagggcagccccagctcccttgcagactgccccacctcgaatgcatcgtagaacctgaggtacaggtcagtgcgctcccgcttggccagcatgacagctgcgatgccgaagccgtttggtctgggaaaggaggacggaagttggagctggagcggacatctaggcaggaggtgaagagcaccgctgtgccttgggcagcttggttaccggctgaccagggaccctgcgcccctcaggcgatccccccaatcatgccagtcgatggcccctgtctctccacagcatcctcccaggctcacgacttgtcatagtccttgaacagggcgcacttcctccccagcaggaccctggggtagggccgcagtcgctgaaaatagtttgcatcggtgctgttgcggcacaccagcagcacgccagggaccttcgatcgtgtcgggcgcatgtggcggcggcggtgagtggggccccgcaggaatccctccctttcacagggctccaacgctcctgaaagggcaggtacagctgccggtgtccnnnnnnnnnntaatccctccctttcgcagggctccaacacttctgaaagggcaggtacagctgccggtgtcccacctccctcgactcccttcccatctggcaacacatagccctcgagaaattgtgaaggcccctcatgcaaggaactgctcacctcgccacgctcgacggcatcgatggcccggttgacaaaccgccactgcatctgtgagtggaagggaggattcagcaggatgtagaatcctttccactcgttcttcagagccagtccattgtcctgggtgcgggtatggggtttgggggctcggatagttgccatgcatgatacctctcgccgaccatgaggagcctaggtgaggagcccccatgtagcatggtttccccacctccacccctgcacccacatgcttgtcgtacaggacctcggcggggatgtttggggcaacccgggagttgctgcacgggtccagcaggcccttgatgaatggaacctcggctgtgggacgctgcagcccaaacacgccaaagcatacggtttcctggggttggaggnnnnnnnnnntcccttgatgaatggaacctcggcagtggggcgctgcagcccaaacacaccaaagcatacggtttcctggggttggaggggggtcaagagggacatgagattgggaatgggagctcagcatggcaccactgagctaaaagtccatcaggtgacgctgcactgtcctattatctggagcgccaagggctgagtggttgttgtcgaccacaacacactcacgatgatccagtccggggtcagccccatcctctcagactcgtcctcgtcagcatcttcgctctgtcgcttgctggtcgctgcctggacctgtggagtgcgggtgggatgactcccttcagattgagcagggtgtgggtttgagtgggaagggagcagtcccctgcctgtgccctcgctgaggctcagattgggctttgagcgtggcgttcatcgggagcggcctcggcacccacctgctgctctgtcttgcagcctgggcagacccagcgctgtgcggggacaaattgcggccccagggaagggcattccaggcacagcgtgtggaaccagcggcggcaggtgctgcacgccagctgggcttcggcgccctggcaggcatagcagcgagcaaaggactgggaggcgcgggtgtgcctctcgtacagggatgccatgcgtgccgcctcttgagccgggtcagtggagctcgactccagctcctcctccgtcgcatgcagctgctttaccctgtgctgggggtgggtgaatgtgtgcgtgcactcactcttcttgccctctggtagagaaggaccagtcccaaacattggagcaggctcacgcaggccagcaggtgaagagttccattggcaccgcccgaggtgttcaattacagagtgctgcagggtcgccagacagccacnnnnnnnnnngtaccctgtgttgggtgtgggtgaatgtgtgcgtgcgctcactttccttgccctctggtagagaaggaccagtcccaaacatcggagcaggctcacacaggcaagcaggtgaagagttcccttggcaccgcccgaggtgttcagctgcagagtgctgcagggtcgccagacagccactgttagctgagatgcatggcacccagccaggtccagctggacactcgccttcccgtcttctggcaccaggccgccagagccgcatgctgcgcacgttcctcatcctcgcagcttgcaaagggctggcatcgccctgctgtcacccaggcggtggtgtgctccccgtagtacctcaccagtactgtcgtggtggccgccgggcgactcagcaccagggcggccgccacgcccttattgcagagggaaaggctccaagcgacaccgggccacttgccagatacccatagccgcgttccgggggggtaggagcccgactcctgtgcagtgcaggggaggcgttcaaggggttgaaaagagggcggggcttggcagcagcctctcaccaaatgacgccttcccctgtcagtgccagacatgagagcaaccggcctccgctgcccaccttcccatacagcgtctcgaggaacttcgtgagctctggaccggaagtgggcatccctgatgcagtcgtcctctcccatgcctgccggcagagcttgggaggagggagtgcggcgtgggaggccgccagcacagcttcggctgccgccgactctgcgaatggtccgatgggggcagctgagcagcgagggaggcatgctgtgctccagtaacctggtgcaaggcgcccatgcaggatggcaccccagtgaccataggcatcttacttgtgggaaggaggtgtgggaagaccttgctcactgccatccggagggacgaccctcgaggctcgagcaactcgatcactgcaatgtcttccttgctgccgttgcacactacctttatcacccgtccctgtcaaggcatgcgatgggcattgtgaaggcgctgcagcatgcggcgagacacataagcaagggcccctggctgagcgcctaacttcatcctcgaggacaacacacatggtatgaaccagatctagccttgtacggggctggcatgatcctggccgggaggagaacctccctccgattgatgcggggcggcatcgagggtggcgtgcggggttccggtgggctacggcaccggtcacacgtcgaacgccgtactcccgcttctggcaaggtgactacacttggaagctcatttcagcaggttaggtgggctgttacccgcagaagcgcccctcggtgcgatgatttacggggccatgcgtcacccatccgggggccccgcctgccaaggcgcgcgcgcgtcgggatcctatnnnnnnnnnntgatgattttcggggccatgcgtcacccatccggggaccccgcatgccaaggcgcgcgcgcgtcgggatcctatctcttcgagaatgaggacttcgatgaccgatgcaaggcccaaagtgtcctacccctgcaagactccaaactcaaagcttgatattcctcctactccagccgactcgagcctgtcccatccaccgatgcctctcgcagcgatggtgtccgtggtacagcccacggcgaccttgcgcgcctggcctacggcgcggccatcccgctgctcgcgcctggtagtacgtgcccaaactgctatcaagatcccagcagaattcaagcaggtgactaggatcactccctggccgtagtctctattacctctcggtgaatgccatgcacggcattgcttagcagaggnnnnnnnnnncccctggccgtagtctcaattacccctcggtaaatgccatgcacggcattgcttagcagaggccggcagttccgacctctgtacccatgtacccctttctgagcctcgtccaggtgatccccaagggacagctggtcctgtccaaggtggcggagacggaggcaaagacgcttggaggcatcctgctgccttccagtgcccagcgggccccaacctcaggtgggctgaagtgatgtatatgctagccctgacagtagggagagctggtgtcccagcacgcatgcggtgtgccatgcatggcatattgctgcgtttcaggcgcctgcccatgccccaggcatccccagacctacaaagcaagcctctacactttacccccctccacccacccccaactcacccaggcgatgtggtagcggtgggcgacggccgcctgcccgaccggacgcacgagttcaccctctcccccnnnnnnnnnnggcacgcatgcggtgtgccatgcatggcatcttgctgtgtttcaggcgcctgcccatgccccacgtattcccagacttacaaagcaaacctctaactgcacccccctccacctaccctcaactcacccaggcgatgtggtggcggtgggcgacggccggctgcctgaccggacgcacgagttcaccctctcccccggcgacaccatcctctactccaagtttggcatcggggtgacggagctggaggtggcgggggaggcccacatcctgatccgggaggaggacgtgctgggcacgctgccctccagcggcgccaccgccgccgatgtgccccggcttcagcccctgcacgaccgcgtgctggtgaaggtgcaggagtccgccggcgtcagcatcggcggcgtgctgctgccggacagcgcccgctccaagccgctgagcggtgaggtggtggccgtggggccgggcaagtttgacaaggacggcgcgcgcatccccccgcgcctccagaagggggacaaggtcgtctacttcaagtgaggcgcgaggcatggcgggggagggggcgggggggtgagtgtagagggacgagaggggaaccgtgtccgggccggtggagtcagccgatgaggcctggcccatgaggcgcnnnnnnnnnntgagtgtggagggacgagaggggaaccgtgtgcgggccggtggactcagccgatgaggcctggcccatgaggcgcnnnnnnnnnngcgagtgagcgcgtgaggagggtcatgcatttcggaaggatgccacaaccagtgcagattgcagcatcggtcgccctcccttcggtcctgacgcctccacactcccattacaatctgtggagccggacccgccccgactgcgttatcaccagggagatacgaatctcctctccgtccatgcttccgaccagggtcattacannnnnnnnnngcgtttggcggtgactctaggcgccagagggcctgggttagcctgcttgaggcagcacaggtggctgccttcctgccctgtcccgtcctgtcctaggactcggtcccaccggcgctggggccgttgtcccagggacgagcccctcaccggccaccacctcagtgcctcatcccctgaaacctacacacccacttgctgtaccaggtacgctggagacagcatggagacgccggagggtgtcaagtatgtcgtgctgcacgagcaggacgtgctgtgcaaggtgtgagcacgcacgtgctcctgtaatgaccctggtcggaagcatggacggggaggagattcgtatctccctggtgataccgcagtcggggcgggtccggctccacggattgtaatgggagtgtggagacgtcaggaccgaagggagggcgaccgatgctgcaatctgcactggtggcatccttccgaattgcatgagcctcctcacgcgctcactcggcccaaggaggagacgcctgatcggaggagaatggatacgcttatcgccgacattctcccgtcatgcgcatcgtgaggctgagcaggcgtggtgcaaggggtgtcagcatgcaagcaaagcccccggctccggcacacgatccagcaaactagtgaccctacccggatgcgaggacacaccaggtgggaatgtctgctcgctggtcaacatatatatcaacaaataaatggctcctcaccccgatccatcgtgtcgaccgcgagtcagggtgtcgccggccgatggcagccccacgcctagccaggtccaggacctcacatccctgcacctggccagggtggacaaccacatactagtgcgcatactgcatagcattgagcactggtgggatcgcatccgagccgcacaggtgtgccgcgcctggcgacaccacctcctgggaccaggaggccagcacacctggcgcgaggtcgaggtaggtccaggtcgcctgctggcggaatttgagaggcgccctcaggaagaccttgctcccggacagacccggcccagacccacgccggagcatgcaccctgtgactcgtcccagttgagctgggcggcagtccttcctcacgcccatccatnnnnnnnnnnggccgggccatgcaccctgtgactcgtcccagtggagcagggcggcagtccttcctcacgcccatccatccaggggccagtgagccaacggtcgccagcccttccctgaccctgaaaccccacacatgccaggttctgctgtgcataaccaccagcaagttgaacgagcaggggatggcgcggaggacccaccagctcacctggtttgctgcccggcacgactggtttcggagcctggccctgaccctgttcctggactccgatgagggggaggccgagctggtgacctatttctacggcctgctggggattctgggtcctcaccttgaacacctggcgctgggagtcaacaacgaccatgaggtcgcctcgtctggcagcgagggtggggattacagcgcccccgagccctacctgctgggagaggggggggcatggatagccctgctgccacgcctccagagcctcactctcctgaccgcgaactaccccgatccacagcacatgccttcaggtgcaggctggggtaaggggggtccccagcggagtcgttcctcccgtcgggctgctatggggtgcagtgtggctggggcccggcgtgcatggctgagccnnnnnnnnnntggtcgtccctcccgtctggctgctatggggtgcagtttggctggggcccggcgtgcatggctgagcctgctccatggagcgagcttgcacgaggccagcctggtggctcggtggagacggtgatcggcccggcaggcactccatgcgccgcccgaggattcgtgggacaccatcgccggtgtctttgcgagctggctccccagccctgctctgccctcccccctcccctgcccaggtctgcgacagctggagctgcccgccagtgccgaaggcagcctggacccccggctgggagccctgggtgggctgcaggacctgaccgtgcacaggctgtgcctggacgacaacaccctggccgccctggcccagctgccggggctgcgatccctcaccctccccggcgtcgagctggaggggctgggcgcttccgtccccggatgcctggccctgcccgacctggagtgcctggatgtgtactcctggcacgcgcggcaccgcctccccgacgcgtccctggccttcctgcgccgactgccctccctccgctcgctcaccctgcgaggctgcgggctggagcaggtgccgggggcggtgcgcgacctgcccctgcgccggctgctctgcggcggcaaccgcatgcacgccgccgacttcatccccgccgggcggtaccttgccacgctgcacatgctgggcttcagcagccaggggcggtaccagcgctccagggccgcacccgcggccgccgccgattccgactcggatgacgcgcccggcagcgacgagagcggcagcgatgnnnnnnnnnngccagggccgcgcccgcggccgccgtcgattccgactcggatgacccgcccggcagcgacgagagcggcagcgatgtgaacatggtcgacgaagggacgtcggaggacgaagcaggcccttcccccgccgcctcgacggggtcgggcaccgcccaatccgcgcccgcggacgggcggcgcgtggacagcaacgccttgggcgccggcgcggccaagcgccgggcagtggagccggctggggccgtggcgaccagctggcagcgtgcaggtgcagccccccccgcgcccgccttctctgagctgtgtgagaagctggagggcgccacannnnnnnnnnagtcgcctcaacggggtcaggcaccgcccaatccgcgcccgcggccgggcggcgcgtggatagcgacgccttgggctccggcgcggccaagcgccgggcagtggagccggccggggccatggcgaccagctggcggcgtgcaggtgcacccccccccgcgcccgccttctcagagctgtgtgagaagctggagggcgccacatccctggaggtcctgcgcatcaacaggaatcccggcctgatcctggaggaggccggtgcgagggatggggggttggcctcgcccagcggggcgccaggagcggggcgaacccgccctttccatctcctgccagacctgcctcctccatgccccagcatcctgccatccaactcgccccggccacgcaggtgtagctcgtttcctggagaacaagccgcgcttctggaagtttgagctgtcaaagtgcatgtgggagtcggcggcagtggcccagcaaatcagggctgcccacccacacatcaagttcctggaggtggactgacgtgataggggctcggatgacctcgcaaccttctgccgcagcagtgggtcctggtgcctcaacctttcgccgcgcagcgccccaagcttggcggggtcaggatgatggcccacttgtgcccggttgtgccccccttgggctttgtctcgctgccgtgctctgataccttccccctttcccgtcggggcttgcgcatcatttggtctcatcacagctcaagttttcccggcctgcgcacctctgtgtacaccgttcctgagtggctagtgagtgtgccacagggggcatgcctgctgcaggaaggttggcgcaggctggaagggaggagaaaggtttggctgactgctgccccagtccacaacagtgcactcgcactctctgcccctccaagaagaaactgattgtataaaagtgttgtttagtctcatcacggcaaactctagaaatgcactaaaaaatgtgacaatcgcccgaagtggggctnnnnnnnnnntacctctgtgtacaccgttcctgagtggcgaatgggtgtgccacagggggcattcctgctgcaggaaggttggcgcaggctggaagggaggagaagggcttggctgactgctgcctcagtccacaacagtgcactcgcacactctgcccctccaagaaagaatgcttacataaaagtgttgtttattctcatcactacaaactctagaaatgcactaaaaatgtgacaatcgcccgaagtggggctcgaacccacgaccacaaggttaagagccttgcgctctaccgactgagctatccgggcagggaagttccccggtggcaactgtctcacatgtgagatttcgtcataagcagggtatacatatgagggtttgactgacgaccaattaatgcccccaccccacgggttaactctccctggtgtacatcgttgggcctccagtccaccctcatnnnnnnnnnngcacatgtgagatttcatcataagcagggtatataaatgagggtataactgacgaccaatatatgccctaaccccctcgttaactctccctggtatacatcgttgggcctccagtccaccctcatctctttcgcgaatgggtccatgcgggccgcacatctcgcatcgctggccgcgcgcagcctttaccaggcccgggtgggcgctccccttccccggggcccggcagcgagcatgatgcgtgccttattcccacacgccattcctggatccacttggatcccgtcccgtcccccactcacaaatgggcgcgtgaggggtactcttggtgtgcgctgcatggccacggctgccgggactgcgcgcaccaagcatgtctacgtctgcaaggagtgcaaggagcagacagcccagtggtctgggcagtgcaccgcctgcggggcctggggcacgtgagcgcagagcctgttcatgtgactgcatttggcccattgtggtagagactgttctgctagacactgtgtggccgcagctggtcgcacagctgtgcgcgtggtgcaatgggcacagtctgtgtgttgtgcatgagagtgcctggcgccgctggccggaccaaactgacccccagcgcccgcgtccacacaggatggacaaggtggcggtgctgtcgccggccgcggagtctggcggaggcgggggcggcggcgcccgcgcagctgcgcgcttcgtgcagggccaggcctcggggcggatggcggcgcctgcttcgtcggcccaggctcgcaggggccagtgggtggaggactccgacggtgggtgtctgaaggcagctggcgagggtgtttctggcgcagggcatggcgtctgggatctcagcccgttggtgtctgtgacgtctggtggtggcttggcggcctagggctcacaaaccgccgcaccccttgataaaccacccgtacacctgtgcgagcagccccgcagcgtctctccgatgtgagccagcgcgggtttggcaaccgctggcgcctgcagcttcccggcagcgtcggctcggagctggggcgagtgctgggtggcggcgtggtgcccgggtcggtcctgctcgtgggcggggagcctggcgtcggcaagagcaccctccttctccaggtgggatgaggggactcaagtgtttggcgtggagaggggggagtccgtcggggagggaagtgacaaggaggtctcctttctggttttatgctgcaaaggcgagccctgctcaggccaccctggggccctgggagggcttgacacatccatgaactgcaaagtaaatgggctgcgctcatcctgctacgtgcccgcacccacccactccctgcaagacaggtggccgcactgcttgccaaggtggggcaggggggtgacgatgggcgccccgtcctctacatctccggcgaggaaagcacagaacagattggcagcagggcggagcggatgggcatgggtcccgagggaggcaacatcttcctctacaggtgcgcctgggagtctgttggaagggccgacctgcannnnnnnnnncatgggcatgggtcccgaggggaacaacatcttcctctacaggtgcgtctgggagtctgttggaagggccggcctgcatcgggctctggtggctgggaccgatggcggccgtgtcggcggggcagggcccttggcgctccccttctcaaggccggctggccaagacgcctctgcttcccaacatgttgcctcaccgcctcgccccgcgcagtgccactcggctggactcgatcctcgccgagatcgcgcgcctgaacgcccgggccgtgatcgtcgactccatacagaccgtgtacctggacgagatcccttcctcggcgggcagcgtcacccaggtgggcagggggggtcagtcggttggacggctgggtccgtcccagaactcagccacaagggtgtgagccatcaaactcctgaacatgcagccgccccgccctccttcccaccccgcgccaggtcagggagtgcaccacagccctgttgagagtggccaagggcatgggcgtccccatgttcctggtcggccacgtcaccaagtctggcgagatcgcaggtgggcatgggtggggggcctttgaaggctagtgccaggctgggagctgtccagccaggtgcgccctgtgtcctgtccagacggcaacccagtcaccgcccttttcttgaaggacctcgggtgctggagcacattgtggacgtggtgctgtacatggagggtgggcgccaatcccccgtccgcctggtgggttcctggaggactgacgggggggtgggtggtggggtttcaggacgaaccttggcactgaccacaccaccatgtgtggggtggacatgtcgacccgaggtcagggtgtgaggcagttgctcgcatcgactccaccnnnnnnnnnnagggggtgcaagtgatggggtttcgggacgaaatgtggcactgactgcaccaacatttgtggggtggacaagtcgacacgaggtcaggatgtgaggcagttgctcgcatcgactccaccctgcccacttgcagatacggggcgtgaagaatcggtacggcgccacagaggaggtcggcgtcttccagatgtttgacgacggcatgcaggtggtggcggacccatcctccctcttcctgaccagcaggcgagcaggatgtggggctggctgcggtgtgggcctgcttgagcagtcgcgctgcaggggccactgtgcaacacccggtgcaccacacagaccttccccatgtgtgcacactcatggactcacaccaccagtaccccctgcaccaccggcaagcttgcagggagatnnnnnnnnnnaacagcccttcccatgtgtgcacactcatagactcacaccaccagcacttcctgcaccaccggcaagcttgcagggagatctccctcgacgtcagctccgccgtcaccgtgaccatggagggctcccgccccatgctcatggaggtccaggccctttgtaccagggcctcccaggtgggcacaggttcgagaggggagggggaggtggctgcctgggcgcatggtctggagcgggtcaggctgggcagtctttcctgtcgtgcccagtcgcgccacaccattcaccatccagtcattccccctcccaccacccccacggccccacagggcccaggcctgcctcccacccgagtcccttccggggtcaagcgggagcgcatgcagctcatcctggccgtgttgagcaagcacacagacatgaagcccttcatgcacgacatccacctgaacgtaaccggaggtgtgggagctgagttgttcgagatgcaaaggggaggggcctggatactctaggggtaggttgtgctgtcgcctgaggagggcatgcctgctctgaccactggcatcacaggccccctcgtcctcagcacttcctacagcttaaatgacccaccaccgcaccccagaaaaaaaactccccttcatccacatgaaggtctaatcatggcggagccggccaccgacctcgcggtggcactggccatagcctccagctactacgaccgcgccatcccgcgcgagctggcgctgatcggcgaggtggggctgggtggcgagctgcgccaggtgccgcagacggagcggcggctggcggaggcggccaagctgggcttcacgcgggccgtcgtaccgccagggggcagcgccggctccggacgccagctggcaaagatgcaggtgcaggagtgccgcacgctggcggccgccatctcggcggtgctcgggggcggcctggcaaagtagggggtctgatgccaaggagcgcgcccggacgggaaaactggcaaccgtggacagattgccgtgatgctgctcccggatcattgctgcatcactggcgtaccgaggaagtgctggccgcgaggccgacatcccaccgctaagtgaacaaactgagtgtgagagatcctttacaacagcagcaacaggggagatttggagggagtatacagagataagggggttgaggggtgtatgcaggccaccgcacagcacaggggatgtgcgcagagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaatgtacctctgggccccacccatccacctcaccctcacacccaacaaaccacacnnnnnnnnnnacattgctgcatcactggcgtactgaggaggtgcaggccgcgaggtcgacatcccaccgccaagtgaacaaactgagtgtgagaaatcctttacaacagcagcaacaggggagatttggagggagtttacagagataagagggttgaggggtgtgggcagtcctgcgcacagcacaggggatgtgcgcagagtgctgccgctggggctggcactccctgacaccatctccatacctaggagggctgatggttggggcccatgcgctcctgtgtccacctgcaagtaaaggagaaaggggcatgtgatttgttcaccaccgtgcaggtactggaaggtccacagggagaaaaggtgaccgttgcaaggcagggacgagacgaggggcaaacagaggtacctctgcagccaacactgggaccctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttccagtggatgtgcttgttccacattttctcccagctgtccccagtcagcctgggcttgcccttgtaccaggcacgaggcgcctggcctcgcagcacatctctccgctgtgcggcctcgttgcagcaggagatgatgtactcacggctttcaatggttgacgaaagggggtaggagtgggaatgacagactgtaaggaaagtgacatgctgtgcccttgtggtgcccttttcttatcacagggctctggaaggataccttgcccactgcccatcaatcacgtggcacccggaccacccagcaacgcacttgaacttcctcgggcgaacttctgttcccaggaaacgtcccggcatcgctgcggcgaacagggcaacctgcgcacaaaaagaagggacctcacagccatgagaggaggccgatgcaaaatgcacatcataaaaaccactcgccgtcgttcacccacccctgcacaagcgcccaactcacatgtgcaccgatgaagaaccccgaaaacattcccggtgcgacatggggtgtgctggctggccccatgaagggcttgcccaggaaatcggccatgctgaccacgcccggcagtcactagtgccgctctcttgggaccaggacctcaggatcggcaaatgataaatttggaagaatgcaccctatttctcgatcgtgttgtttgttcctgcacgcgagttactggggggcccttatcgtggtaccaccacattgagcagtgagcaagtaccccggaatcgtactcggcgtccaaattttgcatgacagttactgtgggacgcaaatccgttcgtgacaccccgatgctcgtgtctgaaagcaaagtttgctcctttcaacgcatgctcttgtattaaggtggannnnnnnnnnatcgcgtcgcgtggtaccaccacatcgaggagtgagcaagtaccccggaatcgtactcggcgtccaaattctgcatgacagttactgtgggacgcaaatccattcgtgacaccccgatgctcgagtctgaaagcaaagtttgctcgtttcaacgcatgctcttgtattaaggtggacttacatcatcaagggagtgctcgcggtctccattcttgttgttaaaccccctccagagccgacccgaacctggcccgtgggcgtaaacgtgttgccaacgagcttgctctatacctgctccaaccacctatcagaccgattccgatgactggagcggcgtgggcgctggcatgtgtcgccttgctcggcgttgcctcggcagctgtgacgcaggacaggatactcaattgcgttccaccgacacagccgcacccaggcaccggcaagacctgccgctccatggcactcattcaacaaggtgaggttgatttcatgagttcactgttgggcttcatcgagcatccatggcagcgaacatggtgtgcatctgacgcgatatcggaacatgccacgaaaccccagccttgccctccaccctgcaggtgatgcgcacaggtacacataccacgcagaatctcccggatcccaggacatcctcatcaccgtggccagtcccaaagctgacatcactgtgctcagcgcactcggcacaccgcttgtcgcctctggcgtgctgggggacaaccagttcatgctcagcagggccgcgcaggagtcggacccaggcccttatgagctgataggtaagcttcgttgggcaggcgggggcacctccctgggaacgtaatactatcgagctgcaggcccacctgtgtgcttggtggtccatgccccgggtcggtcagagtgagagcaacaaccccacgtgcgcccccctttcgcctggcagtccgcggcgtcgnnnnnnnnnntcatgccccgggtcaatcagagtgagagcaacaaccccacgtgcggccccctttcgcctggcagtccgcggcgtcgtaccagagactcagtacactgtctccaccacggtgcacgagcggcgccgctgcctggctggccgggaccgcagcgccctccagtccgtcctggaaggccctggctgctgctccgcacccggctcctgcgcccggctgagggccgcgctgtccgctgatcctgcccaggacatgtgcgaccagcctggcagcctgtgcgacgatgcgggccagctggtcaagctggacctgtctgatcaggcaggcgcgggggggtttgggaagacggtctgggaattgtatgcagggctcacagccgcggcagccgacgtggcgaattggaaatcgcaatgcagtaggctgcctcccttgctgtagcgtagcctgccactctatttgtgccgaggtgtccccccacctcacagtgcatattaatccgtcacctcgccctccaccccctaccacgtagggcctggagtgccccgtcccgcccggcctggccatcctctccgccctgcagcacctggacctgtctgggaacaacctgtccggctccctggaaggcgcgctgccctcgctgggcgccctcccgcgcctgcgccacctgcgcctggcccacaaccggctgaccgggtccctgccatgcgacctgctgcgcgaaggcctggtctccctggacctggccggcaacgcgctgacgggggccgtgccggcgtgctacctggcgtcgcccagcctgcgcgagctgtccctgcggcacaatctgctccaaggcgacctccccgccccgggcagccaggcggcgttggagagcctgcaggccacccacatggtgagagggcggggcgtttaagtggggggagggtggggtgaatggatgtttggcggcccggatgaaaaggagctcaggcgggccggctgggatggacaggtggccgccaagggagcagcgacgtcaccagcggatgacagccagccgccttgcgatcggcgccgaccctgcattatcccaccccatcatccgtgcagagcctgacaggctccgtgcccagcttccaggnnnnnnnnnnaatcgacgccgaccctgcagtatcccacgccatcatccatgcagggcctgacaggctccgtgcccagcttccaggcggcttccaggctgacccacctggacctgcagcacaaccggctggaggggcccctgcccgcactgccccccagcctcctctcgctctcgctgcagggcaacatgctcaggtaggattggcgtggggtgcactgggtgggtgcacacactttacaactcgaatgcttgcccaccctatcgatcttcagggcggggcttgctacaagctttcagcacagacaaggtctccttgatcgtcgagcctagatcaccctctctcacacacacacacagcggctccatcggcgaggggtgggtggccggcctgccggccctgcagtccctggacctgggctccaactctctgaccggcgggctgccggagggcctggccgccnnnnnnnnnncccctatcgatcttcagggcggggtatgctacaagcattcagcacagacaaggtctccttgatcgtcaatcctaaatcaccctctctcacacacacacacacagcggctccattggcgaggggtgggtggccggcctgccggccctgcagtcccttgacctgggcgccaactccctcaccggcgggctgccggagggcctggccgccgccccccacctgcgcaagctgcgcctcgcccgcaacgtgctgtccggcccgctgcccggcgcctggcgcgcctggcgcctggcggcgctcgatgtgagcggcaaccgcctggccggcgagctgcccatgggcctggcccgcctccccgccctgcgctccctggcgctggccagcaaccgcggcctctgcggcgacgtcgcgcgcttcctgtcggccgcgctggcggcgcgcagcccgctgcgcgccctggatgcgtcctggacgggggtggggtgcggcgaggagggcctgcccccctccctcgcggccctggccatgttcaggggcggggaggcggcccagggcctggctgtggtgggcggggatccggccgacgtgttcgatgcgaccgacgcagaggccccggcnnnnnnnnnnggggcctggctgtggtgggcggggaggcggccgacgcgttcgatgcgaccgacgcagaggccccggccagcccgcccgggcgcctgagtctgcgcggcacccgcgtgcggggccctttccccgtttgggtgctgtctgccctggccagggcgggggaggggcagggcgtgcagatcgacctcgcggccacaaggtgtgtgcttgggtcgaggacagaggatgcaggccgggccctgtgtgcaagcgtgcatggcggccggggcaggctccctgccctgcaccaggcacgggctgaatgagtgagggtggcctgtcacccgcactccacctnnnnnnnnnnaccgggccctgtgtgcaagcgtgtgtggcggtcggggcaggctccctgccctagaccaggcatgggctgaatgattgagggtggcctgtcacccgcactccacctcgcccctctgccaagcctccgtgctgccagccctctggtcctcctctcacccgctgcccccatctggctccccccttcagcctgacctgccccggcggggaggatgtnnnnnnnnnnccccctctgcccagcctccgtgctgccagccctccggtcctcctctcacccgctgcccccacctggctcccccctccagcctgacctgccccggcggggaggatgtggccaacgcggcgcgtgcgctgccggcgtccgccctggcgcgcctgcactgcaccgacgccgccgcgctgccctccacgctggcccggcaggccacggcgctgcgtgccgacgcggcgctggacctggccctgcgcgggg

SEQ ID NO: 39788 - DNA, 61 bp, Chlorella protothecoides
ccagttccgacgggtgagtgattccggcagatggttgggcgggccaggacttggatgtcga

SEQ ID NO: 39789 - DNA, 128 bp, Chlorella protothecoides
gctaggttcacagcagcagtcaaattcacaggacgagtgcctcgcttcaaacaccccgccacgcctggtgtgcggcagttacggcgcaatcccagtcattcccaccatcaaccactcccagcaccatg

SEQ ID NO: 39790 - DNA, 61 bp, Chlorella protothecoides
cttctgcgggcagcagcaggtggctatgtgaaaccgctgcaccacacgcatcaacaacagg

SEQ ID NO: 39791 - DNA, 93 bp, Chlorella protothecoides
gaacaaacaaaatgcttgcgagcacaccagccaattaccaccagacaccgtcgacagtccaaaggccccgcctcacccgtgaggtacgccagt

SEQ ID NO: 39792 - DNA, 109 bp, Chlorella protothecoides
gatgagtgcatctcacacgccgttgcaaagacacgggcgtccccacctctgcctccgcgcactctgcagctccatttcccacccccaccacacatggctcccctcgttc

SEQ ID NO: 39793 - DNA, 344 bp, Chlorella protothecoides
  modified_base (89)..(285): a, c, t, g, unknown or other
ctggccgggtgggtatcaatgaggcatggtggctgtgcacctgtagatgcatggtaatgtctgtgcagtcccctgcataggtgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgctgcagtgtgaatctccagctcctctttcccgcggaaacctcccggaagcgttc

SEQ ID NO: 39794 - DNA, 79 bp, Chlorella protothecoides
ctggtcatagcagtcctgtgtttggtgtggacaggtttgtatggggagggtccctggcggccaaagcagccttccgagg

SEQ ID NO: 39795 - DNA, 12046 bp, Chlorella protothecoides
  modified_base (192)..(201): a, c, t, g, unknown or other
  modified_base (260)..(357): a, c, t, g, unknown or other
  modified_base (923)..(932): a, c, t, g, unknown or other
  modified_base (2529)..(2538): a, c, t, g, unknown or other
  modified_base (3063)..(3072): a, c, t, g, unknown or other
  modified_base (3443)..(3452): a, c, t, g, unknown or other
  modified_base (3545)..(3579): a, c, t, g, unknown or other
  modified_base (3668)..(3677): a, c, t, g, unknown or other
  modified_base (4181)..(4190): a, c, t, g, unknown or other
  modified_base (4525)..(4534): a, c, t, g, unknown or other
  modified_base (4870)..(4879): a, c, t, g, unknown or other
  modified_base (4972)..(4981): a, c, t, g, unknown or other
  modified_base (5080)..(5089): a, c, t, g, unknown or other
  modified_base (5257)..(5266): a, c, t, g, unknown or other
  modified_base (5599)..(5608): a, c, t, g, unknown or other
  modified_base (6456)..(6465): a, c, t, g, unknown or other
  modified_base (6693)..(6702): a, c, t, g, unknown or other
  modified_base (7467)..(7476): a, c, t, g, unknown or other
  modified_base (7764)..(7773): a, c, t, g, unknown or other
  modified_base (9779)..(9788): a, c, t, g, unknown or other
  modified_base (9890)..(9899): a, c, t, g, unknown or other
  modified_base (11166)..(11175): a, c, t, g, unknown or other
  modified_base (11403)..(11412): a, c, t, g, unknown or other
  modified_base (11526)..(11535): a, c, t, g, unknown or other
ccaccttccccccttccccctccccccctccccgtctctaccaggccgtggaggccaccaacacgacgctggagcgcatgctgcgcgcctacggcctgacctccaccatcctggtgccgagcgacgcggcctttgacgccgcactggcggcctacggccccgcgctgcgcgacgcggcgctgctcaccgagnnnnnnnnnncgacgccgcgctggcggcctacggccctgcgctgcgcgacgcggcgctgctcaccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtccgtgggcgccacggtctacaccctgttcgacggcgtggcgaacctgaagaccgccaagaaggcgttgccggcgggcaccaccgcgcagggcggcctgacgggcatcgtcatcagcggcccggtgaacagcgccaccgtggtggagagcgacatccgcgcctgcaagaccttcatcaccatcatcgacgaggtgctgctgcccttcgaccccaccggcatcgacgcctccaacgactccggcgccctgggcgcggccctgggcgcgggcacctgctccgtggtgcccaacgcgctgatcaacgcgaccaccctggtgcagggcgggtccaacccgcaggcctcccccgccgcctgctgcgcgtcctgcgccgccaatgccgagtgcaacacctggtcgtactgcggcctggctggggggtgccgcttcccggagggcctcgtcatcccggtgtgtggccggaggaatggggaggtccgcgcctgcgtgccagcgtgggttgcctgtgccccaaggctcccgcaaactcctgaacagactccgcctcacaccccgcctccctnnnnnnnnnnattgcctgtgccccaaggcccccgcaaactcccaaacagactccgcctcacaccccgcctccctgcagtacggctcctgcgagctcaaacgctctgccgagctggcggcggggcaggcgccaatctacggcaacagcgggatcgatgtcgtgcccgtgctggcgggcttcaacgtccccgtcccagactccgaggcgggagcggcgacggcggccaccgccgcgccagctggcgagacactggtcggcaccgctggccgctgagctgcggagcttgctggtccgtggtgggatacgccatcggtgcttgcctggcgtgggttgccacgaggcctctgctaccccagattgcatggttgtttgcgtgatggaactgggtccataccattaattatcaggcctcaatggtgatgtcgggaactcacagcaagacctttgcgattgagcaacgtggacggaggggctgacgagctggtcgaagccgggagtacgtcgtgcacatcatcggtgcagcagcgcattgtgatcgtgacggctgtgcagacggtgctgcgaggacacgtctggacagttggctttgtgactgagcaatcgtcaggtgtggccacctacctccgcatgctttggcttttcaaggctgggttgataactcgctgggagaagcaagaggggaaacaccaactggtgttggggcagacaacaagagcgcggcccactgcggtttcttccaccgtctcagaacgagatggaaatcaagttgacgatagcaggtggtgccgcatgggcatggaaggacagctgagtgtcgctggctgggaccatactcccacccagaggctgtgccgatggggtaaatcagttgcatatgtacccaccttcatgccatctcgcacatgcgcacatcatcaagccaaagcggggaggaaccagggttccagacatactgtgcgtcacgccgaggatggcagaggccagccaccggccacctcctctgggcagggaagacccaggccgggggagccgccgaggtcgtagccattggcaaactggatgcccacagggatcatgccgcacatgttggggagataggttaggttggcattctgcgcgcggacgttggcaaagttgtacagggtgcctgcgaggtttagggggtgcgaagtgatgaacttctaagagcacagaaggacagagtgggtcagcacagcatggcgtgaaaccccatgatgcacacagggtgggacatcgtatgtctgtggtgatacagatcgtcctcgcatcccacgatcgcttgagcatctaatggagtgggcagcaatgacaagggcgcctcggatgcaccacactttccagggtccacacccgatgccatgtctatgctgcagatccaactcaccctcaaacttgttgccgccaatggccagctgcgtcatgcgaccattgacgttcttgtacgagtccgggaatgagccctccaactcattgtctggaggggggaatataggggaggctgtgttgccaggctccaagcatatggaccaactgtggcatgcgcaagtatgagaatccctgaattccctccattagctagtcgcagnnnnnnnnnnaaatataggggaggctgtgctgccaggctccaagcacacggaccaactgtggcatgctcaagtatgagatgccctgaattccctccattagctagtcgcagcccctccgtgtaccccgtccctcaccaaagatcctgatccactccaaggccttgaggtcccccatcgactccggcatgcttcccgtcaggtggttgccctgcatcttcagccgaaccaggcgtgggatggtgcctgtggactccgggatgggccctgcgagggggaggcatgatgcgtacaaggcttcaggagtcggaaataatacatatcggatgtcagggggctctcccagtccatctcttgcacacgtgcacatctatttccacagtgtcatggcgccctgcaacaatgatgtcccttggcatgttgtccggcagattgcacgcacgtatgacccccttggtcaggccttgtgaaggctacgccagccttgaaaactcctccccatgccgcaagccgtgccaacgcaccagtcatgtggtnnnnnnnnnnttgtgacccccctggtcatgccttgtcaaggctacgccagccttaaaaactcctccccatgcttcaagccgtgccaacgcaccagtcatgtggttcctggaaaagtcccactcttcgagcaccgggaggcaggagaggttcccgccaaggtaggtaggcaggttgccctccaggttgcagaccttgaagtcccactccttcacatgcacaaagtcgcagatctcccgtggtggggtgccctccaccccagtcagggagaagtggacgttcgtcacataaccatccccaggcacatggtcgtcccctggggggaatgggacgagaggtcggtgggcgagcatatcgatgttccaagcaggatcactgccccnnnnnnnnnncccatccccgggcacatggtcatcccctggggggaacgggacgagaggccggtgggtgagcctatcgatgttccaagcaggatcactgccccnnnnnnnnnnnnnnnnnnnnnnnnnnnnnnnnnnnttacggaggaggagatgggagtgctatactgagtgtacaaataagaaaacatcaagcaagtggacaacagcagggacccttttgctgannnnnnnnnnagcactctccccatcgatgtggagatatcctttccccccaaccatccacttcccaagacacaactcacggaagagggtgttggtgctgcgacaggatatgtgctcccagttctttacgcggaggaggagatggcagtgctatactgagttgacaaataagaaaacatcaagcgagtggacaacagcagggacccttttgctgaactccaagggtactcaccccccaccagccctctccacagggatcgcagtcgctccccttgctgttgttcgccggtgtggggcactatgagggcacggtgaggagagatgtgcgtgatgctgtagtattatcatccacattgctgcacacggcagcaacccccctctacgcgaccgccactcactgtccatgacgacagggccgcctcccagtggggtcctgcggtcttgtacttgtccctgaaagccaccagtctttgatctacacggttatgaggagtttggaggggttcaaaatggcannnnnnnnnnatccctaaaagccaccagtctttgatctacacgggcatgaggagtttggaggggttcaaaatggcactccggagggcggagcatggcagagatccccccacacgtacactcgtcagggtgggtgaagccccatccgccgggcaccgtcgcggctgcgacgcaaagaagaaggacgatctgggcacaccgcatcctgcaattgtgtctgtgaagtgctgtaatgcctatacgcgtgctgcaaacatcgtctgatgagcttcgccaaggaagaagctgggtgttcctggcacactatgggacgacacaaagatcccatggcgagatcagcttcttcnnnnnnnnnnaaagtgttgtaatgcctatacgtgtgctgcaaacatcgtctgatgagtttcgccaaggaagaagctggtgttcctggcacactatgggacgactcaaagatcccatggcgagatcagcttcttcggccggaccgggagagatcagaagctgcaaccgagggacaatagcagaggcacactgctcggagcgcaacatgcactcagaaagaggcaattgagtcccctattcagaaagcatgcactccgctgctgtgtcgcgcggcatgcgggtggcgatgcccagtgccgcctccgctctcaagatcgtgctgcttgccgcgctcctaggtacataannnnnnnnnntaggcatactgctcggagcgcaacacgcactcataaagaggcaattgagttccctattcaggaagcatgcactccgctgctgtgtcgcgcggnnnnnnnnnnccacgggccagctatacgtgctcgaagcttgtaaagatttccagactaatgcagaattctccactccgcgatcaggtgtctcatccgccgcggtggtcnnnnnnnnnngcgcgggccagctatacatgctcgaagcttgtaatgatttccagattaatgcagaattctccactcctcgatcaggtgtctcatccgccgcggtggtcgtcaacacccacaatggggagaccttcgcctacctaaaaccccaccagaccgtgccgccctcggccaagnnnnnnnnnntctgttccgatgcggaccctcgctccgacgataccctgctcgtcacgtacgactgctaccatcaggccctgtacggcaactgcaatgccacattcatgaaggactacctggaggagctcgtgcagaacgatggtgtgtacctgccagcgctctagggggggggggaaggggggtaatgatagaccttaataagttcaattggtctttgaaggtgggaggggtgatttgaagacaggcctgcacattggaactgaaatggaggtaggggatggggatgggagaagtgtgactctcaaacccttagcctaggtcaaggtcaaatccccatgccannnnnnnnnnggggagaggtgtgactctcaatccctaagcctaggtcaaggtcaaatccccatgccaagccttccccccctctacacacacttttgcaggctactgccagatcagctgtggccgctgcaaatgctgctctgccccctgggatgtcatccagaagacggggagcagccgtttcctacaggtttgcactacgtggatgggcataatgggaggttgcccgatgttccagagggcgcgtaatgcaagtccccaccatgtcatgcactggctgcaccctgcacatctgcgctgtgcatgctcgcagagtcatgaaaggggtgggttgtttcagcaaccctctgcaacccccgggctgctccttgcctttgacaatgtgtctgcctatcgcacatctgactagctctggcactcacctattgcatgctcattcgccgcccctcccacccccctcctgcacaccctccatgcatcttgaattccataccccaatccaacaccccacctcattaccacctactcacacactccacctcatcacacaccgcctccacaggcggtggccgcaaccaactcgtcgcttgaagccacgctgaagcgcccaggctacacaggcaccatcctggttcccagcgatgcggcgttcgaggcggcgctggccaagtacccaggcctgctgcaggacccggcggtgctgctgcaggtgctcaagttccacatcctgccccccgaaccgcgcacgcgcggcctgtggaccagccccttcatggcggtgggtggcacgatattctccctctacgacggcaccgccagcatcaagtcggccaagaccgcgctgcccgcgggcctgactnnnnnnnnnnctcttctccctctacgacggcgccgccagcatcaggtcagccaagaccgcgctgcccgcgggcctgactgcgcagggtggcgtgaccgggatcaagctgacggggcccgtcaacggcgcgaccgtggtgcagagcgacctgcgcgcctgcaagaccgtggtcaccacgctcgacagcctgctctggccctttgaccccgccacccgcctgtcggccactgccgatgcnnnnnnnnnnccacgctgctgggggcctccggctacgccctggcgcccaacgcccagatcaacggcacccaggtcgcggcgggggcggggaacacacaggccagcgtgcaggcctgcgccgcgtcatgcgccaaggcctcggcgtgcaatgcgtggagctactgcccgcagatggggggttgccgcttcccggacgggaccaccgtgaatgtgcgataagctgagggcatgaaggcggatggtattatctcttgatttagggtgtggatgggaggctgtggattgaaccctcggtgacctagggctggagcactgtcttgccatcgcatgcaatcccgcctactctttcaaccaccccgctcacccccatccccacccttcacaacgtgcagtatgggtcctgcgagctgctgcactcggccgaggtggccgcgggggaggggccggcctatggcaatagcggctttgacgaggtgcctgtgatcagcggctgggcgtcacagggtgtgaccccggcggcagagaaggcccccgccaccaaccctgtggcgacggccgggcgctgacgcccccgccttctggagagcctgtccctccgccaccctggtccatgagccccagatccagaagtgtacttcaacaaaaagagcatggggaacaaggcataacttcgaacacacaccgcagttacaagttgtgttggggagacattcaagcgaaaaaattgctgtaaccctgccaccaggtggcgcccgccatgacattggtggtggtnnnnnnnnnngtggggaacaaggcatgacttcgaaacacaccgcaggtacaagttgtgttggggagacgttcaagcggaaaaaatgctgtaaccctgccacccggtggcgcccgccatgacattggtggtggtaatgcggcagtgcacggggacaaggggggggatctcacacgggagatctttgtgacagccacgctccacgcaatgcctggagacggcaggggatggcggcatgaccacattcagtgcagtgtcctcagtacactatgagcttgagggtggggtacccgcactccnnnnnnnnnncaggggatggcggcatgaacacactcagtgcagtgtcctcagtacacgatgagcttgagggtggggtacccgcactccgccttgtagccctcgaagatgccctgcattgcagcgatgaacttctgcaggtactcctccacctgctccgggggcggggaatccaccctgggcacgacgatcggcctgtgaggggagcagagccaggatgagacgcgggggagggggggttctagatacggctggctgtggctacttcacgcgccgtcagatttggccgacctttccaagccaagtggcatgcaggtgcaatggtaccctgacgcccctgcagccagacgcgggggagcaccctcataatctccccacgcacatacacaccatcacaactcatgacacgcacagcactcactctccgatcacgatgttgatggggaacttcttgggcatggccgtgccaagcgacccgaagatgagcatgggcacatagccaatgcggcgcacaaagctgaagtacttggacttggggatgaggctggtgcgccagtcgatgaaggggcgcacatacgagtaggtctccgtctggccaaaggcgaagacggggaccaggggcgtgccgtgctgcagcgccagcctgacgaagccgcggcggcggcgcaggtacaccacctcggccccgcgctccatgtacaggcactcctgcacgccgccggggcagagcgcgacggagctgccggagcgcagctgcgcggcgaaggaatcgcgggagacggggcgcgcgcccagccaccaccagaggtgacgggtgaggggggcccagaagccggccgaggaggcgaggaggcgggcgtgctgcagctccggcagcacatccggatggggctgggacccaaacatggacatggcctgcggcatgacgctgtgcggctcgtaccctgcagggtgggggggtggaaggggtccgtcagggtgggcgggtggagcaagggatgcgagagccgggaaagggcggcctgcgtgacagaatgcagggcggtggtggtgtcgggaaaccggttgggaccccggtctcggcgcaccgatcacgaaaggcttcttggtgtccttgaaggcctcccgcttcacgtagcggatggtgacggggtagtactcgctggccgccgttgtgcagtagcgcagataccgggtcatgaatttggggcagggcacgtccagcggggtgaacagggcgatgaccagcaaggccaggctcacggtgcccagcttggggaagaagaagaggaggagcaaggtgaatgtgggccatagggcccccgcgaccaggccgaagatccagaccggcagcgcgaggtagtgcccgacatggcccaggaggcgcgaggaggtcgaggggataggtcccgccccccgttccgtttcgaccatggctggtggagttcacttggtaattaaaccgggtctggaagatgtcggctgggggctgatggagttgatggcacagacatttgtaatgacggaaacgcgcagcagcgctccatgtgaccgcatgcgcacggttatgcgatggacagacccccgcgctcttcgtggtttgtcaatggtcccatctgttgtggtccggaattctgaattgcataaggctgctgcctcaggaggtcgcctgtgcgcgtgccagaccctgtttgccagggatgcagggggcggggggccaacttgccgcacgctggatcaccccctaagcttattgttctccggtggccatatgaagatgagatgagcaaaaggagaatacaagaccgacgccttagccacttggccaaagaggctgttgcgcgtgcctcttgcgcgaatcgaacgcgcgatcttcggttgacgattctgcaataccacgctcggcagagctggcatcgacttaggcccaattgcattaaatttcggcataggtacgacagaagaccccagacgactgcagttttccgactgctgggcacattctaccgaccgctcgnnnnnnnnnntgtggtttgttaatgctcccatctgttgtggtccggaattttgaattgcataaaggctgctgccccaggacgtcgcctgtgcgcgtgccagaccctgtttgnnnnnnnnnnataaatttcggcacaggtacgacagaaccccccagacggctgcacttttctgactgctgggcacattctaccgaccgctcgccttctcgtgttgaggaacggccactcttacagggctgcacagggactatggggcggatgcgggctgggtgggaggtagctcacgccatgttcccgtcggcccgctgctcgcggaggatgacggggacggaggtaggggggatggcccccacctccgtgatcaccatgctcacaaactgggcgggcatggtgtcgtacatcaggctgagcaggcccaggccctcctgctcgcgccagccttccagccaggccttctccccgcctggcatctggcaggatttcgagggaacgagggggagggggtcaagatcgatggcgcattagaaactcaaacacacagcagccgcgctcgacaccccagggcagtgtcctgctgcggcaccctgcgcgggacaggcacgcagggccatacccagcctggcacccccaggcgcaaccccccggccacctccccttgccgacacacgccaggccccaccccgccgccgcatcgttccctctccttctcccttcgcctcccccccactctctcctccaaccccccaaacccgcaaccgtcccactcacctcgaccaggaggtctgggtcgcccagctcgttgtgcgtgatggagtccagctgcacgcgctcgtggaacttgtaggtctcggcggccaccagcacgggcacgtgcgccgcggaggcggccatggccacggccgccgacccggcgcgcgccagcaccgcgccgttgctgagcacggcacccgcacccagcagcaccttggtcacccgcggcagcacgaagctcaggccgttgagcgcaacgtactgcgcgggcacgcgggcggccagcagcgcgcgcagcatgcgccgcccctccagcagcggccgcgcatcggccaccaccacggcgaagggggtgcctgccgcggcggcgcgcaggagcaccgccgccacgaccgaggagtagccgtaggtcagcaccacgtcgtcgcgctggatgcgcttggccgcctcgcccgccaggtgatcgcccgcaaacaggatcttctcctggataaaggaggagatgacacccagcagccgctccttggcctggaagaagggtgtgagtattttgtggggggttgggggacataagggtgaaggagaatcgtacgatcgagaaggggccttccgatggtggattcgaggtgtgatcacnnnnnnnnnngttttgtgggggggtggggtacagaagggtgaaggaaaattatacgatcgagaagggggcttccgatggtggattcgaggtgtgatcacggaggaaggcaacaaagaggccacacagaccagctcttcacggcgagcctcaaccaacgtggccccgcacgccccatcccctgcagatatcacgccctagcatatcagacttgtccacgcttcctgccagccagggtcnnnnnnnnnntaaaccagctcttcacggcgagcctcaaccaaagtggccccgcatgccccatcccctgcagatattacgtcctagcatatcaaacttgtccacgcttcctgccagccagggtcnnnnnnnnnngtccccctctccccccgtccgtcacccacccacccacccacctcgctctccgggacgctgggctccagcttcagcttctccacggccgccttgacgtgcttgatggccgcgcccatggacaccgacagcgggcggcagaagaccaggaatgagataaccgagttgagcagcgggttgagctcgcgcgcaaactcgcgcccgcccgcgctgcggaactccagcaccacttgccggaagacgtccagcatggcaatgcagcgcgcgttggcgccgcgcagcgagccctgcgccagtgtcaggcccagctggatggccggcagcggcagcgcggcggccgtgccgcgcgccacaacacccgccacgtccacctcgtggtggcgcggcagatgcgcaaacagctccgtggagcggggcaggggggcgtgctgcgcggcagaccccgggccagcgccggcctgctgctgctgctggccgccggcggaggcgggggccgaggggcccgccccgcccg

SEQ ID NO: 39796 - DNA, 85 bp, Chlorella protothecoides
gctcagactgcccagcatgaagccctccctccccccgtcctataaaaccactatcaaaggaactcacccccgccccagccagctt

SEQ ID NO: 39797 - DNA, 68 bp, Chlorella protothecoides
ttcttcaaggccgccaccgagttcgcgctggaggagcgcctgcccctggtgtacctggccgccaactc

SEQ ID NO: 39798 - DNA, 70 bp, Chlorella protothecoides
cctcaggcgtgctccccctttggcgtgcacttcctctccgtgccgtccagcagcctggccagggcgccat

SEQ ID NO: 39799 - DNA, 83 bp, Chlorella protothecoides
gggtcacagagacgctgtagccattcgtcctccagtgcccagcagagtgccagccgcagccctcgaagcggcgaaagttgaag

SEQ ID NO: 39800 - DNA, 86 bp, Chlorella protothecoides
ctcggaggggcgctcctcggcggacatgcgccgcccgcactccgagaaagcgcgcctgaagtggtggtggcagaaggggggggggg

SEQ ID NO: 39801 - DNA, 61 bp, Chlorella protothecoides
gcttcggggggagggcaggcgcgagaccgttcgcacgctgtgcgctgggatagcccagcgt

SEQ ID NO: 39802 - DNA, 66 bp, Chlorella protothecoides
tattatggcccctgtgcagtgcttgcaaccaggccccccccagaacaagctccctcaccccctcac

SEQ ID NO: 39803 - DNA, 74 bp, Chlorella protothecoides
aaatgcacctgacatccgactgtctttaaagttgtacgtcttgatcttctccgatcggctgccggtcccaatct

SEQ ID NO: 39804 - DNA, 61 bp, Chlorella protothecoides
agcgctgtcgaacatatgtcggacccccctacggcagatgccggggaggtagtcgtcacac

SEQ ID NO: 39805 - DNA, 85 bp, Chlorella protothecoides
gccccatcgaacctgtccacatcgccagctcctgggcagctcccccacccccccgcacctgatcatcccgcacggtgtagtcgac

SEQ ID NO: 39806 - DNA, 4571 bp, Chlorella protothecoides
  modified_base (407)..(416): a, c, t, g, unknown or other
  modified_base (626)..(635): a, c, t, g, unknown or other
  modified_base (1050)..(1059): a, c, t, g, unknown or other
  modified_base (1841)..(1850): a, c, t, g, unknown or other
  modified_base (2830)..(2839): a, c, t, g, unknown or other
  modified_base (2987)..(2996): a, c, t, g, unknown or other
  modified_base (3190)..(3199): a, c, t, g, unknown or other
  modified_base (3979)..(3988): a, c, t, g, unknown or other
  modified_base (4222)..(4231): a, c, t, g, unknown or other
ccgccgccgccgccgccgcctttgcccccgagccacccgccgcggtcgctgagcacgcccgcgctggccgaggccggcgcgcggaacggggcaggcgggcagggcgcccgcaaacgcagcaggtgggacgccgccggggcggagccggggcggcgaagctcccccgccgcccgcgtgcccacagcgctgcccgggcccgagttcttctcggcgggcatgccgcagcgggacacgtcgacctgggacgagccggacgcggactttggcgagtacgtgtcgggcgtggtggcgtgccgcctgggcaagtacctccagccgggccaccccaaccgcctgtccctgcaggcagctgccaaggtgcgtcgtgtgggtgaggagagcgggggggggggggggggggggtgggnnnnnnnnnngcaccccaaccgcctatccctgcagacagctgccaaggtgcgtcgtgtgggtcaggaaagcggggcgggggtgatgcagtacactaatggtgcacttctgagagtagggtttctgccgtggcactcgagggcgtatgacgctgctggaggggaccgtccgatgccatccatcgaccctgccctgcgacctgccccgccgcctcttgcagnnnnnnnnnngtacactgatggtgcacttccgagagtagagtttccgccgtggcactcgagggcgtgtgccgctggtggaggggaccgtctgatgccatgcatcgaccccaccctgcgacctgccccgccgcctcttgcagcttggtcctcaaacatcccgcatcaaaactccttgcagctgcatgacaagctgacagaccagataaggaagaaggaggaggaggcgtacgcggagcggcaggagacgggcctcttcaaggccatcgaccgggagaagattgacgctcgcatcaaggagtttgtgcgggactccatccaccgcatggtcctcgccggcgcgacggcgggctgagggccccctggaattcgcgccgagcctgcgcccgcccctctgcatgcagcgtgcatgcctgacttgtgactnnnnnnnnnnacgacggcgggctgaggggcccccgagattcgcgccgaggcctgcgcccgccccccggcatgcagcgtgcatgcctgacttgtgactgcacacccgttcacccggctcgatgccgcagcccgcccggccctgcacgccgcggcgcggcagacccaaccccatgacatgcaagtgaccgccttgcagcaccaccggggcagaccgggtgccggggcgcaattggaggggggggggatggaagaagcagccaggcggctgcgcctgttccggaagctgctcaggagtggtgccgcgggaggggggcgccgccaacagcctgggcctggcgacagactgccacgcctgcaggcacgccgactccggagccggcctcagcgcgccccgtcgctgtcgtcccccgggctggggtcgaagcgggacaggacgaccacggggtaccggcagatgccagactgcttccacgacagcgtggccatgaggcaggggacccgtgccgcctccacaaggaggtcctccgggtgcaggcccactgccggcgcggggaccaaggcgtcaggtggggtgggggggaccagccacagcctgtgatccagcagtcgcaggtccagcctgtggttgccattgaagagggcgtgggtgaccatgccagctggattgctgggttgcaaaggtggggtttgtcccctcgagcccaccaacacgagatggccgccgctggccggaggacaccccgacgctccctgcccacatgaacaccccctcccctccagcgcgctcactcnnnnnnnnnngtacgagatggaagctgctggccggaggacaccctgacgctccctgcccacacaaacaccccctcccctccagcgcgctcactctgtccaggtggcgcccacgcagcacagctcacgcagcaggtccaccgcgcacagcgcacggggcgggcgcaggtccaggcggggcatcgcgaccctcagcgtctgggcctcgatgcgacaggccgccacctgccgggccagggcaccggcctccacgtccaccacgggcgccgaggcggggctggtgatgtcggggaaggagccgtggagcacgaggcggtcgaggtggagggcgggcggcagggccaggtggaaagcgcagcgcagggccagcgggcggggcgtgacgtgaacctcctgcggggaggagggtgctgggccggggtgcgctcgcggttgtgcaggactgcatggtcccacgcctgggtcgttcgggctggagccccgtccccccacgatccacccacccggagcgaggggagcaggactgggtccaggcctcgcagctccatctcagggaagcggacgagggacagggagcgcaggttccgcagtcctccgtgcaggacggaggggtagaagcgttggatggcccccgcctccagcaccaggcgctccagcgccgggaagcggctcagcgtgtcggtgcaggccaccaccgccctcaggctggtcagggtgcgccccgacatcgccctgaagcccgggtggcgcagtaggctctctccatccacggatctatggaatgacaggctggcgcaggggcaggcctggagcaggggccgaagggactggagcgcgggctccgagatcacttccgtggttagtgggagggagcgcactgcctcaagcaccgtccggctcacgagctggaggcgcaccaggctcttcaggggggtgaggtcctctgtgaagatgagctgcaggatgcgcacccacacgtccacgggcagggnnnnnnnnnngtgcacgcgtctcgatggggcagttccctcgtcatctagggttttcggatcggacagcgctcaatcggggaatgcagggccttggatgacaatgatcagggacccacactcgcgtgcacggcatccggcagcggtgctgatctacatnnnnnnnnnntgcgaggctccctggtccttgctccagcatcacgacctgccatgtccctgtcgcgatgaggttgaatagctgcgcatggtttctgtgggccggcgtcatgcacgcatttcgatggggcagttccctcgtcgtctagggttttcggatcggaaagcgctcaattggggaatgcagggccttggatgacaatgatnnnnnnnnnngtgcgccgcgggcttggcggctgcggctgcggccgccgcacggcgtggcgtcagcgcgtacaccgcctggatgtaggccgagccaccctccttacctccccccagcgggtgggaggccagctgcacgtccacctcgcccgcggacttgacgcgcggggtgtgcagctgcaaggctgcctgcggccgggacgcggcctgcttgaaggcggagcacagcgtcgcgagcgagggcgagggccccgggccagcggccggggcagcctcctcccctggcgcaggtcccagggaggccaagtccagctgcaggccgccgctcggcccgcgccgccccggcccctgcgatcggaccccggtcgtagcacatgcatcgccgatggccgcatgtgcgtcctgagcagcagcctgcgcgtcctgcgtcgcaccccgccccgtcgcagaagccgggcattccgccgccacggcgtcgcgccgcgccggccccgccagggcgtccaggcgcgcctccagccgcgcgatggtcgccgcctgcagcctcacgatggccgccagctgcgtcgtctcccgcgtgtttatggccaggccagcccgcaggcactcgacctcgcgggaacccccctccagcccaggacgggggctggggtcctccacgccggacagcgtgcggctggacagcacacccagcgggtggctcgctgtgaggaggggtgtgtggtttcatgggagttgttgctccccctgggacagaggcccctgcaagctgctgcccagaggactgtgcgnnnnnnnnnncgacagcgcacccagcgggtggctcgctgtgaggaagggtggatggttttatgggagttgtcgctccccgtgggacagaggctcctgcaagctgctgcccagaggactgtgcgaggagcccctccctggcccgcaaaccccactccagacccattcaccgccccctcaccgcaccgggaccctgctggaggctctcggcgatgggaagggcgggcagcctgggcgcgattccgnnnnnnnnnnaccactccagacccctccaccgcccccccaccgcaccaggaccctgctggaggctctcggcgataggaagggcgggcagcctgggcgcgattccggcggccggctcggggacgagactccccgcctccgcctggcatgactgcacgagccgcccctcgatctcctccacggcctgagcgagggacaggtgctccgaggtcagcgtgctgacgtcggcgcccagccggcgcacccccgcctccagcgcggtcagcaccgcggcgcggcccgcgccacgctcacgctcgcgcgattcccgcgccgcctcgcgctcctcggcgctcgccagggccgcgtggca

SEQ ID NO: 39807 - DNA, 62 bp, Chlorella protothecoides
gctgaggaaacctagagtgcgtgtgcggaaattaacgagcaagtgaaaaatatcggttcacg

SEQ ID NO: 39808 - DNA, 62 bp, Chlorella protothecoides
ggggagaggtggggcccaaaggactgtgaggaagcagcatttgtacaccctgatacgcaatg

SEQ ID NO: 39809 - DNA, 3117 bp, Chlorella protothecoides
  modified_base (106)..(115): a, c, t, g, unknown or other
  modified_base (197)..(206): a, c, t, g, unknown or other
  modified_base (661)..(670): a, c, t, g, unknown or other
  modified_base (980)..(989): a, c, t, g, unknown or other
  modified_base (1237)..(1246): a, c, t, g, unknown or other
  modified_base (1721)..(1730): a, c, t, g, unknown or other
  modified_base (1869)..(1878): a, c, t, g, unknown or other
  modified_base (2028)..(2037): a, c, t, g, unknown or other
  modified_base (2369)..(2378): a, c, t, g, unknown or other
  modified_base (2633)..(2642): a, c, t, g, unknown or other
  modified_base (2809)..(2818): a, c, t, g, unknown or other
gccgtcccccgccgggccgtcccccgccggtcgggcgcccgcgccggaaagcgcgtcgtggccgggcctcggcgtgcagacctcgctgcgctcgcgagtcggtgcnnnnnnnnnngggggaccctgcgcgaggagaaccagcctccgggtttgcacgccgatgacacggggcctgggccgcagcacgaggccggcgnnnnnnnnnnccgggtacccgcgccaggaagcgcggcgtggccgggcctcggcgagcagacctcgctgcgctcgcgagtcggtgcggcgctgggcgagtcgctgtcggcgctggagggctggctcagcgtgctggccgtgctggggccggaggactcggccgccgtgctctcaacgctaccgcgcggcctcgtcggccgcgtctcggcgctgctgagcagcctggcgccgcaggggaccctgcgcgaggagaaccagcctcccggtgtgcacgccgatgacgcggggcctgggccgcagcacgaggccggcgctgccaaggccccgcgcatggcctcccagcccagcctgagggcgtcggagacctcggcgtttgcccctctggcgccgttgggggggtcaccaccccatggctgaacaagggcgagccgcgtgcaccctcccaggattcttttgcacttgcctnnnnnnnnnngcccccccatggctgaacaagggcgagccacgttcaccctcccaggattcttttgcacttgccttgctcccaagcacatgccaagaacgtccgctggctgggcatgcaccctgcaccacagcgggctcgctccatgcacctctcttttccggaccctgcccagcactcaccccaccgcccgtgcagccgaggcagccttgcaaacttgcaccatgcctgccccacgcggcctccttcatgcccccaatcggcctcttccctgcccttcgctgcagagcactcctctccccaggcacttggaactgaatcnnnnnnnnnngcggcctctttcctgccctttgctgcagagcgctcctctccccaggcacttggaactgaatcggggctcgccgagccccgcccttctttctcccccttgctaagtcccgcccttctccccctcgctgagccccgcccttctttctccccctcgctttcgcaaccctcttcccccccggcactgatgagagttggacatggtaatagcgattcttcaaagggtgagcggggacgggtgctggcccggcnnnnnnnnnntggggctcgctgagcccctcccttctccccctcgctttcgcaaccctcttccccccgacactgatgagagttagacatggtaacagcgattcttcacagggtgagcggggacgggtgctggcccggccagaggcacggagcagacgccccacacgggccccacaacacggttctgggaaaactggggcctggtcgagcccccgaagcaggagggctcactcgtcggtgacgcaccccctggccgccgaagacaccagcttggcatacttgtacagggtcccgctgattgcgcgcaggggcggcgccgtccacgccgaacgcctggcggtgtgggattagaagggatggtgagtgccggcaccgtgggtctgggaattccagggcaccggcggcagcgcgcacgttcgagccttgggcttccgcggaccggtttccctgaacatagagtctgggctcccccggggcagcatgcatnnnnnnnnnnggaagggatggtgagggccggcaccgtgggactggggattccagggcaccagcggcagcgcgcacgttcgagccttgggcttccacggaccggttttcctgaatatgcgagtctgggctcccccggggcagcatgcatnnnnnnnnnnagaggaggcgtcaatacggatgatgtcgccgtcctcaacctgtggaatggtgtgacggagggcatgcgtgtgggaaaaggaactgggtggctggcaggacgagcgggtgcggaacgtgacagggcaggtgcgcatgcgagcgctgtgccnnnnnnnnnngccctcgtccccagccaaacacagcgcggcaacctccccacccgcccacctcctggcccactcctcctcggagacgttcaggacgtccatgacgcgggaggaggcgtcgatacggatgatgtcgccgtcctcaatctgtggaatggtgtgacggagggcatgcggctgggaacaggaagtgggtggctggcaggacgagcgggtgcgggacgtagcagggcaggtgcgcatgcgagcgctgtgccagccctggctggagcagtcattccccaacctcctcataaaagccctcaccagggcaatggggccgccctcctgcgcctcgggggtgnnnnnnnnnnggtcattccccatcctcctcgtaaaagccctcaccagggcgatggggccgccctcctgcgcctcgggggtgacatggccgatcacgaagccgtgggagccgccggagaacctgccgtcggtgatgagcgccacgtcctggcccagacccgcgcctgcgattgggggaagctcagatcgtgagcctgtgtgcctctcaaatggtggcatgcaggggttcacagggcccccacgcagccagccctgcgcctgccgcnnnnnnnnnncattgggggaaggccagatcgtgagcctgtgtacctcttctcaaatggtggcatgcagggggccacaggcacccccacgcagccagccctgcgcctgccgcatggcacggcctgggtccgggatggcaccccgcttcctgccgcctccatcttgttacaccaatggnnnnnnnnnnggacacggcctgggtccaggatggcaccccactgcctgccgcctccatcttgttacaccaatggcaccaccaccagccccgcccactcacccatgatggcagaggtgggcgtgagcatctctggcatgcctggcccgccgcgggggccctcgtaccggatgacgatgaccttgcccttgaaggcagccgagttggcctccagggccgccagcatggcctcctcttgctcgaagcagagggccgggccctcgaacagcaggccctccttgccggtgatcttgcccactagggaggggggg

SEQ ID NO: 39810 - DNA, 61 bp, Chlorella protothecoides
gcactcgcggtaacagacagggcccaggggacacaggcggggggtgtatgccagcggagca

SEQ ID NO: 39811 - DNA, 76 bp, Chlorella protothecoides
cctccccctccttctcccccccgaaaaacaaatcgacattttgtcccccctccattcccccatcccgcccccaccc

SEQ ID NO: 39812 - DNA, 65 bp, Chlorella protothecoides
tttgtgggggggggggggggggggggggggaacgcatgggcacatgagtggatgtgactggcagg

SEQ ID NO: 39813 - DNA, 14012 bp, Chlorella protothecoides
  modified_base (1150)..(1159): a, c, t, g, unknown or other
  modified_base (2970)..(3091): a, c, t, g, unknown or other
  modified_base (3169)..(3178): a, c, t, g, unknown or other
  modified_base (3256)..(3265): a, c, t, g, unknown or other
  modified_base (3513)..(3522): a, c, t, g, unknown or other
  modified_base (4260)..(4269): a, c, t, g, unknown or other
  modified_base (4468)..(4477): a, c, t, g, unknown or other
  modified_base (4792)..(4801): a, c, t, g, unknown or other
  modified_base (5246)..(5266): a, c, t, g, unknown or other
  modified_base (5426)..(5435): a, c, t, g, unknown or other
  modified_base (5861)..(5870): a, c, t, g, unknown or other
  modified_base (5928)..(5945): a, c, t, g, unknown or other
  modified_base (6344)..(6353): a, c, t, g, unknown or other
  modified_base (6712)..(6721): a, c, t, g, unknown or other
  modified_base (7403)..(7442): a, c, t, g, unknown or other
  modified_base (7523)..(7532): a, c, t, g, unknown or other
  modified_base (7615)..(7624): a, c, t, g, unknown or other
  modified_base (7783)..(7858): a, c, t, g, unknown or other
  modified_base (9756)..(9765): a, c, t, g, unknown or other
  modified_base (10010)..(10019): a, c, t, g, unknown or other
  modified_base (11081)..(11090): a, c, t, g, unknown or other
  modified_base (12133)..(12142): a, c, t, g, unknown or other
  modified_base (12236)..(12245): a, c, t, g, unknown or other
  modified_base (12777)..(12786): a, c, t, g, unknown or other
tgggcgtcgcggcgcccgacccgggcgtcagccgcccctcggacagcagcggggacagcgccggctgccagcgctcggcggccgcgccgcggcgcggcgcgcccggggtgcgctgtgtgtggattgctgcccctgcccccccaaccccggcgaaggagaagtctgagggggggggcgacagcgagcgcaccgccatgcaacccgccgcggcggccgctgcgcgggaggacaggtcgcacatggcgaagaccggggagggcgggctggtgggcatgcccgcgatctcccccatggggaccgctggcacgctggcggaggcacggctggcactcccttccaccgcccccccgtccgccgcttctccggcctgtcgccggacaaaggacaggacctgcgcggccgaggggcgggaggtcggcgcgccggccagcagcgcccccagcaggcccaggaaggccgggggcctggcggccagggcggggtcgggcccggccgtggcgcccctgcttcgcggcagcttcctcccggtcgcgcactcgtacagggaggcccccaggctgaacatgtcggcggggggaccgggctcagcgccgtcgagcagctcgggcgccacgtagtcgccgtcgccctcctcccagtcctgcggtgaatggtgaagaaggggaagggaacgggtcgaatcgctgcgaggagcgccacatggcagcgcgcagttgccaacagggtggcacaccctgacagttgctggcacgcatccatccaccggcaagattgctcacgacccagctcctccccgcccaggtgggaacctctccccagcctcggcaccctcactttcacccacccggctctcgttggccacggccagcccaaagtcgccgatacgccacgccccaccaagatcccggtagatgttctctggcttgatgtccaggtgcaggatgccggactcgtgcaggaaagcgagcccggccgccacgtcggcggcgacgcgccagagcgcggcgtcgtccatgcgatggctctgcgtgtcgagacgggcagggggcggcatggctgaggatgtgtgatgccacgcgcatgcccacaccaggccctcccgggcccgcttcatacacgccctggcccctcgcccacctgcccaagagcnnnnnnnnnntcacgcgcaagcccacaccaggccctcccgggcctggtccatacacaccctggcccctcgcccacctgcccaagagcttccagcagggtcccgccctggcacaggtccatctggatgtggaagtggccgccctcctgccaggcgcggtactggctcacgatgttggcgtgcgcgggcagggccgccacggcccgcacctccctcaggcaccgctcccgctgcatcttggacctgaagcggcgccgggggcgcttgacggcaaacagctcgccggaagcgcggtggcgcacacagaacacctcgctggtggcggtcttgccaatcaggcgcaggaactcaaagtggttgtggtactggaacagatccgggttgatcacgctgtggctgcgcttcgcctcggtgacgagcagcacctggggagtatcgtgggaggggggtgagaagggtctgcgccgcaggcgcaggcttgcaaagatgggactggcgcctgtgccgctcatgctgatgttcagcaacccagtggcttcagaacagcatctgcgccctcactgcgcagatcaccacaggacagctgccagtctccaagaaaacaccacaaccccgcacaagataggccccctttgcatgcaccggctgaccttggactcggtgagtgagttttggcggtggccaatgtgcccggccctgctcttggttcggcggtggttgccgggagacaccggggggaggaaccagggggaagcccccgcctccacggggttccgtggtgtgtctgtgctcatgtcgctgagcgtcaggctcggggagctcagcatgccgaaacgctcggagcgcatggtcgactggactccatccacctcacacagctgttggttctctatcatccaacactcacgcgcggccggtcggctgtgctgtcgtgtagagggctgattgtttcccaaatatatatgatgggaactggtttgctgccgttcgggaacctaaggtgagaggtctctcaaaggtggtctgtctgttgtcgttggggttacgcccgccagaaaacgcctcccggttctcggttacttaccaagcaggatgttgtgattgtttgctggccccacatcccgacgaggcatatcggctccgtggctcaggtcgcggaacggaagctgcggaaaaacacgttgaaagtgctgtctctggaaagtccgaaaacacggatgcgaatcgccgcatccccagcagctgccgatacggatctaacacgcgcgcggccccctcggcacagcctccctcaggagtcagagtcaatttacatcctcggggaaggagcaggacagggtgtgcctcaaccaggcagctgctggcctgcgtccgcccccaggcagccagccccgctgttgtgcagcgcggccaggtaggccaggtgcagggcggcgacatacagcaccacgatccaggtgcgtggactcatcctccccgccaggggccggccagccgtcccacggacgcgggagccccgcagcgccgccccgggctcggtcgccgcgctcgttccgccgctcatcagggcatcgagggcggcgggaccgaggcccagccccgtcaggccgtggctctcagggggcgcaggctggacaggagggcttttagcctgtgactccaaccgctcctgcagctccgagcactgcggggggggggccagagatggtatggggatgggaaggagaggggtggtgcatctttgaggagctcctgagagctcatgccagaggcattgaccctacccccaaggaagtgctgcctgactccgactctggacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctctgaggccagtgcggcggaccgtcgcgcatcctccgcagccctggccagctctgcggcggccccctcggcccnnnnnnnnnnggcctctgatgccagtgcggcggaccgccgcgcatcctccgcagccttggccagctctgcggcggccccctcggcccnnnnnnnnnncccagagatggtatggggatgggacggagcggggcggtgcatctttgaggagctactgagagctcatgccagaggcatcgaccctacccccccaaaagtgctgcctgactccgactctggacggccaaaagagccctggtccgcggctcacctgtctctcggccgcctcagcacgagcggtcgctgcatcggccgcaacctgagccatggcgaatcggccctccgcgacctctgccctccggtcggcnnnnnnnnnntggcctcggccgcccggcaggccaactccgcagcccgggcggcctcctctgcagccctcctagccgcggccagctcctccttcagctgacgcacgtgggcagcatgcacggcatcttgcgccgcatgctgcgccgccagcgcgtcccatccccggctgcgcgcgtccgctgcggcattggcatctgccagctcccgacgcagctcctcggcgcctgaccgtgccccctctgcctccgcccgggctgcctgctcggtcgcctccagggtctccaccctgtgtgggggggaaggtgaagcgggttgttgcacatggcagaggatgggcattggttgagaagcacacctttcccgacagagtgtgatgtgccttggcgctcggtcagcgggaagtctgcagatgttccgcaggtgatgccaaacaagcccagccacctgtctcggagagccgccttctccatctcccaggcctgctgctgctcctgcactgcagcggccactgcattgtggaatgccttgctcctccgtgccgcctcctcgtgaagctgccgggcagcatcctctgtctcagcccggtgtgcgcgctcggcctctgcctccagcagcgcagcctacgcgaggaggaggtggatgtctcaggatctatgagaaagtgctgagaggagggcgaggcacgcacagcgagagcacacaggctctgataggttgtaggttttgcatcgagggggtggtcgggcggnnnnnnnnnntgcgaggaggaggtggatgtctcaggatccatgagaaagtgctgagaggtgggcgaggcgcgcacagcgagagcacacaggctttgataggttgcaggttttgcatcgagggggtggtcgggcgggcatggcacaagcatgtcttggagccctgacgcccagcaatccacagacacaccttggcctgggactcagcctnnnnnnnnnngttggagccccggcgcccagcaacctacagacacaccttggcctgggactcagcctcacgctgggcacgctgggcctctcgcagcccggcctcggcctgcaagcgcgccgccgtgctggcccccgcctccgcctttgcggcctcggtcgctgccgcagccacctgcacggcctcagcagccgcacgcccctccgcaagggccgtttcgagggccgactccaggctcgccagccgctcacgcatcaccgaggtggccgcgagtgaggcctggcgggccgcctccaccgccccctgctgccgctccttttgcgtggnnnnnnnnnntccgctcacgcatcgctgaggtggccgcgagggaggcctggcgggccgcctcctccgccccctgctgccgctccttttgcgtggccatgcctcgccgcaggacggccatcttcttctcgttggcgctcgcctgattggtcagcctctccacctgggcggccagctccgcagcctccctctgcaccgaggcccgctcctgctccagggtgctgcagcgggcctcggcgtgggctctggccatacgggcctcctgcactgcagcctcctgctctgcggactgcaggaatgggaccagatgtctgacggtaggactgagcggctggctcagcagggacaaacacgggtgtgagccttgccaagagcaggaccacacactgacgaggataacgacgttgactgaatgtgaaggcctgtgtaactccatggcatgccaacacctgaccannnnnnnnnnnnnnnnnnnnntcctcacctggtcctccagggattgcagtctggttcccagctcagccagcatggtttccaggtctgaagcaggacttactttagaaaaggcaggcagagccaattccgtactcaagtcaggtgaagtcttgagcagctcagaggtctttggcacatcatnnnnnnnnnngactttagaaatggcaggcagagccaattccgtgctcaagtcaggtgaagtcctgagcagctcagaggtctttggcacatcatgcccgacatgcggcctatctgtctctgagctttcggcattgcagagggccccgctcgtctcggcagcatcctcgccagcaacaggggtagaggctccttctaatccagagacatgattgagaggcttggacccaggggatgctggttgggtgccagatgtcccaaccggcaaggacgggatccccgtggagggtatggaagacttcaaggccgagagaatgtctctggcgctctgcagggcatgctgattactgagcggctttgacccagtctcttcatcagcacttgacaagctgcgggctcatgggaggggtgccttgggtcaggagctctcgagcagggnnnnnnnnnnagccagaactcccaaccggcaaggacaggatccccgtggagggtatggaagacttcannnnnnnnnnnnnnnnnntgccaatgtccacaatgccgaacgcacaaactctgttcttgcagatccatcacaatggaaaaattacagcacaccttgaggattcctgtgagtcggcccgctcgagtgaaaagcctccgacatcccaggcctccagtgagggtgcagcctgaggtcaagagcaacaagttcgtgctgagcgcacaacctccaagacagacctcctgcaacatctgcacctatgcttcgcccatccacctcagctctaccttagtctttgctctggctgagcgcactggcggtgggtcccttgaactctttaccttggccagattcttgccctgcggggagcaagcccaatgaataatatctctggcagggaaaaaggtgatccaacaagatctataccgacgtgcgcannnnnnnnnncgctctggctgtgcgcactggcggtgggtcccttgaactgttcagcttggccagattcttgccctgcgggggagcaagcccaatgaatgacatctctggcaggaaaaaaaggatccaacaagatctataccgacgtgcgcaccactttagcagcatccactgcctcgactgccacttggtggcgaaggtcctgcactccgtccgcaactgcctcccgcagagactgcagcccttggagcatgactctgggtttacgctggcatcatcccagcaagagtcataaaaatcaagattattgcagcatgaacgaaatcgatgccaagtatgaatgttcttgctgtagagatgaggtgcgactnnnnnnnnnnccaagattattgcagggtgaacgaaatcgatgcgaagtatggatgttcttgctgtagagatgaggtgcgacttgtcccgacttgcgaagcccccacttcagggcgcgctcgtttccatctgggccatccccccccacgtccgttctgggcattctacaacaatttgcttcattttcaggccagtccacgagctcgtgccacattctcaagagagccgctgttctccttgatgtggttcttggcgacgttcacgtagtgctccgcagattctgctcaaggtcgggtgtgggaaaagtctttgcattgggaactacctcaacagcttgccagcacattatagctgttttcggacacggatacagtcaatttgtgtcctggaggctgcgggcagcctgccacccccaggcgatcacatctcctgcatgccacacctgccaggaatgagctctcgttgtccttgaggtccctcaggaagcgggcggggttgcctccccaaatttgaccagcagggatctctgtgcccgggggcacaaccgctccagctgccaccatggcccccttgcgtacctgaggccatggaggaatgaggtggggcagaaggtgtgcatatgcactcagttccttgtagggtgggtggggcagaccccagcaggcaacacatgcacagggtgccacggattcnnnnnnnnnnnnnnnnnnnnnnnnnnnnnnnnnnnnnnnntggtgaggcaagtgatgtgacacccacatggtctatgtgtgcattgctgcggagcagacaccctccccagcccctggccannnnnnnnnncggtgaggcaagtgatgcgtcacccatatggtctatgtgtgcattgctgcggggagcagacaccctccccagcccctggccannnnnnnnnngtggaggaatgaggtggggcagagggtgtgcagatgcactcagtcccttgtagggtgggtgggacagaccccagctggcaacacatgcacagggtgccacggattcccctcagggcaacaccaaggtctgccagcgacctcagacacagtttgaccgcnnnnnnnnnnnnnnnnnnnnnnnnnnnnnnnnnnnnnnnnnnnnnnnnnnnnnnnnnnnnnnnnnnnnnnnnnnnnggcacagaaagccccggcggcaggctgcagccatgcctggtgcgaggggtggcaccccacactcaccactgtgccatgtgagaggacggcccccatccccaccagcacttcgtcctccagggtgacgccatgcatggacacctggtgcccgatggtcacgttggcgccgatggtcgtgtccgccgcgtgctcgtcgatggactggggggcggtgcggatgagggagccgtcctggatgttggtccctgcccccaccttgatgctgccggagtctgcccgcagcaccgacccatagaagacggaggatcgggggcccagggtcacgtcgccgatgacagaggcattgggcgcgacaaaggcgtcggtgcccagggagggtttgaggttgaagaggttctggaggggcctcgcccggttgactgcacgcaacgggtgtttggcagggggggtgtgacagggtgcgggagtgaggacgacgcatccaagcacacatgctttccccagacctgatggcacatccgatgcagggcgatctggattagtagcatgcacgtagcctcgccacacgcagacatccatcgattactcacgctcttcgcggaaggcgtagctcccctgcagcctgctgccaaccctgtctagcgcctggcccgtctccctgagcgcaaaacccaggcggtaaaccacataccccaaggatgagcccgctttcgcgaccatggcggccactggtctactcgcggcccgtacaactgtcggggtgggggtgtgcgagcctggcctgcgaggagggccgagccaaaggggggaatgcgggatgtcctcctctcgcagtgcaacaccccaagccaaatcctgcacactgcaaatcgaggatgccctgtaccgggcccaccgtgctgtttgggagggggcacggggagagttttgtcgcgaagcgcaatgccatgctttcctgggcgtataccaaatgctgactctctgtacaaaatgtgcaacgtcaaagacaaggcgcccatgccttcaccagcaaagcctctgctacaagaaccattctccctccaggaaagacttgacattgccctctgcaaccccctccagcttgtagctgtacaggatgccgctggaggtggccaccgctagtgttagccagtcattgtcagcaggcccagagccctcgtccctgtgcagcagaacaggatgctgtgctgagtggtctgaatggcatggtgcaaaggggttgggggggtaaagggtccatgcacctgccatgcgccttgcatggatgcccaccgagccaggtgacccccactcctgcaccaacgcaccccccatccacagtggtgagactgcagacggacgctgccggccggccaggcaaccggatggtcgtcaggcatcgcgtgggctccaccgctcgcgcgatggtggccggaaggacggaggagatgaccgccgctgctgctgcagtgctggacttcctgtgtgatcgtgcggaccgagggatggttactgatggtatctcatgtcatggcccggcctcccccgggaagatggggatttgtcacctgcaagcatgccctctgggtgtattccttgcgcgccccttggctaacacaagcgcgcacccgctgcacggatacacccttcactgctctcggcccggctccccctcccaggagcgtctgccactcaccgctccaactggggggtgatgcggaacaggtgcacagtcccatggtccgaggccacacacaggagcgccggctggactgcggagggggcgaaggccaggccgctgatgcgtgcgggcgtggaaccccttcggaaggagtgcacggtgtctggcgaggcgggggcatgaacccgcaccaccgtccccttttgtgaggctgagnnnnnnnnnncccccttcggaaggagtgcacggtatctggcgaggcgggggcatgcacacgcaccaccgtccccttttgtgaggctgaggcgagcagcgagcccgtgtcgttccaggccagcactgcctggggggtcgggatggggggattctgggggattgggcgcggagggctgtcacactacatactaggaatgagcccagggccccatcgcacgaggggcaagggggctgcggtcgggtgccggaatcgcnnnnnnnnnnctccaggccagcactgcctggggagtcgggatggggggattctgggggggtgggcgcggagggctgtcacactacaagctgggaatgggcccagggccccatcgcatgaggggtaagggggctgcggtcgggtgccggaatcgcacagcacgatgccgtccccatgctgcgccagctcctctacggggcaccccagtcaccctgacgccatgcctctgtccggccccttcccggtccccactaaggctctccattcccatcccccaacgccccccaccagcggcgagcggtgtgcccggagctcgccgaggacgctgccgctgccggaggctgcgtcgtaaacgcgcaccgccccaggctcgccgccggcagggaccgccagctggcaagtgggctcatggcacgtcgtcagcgcggccaccccctggcacaggtgcggcgggcgcgggtgagattgatggtgccgggacatgcccgacgcaatgtgcccacgttcgtgaagcgcctacccctcagctcgccgcaactacctccgggttgggtgccgtgtcgattgtccgcaggagctccagcgtctccagcacataaagcaggacccggcgctccagtaccaccgccagcctggtgaggcaggaggtgcagatgtgctttactgggcggctcgctaggacggtgggccctcagaaccaaacccaagcacagggatcaaagaagtttagcttggtgagctggatgcagggccgggggaacatcaagaagtgatccaaaagccaggacaacacacaacgcaccgcttgcggttcaggtgaacccccaggacggaggaggggaaggagaggctctggatggcggcgttggagtgtgtgttgtacagggtcagcttgcgtgggctcagggtgggctgctcccccgcacccacataagccagcaggctggtgcagaacagcatctgcgccagtctgcatgggtgtggggaacatgtggcagtcacaccaaatacgcatgatgctctcagacaaatcgcagatcaatgtccatgtgctttccatgccctgcatgtgnnnnnnnnnnggtgggggacatgtggcagtcgcaccaatcacgcacgatgctctcagacaaatcgcagatcaattgtccatgtgctttccatgccctgcatgtgaacccggcttggagatccgggccctcaaacccgcaggaagatgcatacccctcggcgactgtggttccaaccaatgggaaacctcgtccaagacggcaccactataccggccctcgccctcacccgatggccccgatgtcgagtctgaaggcacgtttatgctgctccagactgaacacacgcaggccgctcatgtccgccaccgcgacacaggtgttgtcctggttaaaggccacattgagcacgcccgagccacgctgggcacagtgcagcgacgacatgatcaccgcccccgcgccctccaaatgctgttttatactcaagtcatgcccaaatgctccatgcgagcccaggcttggccgatgggtgcaggggtcgatctcggaaaatcactttgctccagtgtctagggcgcgcgccccacagcaattccagcgcgcatgatcgcatttacacttccaatccgaccatgtcgatctagcactgcatgcagtagaaatttggtcaaagctgacccattgacgtcctcttgtcatgccaccggccatcaccacctgagtcgagctcgcagggcggtgctgcttgcgcactcaggtgtgcacaaatgcacctctctgcaccatggtgcagggcatccacgacgactcaagcctcaagagcatcattccaaaagcctctttgctttcctgctcgtgcaactcccacatgcgctgcacggaggtgtcggttggtgaccaggtgcaccagtcccgtgtcggaggggggcatcccagagtacgaacgcgtggtcgtggtggagggcgccaatgacaggcgagccctgctccgagccgtccaggcaaaggtgcgggtgtggagtgtgcatgcgcgggccgaaccgattgtacaaggacaacatcggcgccccggcggccatgccaatgcccggacccacaccacatcgctgtgnnnnnnnnnnggcttcaagagcaccattccaaaagcctcttttctttcctgctcgtgcaactcccacatgcgttgcacggaggtgtcggttggtgaccaggtgnnnnnnnnnngtgtgcatgtgcgggccgaaccgatcgtacaaggacaatatcggcgccccggcggccatgtcaatgcccggacccacaccacatcgctgtgccaggtgatcgtgctgggctcggcgacggtggcgctctccgccattcccagccccacgctcgcagccctgcgcgcggcagggaacgcggctaccatcctcaccgacccagacgttgccgggcgccaggcgcggaatgcgctggaggagctgctggaggagccatggcacgcgttcctccccgtccgccactgcacctctctctctgccacgccgtgagccaggggctctgtgggtggtcagctgccgcgaggatgtgcgctggccttgcggcgcgagggtcgtgcgccctcggcgccctccccgtgggcgcctccccgtgccacacgatgacaacatgacagaatgctttgccccgcacgctcctcttcgatccaggtgccacgaggtcggcaacgtcggggtggagcatgccagcccagaggcgctgcgcctggccctgnnnnnnnnnnacatgctttgccctgcacgctcctcttcgatccaggtaccacgaggttggcaacgtcggggtggagcacgccagcccagaggcgctgcgcctggccctggcggcggccaggcccagctcgcccgagcgcactgcgttcacgagggagcggctggaggcgctgggcctggtcgccagcggcattggacctgctgcgggggcccgggcagaggtgggtcgatggatcaattcgaatcgtaatccccccactgccgggctctggtccgcaggcaccctccctttccgtcccctctgagccattcagtgcactccctgctggggcccgcagggatcaaacagcgcggcgacggtgcggcggcgcgcagcgctgtgcgacgagctgggcatcggcatgtgcaacggcaagcagctccttcgccagctgaacagctacggcttctccatggatgatgtggtgtccgtgctcaatcagctggagctggggggggtgcggtgaagccgaggcactgctatgaggggcgggtggtgatgccctggagccgtgaggggcaccgtcccacctgcattcctgcctccactgccgctttggcgacggggcacgagaagaatttttgtcctgtgctgggaagtgctgcggagtggagcgctccaatatgatgccttggctgacactgcactccacatggactcgcttgatgacatgctcacagtcacccccccctcctgcccgccgatgtatctgctgcattattctacacaatgtcataagcattgttcacgaaaaccttcgagccagcgtgcacagcgcttgaaaccgcagcatgtagggtggagcacagatgcaggcaggcaccagcgtcgcctactcctggccgcccccccgcgtcccgccccagccgccctcatagtagttgttgggcaggcctagccagaacttgaggcgctccaggtgctcgttggccagcaggggccggctcgcggccttccccgcctcgcccgcgccgcgcccgccgccctccagcagctggcggtacttggacttgtccacctccacgcccatgcgctccagagcgcgcagggcctgcatgcccatgcggaactcgcccgtgcgcacgcacagcgtagccagcgtgtccagcatctgcgcgtcggggcggccgccgccggcgtggaaagcgcggacgagcgccaccgcaccgcgcacgtcgcgcgcgcgcgcgtgccccg

SEQ ID NO: 39814 - DNA, 106 bp, Chlorella protothecoides
atacaagcggctggcggcatgggttcttctagtcattgagaagggagcgcaggaggagcgcgctgcactctacaagtaccttgtggaagctgatccgcctgtgctg

SEQ ID NO: 39815 - DNA, 110 bp, Chlorella protothecoides
gggcggtgctgtacaggtgatgccctgggggggcgagggggactcgaggggtcaccgggcctcgccagagcgcctggcccctgctcccgcctgctgcagagcctggctgt

SEQ ID NO: 39816 - DNA, 61 bp, Chlorella protothecoides
gtggcggatcaggccaaccgcggcatccacttgctgggaccccacggtcggccgcgggacc

SEQ ID NO: 39817 - DNA, 61 bp, Chlorella protothecoides
ccgctccagccgctcctccaggtagccgcctgacggctcccgtgcaaccatcactgtgatt

SEQ ID NO: 39818 - DNA, 96 bp, Chlorella protothecoides
cctgcaccttcccgacgaggtctgccccgacgcctgcagggctgcacggagcagggccacgggaattctggtcctcacccttccccgggagggcaa

SEQ ID NO: 39819 - DNA, 90 bp, Chlorella protothecoides
accgcccgccggtacgcctctgtggattttagggagaagtcagagtgtgagggaggtgcatggggatgggcgccccgatgcatcctccgt

SEQ ID NO: 39820 - DNA, 68 bp, Chlorella protothecoides
cagggccaagctcgacagccgacgacctcgataacgctgagatgcgctcttgcaccttttgacggata

SEQ ID NO: 39821 - DNA, 61 bp, Chlorella protothecoides
cccgcatcacccacatctcggtatggtggggggggcttctattctgctacattcctcaaag

SEQ ID NO: 39822 - DNA, 103 bp, Chlorella protothecoides
gccgagctcctgcctggcgccagtttgcgcaaccaaacagcagcttcagccagctcgccgaactctcgccgggagaatctcatcataatctacagctggcacg

SEQ ID NO: 39823 - DNA, 111 bp, Chlorella protothecoides
cgccttctgcgcgtgcgtgcgttgttgtggctgggtgtagggtggggatgggggaggcagagggcctgaggcacatcgtcgatcccctgtgcgcccctgccgaaagtggga

SEQ ID NO: 39824 - DNA, 111 bp, Chlorella protothecoides
gggagggtgtgcaatttgccaggcacagggtgacccgacgggcgatttcagggcgcagaccggagcaggataccccctgcatctccgtctggccaccctaccgtacctcca

SEQ ID NO: 39825 - DNA, 105 bp, Chlorella protothecoides
ggagatcgagctggccgtcaagttgggccaatgggccaagaccctggtggtgagcaagggttttggaggtattggggtggtggtggggggttaggaatgttgtag

SEQ ID NO: 39826 - DNA, 124 bp, Chlorella protothecoides
aggcctgggtcccagctgctggacattgtgcgtgggctgcgccgcttgatggcgtggcgcgtgtcggccgggcccaccctggcagcccctctgctcacgccgcaaaatgcccgaagcccggcat

SEQ ID NO: 39827 - DNA, 7304 bp, Chlorella protothecoides
  modified_base (4598)..(4607): a, c, t, g, unknown or other
  modified_base (6000)..(6009): a, c, t, g, unknown or other
  modified_base (6099)..(6108): a, c, t, g, unknown or other
  modified_base (6221)..(6230): a, c, t, g, unknown or other
  modified_base (6408)..(6417): a, c, t, g, unknown or other
  modified_base (6515)..(6655): a, c, t, g, unknown or other
  modified_base (6730)..(6739): a, c, t, g, unknown or other
  modified_base (7039)..(7048): a, c, t, g, unknown or other
cgacgccatcgcccggctggcgccggcggcgggtcggcccacgcccgccctgccggaggccatggccggcgcagcggcgctgcagcgcctggtgcacgacgccgtgctttccacggcgctggcgcggccgcgcgccctgtttgccggcctgccggcggcgagggagtacgtggcgggggacggcgcggccgccatgccctccttctcggccatccccctgcccgccgtcacggcaggcacgtgaagctggctgggcgggcggtttggttgattttttggagccgagatcagggcttacacctgttgcattgcatgccgagcagggggtcagaggctgagcgccctgcgctgagcgggcagggggctgctggtaggtggcggagcgacacggctctgtccctcaccgctgttgggtgctgcagcagtattcgctgtcgccccagtgccctcgatccatcatcacctccccgtctcaccctgcagccggggagtacctgctgctcctgccgcagctcctggaggcggtgctcctgcgcgacgaggaaagcgcgggcgcggaggacgcgctggccagtgtgaacgagtggacctcgcgcgtcgccgcggccacggcccaggagctgacccagcgcctgcgccagctgccgcgcctgacgcgcggcggggcgggccagctggcggccgacctggagtacttttgcaacgtgctgagcacgctgggcatggaggcgccggacgcgctggcgggctgggcggcgggcgcggcggtgcagggggaggagccgggcgaggcggcgggcgacgcacgcgctgcgtttggggagctgctggcggccgcggaggggaaggaggggcgggatgcggtgcgtgctgtcgccgcgctgaggggcatccagctgtgagcggcggcttggagtttgtgcctcttgacgagccgcgaccaccgcctgtggcacactagctcggctgccatgtacgcctgggaatgtcttccccaagtaacattcaagggacaggacgagtcttgtaaaagataatcttcgcacccagagcacaggagcgagctgtatttccagaccagagggaggagatgctcaaggctgactgcaaataacatgctggcggcaggcaagctgcacgccacatgcccagtcgctctactgcttccgcgtgaatcggttgggcacaaactggaacggtccatcctccaggggccagccggtgtggcgccctggcggtgtcaccgtgttggtcgcggggacggcatgcaggaccccctctggaccatgcaaggtgccacagatggcgcaatcctgcacatggagaatgtgggaggatgggtgctcagacatgccagctccagtggcgcagcccacatggtcggcctggcagggcaatggacacactgagattcgcggctccagcgccccattgcagctgccctgcccacgggagactcccagcaccctccctgctgggtgctccgccccccataccgccacccgccccacctctgcgacaagctcggcgccctcctcgaacaccatgatggcatgcgaagggcccccctccagcctcacgccgctcagctgggctcgcgcctggtcccagagccacacgccccccacgttctcttgcaccgccccgccgaccagggtcgcggaggcgcggtcgctcaggtcgacgcctgggcccttgcagcctgtcaccacggtctgcgagcacgtgaggagagcgctgtccatggccacgaggccctcctcctcgcacttctggacgatgcagctggtagggtgagagttgggagcggaaactctcagtgaattcaagggaaatgatgggacattccgcttgttccagcgtgctcaacaaagaccgtgcttggcgcaagcagacaccaaagcggtggctcaggaaagcatgcaatggtagattcaagcttggcaaggggacgagctgcaccggggcagatcggagctgcacatgcgggatcaatcaatggctgtccctcttgaactgcagaaagcacagcgggctaggggcagcactctccccaccctcccccccccaggactcactctgtgaggtcgcacttggcgctctccaggagcttgacccccgcctccccgcatttctcgatggtgcaccggagcaggcgcggcgcggcgctgtcgaacgccctcaccccggatttcctggccgtcagctcgcagtccacaaacaggggggcggcgccctggcagacattcaccgcatcgtcccctgagcacttgaccatgcagcccaggatcagggggcccccagcccccgccggcccagagacgcagagtgtctccttgaacccggtctgatccagggtcaggttgtgcagtaccactccccccctacgtttgagagaggttgggggtctggcagtgtcaagggcagatcgaatcatggagtggtcccagcttcgagctgtgtgactgcagcgcaagctgtccaccctgacccagacgcgtatggagcccatctcaccggccgatgcggaaggtggggctgttggcccgctggtcgatgacggcgtcgcccagccgcccttgaccctggatgagcagccgcttggagacagtcacagcctccctgcttggcagtgtgtggcaccatgctcatgaatggggcaggagactggtttcacaccccagcgggtcagtgggtgatttggtgggcttgcaggctgatcgtttggcaatcttgcgctgcgcatactgaggggctgtccccctgcttccccacacacaccctgctagctccaggacaccatctgcaggactcaccccatgccattgtggaccccggccagcaggacgatggtgtcgccgtcttcggcggctgccacggcctctttgaggctccggaaggaggtgcggcgtggccctgatggcgccctccactctgccaggtcttgactcgcgccggtgatcttcaaggccagcccacttgcctccgcggggaccagcgcgccgccagacctggctttggcctcgaggctcgccgactcgatgccagcggccggcggttggagacaagcccctgttcctgcgggcaggtacttgaccacctcaccaggctcggtggcctccggcccatccaaatgcggatcgtggggtgctgggcccccgagccaggcttcgtccccggcgctacgcacctggtggaggggtcacaggaaggggcggtgaggcagagacgagggaagctcaatgaggggagcccagccgcaccacccctaggagtcaactgacctccagccgggctccaccaaacccagcgaggctgccggccacaaaggctgagaccgcaacttcatcctgcagggcctggaagctgggcacatcggccggccccgccagctgggtgccgcgtcgcgccgccgctgcggcagccgcccactgccccagcgcctgccgcgcccgggccagccggaacaggggtttgtgccagtcggggcgcagtcgatgcgcgcgctcgcatgcggcggccgccttggcggcggctcccagccgcaggtgggcggccgccatgttgcagtgcaggacggccgtgtcccgcggagaagcggagggctcggccaagcccagcgcatagtggcgcagcgccgcagcacagtcccccgccgcgagtgcggcgttgcccgcggccctgtgcgcgtctgagggccggtgaccccagtgcgcacagggagggtcgggtgcgtgcctgtggctgcccgcatcccagtgcagagtcccctcgacctcttcctcctcggcctgggtgctgggccgcagcatcgagggtccaggggtcgtgcaggactcaagctcgtcgtcgctgctgtcggagacctccgtctcacgaacgaccgggctgctgggcttcgataccataatgatgccgtctctttcctttcagcagacgcacctctaaaggagaaggatacacattgaggaagtggattgttctgactacttttggtcaaagttggcctcgaccatggacgtgctgcaagtcaacgagggcaggcacctgatgctaagtagcatccaacatgacgagctggataattcatgccagagactgtgacaagatcgtgccagctgttgtcttggtgccgagggtttcaattctctctcgcctgccactttcgagtccgggcgcgcttcaggccgcaacagggcaggcatcccggaattgtggttcaggcaggaagatcaaccctcctactccgacaacgaacttgagcatgcacaggctttgaacaccaccgtcgaatcgccacattgtaaattccttcagcagtggagcttcgtccaccacgccatcccctggaggcgagcgggctgggatggcgaatatgcctgcacaggagtcccttattatgtaccccttgagtacatatacatttggtcagaaggccgcagtggtggagaagcatggctcagtccccgtccgtatggagcgcctcaaggaaaagtacgagtcctgccagatgtttttatcacttgcaatgagttgcccgatgtagctcatatatggctgatgctttatcaaatggtacctgcactggatctgttgtnnnnnnnnnngttggccgatgtagctcatatatagctgatgcttcatcaaatggtacctgcactggatctgttgtcgatgacaggcgtgtcacgctgggcagcacctgtccctcacccactgctgggccgccctccccgtgcccaatgcaggtatgccctggagggcatccggcgctctgtggatgcggtgctcctagtgcatgcccacaaccacccgcacatcctcctcctccagctgggatccaccttcttcaagctgccgggtggccgactcagacccggagaagatggtgtgtgaaccaagccggggaggagttcttagggcggggcgaaggtgcacgggatgtcctggcatgctcctgacggcccatgtcttgtggacggagttttatcaatgtgggaagattgcctctgcagggcttggcttaccgccggcacagtcttgctgcatggcggacccctcacagggtccctctcgcctgtgctctccctctcccagaggccacggggctgatgcggaagctgaacaaggcactcgctcccgagaaggatagcatgaagccagattggcgactaggggacctgcttgcaactttctataggtgggtgtggaccatgcagcgataatcgtatggacctgatcagtttgtactgtgtgggactactggcctgacgacgggggccacccgcccagactgcctgccaggtggcagccgtatgctgaaagcatgcttgcatttgatgtgcttgccttcagtcttgccttcatgcccaggcagagatctctggagaagccctgccctgccatcagtatcattgctctgcacacttaatacccccaaaccactccacgattccaggcccaactttgagaacttcctctacccctactgcccgccacacatcgagcggcctaaggaggttaggagcctgtacctcgtccatctgccggaaaaatgcttcttctccgtaagtccaccttgtggacccttgaccatgaagttcgagccctccgtgtcgttctgagatatttggcagcgtcggaccctgcaaaccgacgtcagggagtgggtccgtcacaccagtatcttgctctcgctctcacatcctgcctgtctccactggtcgcacaaggtccctcaaaaccagaaactcctggccgtgccgctgttcgagatctacgatcacatgtcacggtatggccccctcatctccgcggtgccgcagctgctgtcccgctatgcgctgcgcctgatacggccagacggcggggtagcggcggcccccggcgcagtcaccacacagcccccccgtgcagctccggaggcggcaagcggtggcccaacgaggggcacagacaacgggagcgttgatgcatcagggcctctggggaatggagagnnnnnnnnnncaccctgcaagccgacctcagggagcgggtccggcacaccagtatcttgctctcgctcccacatcctgccctgtctccactggtctcacnnnnnnnnnnctttgatgattgagcgagggctgttgtagctaaccatagctaaaatgagcttaggaattcaggatagtgtgcacaagagggggttggagcatggttattgagcagtccagggnnnnnnnnnngcccaggcggggggaagggtgcctcaggagcagccaccagccccgccctctgaattcatggtggattttgatgattgatcgagggctgttatagctaaacatagctaaaatgagcttgagaattcaggatagtgtacacccgggggagttggagcatggttattgagcagtccagggnnnnnnnnnngctcccccgagcagctccggaggtggcaaacggtggcccaacaaggggcacagaccacgggagcgtcgatgcatcagggcctctggggaatggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttggggagccacgtgggcatgggggctgtcatctgtcaaaagaaagcacggaatacccttaccccctcctannnnnnnnnngaacactgccgtcatgtggacactttatgcgcagaatcaatggcatgagtccactaatcagactggttcataattcaatcacacaatgagtctgtgcaaccttcggggagccacgtgggcatgggggccatcgtccgtcaaaagatagcacggaataccctttacccccattacagggcttgcgccggttgctagcagcttcttcccgcgaaagggatatcgctggcgtaggtggttgcctcaaatggcgaaccgaggggttgggggtaggaggaaaggaaggggaagcagggggtccannnnnnnnnncggacgggatatcgctggcgcagatggttgcctctaatggcgaaccgagggggtggggggtaggaggaaaggaaggggaagtaggggtccaccaaaagctgtgggacgaggtgcaatctcaataaagcacttggtcagcatcaggatgttcaccgctctattcacgtcgcggttgacaacgttgaccttgcaggccgtgttgacgcaccgcttcgtgtcccatacttccgtccacgtctccacgccatcgcagacc

SEQ ID NO: 39828 - DNA, 109 bp, Chlorella protothecoides
cagcgtgcccagcggccaggcgccggcctctgtgtccaccgtgctcagcgggtagtggccaaaggccaccaccggcggagcgggggaggatgccgagcagcgtcggggc

SEQ ID NO: 39829 - DNA, 61 bp, Chlorella protothecoides
cctccctctcagccgccccttcccaccctctctcctcccaccgcatgcatgctcacaggac

SEQ ID NO: 39830 - DNA, 29347 bp, Chlorella protothecoides
  modified_base (2085)..(2094): a, c, t, g, unknown or other
  modified_base (2553)..(2562): a, c, t, g, unknown or other
  modified_base (3234)..(3243): a, c, t, g, unknown or other
  modified_base (4039)..(4048): a, c, t, g, unknown or other
  modified_base (4104)..(4113): a, c, t, g, unknown or other
  modified_base (4614)..(4623): a, c, t, g, unknown or other
  modified_base (4893)..(4902): a, c, t, g, unknown or other
  modified_base (5776)..(5785): a, c, t, g, unknown or other
  modified_base (6290)..(6299): a, c, t, g, unknown or other
  modified_base (6917)..(6926): a, c, t, g, unknown or other
  modified_base (8511)..(8520): a, c, t, g, unknown or other
  modified_base (10163)..(10172): a, c, t, g, unknown or other
  modified_base (10317)..(10326): a, c, t, g, unknown or other
  modified_base (12509)..(12518): a, c, t, g, unknown or other
  modified_base (13483)..(13492): a, c, t, g, unknown or other
  modified_base (13890)..(13899): a, c, t, g, unknown or other
  modified_base (14979)..(14988): a, c, t, g, unknown or other
  modified_base (15253)..(15262): a, c, t, g, unknown or other
  modified_base (16247)..(16256): a, c, t, g, unknown or other
  modified_base (16458)..(16467): a, c, t, g, unknown or other
  modified_base (16805)..(16814): a, c, t, g, unknown or other
  modified_base (17338)..(17347): a, c, t, g, unknown or other
  modified_base (18538)..(18547): a, c, t, g, unknown or other
  modified_base (20731)..(20740): a, c, t, g, unknown or other
  modified_base (20926)..(20935): a, c, t, g, unknown or other
  modified_base (21332)..(21341): a, c, t, g, unknown or other
  modified_base (22441)..(22450): a, c, t, g, unknown or other
  modified_base (23166)..(23175): a, c, t, g, unknown or other
  modified_base (23326)..(23375): a, c, t, g, unknown or other
  modified_base (23871)..(23880): a, c, t, g, unknown or other
  modified_base (24070)..(24079): a, c, t, g, unknown or other
  modified_base (24493)..(24502): a, c, t, g, unknown or other
  modified_base (25342)..(25351): a, c, t, g, unknown or other
  modified_base (25727)..(25736): a, c, t, g, unknown or other
  modified_base (26551)..(26560): a, c, t, g, unknown or other
  modified_base (29089)..(29098): a, c, t, g, unknown or other
gaaggagcgagtcattctctggcagtggcaaattggagaccatgacccatcaggctgaccaggtgtgacctggagaacaactatccttcacaccttggtgcctttgaccctgattttgagccacttgatcaatgtccatcaaaacgtggccccaacatatatagcattgcactctctgacgctaagctcattgcggtatccgaggccagcattagcaggaggtatagtgagggatagtgcgcttgtcaaacctgccacccaggcatctctcagggcaattgcgtgacattcctggagcgcgagatccgatgaacggacaatgcccctttcccaggcatcgtgcacagtaatccaacaccacttttgccactgcacatcccaggcaaccaatctgtgccagtttgggggtggttgagggtcataagctgcgacagatactacagtagcaaaacatccagacagattccacgtatatccctcgtatatctggtaaggaatcgcggcctagcactggtcattttctttgaggccttcggccctcagatatcaggggtggatgtccaaaaacggggcccgaggagttgcaaccacagtcgcaccagcacctcatgaccgggtgcctaaagatgattttgaagagtgcttagcgagtactgctagccaaggggcatgtctgcattgcaagcatggttgctataggcgagctgttgttcacccgccctgctttcttaagacaccaatatggcctcgaacggcaactggggaccaagcgcggttgtcagcggtgatactaaggaaaggtctttggcgcaccattacgtgcggactgtcagtcaatcacaagctaacacatagaggctgatcctgtgagcgcggcgtcagactctgccgcgatggatcgttcagtggccatggcactcctgtgcttgtcccttgtcggtgagtccttggacgtgtgcggggcacagcgatgacattgcaacagtatgagctcaccgccactgtccatccgaccttgcaggctcagccctggctgcacagagtatcgaggtgaagtcctggttcccggagaatcccaccaacgagtttctgcccggcaaggaggtcaaggctgtcctgggccttcacaacgccggttccagtgccctgaatgtgagctacggcgctggcctcctggcctcgccgtacgatgccaaccaggtcctcttgaacttcaccacccaggcgaggagggcgggtaggggtgggagagttggcctcggccttccctgtggcagactgcctccaacccacctagctctgcaggctcgcccctcacctctccaggcctatccccctactgtgcagtacctgaacaatatcccgctggcgccccagcaagaagccagcgtagactacacgttgcacttcccagcccagatccccccccacgagttcctgctgaagctcgtcctctacaccactgtggatgagcaactggaggggcacctggtgtacaaccaggtgggtcctgtgctgttgaacccggggcagcacgctgcatcgactctggggcaccgtggattctgagtgcacacccacccggctcatgttctcaaccccgtacaccaccgcagaccatcttcgtcatcgagcccgcactgtggatcgacctgcagctgatcggcctctacctcatcggcctggccgtgctggcgctggcaggtgcgtgccggcggccggggtgggtgatctgagcatgccctccgacctgtgcccccccgggtcgtcgtcgagttgagcatgaggcatcgatccctgattcccatccccatgcccctcccggcctgcctctttacaggctacttcggcctgggctgggcaaagagcaaggggtacgttaagaagacgaggaagtccaagctcacaaagacgggtgcggcgtgatggtgtttgggggagacgggcccctgtccgacgcctgtgccagctgctgtgccatggttttcatgcttgaggggtgtatctgcatcgatgtgctgggatgtgactcgccccccccccactctcccacccacccctccagctcccggcccggccgacaannnnnnnnnntctgtgccagctgctgtgccacggtcatcatgcgtgaggggtgtatctgcatcaatgagctgggatgtgactcgggccccccccaactctcccacgcacccctccagctcccggcccggccgacaagagcgactatctgaagggcacccacgggcacgaattcctgcgcaagaggtcgggcaagctgagcgattgacgccctggtcgcctttaaaggagcggtctggtaccatctctgtgaagctgtctttgcctggcttgagccctccaggaacatgagatctttggtgcaggggccggagcggcgggcgcggatgagcccttcgatcggagattccgtcgcggcacccttcccccaggcgtgagcaccatgacgacgctgacgtgcatgcatgcatgttattgagaattaatcgaggaccaaactcccggatcgagcgtcccaaggaactgatgagnnnnnnnnnncgagaactaatcgaggaccaaatttccggatcgagcgtcccaaggaactgatgagaacccaacaggccaacacgtcgcccctccgatagccacagtggtgttcgcgggcttgcgcccccttcaatggcaaagagtatgcgacaagggtgtgcgagacatgcactgcatctcatgttaatggctcgctggaaggacggggtgcatgtctcttcgcgagggaagtccgacacctccctgccctgtgacgcctgtgcagagaaggcagcctcgcgtgcaggctcccgcgcgggctcccgggcagcatccgaggctggggacgatctcgcctccacgggctggtcctccgtggaccagaggagcatggggagcagcggggagggggtggaggagtacatggacgacccctttgaggccagcattgagggcctgtatgagaaaaggtgggggttcactggggtatccttgtggtggtgggcagggggcattcccttgcatcccctggaagccggtgccactgtcatgcgcagccttctgttttgcgctagagcacatgcctctggcctgttcccatgcgcgaggccccctgccgcaaagcagggcgccggcgcatgccggccccctgcctcagcggccccgctcagcccccattccttctctccaccaaccccgcannnnnnnnnnaattcccttgcatcccctggaagccggtcccactgtcatgcgcagcctcctgttgtgcgccagagcacatgcctctggcctgctcccatgcgaggggccccccaccgcaaagcagggcgccggcacatgccggcccccctgcctccgcggccccgctcaacccccattccttctctccaccaacccctcacatcccaggacgacgacccgagagggcagcctcaccaagctggtggccttgctgtcttcccaatggcagtacgaggagtgcgcgctgcgggaggagaccctgttccagctcttcctgcgctccctgcggcggggcaagggcgcggaggcgcggctgggggcccgcgcgctgggcctgcacgccatcacgctgggtgctggccccgccgtggagcgcatgcatgccgaggccctgcccgtgctggagcccattgcgctgacgggtcaggggcccgagcgctgctccgcgatcgacgcgctgagcatgctgtgcttcgtgggcgcggaggggccgccggagacgctggcctgcatggacatcctggcccgggtcttctccacgtcctcttgtgggtactgtaggagtgtgatctggtggtgatttgggtggggagggggcccatgtggagatgggtttttcctcatggtgagtatgatgaagccatgtgggaggggaaattgaagagtgtcctggcttgtgcactatctgctggggagggcgcggatgcggctgggcctgtgccggcgagacgatgcctgccgtcccaacgcaagcggcgccctgggnnnnnnnnnngttctccacgtcctcctgtgggtggtgtaggagtgtgatctggtggtgatttgggnnnnnnnnnntcggctgggcttgtaccggcgagacgatgtctgccgtcccaacgcaagcggcgccctgggctgccccacaggtcttccttcttgtcccttatgtgaatcttctctccagaaccctctgccccccaaaacacttgcaccccaggtccagaggcggtgcaggccacggccgtcagggcatggaccctgctgctgaccaccgtccccgcctggcacctggaggcgggctgggtggaggcacggctggccacgctgggcgcgctgctccacgccccctcggtggcagtgcgtgcctcggcgggcgaggcggtgtccctgctctactccacctgcggcctggcgtcccttgcggatgcggggcagcaggggcccgccgcggcacctgccacgccagcgtccccggggtccaggccgccgcgccccagacccggggggaccccccggccgggcggcgggacggagggcgaggagctgcccaccacgcccggggtggacctggggccnnnnnnnnnncccccccggccggggggcgggacggagggcgaggagccgcccaccacgcccggggtggatctggggcctagggtcaatggcaagagcgtcagctactctgccgacatccgagcggagccgtccagtggggaggaggaaagcagagcggagggcacctcctactctgccaaaagtatggaccggaaggctgtgtgcgggtccaggggcgggggcgtgggtgtgcgctgtggcgcttccagtgagcaaccatcccagcccctggctgacaannnnnnnnnncaccggaaggctgtgtgcgggtccaggggtgggggggtgggtgtgcgctgtggcgcttccattgagcaaccatcccagcccctggctgacaaaggaggagtgtgttgtcatgcattccgcacggatcaaggcattccagtcggggcctggcaggggcccactccagcaaccaggactcatcaatgcaccccccccctgccactgttccaacagcggtggagcgcctggaggacatcaccgccaggatccaggatctgaccaccaaccgcggcgacgcgtcccgtcggagccagaaggaaagggcggaactgcgtaccacattccgtagcatcctcacggccatcgaggtgtgctacactggggatgtgcgagggggcatgccggttatgccgcccctcagtcctccgcaggagtgaccttgctgctgcgtgggtggtgcagcctacgagtctcatggtcacccactgtctccgtcaagtcaggcgcccaaccctcagtcggcacctctgcatccgcacagggtcagacagctttgcccacccagaagattaagttgcggcatggtgatgtcctgctggtaaacagcctcacggctgtgctgcggctgaatgccttccggcgcttccttgccgagggcttccaggcccacatgcaggtgggctgggaggttgaatgcatggtgtagtgcttccttgccattcctggcatacagcgtctgggctccagccccaggcgatgctcaatgttggcggttcatgtgggaggtgctagttctgccaagtggcatctgacaaatgtctgtgttgttgtgtggcttgcctttctggcctgcaaagaaaatatatccacgttctgcaccttcacaacacaggannnnnnnnnnatggcttgcctttctggcctgcaaagaacatgcatccacgttctgcaccttcacaacacaggacaaccccctcctgcacgaggtcttcaatttccaccccagacaggaggccgcagaccgcctgaccgccctggagaagcgcctgtatcgctcccccgcctccgccgagagcaaggctcgtgcgcaggacaggaggagggagcgggagctcatggcgtcctacaagggctccatgctgagcatggagtagggacgggctcccgagcgacagctctgagagcacagagcatgctgccagcgacgctgctcccatggcatgcatcagtcaaatttaccggcgtattgcccttgccattcccatcatgagcaggtctggcaggctttctcaggcatcttgaacccaaattgtccatgctgttacatctcacttcacatgtcgcatgggagaagcaggggcacaaagcacgggagggtgaggctctgaaaaagggccagcactgtagannnnnnnnnntacatggtagaagcaggggcacaaagcacgggagggcgaggctctgaaaaagggccagcactgtagagctgagcacccaatgctgcacagggcacgactgtgcaccagaccggggcaggtcgcacccaactacgaccactgcgcgctcagttccggggctgtgcatccagcttcctcctggctcctttgagcgtgcgctgcagcgcccccgctgccaccccggcctggccgtccaggcggccggcagcggtgccggccgcagcccctgctgcccccagcgcctcgtccaggatcgcggtggctaggcccctgatcccgcgggagaggtcccgtgcaaacccccggcgcttgggcctggagaggccgcagaaaggcccggtcaccgcggcgccagccgcgccggccacacgcacaagcgggcggatggggcgggtgccgcccacgaacttgtgtgcctgataggccgtttcgcggatgtaggcgttcaggatggcggagcctgcacaaggttgttgggtggtggtagagcctaatggtgtggtgaggagacccgacgcagagccaagcgtagcgccctgctgcatatatcctcagaccaccccgaaccccaagcccacnnnnnnnnnncggcggagcctgcacgaggtttttgggtgatggtagagcctgatggtgtggtgaggagacccgactcagagccaagcgtagcgccctgctgcacatgtcctcagaccaccccgaaccccaagcccacaccgctcaccgagggcggccaggccatccaccccgacgaggcggagctcacggtaggtaaggcgcacgccccccagcggcaccaggtgcaggagctcattcaggctgccctccctcagcgcctgcaggttgaccgcgctggcagcgtggtccagcacaatcagcatgggcttgagggtgaagtgctggatgaagggccacgatgcagtggagtctgtagggaggggtggagatgtgttgatggaggtggggttgggggatggggggaggaattgagcggcttgggggggagtacgagtgcggggttgtgcctccgctatttagggctgggccaggctctgtagaccatgcctcgtgacaagtatttgagtggcccaatccaacaaccctgtaaggaccctaggcattgccaagcacaccgttcatggcgggtgtatcccacacagggcaggctctaatcgtggcatgcccaccatcacccaaacaaacacgaccaacacctctccccacctgccgtcccccccgccttggactctcccgcctccgcctcgccgtcctcccacccactccagtccaccagccgcgccccaaagtcctcgtcaaagtcggcgccctcggcgccctgtgccagcacatcccgcagcacgtcgatggagcgcttgcggagctgcaggcgcagcggcgcgacggccgcggccacgcggtactccacctcgcccccgacgcgcacgctgtgcacgacgaccgacagctggggtgggggctcggcgcgagagggcgtgggggggccgtggcgcgacagcacggggcggcccctgctgtcctccacggtcagcgagcgcagcgtgcatgtcgtggccggggaggaggcggcggcgtcgggcccgtccctcgttgcgctcgactcgccctccacctggaggtatggcaggggatgaggatggggaggagagggtgggctgtgcgcacaaaaggccttgggaacgtgtggcgtccaggcagacacagagtttcatctgccggcgcctgcaggctgcctgactgtcacaggcctcactccagccacccgcacccagcccctcaccatgatgcacaggtcgcgcaggcgggtcacgacgacgtcgccggtggacgctgtcagcgttatgtcgatgttgagggtgcagtgcagccggaggtcctctgggtctgcctccagctggaggggagagggcacaaaggatggggggatgacgtaatcgtctaccagtctggtcgctccaaaccaggtgccgtcctgggtgtccctgcagattgcacacgggttgtggggggacgaatcagaaagcacaaagcatactgtaatgcatctgaactgatgctttgatcccactatacaatcacaatcctagtggtgatgcacaagtcggctgtcccaccctctcatctggatccctgtcatccctctcccacggatgcnnnnnnnnnnttgtccctgcagattgcacaagggttgtggggggacgaatgagaaagcacaaagcataccgtaatgcatctgaactgatgcttggatcccactatacaatcacactcttagtggtgatgcacacgtcggctgtcccaccctctcatccggatccctgtcatccctctcccacggatgctcacgaggagcttgggccttccagctcctgccaagcggtgtccgagtcgaccatcactggtgggctgccggctggagacaggggttccaggggaatgtcctggtaaaacccccctggattcaggggggggccggaggggggattgacaggagcagcttttgcaaggggggccacaacaagggtcagggggggggaaacattgtgggttgcttctcagcctgcacgcccttcaggcccctgcatgcggccaccgatgctggcaatctctgttcccgtccccaggggcaaaccgcatcgccccgcgcgcaccttccacaaacacagaggcagccggtcccgccgccccgcccctggcgcgggcgccgcgcgcctcgcggaaggcgtcctcgtcaacccctgccagcacgtcccgtgccgccgcgagctcctgctcggcgccttcggggcgcggcgaggcgcctcgccccggtcccaccgccccggccagctggtgccccagcctctggaccagctgcccgccccgcggcgtcagcgccagggcgagcagctggttgcagacgcggaccccgccctcgcccgcgtctgcgggcaggagcacctcgacctccgcctcgctggcgaccagcaggtacccctggcccgccaggtcggcgcgccagccgtccacaggggcgccccgcgcccagcgcgccgcctccctggtctgcgcgggtgcgacgtgcaggtccaggcagccgaggaccagtgagtgccgcgctgcggcgtcgcccgcgccgggcccgcgccagaccgcgctgccggcgcgcagcacggcggcggccgtcggggcaggggccccgcgcggcgcctcgtaccgcacggccaccgactcgcaccgcacggtccacagcgcccgggggcctggggcgaggggggggtccggggacgaagcgctcggcgccggggcgagcagcgcgcccacctgcgccagccagcccagcgtcgggtcgccgtcggaggtggagagggtgcactctgcacaagggtttgatgggcatcatggcatgaggtggagaccgtggcatgggacgacgagcggttgccggtcggcacaggggtgatggtccacgacgcgcgggaaagagggcgagagtcgggtcctctgctactttccagggccgcagcctggcgagacggtggacaggcatgcatggcggccaggccccttctgtccgaccaccgcacctcggatctggaggaggccgatgctccggcaagggtagaccactcgccgcccctggtttatcactgtgccatccacttgcctgcacagtggtgttgcggacggggcggcagtcataatctcagctacgggtttgcttgcaccaggccatgcagatgagcggcgagatgagggatgtgccttccacccctggctctgagaaacccaagggtcaagggccaccccctccctctcccactattnnnnnnnnnncatggtccacgacgcgcgggaaacagggtgagagtcgggtcctctgctgctttccagggccgcagcctggcgagacggtggacaggcatgtatggcggccaggccccttctgtcccaccgcacctcggatctggaggaggccgannnnnnnnnnttcccatgtcatttgaccccaacatcgctttgcctggagagatgcagcagggccagggtggggccgctcgcccctgggcccccgccatgcagcagcaagtccccagtctgggcgcaggccaggtccgctccatcgagagtgagcacggcggccgaggcccccggcaccctgcccagccccgccacgaagaaagcatggaagccggctacctcggcgtggaagaggggccggtccgccgcgtcgcgcagcgtcagccgggccgccgcgtcgagggacaggcagttctgggtggccagctccacgccgggcagcgtcggcgcggggagcaggcccaggcaggcctccaggaggggcgccaggggtgcgagtctggcagggtcgaggtcgaggtgcacgtggaggccggaggctcgcagcgcgtgcgtgcactcctgccttgtgctggcctccaaggaggtcagcagggcctccggctcactggacctccagacaccacatcctggaagaaaggggggaaaggggtgcggtgagtgagacgggactgaggttgccgcccagcggacccacaagtgcgaggttgggggatctgcgcccagaggatgatccccttcacccagcatccacaccttcatcagacgcgctggtgggggcgggggtcgcctgctcccacagcgcctccagccgatcggggctggacagaggggttgcaccaaagcttgacctgcagaagacctggatcgcgccacctgcgatcgcatgaggttgcaaatcagggcaggccacttgagtcgtgtaatagcatcaggtcttgcatccgacccgccctgtcaaaggcgccatccaccactgcaaacatcaattctgctggctgcccacctccatcctgtgggctagcctccagcaaggcccctgcatggctgccagcaggcagccacaacaccctggcacctgccagctggaggctggtgaacacctggctcagcctggccggcggggcccgccgcacgaccagcgtcagggctgagctggcatgcagcgcggcgagctcaggctgcacattggagtgggtttcacaggaatggattgatgattccagcggtgcctgccacccaggactgtgcccgccgatcagagaggggcgagtgcatgccccaggcagtgcaatgggaccgacagggaaccctatgcaccttgcagtctgcgctgtcgacttcgcgcacgccttgcatggcctgtgcgtgcacgagtgggtcgccgcagcccagcgatgtgatcagggccaggcaggaccccgggccgggccacaccgacgagccgtccaggccgcttgcgcaggcggagagggggaggggcaccagcaggcatagctgggagcagtggatgctgagggagggctccagctccggcagggagacggaggattgcctgcgtggatgtaggttgggcagggactttgttgcccagtgatgtatgcaatgtcatgtggaaagatatggactgcgacgaaagaatcgtggcacagtcgaaagccccaagagcaaaagcccacatcggaataggtatataggactaggagcactcccaaggcactcacctatctgtgcccaggctctggctggacacggccggggacaaagtgctggggctgactgccacaccacaaccggcaacctcgggcgccggtgcgcaatcgtgcatgcccaccgccaacctctccacggcggccagcaggcgctcggcagccggcaaattcagccagcaggaaagcggggccaggtgcacatgcgtgtcccaccctgtgccgctgccgccgctctgacagaagagcgtgagagcggcgcgctcatccgctgccgcgcctgacctgctaagaccctgtgcatcgctgccgctgcagaagaggaaggggtaggctgccgtgctgctcggccgtgcctctgtcccagcccggtctgggatgtgcagatccgacagctgctccagcgtgctcttcagggggctctcgtcagggtcatacggccctgggcagggaacagggttggtggcattgctggcttggggcggaggacggaagtattcagcacctgcagcagtctttctatcaaggcgtgaacccttcggctaccacgcccatgcagcttgtacccccccttgcctcaccgggcctggcatagtctgggcannnnnnnnnngtaccacggcccatgccgcttgttaccccccatgcctcaccgggcctggcatagtctgggcagggtcccacgctgctaggcagcgagcagcatgccgtcatgtgttgatcctctgccacgtcgacggccgccgacctctcttccacgagctccaaggtatggagcgtcaagccagccaggatgcagggtgcctggccctgtaggggttagtctcagggcacctgatgaggggagcacgggcctccatataccaggctgcagctccacagcctgccacccacgtgtgaaacaaggagcggtgcatgatgtcacgcaaaggagttccctcacccggagctgcagcgagacgtgttcaaagctgaggaccagcccgtcgtcggtgcctgggtatggcagggtggcctgcacccggggaagcttggccgagaggctccactgcagcggggctgccacctgcatgggtggtgagggtgggcgggacgtgatatgcgcggagaggccctgctggggaattctccgaaagcagactccctgcctctcaaatgcaacatgcctcccacccctgggcctccatgtgccaatcacctcccgaatggaggcggtgaggtcgtgcaagcgggacagcgtcttctcaggcgcagcgagcgctggcgtggcagctgtctgcatggaggctccagcgctgctccacacagagccggtgcgggagtcggagctgtacacggactggaaccttgagctggtgctgcagaaggaggcggtctgagacctggcatcccagaagtctgggtcgctcacctcctcgtcaggctgcagcaaggggggagtgggaggaaggggtgggcccctacggtgcccactgcaacagttcaacatgcaggcctccactcatcccccgagcaggccacccagtccctcgcaatcagcctccctacccccaggcaactgaccgggacctccagctnnnnnnnnnnagcctcgactcatcccccgagcaggccacccagtctctggcaatcagcctccccaccccccaggcaactgaccgggacctccagctcagactcagcgccagcaaaggcctccagcaccaggtcctcgcagtcggggagcatgaggctctccagcagggagcgcgacgcccaggccccaggggggtcatgctgctcgcgacagggctcagggcccgcccccttcgtccctggggcctggccccccgcccccagcatgcctcgcagcacggttgccaggcggtccagggtggccaggccgccagggttcaggtcggcggccaggccacccagggtcaggcccagcgaggcggtggggtagggcgtgccgcacccctggcccaggcccagggtcacggacnnnnnnnnnnggcggtcaggtcggcggccaggccacccatggtcaagcccagcgaggcggtggggtggggcgtgccacacccctggcccaggcccagggtcacggacatcgtgcccccgcacccctcgccatccgcgcccgccagcaggggctccgcagcgccccccgccccggcgtcgaccttagcgccgagggccaggccccggaagtccacgctgcgcgtgctccgcggcgccgaggtcaggctggaggcctccggctcggccccggtgtagctcagctgctccagggtgaggaccaggagggctgggggggtactgctgtgctgcgagggcagcagtacccgccccacgatgttcgaggcctggacttgcagacgctggaccagggattccagacccccggcgatgatgcggatgccgtcggacacgccgtccgtgggggcggggggcgggggtctcggtgtgccgggggctgcgccgggcgcatgcgacgcagggcccggctgcgcccggggctggacggtgaggaacacatccacgagctggatgctgcaggagtcctggtacagggaggccagaggaatgtaggccctgatgcagcccacgaaggcggtcaccacctcccagtgcgtgtggtcctgggtggggtgagtgggtggggaccatggtctgccatgtcggacacaggtcaggggtcctggccagtgccggaaccatgctggcatgctgcagatgatatcagacgcaatctgtggctcaccagctgctggtttatgtagtcgacattcaaaagaacctcacgcagctccaggctgccttggccgagctggacctcgacctggtccaggtctatctcggtggcgatccactgcttcaggttgcgcttcagcacaaacttgaggagcctcttcaaggcccatgtggtcgctgcgaacatctcttcgacccattcggaagatggacaccgtctaacaaggagagggccccaagtaggggtttttatatggggagagttctcgcgcgcgttcccccggatcacttcccgggatggagatttttcatgcatgcgcgatgatttcacacaggannnnnnnnnngaacaaggtgaggtccccaagtagggctttttatatggggagagttctcgcgcgcgtccccccggatcacttcccgggatggagattcttcatgcatgcgcgatgatttcacacaggaacaacccagcaacacctgcttccatcaatgcgctgtccataggatatttgactctacttgcattgtaatcaaggaggatggccaacctcattggctccgctcactgtcgcggctgtgtcgcatggacagccatgggcagggatgccnnnnnnnnnncaaggatggccaacctcattggctccgctcgctgtcgcggctgcgtcgcatggacagccatgggcagggatgcccctcttcgcaagcgcttcgccccgacgtcgagtaaatgcccctctacgtttccagcgccacgaagagggctttccaccggtctcatggcggtgaacgaggagggagatcggggaacggagcagagggagctggcagatgccgtggacaaggacttttgggaggtgcgctcgccctggagtgtgtggagcattggttgggaacggggctgctccgaatgccttctgcgttgcagggatcctgcttcaggctggaccccctccctggctcctgcgcatgcgtatgcagggctccaactgggagctgctgggcaaggcggcctccatcaccatccccaccctggtggtcatggccctcctggtgggcatcttcgcggccaagttctacaacagcggcgccaacaccttcctggagatgcccaaggggccggacgacaccgcaaaactgtaccagcgggctcctgagtaggctggcctgtgctgaccttgcagaaccctcccccaccctggcccctgcatgcctggtgttgccccgtcgccagcttcacacctcgcctccgaggaacagaggctgcacaagggtcagcagggggggcatgccagccgggtgcaaccggacatcgtcagtcccacttcatcagcttgtagtcgtcgtcggtgagcagcgtggccaccacggtgcggccgctgaagcggcgcccgtgcatggcattccgtgcggcgatggcggcggagggctccgcgaactcgatgagcaccttgcccaggccggggaccgcgggcgcgtcaggggggccaggcctcgggatgtggacctgcggggggaggggggaggggagggatcaggggggggggcatgggtaggtgcatgcatggagaatagggtttggggtgtgtcgcagtagagatgaggnnnnnnnnnnttggcatgggtaagtgcatgcatggagaataaggtttggggtgtgtcgcagtagagatgagggcaaggaccacagcaaagaaatgtgctgggtggcttggcctgcagagggccacatgaatgcacaaggggaacacgcctgtggtacgccaagaaagagccatgataggctcctgggcaatacgatcgcatcgtgatctcannnnnnnnnntttgggtgacttggcctgcagagggccacgtgaatgcacaaggggaacacgcctctggtacgccaagaaaaagccatgacaggctccctgggcaatacgatcgcatcgtgatctcatcaagaccaaccgttcctgcaccatagccttctcccctattccgcacctggagcaccgtgccgtactttccacactcctcccgcatgtcctccatgatgtcggcgtactcctcgtcgttggccagctcgtccggagtgactgcgatttggtgttcaaggagggtgaccaatgagccagcaaaccctgctgcctactgcaggggcaggcgcccagcggtgggnnnnnnnnnnctccggagtgactgcgatttggtgttcaatgagggtgaccaatgagccagcagactctactggctactgcaggggcaggcgcccaggggtggggtggcacatggactggcagagcgtcccatcaccgtgtcggacactcaggacgcagccaccagtaggccatacttctcccattgcaagcaagctacgcaccagcctccagcaggcggacgacgcggggcggggccaccatggtcacagaaccgcccccgccgtcgttgttgcgcgagttgtcgttggcgggcttcaccgtcagggcgcggtcgcccatcttcatcccgtgcaagccagccatggccatctctgccatgggctgctcctcaaacaccacaaagcagtatctgtgtgcatgaggggacgtgaaggggcgagcgaaggggatgaggagagcatctggtggatttcatgggaggggcatatacaaacgcaatggacttcatttgactggccccattgggcaaaatcccagcccacccaccccttgnnnnnnnnnnatgtgcatgaggggaagtgaaggggtgagcgagggggataaggagagcatctggtggatttcatgggaggggcatgtagaaacgcaatggactttatttgactggccccaatgggcaaaatcccagcccacccaccccttgaactgctgcgtctcgcgatcacggacgatgtccagctgccggataacgccaaaggaggagagcagctcccggatgtgctcctcggtgaggtagtagggcagcccgccgacaaagatcctgtccgatccccggttctcctgaggtagggtgggtggcgggcgggaggaaggggtgggggacagtcatgcgccagctagggggaccctcatgtgcatgctcctcagccgcgacccattgcccctcccattctagtgtctgttgacaaccgcagccccaactcaccggaggcaggggctgggccgggagtgcggagggcggggcggcggccgccgcgacggccgcggccgctgcctcctgcgctttcttgtccagaccaatggccatcaggttgaggttgggattgggctgggagggccccagggacagcgcggcagctgcctggtagtcggcggggcggcggatgcgcaccgtgacgccctcgtacatgatgccgtccagggccatggcattggacgtctcctccactgttttgtgtggaggaaagagggaatggtgggacataacaagaggtggtctggggtggcatggtcagtctcgcatgagcaatcgtgctgctctgccggaccttgggaagcacagagcaatatcgtgcccaacaaccaccggggtcaacagccgatcaagcaaacaacaccgcgcttgcatcaagccatcctattcccaggctccgcatcgcacccgtcctgagttcgacaaacgcaaacttcttctcaaagttgatgtatacgttgacgacacatgaccctggaccggccaccgtgccgcccactgccgccagagcattactacacagtgtggtagaaagcgtggcggggattgggcatgccgctcaagagtcaggcgtcaggcgcggccccagccaggttgcgcaagcgattctcctgcactggcaacccctctgcaaagagcacacaactcgtgccacatcaacttgcgtctgaggcacaccagtttcgtatcgctccccctcacctgaaaaaggaagccacnnnnnnnnnngggcgcgtccccagccaggttgtgcaagcgattttcttgcactggcaacccctctgcaagagcacacaactcgtgccgcatcaacttgcgtctgaggcacaccattttggtaccgctccccctcacctgaaaaaggaagccacgccgtcttccgttgcagatgggggcaggcctcccacgtagatcctcctggcgtgccgcgtggcctgctgcgaggcggcccctccaaacacgctgcccgccggcatgatggggatgctggtgtcgctgatcacctgcacagctccagggagcgaggagagcgggggcggtccgcctccgatgggggggatgtcgaaccaggtggggcgccgacgggggcgttcagggtcgtaggcaggggaggctgaccgcgacctgctgcgacggcgccggggtgatctgcattgcaggggagagagtcatggtggaagaaggggcgactgggtttggaactgcagggggagagcagggcaccgcaggtcgccccattgaaagggggcaaataacaatcttccaggagttgcagtacacacctggatcgccgactgctcctcctctcccgggacctgtctctgtcatcgtcacgcctatcatccttgcccctgtctcgggacctgcgaggcggccatgcggcttgagctgcaatggctagcgaggggatggtccatgcccaaacctatgcaaacgcttgatcttggagggagtggcagctagatcgaatcccacctacccaacccacccacatcctcgaaccttgatctacgactctccgaatccctggatctcctgtggtctcgtcgatcgtctcggtcctcacggcgatgctcccgccgctcctgggcaagtgccgtgcaacaggttgagcagcattcacggagcaggctcatagtaccacatgattccggttataatcttaccacttccgacatgacggagccaagcctttcacagacaggccagtcctttttggttgtcagggatgcttgctgcaaggtctggggtcaacacaggtcagcgcaaggccacgcctctgtaaaaacttggctcagtatcgctgcaatgtcagcttgggtcaattgtcatccgtctgcagcatggccagtggcagtgagcggagaatggccggagccccgagttttggtactactgtttcgaagcatgagatatgcctgcaccgtgagtggacctccgaagcagagcattctgccggtcaaaagcctgccaccctccagattgttactatcgtagggttttgacatatacctaggtgccgagtgagctgttagcagaccgcccagtctctgtgcgcgcttggccggaacgctcggacttcggccatatgcagttggcatgcatgccatctctgtcgcacataggcatggcccggtcatctctcatacttaataccacacgagcattttcttcgtgccgtccacgagcctatgccgcggctttcccccaagtcctcagggcgggggaggagtcggtggggctagaaacgagagacgtgccgattgaccagcagcgcctcctgcaagtgggcatcctgggggttcctaatgcagggaagtcgacgctgaccaatgccctggtgggctccaaggtagggaggagtggttggtgggatgtgaggtgcacgagatgctggcattgccgcccagccctgttctgctcgacggcataccagccccaattacaacacatgcaggtatcagccgtgtcccccaagaccaacaccacacatcactgccggctgggagcatatacacagggcccgagtcaggtcgtgctctatgacacccctggcattgtgggtaaagagtgagtgggaatacatggttgtcatgcggtggtggccgattgactttggtgctgcatccctgtgctgcgaaggggaaaggggcacagagattctagtgacatccccatcttagtctgtattcacacatgcttttggcaggcaaataaaaggggctgggcatgagacgagggtgatgtcagcatgggggacggcctcgagctgtgacctcgtgctcttcatcctggacgctcacagacaggtaggcaggggtggtctggtccacccagtgtggatgcgcccgggcatgcctgccgtgtctttgtgatgggttgtgttgcgcatgagactgcctgatgtgtgtnnnnnnnnnncgtggatgcgcccgggcatgcctgccgtggctctgtgatggctggtgttgcgcatgagactgcctgatgtgtgtatggtatgaccaggatactatcaccatacaccccccctcctgacccaactattccacacatagatccaagtacctgacccgcgtgtcatccgtctgatcagcaaccttggcnnnnnnnnnngtcaccagacacccctcccctcctgatccaactgttccacacatagatccaagtacctgacccacgtgtcatccgtctgatcagcaaccttggcagcagcgctggcacgacggacctcccgcctgccatcttagttctcaacaagtgtgagatggtgccaccagagcaacggccagacctgttatcgctggcaggatctctccgagacttgcacgatttccaagacacattctgggtcagcgcgctgaaaggtggggtgaaggaaggagtgaaaggcgaaggagggtgtcttgctggcgcttgctggtggaggatatgttttatggatggaggctggcgagaatatgtggtagctggagcggcttcgcaaacatgagagtggaggacaggaggacannnnnnnnnntcgaaggagggtgtcttgctgggcgcttgctggtggaggatgtgttttatggatgcaggctggcgagaatatgtggtagctggagtggctttgcaaacatgagagtggaggacaggaggacacagcgcagacttctatcaggttccgatggggactggcaatggcaaggcgctgtgcggaacgtctcctcctccccctcccatgatacattcagggagaggcgttccaggcctgaaggagtacctcctgagtcaggctactcctggccgttggactctggaggcaggaatgtccacggatcgcagcgcagaagacctcgccctcgagatcgtgagggagaagattttccagagattttacgatggtgcgttgggagcgcgggcatgattgggtgtatacctttgatgatactgaagagagaggcagcatcttatggcatagccttaagtgacggtgtctctatccgttcccataaacacttgccacttgcagcttccccaaccacccaccctgtacctctgacatccctgtagaactgccctacgagctgacagtcgttccggtgtcctgcaagtcgctacgggacggctccatgcgcgtggagcacatcattgtggtgccgcacgagggcgtcaagaagatcgtggtgggcagtcacggtgccgcactcaagcacgtgggcaccagcgcgcgcatggagctgcagcgcatgtggggccacaaggttcacctcatcctcaccgtgaaggttgccaagtgaggagggtgctggcagtgatcactcgacgtctggttgttgtacagaggccaggagaatggaggtatatcgatataaggggatacaagtcgagattgctttgccagggttatccatgctcattgtcttcgatgggaagagatgattcaattgtcggcgagtcagatcgctgacatcgcttggaaataggataaaattcgtgttgccatgattgtacggcctgcatcccttcgagtcagacgaacgtggatcgcatcgttcatcctcagaaagtaacaattcaatatccatatattacatcatgttccatggcgcacccagccggccccagctgttccagccnnnnnnnnnnctccatactcattgtcttcgatgggaagggacggttcaatttgtcgacgagtcagatcgctgacatcgcttgaaaataggatagagttcgcgttgccatgattgtacggcctgcatccctttgaggcagacgaacgtggatcgcatcgttcatcctcagaatgtaacaatttgattcatatattacatcatgttccatgtcgcacccagccggccccagctgttccagccaaagctttgagaggctggcacctggttggctgctgcaccccagcttcatgtcgcgcgaggcggacaaacccgatgccgacactaaagatgcttggcaccttgacggcatccagactttacccacgcgattatcataaatccaatcgcatttccatcaacgatgtcgtcggcacgcactgttgttctcctgatcctcgcggtggcgttgccggcatgccttgcgatgcctcgcttcattaaggacgatctgtccgtccaggggatccagacgcagcccgatttctgcgggtgggcgcattgcttgatgggtggagtggatcaggttgctagggaccatgcgcgtctgttgcagggtatgtggaatcttccccagcttcagattctcgcgtcgctttacacctttagttcaatcaacgaggtgatggtcaaatccatgttggcgatacttatattatttattgcagagactccgagtgcccccccttnnnnnnnnnncacacctttagttcaaacaacgaggtgatggtcaaatacatgctggcgatacttatattacttattgcagagactccgagtgcccccccttcaagctggtgaaagagactgataactacgaagtgcgaacatacgacgagggtaagagtcnnnnnnnnnnnnnnnnnnnnnnnnnnnnnnnnnnnnnnnnnnnnnnnnnngtttcccacgccaatggctcctcaacacaaacacacagagaagtgggtcatcaccaatgtgactgactcgttctacaccgtagcctaccccaaggccacgacggtgagcaatcagtgtgtagttgcatgccttctgtgacccaattgggttggaagaatgtatccttgttgtgctggcaacagaccgcgtctatctaggtcctcttacctcacaactcaaaccctcctccttgtccgttgcagcgcctgctcaagtacttcaagggtcagaatgacaagggcacgcacctgaacatcaccacccccaccgtgtcatacctcgagttggatgatgacagaaagggcaccaagaaggcatacacctttggatggttcatctctcgccacatcgaggtagggagttcggttataatccgcacctgagtcatcgagaatgcatttcctcctgctactgtacgcaccagagagtatcaagctgcatctgtgttgccgccgnnnnnnnnnntttataagctgcacctgagtcgtcgagaatacattttctcctgctactgtatgcaccagtgagtatcaagctgcatctgtgttgccgccgactgacattttccacccctttattttggtgcaggagatccctaagcccacggaccctgagctcgagattgtgacctaccccgagacgacccgctacgtcnnnnnnnnnngattcggtgcaggagatccctaagcccactgaccctgagctcgagatcgtgacctaccccgagacgacccgctacgtcagggtcttcggtggctacgcctcagagggtgagggcatccttgccttggacagatttggggatggcacggtgactatcataccttcaaagcatggatctggctgcaactatcaaattccagccgcaaactacctcacaggaaacattgtggagcaggctgtggcgctccaggatgtgctgagcaaggaggggaagtctttcgagcccaaggcacggaatgggaagggctctttggttgcgctgttgggctcatttggttatgattggtttgggagatatcgtttcatgcacaccttcaccctgctacccatttcacctgtggcgcagggactgctnnnnnnnnnngggttattattggtttggtagatatcgtttaatgcacaccttcaccctgcgacccatttcacctgtggcgcagggactgctggcggctgtgtatgatgcgcctcaaaagctcctgaaccgtcacaatgaggtccacctgtttgccaccgacaatgacgcccttgtgtctgcctgaagagtgcttgaacctttgatcttgtgaccggcacactgttcatttctacgagtgtgaagatcttgctcgtcatgtctcggatttgggatcacaggtcacaaacttacgtaatgtgtaccaaaccctttcaacactctgtgtcgagggtacaaggcctgataatgcagcgcgtctcagcgcaatgcgactacacaatatgttcattaattgaagccagcgtcttccttgtcccgcagtatccacctaggcagaataggggagagtcctccgagactggacacgatggcctccgcattccagtcctgccttgcgctgctgcagttgcaggtgtacagggagacgctggaattacaaccgaatgtcgacgaaaaaggaatcgacgacgaagccgacttccagtgagcaagggatggaagacccgcacggaatcttgatttgagggggggggggcacaggtttcagtaggaagggaatgggattatgcagaagatctcgacctgatcagagcgacacatgccgacaagctcatccaacagacaagcagaggacttatcaaagggcgccatcctaaaggccaccttgaacgagggatcgggagaggtacctgccacaaacgatctggtaaggggattctgcaaagggcatgatgacaacgtctcgctgtnnnnnnnnnngacgagggatcgggagaggtacctgcgacaaacgatctggtaaggggataccgcaaagggcatgatgacaacgtctcgctgtgcaggcagcttcgtacccgcccaccaacccacccgacccacccatacaggtcttcctgcatctccggatcggcaaggggaactcatacctcacaagcaccaggcccgaggatgggggacagggccacccccagccattcatcctcggcaagtctaagaacctgctgaagggcctggaactggcagtgcgaggtgagctggcaggggcaaggggtgctggggcgatgaggtcttgagcgagtcgagcatgcacatgcaaagactgctgctctgccgaccggactgagtgtgcccnnnnnnnnnnaggtgctggggcgacgaggtcttgagcgaatcgagcatgcacatgcaaagacggctgctctgccgaccggactgagtgtgcccgccagcgagacccgcgtaggcatgcggcggggggagcgagctgtgctggacatccagccaggctatgcctatcagcacaggacctgggtgctcgatatacctcctgggcttcgtaagggggacaccatccacgcggaggtggaggtgagcatgggaggtggaggtgaaggcttggaggtggaggtgaggggactgaggttagatctggcaagtcgaagtggagggtgtgatttacagcactcactctccccttgcagctggtggaggtggtgccgggcaggacagtgcgagcagtgctggcagccgaggatacatttaaggtcacggagcaggcggggagggactttgagaccccccgggctccttataaggtgtgcatggcgggaggggcgccgggaggtcttgggaaggggggggtcgtgcctaggagaaggggagagaagagagatagattggagttaggtgttccacctccccccccccaaccccataatcatccatcttgcacaggtcaagctccacctcagggcttccactccctccagcgacgacagacctctgggtgccagtcaaacttacttcacgatgcaaagtgggacgcccctggaggctacgctcggctctgggcagcttcccccaggtgaagcagtcaggggaatgggggggggggtgctgccggcgtctggacaatgctgtgtgcgtctggacaagtggcaaacctcaacctcatgnnnnnnnnnnaaatggggggggggtgctgccggcatctggacaatgctgtgtgcatctggacaagtggcaaacctcaacctcatgcctgagcgatccctcattcacacaaatgactccaggccttgacgctgctctgcactccatggtgcgaggcgagcggagcattgtcacctgcccgcacgaggcagcctcgggggggaccctggtgccggaccctgacgcgagtgggagcggccgcgcagagtttgccatcgagctgctcgacttcacccaggtgcaggctgggggtcgcgacacttgctgcaagttcgattgctgtgcagctggatttcagtttcccccacccccactggccaatcctcaggtccgggacctgactgggagcggggagctggtcaagacgatcatgcaacagggcgagggtgtgttcccggtagactgcccggtggaagacagcctcatccaggcccactggcggtatgttattgggggtttccatctctgggctgcggtgcgatgccagcagtgtgcaccccaccgagtcagccatgctcacgcccacctcccgtctgactcagtgtgaggaggcagggcacgggggaggcttgggtgtttgatacccgctccgcaagcgatgcgcagaggcccatcgagtttgacaccgggatggccactgtgccagacgtaagccaaccacgcaattgtgatagggatgagggtgttggtggcggacaggaccattaatcgtgactgccatgcacggtttactcaacccctgggagcccaggtgcaacaactccgctcccccttgcttgttcccaggcggtggacatggcggtgcgattgatgttggagggtgaggtcgcgctcgtgacgtccagctggcgatatgcataccagggtcgtgccgatgcgcctcaggttcgtggctggtgctatgttttggaagagcatcctgcacagtggggcagcaaccaggcaatgctcttgaaccccagcctgaaggtctcgtgtccttcctttggactcccaaggctacggctgacgccacctactttggctgctgcagggagtcaccgagggggacaccctggagttcgaggtggagctggtgcactttgagcgggaccagatccgggaggacaccacgactgccggccggctgacggtggcctccaagtggaaggaccagggcaatatgctcttcaggagggtgggtaggatgctcactgctgggggatgagggaggggagagagggatggtgggaccagactggcaggctcatgccctcggcgtgcctccagccactcgtgggtcccagtgtgcaccttcccagtactttttaggagcttcttaagctggccaaagccaagtacctcaaggcatccaaggtcgtggaacggattgtggattatgcagacgaccagacctatgagcagagccagacgttgcaggcaagcacggctcggggagattttgtctgctgatcggtcatggccccgcccttgtgccttgtgcccacccacccaatgcctgccactttcatctaccctggcaggtctcctgctatctcaacctggcgctgtgtgcaacaaagcagcgggaggcagcggaggccattcactactgcaacaaggccctggagtgagtggccgggggcagagcaaccggtcatctctgccttctggatgcacacactcttcctctaatacaccagcgtggcatgctgagaagggagggcataaaacctcacctccctattctcatcctttgaccggccaccgttctcatcgctcacacgcccatgccctggcgaggtctctccattttccgcccctctacccctacagggtggacccagcatgtgccaaggcgctgttccgccgagctgcggccctggcactggtgggggagtacgcatcggcccgcgaggacctgcaggccgccgtcaacattgacgcctcccttgagccggacgccaagagggaaacagcgcggctggcctcgcaggaaaaggcccaggccgccaagcagcgcaagggctttggcaggttcttcaagtgagccttctttgctcgctcgacgcgcaggcatgcacaaggatcgggtctcctgctcccactcatggccagtcgacttgatgggaaccgcgcccgccagcggctggagctccctcaagacgatcctccccagcatcacatcgtgaagaaggatatggcttccttgagcgcctccacaaacacatcaacctcgtgctttgtgttgtaaaggtagggcgcggcccgcaccgaggcggagatgcccagttctcgatgcagcggctgggtgcacatgtggccggagcgtaccgccacaccagactggtccaggatggtggagatgtcggtggggtggatgccatccacgttgaaggaagccagcgctgcccgccccacgccctcttcgggcccgggcccatagatccggaccccgggaacagcctgcagctgcagagggtggacagatgcagagcggtgggattctggagtgcatatgtnnnnnnnnnnctccacgttgaaggacgccagcgctgcccgccccatgccctcttcgggcccgggcccgtagatccggaccccgggaacagcccgcagctgcagaggggtggacagatacagagcggtgggattctggagtgcatatgtcagcacatgagggaatgccacgtgccgagtccatgtatcaatatgaagagacaagagaacgcccacccacccatttctcctagaagcctgcgccgccgcccgccccccttc

SEQ ID NO: 39831 - DNA, 61 bp, Chlorella protothecoides
gtggctcaggagtctccggaagcgtcgggggggcgcctcttccgcaaggccgcctcgcaga

SEQ ID NO: 39832 - DNA, 76 bp, Chlorella protothecoides
ccgcgacgccctttccaacccaggtatgtatttgtttttttgggggggagggggttgattctgctgcctgcctggt

SEQ ID NO: 39833 - DNA, 61 bp, Chlorella protothecoides
tcaaatgctcaaggccggagcccctctcttcaaaaatttgagcatgctttgggtcatggct

SEQ ID NO: 39834 - DNA, 85 bp, Chlorella protothecoides
cttggcatgctggtagtccagcgaagcagcggtggccgggtcagacggggtgtcagggggattgaagggcctggcccatgcgatc

SEQ ID NO: 39835 - DNA, 61 bp, Chlorella protothecoides
gacacaatgcagctgagatcaggccgaatggccccgaatccagaaagtagtccctcctggc

SEQ ID NO: 39836 - DNA, 16410 bp, Chlorella protothecoides
  modified_base (495)..(504): a, c, t, g, unknown or other
  modified_base (898)..(932): a, c, t, g, unknown or other
  modified_base (1127)..(1136): a, c, t, g, unknown or other
  modified_base (1195)..(1204): a, c, t, g, unknown or other
  modified_base (1263)..(1417): a, c, t, g, unknown or other
  modified_base (1828)..(1837): a, c, t, g, unknown or other
  modified_base (2911)..(2920): a, c, t, g, unknown or other
  modified_base (4254)..(4263): a, c, t, g, unknown or other
  modified_base (5147)..(5156): a, c, t, g, unknown or other
  modified_base (6081)..(6090): a, c, t, g, unknown or other
  modified_base (6793)..(6802): a, c, t, g, unknown or other
  modified_base (7004)..(7013): a, c, t, g, unknown or other
  modified_base (7246)..(7255): a, c, t, g, unknown or other
  modified_base (7759)..(7768): a, c, t, g, unknown or other
  modified_base (8164)..(8173): a, c, t, g, unknown or other
  modified_base (8547)..(8556): a, c, t, g, unknown or other
  modified_base (9049)..(9058): a, c, t, g, unknown or other
  modified_base (9617)..(9626): a, c, t, g, unknown or other
  modified_base (10807)..(10953): a, c, t, g, unknown or other
  modified_base (11013)..(11022): a, c, t, g, unknown or other
  modified_base (11082)..(11091): a, c, t, g, unknown or other
  modified_base (11298)..(11309): a, c, t, g, unknown or other
  modified_base (11890)..(11899): a, c, t, g, unknown or other
  modified_base (12046)..(12055): a, c, t, g, unknown or other
  modified_base (12131)..(12140): a, c, t, g, unknown or other
  modified_base (12584)..(12655): a, c, t, g, unknown or other
  modified_base (14054)..(14063): a, c, t, g, unknown or other
  modified_base (14217)..(14226): a, c, t, g, unknown or other
  modified_base (14891)..(14900): a, c, t, g, unknown or other
  modified_base (15536)..(15545): a, c, t, g, unknown or other
  modified_base (15760)..(15792): a, c, t, g, unknown or other
  modified_base (16018)..(16027): a, c, t, g, unknown or other
  modified_base (16091)..(16330): a, c, t, g, unknown or other
cgcctcgacgcgggcgacgcgggcgtgcaggcgcggctgcgccgcgcggcgcgggcggccaaggtccgcctgtcctcctgccccgcggtggacgtcgccgtgccaggggtggaggggcgcttccgcctcaccacccaggccttcgacagcatgacccggcacctgtaccgccgtgcgcgcgagacgctggacaaggcctgctggcaggtgagggaggagctgttgggggggggggaccaggggaatggacggtcggaagtcacggatggcgaccccaggggtatgggagcattgctgaggtgtaacgatcgaatgggctcgctggacgggcggcggggtttcacgcatgctcgcaccttggctgagaaacaatggaaagcctcgcggaattgtacgtacttgttgcaaccgccaggcgtcgcggctttgcccctcaaaactttcctaccccctgctccaccccactcaatccaatcaggccggcttcgatctggnnnnnnnnnnggcctcgcggaatggtacgcagttgttgcccccgcaaggcgccgcggggttgcccctcaaaacttgcctaccacctgctccaccccgctcaatccaatcaggccggcttcgatctggaggaggtgcgcagcgcggcgcagcacgcgcagcgcaagccgcgacggggcgggcgggcagggcaggcgggcggggcggggctgcagcccaggggggcgcacgcgcccgtgacccaggtgctgctggtgggaggggccacacgcatgacgggcctgcgccgcttcgtgaagaacatgaccgggctggaggcggaggagcaggctgtagacccagacctggtgcgccgcaaggaggcagggtaacctgggatcgtgattgttgtgtgcgtgcgtgtcannnnnnnnnnnnnnnnnnnnnnnnnnnnnnnnnnngtgctcttctccctttcccctcacaaatacacaggccgtggccgccggcgctgccatctgtgctggcatgagggacgggagcatgggggatctcatggtgatggacgtatggcaggcggccctcatgcgggctttggccgcaaagaacgtgctgtaatagggcattggaaaccttcatcggcagacgtacatccnnnnnnnnnnttgccctctcatgttgcatgtgtcctgcgtgtgggcatgggacactgtaccaactgcannnnnnnnnnctgccccctcatgtggcatgtgtcctgtgtgtgggcatgggacactgtaccaactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcaggcagccctcatgcgggcgttggccgcaaagaacgtgctgtagtagggcatttggaaaccttcatcggcagacgtacatcctggtggtcgcttttatgtgggggtaaatgtgtgcaggtacccctacgccgaggaaagcagtgcagtccacgaggctgggggaatcgctgggtgcgggttcagatctttaccggacaacatatagatccgaggagcagatgctccaggggcggaacccagccccacgtggcattgcgggtggggtaggaacccttgatatgaggactcgcgtcggctgcgagcccgtttacagtgtcacgtgtatgacataatggtagtcaccggattggcgccggagtagcgcgaagtggagtgggcaccaccctccgagcatgggctgtcgcnnnnnnnnnnggtatgaaataatggtagtcaccagattggcgccggaatagcgcgaattggagcgggcaccaccctccgagcatgggctgtcgcccgcagaagcatttggccctcctcctgcttcacttctgtatatgccatggtgcgtctccgaggcggtcatcggggggtccagagacatataatggtgatcttatattgaaaggcgccccaaaacccttctgcagccctggttcaagacgtttccgaagagtgcaaggacctcggagacatccttctggacgagcgctgtgcccctcaaattggcctgctcctcaggttgaccgttgcaattggtcttaatgcggcctccggggcttgatcttcattcacgagctcttgccgtcggttacgcggtcgcagccgtagtggaagcctccggagcggctcccctgcacctgatgtgtccgggaagatactctttacagcggctcatgcaagcaacctcaacccccttcccgccactcgcagagactttcctgtttcgtcggatgatcccacgacccagtaccagatcgagcagctaatatataccatggctggcgggcttccgtcctcggggtgaggctgagtggtgtgggaagcagcccgccagcatggatctttaacaagtgggaatgcacaagttctgcagctagttgaatgacaggccacctgctcaatttactgcccttctcttccccatacatgcggcgcagaaggtcctgctgcaacaccaccgacagctttactgaagcggctgtggaatgtccatgcattcccatactgatcgacggggctccagtgcccaacaccaatcccaagggccgttcgaccgtgcttctggcgctggaacagatctgcaacgtcacccttacaccctgcaattgataagcttgtgtctatcttgaggctccctgtgagggttttccactcttcatatctcatccacactcggctaccccctgtgccatcccgatacggtctttccctttgcccttctccgctacgacccaccagtcgtaagaatcttagaagcaccacttccggccctgttgactgaannnnnnnnnnttctcatccacactcagctactccctgtgccatcccgatacggcctttccctttgcccttctccactacgacccaccagtcgtaagaatcttggaagcaccacttccggccctgttgactgaaattatgtacgtcttggaacaaaagccccttctcgtcgaggggggaatgtaggggtacgagtcgtattgcgacacgctttggacgtggaaaggctacggcgagtcccataagaggctgtttcccccgcttggtgtcggaaattcttccacgtgtgtgatgtgagaaaccatactttgggaattcgaggaacagaactcttcccctcgcgagtcatacaaggcggggcgccgcagccatcgagagccgagcaattccatgattggcacagggcgtcgaagcctcctggtgctcgcgctgctggcgattactgccggcgcaagcccccgtgagtgtttccatgaccaagcgggagcattacatgaccctggacccagtttaaggacgccctcatgtcttccatgccctccgtactgcagagacggagcccaacccttgcatcgcgctgggcctgggcttgctcaccgcttgcaattcggaggcgcggtacctcgtgcagtgagtctgggtgggactcctgcatgagctattgtcggattgccacgagatcgtgcgggttgctgtgtggatacgtcgtggatggaaacgccgagcatgagcccctgacccacaccggccctgcaggacctttccattcaatgccgtcgatcccatcaccatggagcaactggacaccttgataggcaactctccgccaggcatacccactgacacgtaatgcggcgatcagaggcgggggaacatgctgcatgccatcgcttcaccaatgtgcctgggtgcagcagtaattgtccccacacaccgccccagcaccaggctggccctcctgcctactctgggccattctttgacccagcgctcgctctctcctccatgccaggtgctgcaacgccaccatcaccttcctggagccgcccacggagtgcaactgcgacccaggcctgctggacctcatccccaccgcgggcgtgaccctgaacggcctggccggcatgctggagtttgtgggcgcgagctgcggctcggagccggtgcagtgcacgtgagccatgcaggccgtgctttgccagcgtcgacgcccggctcccgagccctggggtcgctgcctgccatggagtttggatgctggtgccctgcgcatcggcaggcttgctcccccccccgcaaaggcggcagggcctccattttgtttccgttgagactgtcttcgtaannnnnnnnnncgctttgccagcgtcgacgccctgctcccgagccctggggccgctgcctgccatggaggttgaatgctggtgccctgcgcatcgggaggcttggccccccccccgcaaaggcggcagggcctcaattttgtttccgttgagactgtcttcgtaatcagaaagctccgagcgagccgcggctggaatcgccccccctccccggcccagagcctttcaccatcacccctgcgtcgctgcacgtcgtgccccaccctcatgcatgccatctacctgatgtaccaatgccaaccagggtttgcgggcgatggtacagcatgacagtcagggaggggtaaaactcaggtgccggagaggaataggttggtttggtcgaggcggcgccgccagcccagcgccgcagcgacccccggccaatcacccgccgtcgccagcggcggcctgcgcacgcaggatgcgcgccacgaggtcgtccttcttcccgctggacggcagggcccaggccttgagcagggtctggagctggcgcagcgtccaggcctgcagcgcgaggcggctgaacttggcctccgaaggcgatggcagccccccgacaggtgtcaccgtgctgggttggaagagggggctgcccccgggcgccctcgaggcggagggaccggcgccttccgccccctcgtgggcccgcttggcgccccggccaggcgcgtcgggcccgtcgtccagctggcgcttgcccttgtcagctgcgggtggacagggggagcacgctcatgagagggtcggcaggccccgcaccgcaccgccatgccacaggcgaggcagtagtgccccctgtatggccatgccagcagcacccttccccagcagagcgatggggttgccgacgnnnnnnnnnngagttcggcaggccccgcaccgcacctccatgccacagggaagtcagtagtgccccctgcatggccatgccagcagcacctttccccagcagagcgatggggttgccgacgcacctgctgccttccctccctgcttcctcttcgcctcctcctttcgactctgcagcgcccggaccaggatgctggtgggatccgacttgatcacctgactggcgggcgggtctgtgtcatggctagcgatgtagggcgtggcgggggacaggaaggtagggccgggtttggtccgggtgaagtggcctctgcgcacagggagtgggggtgacgcagctggctggagccaagcaggacagtgcacattgtacacacgtactctatatcactgaagacctgcatgcagctccgcgcaccggctcggcagatccgcgaggaaacccgcgacctgagacatgtgccctgcgaccctccctgaagctagctttctcgcagagcagacgccgcggtgatattagccgagtgaccgaggatcgggggccagctggtttgcaggaagcaggggcgcatgccgtgcattcactgcattgacctctggcttaagaaccctgtcccgctgctgcgcgtgcggcctgaggagcttccgaatacaagtggcgatgggcatcaggaaacgatatcccctagtgtcagggggtccacaaggactccctttgctcgctcacattttgtggagtagggatctcaccatcgagggcgatgagtcctcgcaagcacagcaggcccctgagaatagccttctgccacccagatctggggctcggaggtgagataatcccgacatgtttggaatcgagacacccattgtaaacatgaatgcaatgcgggccctatgatgcatttacaggggctgagaggctgatcgtcgatgcgnnnnnnnnnntatgaacgcaatgcgggccctatgatgcatccacaggggctgagaggctgatcgtcgatgcggcgaaagagctggccgccagagggcacatggtaagagcacaaggtgcttgttctcctgggttttgacatgctgctcatgccaagagggctcgataagccaatggcacatttgttgtgcgagaatgtgcagggttcaagtcgggccaaagtctccatccacaggtagagatcagtactgcctactacgacccagcccgcagcttcgaggagaccaggtctggcgcatttgccatcaaggtcaggggcggctggtttcccaggagcctgggcggccgcgccattgcgctgtgcgcctacataaggtgcctgatcatggcggtgtccctctcatggagctgctggaggtgaggtgtgggcggcatggttggggctgggaatgaatgctgctgcagattattcttgaggccagggttctgcagcagctcttcctgcacatgccagaaggaggggaaaggggtgaagggggcgctgaatgaactggggctcacagatgggctctgcgcggcatgccctgttgagttcctctcctctatgagggacccctcctcccctccaaacccaacccatcccctttacttgacggattccctgcagaacggcctcccggcccgacgtcgtgatcgtggaccaggtgtccgtgnnnnnnnnnnccacggattccctgcagagcggcctcccggccagacgtcgtgatcgtggaccaggtgtccgtggcgatccctctcctgcgctggctcctgcgccgccccgtccttttctactgccacttccctgatctgctcctggccgctccgacctcccgtctgcaccgcttctatcgtgcccccctggactggctggagcaggcgaccnnnnnnnnnncgatctgctcctggccgctccaaccacccgtctgcaccgcttctatcgggcccccctggactggctggagcaggcgaccacaggcactgccgacctggtcgtggtgaacagcagattcacacaaggttggtaccaggaaaaggggctttgaaaaatatgggcgaaagcaggcttttgagcatttttcaggtgcggacgttgatggctctccccggcgtgtgccgtggcagttnnnnnnnnnnccaaggtgggtaccaggaaagggggctttaaaattttgggcgaaagcaggcttcggaacatttttcaggtgcggacattggtggctctccccggcgtgtgccgtggcagttgctgctcctttcccacttgcgatggcagtgtaatgaggcagccagggcccttgtgtaccacgatcgacgccgctccagcctatcccactcgcctccttccccctcgacgtccatggaactcggactcgccttcgccaggcatctttgcgcgcaccttcaggcggctgcacgggcgaggcctcgtccccgacgtgctctaccccgcggtggtggtaccatctgatgcgcagctggcggcggcgcgggcggggtggaagcggacgctgccccccgacctggcccgcttcatcgagtccagggacgctgtcttcctctccatcaaccgcttcgagcgaaaaaaggtttgacgagggggtcccgggggggtggccgggggacaagggtgggcgggannnnnnnnnngccagggacgctgtcttcctgtccatcaaccgcttcgagcggaaaaaggtttgacgaggggatcccagggggctgggccgggggacaagggtgggcgggaagtgggcgctcggtttgcagcggcagtggacctgggcttccttgcgcccagtgggcttgctcgtgcggaatggcgaacgcatgcactacctcgccgcccgaaagagcgccaagcgcccccatcccccacccctgccgccaccctgccccctttttgcaaccaacccctccccacccacccatcagaacgtgggcctggccatccgcgccctggcggcggctcaggcccagacttcgcatcgaggagcttcggctgcgaattcctcgctgggtttggttatcgcgggaggccacgannnnnnnnnngcttcgcatcaaggagcttcggctgcgaatcccttgctgggtttggttatcgcgggaggccacgactcgcggctgcgggagaacgtggagcacctggcggagctgcgggcgctggcggcggagctgggtgtggcgggggccgtggctttcctcccctccttcaccgacgcgcagcgcgcggcgctgctggcctccgcgcgcgcggtgctctacacccccactgacgagcacctgggcatcgtgccgctcgaggcggcggcggcggggcgggcggtgctggcctgcgccagcggggggccgctggagacggtggtcgagggcgagaccgggctgctccgcgactcgcggcccgaggtgtgggccgacgcgctgcnnnnnnnnnnactggagacggtggtcaagagcgagacggggctgctccgcgacccgcggcccgaggtgtgggccgacgcgctgcgcgcgctgtgcacgcccggcgcggcggagcgcatgggcgcggcggcgcggcggcgcgccgcgcagtgcttctcccgcgccgccttcggcgagcgcctggaaagcctggtggcccgactggccgcccacggtgcgcagcgagcgggggcggggggcggtggtgccaagacggagtgacatgggacatgctgccgcgcgaggcgcgcgatcaggaacatcgaccagcagagtgacaggcattcgcgtcgtgattttaatggtcacatccgagtttgtgagacagtcctcatcacatggagccggttgctgacagaatggcctgccagagagcgtttgccgccaaaggctcccgagttcctgcaccaccaccccgctgtcctgctcccctgaaatgggtctttcccctgtcctcgatccctnnnnnnnnnntgcgatcaggaacatctcgaccagcagagtgccaggcattcgcgtcgtgattccagtggtcacatccgagtttgtgaaacagtcctcattgcatggagccggttacttgacagaatggcctgccagagaacatttgtcgccaaaggctcccgagttcctgcaccaccaaccccctgtcatgctcccccaaaatgggtctttcccctgtcctcgatccctgcgcccggcccatcctcttgtcgaatcccaccactcccccctggctgtgtgtcaaagggcatgcttaaagcatggtgggcggcatgtatcggagcattcccctaggcactctagatctcggtctgctcgcgcagacgacggatggtcgatcgcacggtgacggaggcagcagtgctgtgggggggggatgggacatgcaggttagaatactgaagagagctgcggagagcaggcagaccctgtgcaccggactgttcctgcaacatcctcacactcacacaccagcaccctcctccaaaccccactccatcccaggctcacttcaggacgtacgctccannnnnnnnnnagggggggtgggacatgcaggttggaatactgaagagagctgcggagatcaggcagaccctgggcaccggactcttcctgcaacatcctcacactcgcacaccagcaaccccctccaacccccactccgtcccaggctcacttcaggacgtacgctccaccagcctggacctgcttgcaggccttgcactcccagatgccgacggcgacgcgcttcacggagaactgtgcgggcgtgtggaaatgagacggggtcacatgccgatggcctcggtcatcaccaccccagaatcacgacagggacgggtgcaagcaggggggcactccagctggtcctcaccttgccgcagaaggagcagaagtacttggagtgctgtgacacctcaatcttcttgatctgcttacgcagactggccccgtaccgggtgccgtacttgccgacgatgccgaccttcttcgtgcgcttcgcctgcaggttcaaggggagggggcgggtcaggtccacacttcacaccgtccgactccagaagacgggggatagcgggactccgccatgttccgccgcgactccgcctggccacgccaggcatcgccctgacggctgcccagcgccaatcctcctagaccccatccagcactttccgagccccggctcaccatcttgacgctccttccgtggggtaaagagggcgaggagggcggaacagcgctgggtagtagcacaccggccccgccttataacattgggacaaggcgatgctgcgcatgctgggtcgtcacaattccgataaccctgcgccttcactgtggtgaatgcacggaccacaccccaacgaacgcgaatcgaggtgcttcttactgcagggaaggcagcatggctggtaccatgtcaaggtgtgcgagtctgggagcctgctgggcgagaaggcgtactcgtgaggttcttggccagcgactcacatccacaatctcactcctgtgcagttttatgggcgggacggcccttctatcttcctcgaacatatcagacaggcattgtttccgatccacagtagcgtgccctcggccgcagcgccagctatgccaagtgggtctgggtgtcgggtatgaacccaggggccggctggatgcttgggtcctggacgcatgcacccctgctaaaccgctgagtacaacgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcatgactcagcgcgtgggcgtcgtttaagcccatgaggttgtggaatttccccaatnnnnnnnnnnctgcatgactcaccgcgtgggcatcgttcaagcccatgaggttgtggaatttccccaatnnnnnnnnnntgcaggggccggctggatgcttgggtcctagacgcatgcgcccctgctaaaccgctgagtacaacgcaatacaccaccctctgcagccacgatcggccctcagtaggaagggcaaggagcagacgctgcagaagctggttcccctgctggagaaaagctctgtgatagtcggactccgatacaaggggctcacggtgaggagaaccnnnnnnnnnnnngttgttcccagcgtggtcgtgcaatcatggagactattgtccatccatataggtgaagcagctgcaggagttcagggctggtctcccagagggctccaagctcatggtttgcaagaacacactcgtgtcagtcgcggccaagcaggtctctggctgggacggtctcactcccattgcaaaggtaggtgccgggtgctggtgaggtggactccgctgccctctgtgcctttctgcctggagatgcgacagtggtgctctcatcctgaggcattctcttctggacagacctcagagcagcatgccctgcttgctgcctgtcagtgagatgcacttcctgtgactcgacatgcactgtctcctgctcaccaaccacagggcgacaacgcctggttcttcatggaggaagagaccatttctcaggcagtcaaggcatatatcgactttgagaagaagctaaaggaggcgctgccccgtgaggccaggaaggaggcccggcccatcgacgtctcgggtgaggtggggtgccatgtctgattccggctcagtcgcctttccgatgcacttcactctcctcgccctgnnnnnnnnnntggtgccatgtctgattccgcctcactcgcttttccgatgcacttcactctcctcgccctgaccacttgcgccctgtactggtccatgcggtctgcttgcccactcgccgccaccattccccccgcgcccccccctccccacccccnnnnnnnnnnccgcatcctttgccttcctctgccacaggcggcgtgatcgagggtcaggacatcgactacctggccttcaagtccnnnnnnnnnnaaataacaacactcactccaccgcatcttttgccttcctctgccacaggcggcgtgattgagggacaggacatcgactacctggccttcaagtccatggagaagatgcccagccgccaggagcttatggccaccatcgcgcggctgatcaatggcgtgcctaccaagctggcgcgctccatcaaggcggtgcccaccaagctggccatcagcatcaaggccctggccgacgccgatgaggacaagtcgcagcgtgtgggcgacgtgctcccccgccagccccccactgaggcggcggtgtaggcgtgaggcggcctggtcatgatgcggggtgcttgttggatttgatgggtgaatctccgtctgtcaaaccgagaggctccatgaagcagagaacgggtgttgccgaggtatcgggagggcaacttcaagtgggatgcccaannnnnnnnnnnnnnnnnnnnnnnnnnnnnnnnnnnnnnnnnnnnnnnnnnnnnnnnnnnnnnnnnnnnnnnnatagcagggaatggtgaggagagcgagcactgaaggggcagtatacaaggccatccgacaaacatgtgtcacgcgtccgcggcgtcgtcgagcgcggcgtccatctgcaatcgccgcttcttcaggaagcgcacgtccccgctgtccatgcccgctggcgcggggccaccggcctccgccgccggcgtcgcctcccgctccccgcccggccgtttggcgctggccgccgccgccgccatgcgcacgcccgccctccccggcttgggcagccgctcctgcggcgtgggggcggggtccacgcggaagtagcggtgccggagcgcatcggcggcgctgatgcgctgcgccggggcgaggcttaccatgcgcgacagcaggtccagggcgtcgtcgggggcctgggtggcgggaggaagtggggcagatgagaggcgggaccagggcgtgggctggtcatgattctaatcgaatgaacatgcacccgggaatgacgtgggaaagggcggagcggaagcgtggggatggacattgaggttaggagcatgcacacaccacccctctccaccgccgctgctgtatctggcgggcctcacgattccacgtcacccatctccttgccacccctgcacacacctccagcacccgcttctccctctcccaaccccccgatccccagctcaccaccgccacgttgggaaacagggagcgcaggggcggcgccggggtgggctggaactccacgaaggccggcatggcacgcagccccccccagttcgcatcgcgtggcgtccccagggcggtgaagatcttgttcagcacgcccacgtcgctctcggcggagaaccaggggcggcgcaggaggagctccgcgaagatgcagcccgcggcccacacgtccacgcccggtccgtagcaggtgctgccatagaggagctccggcgcgcggtaccagcgcgcgaagacctggtgggtgaaggggcggtcgggggagccgtagggacgagccaggccaaagtcggccagcttgagcgcgcccgaggaagccagcaggaagttgtcgggcttgacgtcgcggtgcaccacccagcgcgcgtggcagtgggccagccccgccaggaccatgcgcaggtaggccttgacgtctgcgccggtgagcaggacggcgcggtcgcggatgacgcgctccaggtcggtctccatgtactcgaagacgagggcgatgccgcggcgggagggccagacatccagcaggcgcacgatgttggggtggtgcagctcccgcagcagcttcacctcccgcagcgccgtcacgttcaccccctgtgattggagagggggggggagaggggggaggatcatcgtcactgagggtgggagacagaagaggcggccaggcatnnnnnnnnnnagtggggaagatcatcgtcactaggggtgggagacagaagaggcggccaggcatgcgggcagggagggcacaagcggacgcaaagtgagagcttgatcacgatccggagccggagcaggggtacgggcatcagggcatcaggtccactgcaaannnnnnnnnnagatccggagctggagcaggggtgcgggcatcagggcatcaggtccactgcaaaactagagctgcctcgaggaaagcatacagcaacaccccagcacgcccgcacctcgcccttctcgcccacgcgtatcttcttgatggccaccaactcccccgtctgcagtgggagcgcgtacatcccgggcattggtggagagacccgtgcatctggtctgtcgaaggcagtgtgcgatatcaagagcatggcggtcagaatgctcccccaaccctgttccaggtgctgcctcacctccttgtgtgtcccctgcaagacctcgccgaaagtacccttccccagcaagggaccttttgtgtaattttccatggcgccagaggctcccggccgcgcctgtattgcagcggggatcggcagatcctagccttgtcgagcggggcacaggagtgagaggcaggctgtcctgcccgagcaaggccgggacgcagcgcgtcgatcagggagcatgtggactctttgatacccttcacattgacagcattaatgcggatgaatgtcagggatgctcacttaagctccaatgcagcactatcacccggtgagatatgccaggtcgcgcccagacctggcaacaggggacttcgaacatccgagacctcaatgagacccgnnnnnnnnnngtaatgcggatgaatgtcaggaatgctcacttaagctcgaatgcagcactatcacccggtgagatatgcgaggtcgcgcccagacctggcaacaggggagttcgaacatccgagacctcaatgagacccgatcgcacgcaccctcgacccacaacgccatggaattcccttggagtgcgacctgagtcgatcatgcaggttgcatggagacatgccctcctcttgctgtccctgctggctgtcgtcggcatgaccaggggagccgggcccgtgatgtattgtaactacacatccccctgcacgccctgcatcacccgagccttcccgtcctgcaaggagaccggttttatcagggtgagatgctcccactggcgatttccaggatccatcgatccctggtcgcacaccctcagagccgcatggacctggtgaggaccttttttgaacccccctccaactcaagcccttcgcaggaatcccagtgcatcctctcagccaaggcgctggcctgcgactacatgaccgcgctggggagcggccagaccagcgacgaggagcagacccaggcctgcacccctcgcctccgcctctcgctgcccgcctttgagctgtgcatgctggccgtcctgggcgccnnnnnnnnnngtgagcgcgctgggaagcggccagaccagcgacgaggagcagactcaggcctgcaccccccgcctccgcctctcgctgcccgccttcgagctgtgcatgctggccgtcctgggcgcctgcattctgttcatccgcgcgcgaacgaggatttgattctgaagtacatgcacggcagcaactttcaggaggacacacagtggagatttcgcttatannnnnnnnnnnnnnnnnnnnnnnnnnnnnnnnnctttgaccgccgcgccgacgcacgcttggccgcggcctccaccacgttgaccttctgcagagcggcaattgggcgtgtggaccgagttgggtcacacctgacgagcacagcacttgagatatcttctactgtgcaggctcctgaacctcgaaggtgtggctctcactcaacctgcagactcccccttgcccaccatccttcgttgccgctcgtctccgcctccggnnnnnnnnnnactggtgaggacctttcttgaaccccctccaattcaagcccttcgcaggaatcccagtgcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaggggaggggggtgaatccacgcacagagaagggagggtccccttagcccacctcgcgccccgctcaagcggtgac

SEQ ID NO: 39837 - DNA, 6706 bp, Chlorella protothecoides
  modified_base (265)..(274): a, c, t, g, unknown or other
  modified_base (819)..(828): a, c, t, g, unknown or other
  modified_base (1721)..(1730): a, c, t, g, unknown or other
  modified_base (1786)..(1993): a, c, t, g, unknown or other
  modified_base (2066)..(2083): a, c, t, g, unknown or other
  modified_base (2261)..(2270): a, c, t, g, unknown or other
  modified_base (2729)..(2814): a, c, t, g, unknown or other
  modified_base (2871)..(2880): a, c, t, g, unknown or other
  modified_base (2937)..(2946): a, c, t, g, unknown or other
  modified_base (3126)..(3167): a, c, t, g, unknown or other
  modified_base (3868)..(3877): a, c, t, g, unknown or other
  modified_base (4128)..(4137): a, c, t, g, unknown or other
  modified_base (4936)..(4945): a, c, t, g, unknown or other
  modified_base (5439)..(5448): a, c, t, g, unknown or other
  modified_base (5717)..(5726): a, c, t, g, unknown or other
  modified_base (6032)..(6041): a, c, t, g, unknown or other
gccggcgcgaggggcgccccggagcgggctccccacgacgggcctgcgccggcgaggccggggcagggcgcggtggctggccacgcgggcccccacccggtgcaggagggggacgcgccgcacgcccccggaggccgcagcagcgggtgagttggctgcgccgcggtcttgcctggcctggcgtgccccgaccttgtggcagaggtgcaggcgtggatgctgcaaggctgatgctctcgctcctctcctcaccctctccgtgtcnnnnnnnnnntgccccagtgcaggacggggacgcgccgcacgcccccggagggcgcagcagcgggtgagtgggctgcaccgcggtcttgcctgacctggcgtgctccgaccttgtggcagaggtgcaggggtggatgctgcaaggctgatggtctcgctcctctcctcaccctctccgtgtcccactcgttcccttcctgaccaggcctgcttggggcggccgagggggccggggccgtggaccccggggaggtcgggggtttgacggtgcgggccgtggcggcgcccacagcagcactgcccctgctcaggtggggcggggaagtgggcctgctccatggtatcgggtggaatgggaacaatctgtggactcggtacttggtgcattcattgtgtggcatcaggatcgcgcacaggcagtcagccttgacttccaaccccctcgccgtcccatccccccctcccatcccaggctgcccccgctgcgggcccccctgggaagcaggtggtgaccgagaaggtaatcgtcaccaaggtgcagaacaagtttgccannnnnnnnnngattgtgtggcgtcaagatcgcgcacaggcagtcagccttgacttcagccccctcgccgtcccatcccaggctgcccccgctgcgggcctccctgggaagcaggtggtgaccgagaaggtggtcgtcaccaaggtgcagaacaagtttgccatgctgaacgtggatgacaagtgacgtgtgcccaatgctcctcctgtgacgatgacactcaaagggcgagttctcgggaggtcagaggtgggcggcgtgagggaatcgggcggaagacagcttaaactctggagaaagacgctatggattccctcgtctcccattcagctccggatctcctcgcgcgcgcgcgcctatcggggcccctcagacatgcatgggtggggcacatgcgacattgcgagacagaggaacacggcggtatcagcctcggaggactgcaaggattgcatgtaaattgaagccgagccggctccttgcctgcgaagaccttaagccccgacggtccaagtgctgcccaggtggccgacgggacacccaccgatcagactgagatcacgtcgcattgcctccctctacaggactatagtacccttgacggaatctaccaatggattccaacgccctgtggttgccgcccgccaaggaggcggagtggcaggcctccctgcgctccacccctgcattcaccctgaccgccctgctcagcttctgggctctccactccgtgctccccagactgatgggcaggaggctcgctggactccccgcctccaccaagctcagatggcagcaccagtgcgctatgttttgagccctgactgtcgggcatgggttgtggtattggagggttgcgcaagtggacccccctggtccagcccctggccgcccctcttgggcnnnnnnnnnnaagccagaggaacacggcggtgttggcctcggaggactgcaaggattgcatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctacagatggattctaacgccctgtggctgccgcccgcccaggaggcggagtggcaggcctccctgcgctnnnnnnnnnnnnnnnnnngtgttttgagccctgactgtcggggcatgggttgtggtactggagggttgcgtaagtggaaccccatggtccagcccctggccgcccctcttgggcatatctagcctgtgggcacacccgcccgagcgtccaaagccgtgtttcaagccaccatccctctgtcccgcaggattgcatnnnnnnnnnnggggcacacccgcccgagcgtccaaagccgtttttaaaaccaccatccctctgtcccgcaggattgcatgctgcgtgcatgccgggctgtccatcgccgcggccctgggctcgctgctcgcccgctactacgacgatagctccgaggctggcctcttcactgctgatgccaggctcagcgctgtgaccgacgcacacgccggcttcctgctctacggcctcatcatgtacacgaggcacgcgggagtggtggctcccccctttccttttgtcttgctgcagcatgccgccctcctggcttgctgggccatggccaaggtgagctcgaggaagggagggtggtgggaagctctaggagctgccaggcgccgctgtgatgtggtagaaaacccgtaaaataccagctcatggtcttggggtgcttgacattaggttgggcggggcagtgagtgtcgctggnnnnnnnnnnnnnnnnnnnnnnnnnnnnnnnnnnnnnnnnnnnnnnnnnnnnnnnnnnnnnnnnnnnnnnnnnnnnnnnnnnnnnnagcgccatcgagtgctcaaccccccaccaccaaccggcccgtaggtcttcccctgcnnnnnnnnnnggcgccaccgagtgcttgacccccccccaccaaccggcccgtaggtcttcccctgcnnnnnnnnnnaggagggtggtaggaagctctaagagctgccaggcgccgctgtaatgtggtagaaaacccgtaaattaccagctcatggtcttggggtgcttgacaataggttgggcggggcagtgagtgtcgctggcaacccttggaaccctagcttgcctacccatgcacacgcttggccgccagtgnnnnnnnnnnnnnnnnnnnnnnnnnnnnnnnnnnnnnnnnnnagcctgacgtacgtgctcctgccctaccaccagctgggtgccgtggctgcgctggcgcacgcctggcgcgccgtggccgtcatgcgtggaaccggaaagcgcgcgcacctggggcgcctgcgcgtggagctgggcgctctggcgctgcgggtggccctggcggcggcggccgccttcagggcctgggcctggctccgaggccggccgctctggacgctgctggaggccacgcctgacgtcgcggcggcgggcagggtttacgcgaccctggtgctggcgagcagtgcgctgctggtgctcgtctacgtgtcctggatgcagaacgtgagtggtttggtgcctgcacgatggggcccctgatggctctcaggtcttgcttgatggtgagaccaggggacgctcccgagatgctcacactgtcctgctgccatcctaccaccaaacgcccaggtcctcttccaaatggccaatgtgccgatcataaaggcaagcgggggtggggaccgcgccgccgacacggctgggcatacgacacgcaggaaggccaaggctacgccatcggggtcggcaaaaaagcggcgccagagctgagcagctgcttcagccctgatctcgagtcaaagcgctgcctgcatctcatgataggcgattttggcccggagttcgcggatttcttcgtgtttcaatgcatccttccatgnnnnnnnnnnagaaggccaaggctacgccgtcggggtcggcgaaaaagcggcgccagagctgagcatctgcttcagccctgatctcgagtcgaagcgctgcctgcatctcatgataggcggttttggctcggaattcgcgggtttcttcgtgtttcaatgcatccttccatgtgaacatgttacctgaagctaatccacattccatgctctgggtgctgcgccatagacgtctcaccctgttcggtgagagcagtgattgnnnnnnnnnnccatgtcacctgaagccaatccacactccatgctctgggtgctgcgccatagacatctcaccctgttcggtgagagcagtgattgcgacaatgcatgtccgctccgcgatggcgaatgatgccatcatcaaacaccggcgcgcagcatgaacgtgtgtatcgacagtgtgtagttggatattcctctggaacggcgccaccccctcgcgggtctctactaccgacaccgggcatccggccatgcagagcaccatgagtgtctgcatgcagcacagcatcccattccgacaatgcgaaacgcatgcattcacatccatgcacccacaacgtgcacggctgaggacttcaactgcggctgttgctcgcagggtctcgcggtgtaccccagcaggcttgatggtgaaggctacctaccctgagccagagacagagaaggagaggtcacctatcgacttcccacaagtaggcgcagggtgtctgacgggtggtgtgctggttgatggcgcctggagagcttggtgttggagggcaaccctgcatgggcaaccaatcctatgtctccgacatccaggaatggctgactccccagcccagtcgtcggcccgacatcttccccgagtttgagaaggtaagtccataccactgggtgcgaatcacttgcaagaccctgctgcaaagctggatgagcgggtaggggcccggcattgaaccatgggcattggcctttactactaccacttttactgaaggaatgcttcacctcccactgccacagctggacacaccgctgccaaagccnnnnnnnnnntcgctgcaaagcgggatgagggagtaggggcccggcattgaaccatgggtattggccttttgctactaccacttctactgaaggaatgcttcacctcccaccgccacagctggacacaccgctgccaaagccattgccgggtgacccggagctccctgatgaggaggaggaagaggaggtaaggccgggtgatgcatgctcatggcattggtttatttgcttgcagagcggtacattggtctcgctctgtatctcttactccaacatatgcaatgcatggcttgctcgcagaagaagaaaaaccccaagaaggacccagatgaggaggacccagagaaggagaagcctgagcccagccaaccggacgagtgattctcatgctctagatgtggttgctggccagcttgttaatgaggcgagtgttgtgagtcacatctgtgtgcagcatgggtagaatttggggagtgggggcgggtgcctcggaagggagaggnnnnnnnnnnccagcatgggcagaatttgggaagtgggggcgggtgcctcggaagggagaggtaaaatgcaaagtcgggccggtggagggatcgagtccggccaagctggatgcgcgtaccttgtgaacggagcgaggtgcattgacaacagatactcgcagcgtcaatccaaggctttcattaaatgattctcgatcattttcagcagtaataagttcagaaaggatcagtccgaggggctgcggctagaatactgggccggggggtgatcgagccgnnnnnnnnnnccaatccaaggctttcattagattattctcgatcactttcagcagtgataagttcagaaaagatcagtccgaggggctgcggccagaatactgggccggggggtgatcgagccggccccggccactgcgcgggggaggttaagctctcgccatgtcctcctcaatatcgagtggaccgtcgagatacggacatggacagagtgtggtacgcgtgtgatcggggcgagtgatgtcgggagatacctgtgcgcgctggccacgatcccactggagcagtgcgcataggcatccgttctctcacccttnnnnnnnnnnggatgtcggggagatacctgtgtgcgctggccacgatccccactggagcggtgcgcataggcatccgttctctcacccttcccacagggcagcaagtgggagcgtctggccgtcctgacagaggagcagcaggctgctgtcgccgctctgggtgccgcctgctcccagcgtccggtccccgacgtggtgcgtgattttctggtgctccaccaagccatgctccatggggtgaggggcaactgcacgactcaggccagcccaatagcaatccccccttccctccccggggtgtcctgcgccggtccaggcccctgcctctggatcccttccccatccgccggcctctgcaggtgctcgccagagaggcggaggggcgtgagcccgcggccccgccgaccccctcctcgccctcctggcccgcctcgccgcgcgccggggtcgacgccgcggcgcccgcccccgcccgcgacgtcgtgctgcagcactcctccgacttctacgcctggctgtcagagctggaggcggcgcgcgggcgcgagaccgccgcccgcttcggcacctaccaggccgagctggcggggcacctggcggcctgcgccggcgtgctggagtcgtgcgaggcgctggcggcggcctgcgccgcgctgggcgcgggccacgccggc

SEQ ID NO: 39838 - DNA, 120 bp, Chlorella protothecoides
gccccctcgcgctctcagcgtccctccctgcacccgattccgatcctgtcccacatacaacaccccccaacacaccctttccccccatcttgaacaggacctgatcctgaggctgctgga

SEQ ID NO: 39839 - DNA, 61 bp, Chlorella protothecoides
cgtcatggggaaaaggacgtggaggggccggctgccatgcggccctgcagcacagttccga

SEQ ID NO: 39840 - DNA, 151 bp, Chlorella protothecoides
gccctccccaggccgccctcccacgctgcgtcgcggcaggcctgcagcgcgcgcgtcgcagcgcccagggccgcggataacaggccggcaacgtccacccgctcgccggcctccgtcagcgcgcggcgggaatgtttcatgtgcgtggtag

SEQ ID NO: 39841 - DNA, 104 bp, Chlorella protothecoides
ctttacgaccccagtcctcctcccctgcagtggcccaggacccccatctcaccatgagaatcatgtgcgtccaggcgtactgcccaaactggtaggtgtacatg

SEQ ID NO: 39842 - DNA, 144 bp, Chlorella protothecoides
atgccggtgctgaggcgggcgacgcacgcggtgagggtgccattgcgccggcccaaagcaggaaggcggggtcgacgcgtggctcggccgcgccgcaccggggcaggcggcaaacccccggtccgatcgcacatccccccaaac

SEQ ID NO: 39843 - DNA, 201 bp, Chlorella protothecoides
gccgtagcgtgtgccctgagcctgcgccgacgccgcgtccctgtgggcctgcgaaccccccccgccatgccccccaatctgggtgctggcgggtcggcgcccagcggggctgggagacctctgctggcgtgcacggctgggactgcgtgacctccgccgccgctcgcggctgggactccgtgacctctgtcgccgctcacg

SEQ ID NO: 39844 - DNA, 108 bp, Chlorella protothecoides
gacagcagggggaccggggccagcaaggagcccagtcccgctcagcagtgtgaaggggcgtctggattgtgcaatccggtagagcagtgggaagcctgcagtgcaggg

SEQ ID NO: 39845 - DNA, 112 bp, Chlorella protothecoides
tcggtgacagtttggaacatgtgcacacgatgaataagaggatcagggaaacacgaggacgagggtctggttcagcctctcagcagggtcaggtcatcaacagaacgcagca

SEQ ID NO: 39846 - DNA, 86 bp, Chlorella protothecoides
atctgtcgccgcagtgcatgctgatgcgaacctgatcattctctgtgtgacggggcattgcggtgtgggctggctgctcccaaact

SEQ ID NO: 39847 - DNA, 12214 bp, Chlorella protothecoides
  modified_base (271)..(280): a, c, t, g, unknown or other
  modified_base (1317)..(1326): a, c, t, g, unknown or other
  modified_base (1731)..(1740): a, c, t, g, unknown or other
  modified_base (2209)..(2218): a, c, t, g, unknown or other
  modified_base (3443)..(3452): a, c, t, g, unknown or other
  modified_base (3655)..(3664): a, c, t, g, unknown or other
  modified_base (3973)..(3982): a, c, t, g, unknown or other
  modified_base (7744)..(7753): a, c, t, g, unknown or other
  modified_base (8222)..(8231): a, c, t, g, unknown or other
  modified_base (9641)..(9650): a, c, t, g, unknown or other
  modified_base (9983)..(9992): a, c, t, g, unknown or other
  modified_base (10534)..(10543): a, c, t, g, unknown or other
  modified_base (10668)..(10677): a, c, t, g, unknown or other
  modified_base (10747)..(10756): a, c, t, g, unknown or other
  modified_base (11736)..(11745): a, c, t, g, unknown or other
  modified_base (12110)..(12126): a, c, t, g, unknown or other
cgggccggccggggctggggccatgagcacgtcggaggggacgtccacataggcgccgccggggcgcccgctcaccgccgcctgcatgcgtggggtggtcgtgtgggatgggagtcggacaggagggaggggcgcggtgtgcgagggatctggggcgccgaaggcaggggcgccctggcctgggcgcccgcgcacccgtctgctctggttggaagcgttctgacttctcactgatctgaccccaaaggccacgtggcccccccatccagannnnnnnnnntcgtctgctctggtcggaagcgtcctgacttctcactgatccgagcccaaaggccacgtggcccccccatccagacccaaccagacccctcctccaaccctcctgtcaccttgaaggcggcctccaggacggcggggatctcgcccaccgcccgcgcctgacccgcaaacttggtgtagggccgcaccgccgccacctggtccagctcctggaaggagcccttgcccacctcgcccgtctcgcaggacccggacagcagcacaaggggccaggtgttgacctgggcatggctgagccccgccagggcgtggatgacgcctggcccggacaccgtcagcaggacgccggggatgccagagaggtagccggcggccgccgccgcgtacccggccgactgctcgttccggaagctgatgaagcggatgcccacggcctgaagatgaggcggagcggatgcgggagtcagggtgcatgggaatgcgtctggcagagcggtggggatggggaccaaccggacccgtcagtgtgaccctgtggtgcggctggcgggagcaaccgcaacagagcctctccgacgagctgtcagaccagagatgttgtcaacttcttgccactgctggcaggcccatctttgagtctcttgtgcagatgctgtgtctcctgtcctccttttccctgctgccacctgcttccccatcgaaccccacttctggaccaagccctgcagagcattgcgcccttttaaaccccccccgcgccttccccctcccccacagacctgcaaggttgacgccagctgcgtcacggggatgccaatcacgccgtacacgaccctgacccctagagccctcaggctcttggctatggtgtagtacccgtcattgggcaaggcatccaggtccagggtcgcccccccaacagcccctgcagcacacagtggaggtggcggggggggggttggctgctgaggggcgggcaaggacgaggcgtgggggtgaggtggggtgccctgcgcagaggatgggatccccttgtannnnnnnnnntggggggtgctgctgaggggcgggcgaggacgaggcgtgggggtgggggggggggggccctgcgcagaggatgggatccccttgcatggactcgtctaggacgagtggcagtgcagagcaccaccgtcacgccatctcaggggctggtcccatctgggtggaggggtgttgaacccctgcccctcccaggttttcgaagctggacctcagacagggtatacaccaaggcagaggcgggagtgaatcgttccatcaagttttagagaatgtgggcctggcccgtgcagcagcgcaccaacagcagccaagggtaggcaggagcgaaaaggcaatggacccagcaaggccggtgcccgactggcttggcgtgcctaaacaaacaaacttggggtgcacgttgctgcnnnnnnnnnntaggcgatggccccagcaaggccggtgcccggctggcctgacgtgcctgaacaaacaaacttggggtgcacgttgctgcccgcctcccctccaatcatgccgacgcaccatccttgggcttgttgatgaatgcgtccaccatgaagcggcgctggatcttgcccgtcgcggtcttgggcagttcgtcggtgatgaagatctgggtggggatctgtgggtaagaggcgggacgagtgcaagggcgtgtgattggggagggggtagcagctttggctaggtgtgtgagtatacattccacccctgacatgctgcctcatggctgaagggtgaggacaggcctgtgtgatgggatcctattggtcgctccacaagattccctttgtgttgccaaggtagccaaggtcctctcaggcacgagcatgcccatcccccccaccaacttgcccccaccaccccggctccaccaatnnnnnnnnnnagacaggcctgtgtgatgggatcctatcggtcgttctacaagattccctttgtgttgccaaggtagccaaggtactctcaggcacaagcatgcccatcccccaaccgacttgcccccaccaccccggctccaccaatcgcttcccgctcaacccaaaccaaaatctgagtaccccgcaccttgaaggcggagaggcgggtgccgacgtggcgcttgatgtcctccaccgccccctcccccaggcgcttgccctcctcattcaggaccacggcagcggccacggtctcgccatacttggcgtctggcgcggcaaaggccacggcctcggccaccccccggtggctcagcagcgcgccgtccacctcgatgggcgagatcttctcgccgccccggttgatcagctccttgatgcgccccgtcagctgcagatagccctctgcatccagccgtccctggtcccccgtgtggaaccagccccccgcaaacgcctcctcgttcgcggcggggttggcgcggtaccccgccgtcacgttgggcccgcggatgcacacctcccccacctcccccgcgggcagcgggtggtggtcgggccccaatatcaccagtgcgacgctaccctgcgcgcggccgaccgtgccggggcggcgcgggccatgctgcggcagcgggttgctcgtcatctgatggctggcctcagtcatggcgtaggcctctaggacgggggcgccgaaggcagcctccaccgcctccagcgtggcgggggccaggctggaggagcaggagcggatgacgcgcagggggggcggcgcggccgtggggaagtcgctctccgcgcgctgcaccagaatctggtggattgtggggacggcggtgtagaaggtgacgccgtgcgccgcggcgtccttccagaaggtccccgccgcgaagcgcccctccgccgggaataccacgctagcgccagcggagagaggggccagccagcctgcgcaagggggggggcagggtgtaggagcttgaagagtagaggttgggggtgtttggcgtgctcgacggactgggcaggggggtggcagagccaggcgaccaagcaagtcctccgcccctgtacccccgccgtcgttgcagggcccgatgcacgctgtgacatgatgggcccccatgtcacggacccgaggacaggagtgaggatgcatcatcattccaccccactcacccgccatcaggnnnnnnnnnntgccgtcgccgcagagaccgatgcacgcctggacatgatgggcccccatgtcacggacctgaggacaggaatgaggatgcatgatcattccaccccactcacccgccatcaggccgtggacatggaacaggggcatggccaggagggagacgtcggcttctgtgaactcgtacgtctgttgagggttgcataggggggggggnnnnnnnnnnggaaagagggcatggggaattgcgatgggccgacactggaccaaactgatttgccagagcactgggcaggtggagccctcatccctggcaccccacacatgcaaatgaactggacgctgccagccagcatgtgggggtgtgctggaatgcaggacccagcttgtgggctgacaggcaggcgatcacatgcccagaccttgggcctgcattctagctcaaccaggtatccttgttagcagacccccggtgccaccaggtgcagcctatgaccccacctggcggatgttctccaggctggcagtcaggttnnnnnnnnnnagaatgcaggccccagcttgtgggctgacaagcaggcgatcacaggcccagaccttgggcctgcattctagctcgaccaggcatccctgtcagcagaccccggtgccaccaggtgcagcccatgaccccaccttgcggatgttctccaggctggcagtcaggttggcgtgggtgaggggtacgcccttggggcgggaggtcgtgccggaggtgtgcaggaagagcgcgacgtcgtctccgcgtggggggtctgccagagcctcgccggcaggggcggttttcagggcaaactccccggcccgagaggcgagctgcaggacgggtgcgccggaggcaaagtccagggtcacgccgatggccggagcgactcctgccgcctccgcccccttgttcccagaggctcccacaaccaccaaggtggagcccgcatcctcctggtagtacttgaactcctcctgcagaggcgagggtggagggggttgaccggctgcagacatggggggcgagccatgcatggtcaggctggctgatgggaggagccacaggaggggtgccagccatgggagcagcaactcttccatgactgcatgacacctttgctggagattgcggccagacggccactcagtcccaggtgcccaagatgcccatggagtgcggcacagcgtccacatacctcgtgatagttctggttcaggggggcggccacagccctggcgagggtcgtgcccaggaacgccactgcaaactcgagctgcacagtaatgaggatgacggaatgtgtggggcatcagggacttcctagtctctgagtgttcctgatcaaggccacctggactggcatgcgccacgagaccccatgcatgggcatgactcatgcatttagcccgaccctgcctcgacgtaccgtgttggagtcgacgatggtgaccagatcgcttggtttcaccccactggcgcgcaggctctgggcaaactgggtggccagctccaaaaactgacccctggtcagcttctgtccgccgctgcccaccacaatggctgggctgtcgggggagccccccaggacatcgagcaaggtagaacccgacatgcgccaggtatcgctatgggtctcgggtgcgggagggaagcttgggagaaacccacaaagatcgctggtaatccgatttgtgtctcacttcgagataggttaattatgttggcaactttgggggatgtcgtaagcgcacgtgcatgtggcatgtaccgtcaaaacccgttctgttgtgtcgccattcacccggtgagtgttctcgcggagccaggcagacgcacaatggaagctgcaggcgatccggctcgcacccccctccccatccccgtgcaacccctcgcttgacgatcgctgctgaggcaatggcacactcacaggctagtcagcgcagaggcgactccaacatgcaagtggagatctccgtccagctcagcggcaggctggcttgcagacaaaagtccctgggtttccttggcagggcaggggacaccacagatcctctacctgttcaggacctccagcagcttctccttcactgcctcgccatatcgggccgacagcacgaagactccaccgaatgcagccaggacgccgatctctgttgacgagacgaggagcgatgggtttgcgagcagtcagccgcagcagggtggcagacgggatccgcatggccagcatgccccacagggcaccagttttgatcccataaccagtgatgttctctggaggggagtctgcatgtgggccttgcattcgaccaaagccaggccaggggcccatcccttcgacacccacccccgacccacgccacccaccagcaagccacaggggcaggatgccgcgccgctttgcgctctgcttctgggcctgggacgcggggccggcgggggtgcccatgccctgcagctttgcggtcgcggccggcacctcggtgagggcggggcgggcggggaccaggggtgccttgggtgccggctggctgcgccctcccccaaaagagaagaaggagttgccggccggagacgcatcctcctcccgggctgcgggggagcgggcggccggcgccgcgcccgcgccactggcccccgcatccccactcccctgggagcccctgcctgccaggccgccatcggcccctacctccagcacccccgacggccgcggctgctggtccacagcctgggcgcccccgccctgctgcggcccctggtcgaacgccatcaggccgctgcctggggacgcgggcatccactcctcatgctctgcgcgcttgggggccgggggggactgcggcccagcacccttgcctgccaggggaagcgacggagtggagggggccgccggcgcaggctgctcgcggggggggtcgggcccttcggcctcggcgtcggcgggcggcgcagtcgccgacgggcctgcgggggcgggcgttccctgcgtcgcctgctgcagggcgggcgcatcgccgcgaccaaacaggccgaagggcagggagggcgcgggaaagtccctgcgggtgcccttgggcacggagggagccttggcgacggcggcctcgtaccgctgtgggggccagagaggaggggacggactttaacgagggacaccttggggccctcgtatcgttcaagccccgtctcgcacgcaggcaactgcagtcccatcagtcgtgtgcccaggtgggccagggccttgtgtgtccagtccaaagggtgcatcaggatcttcagggcaccaggggttggcatggcgggtgctcgactcgccttggcagcatcggagagtgtgctccccagctgactgacgagcggtgagtcagagcccgcgtcggcaccctgcgccatggctgcgctcgatgaggccagaatggcggctgcaaggacaccagcagcggccctgccatctgcctgtggcatcagtgtgttgttggtctcggcagggaagtccgactggcccatgcgagagggtttagcccccaccccatgcactaagcaacatggtagtcacaacccgccagaacctccgacggcaagtgcccaccccctcacaaggtagtgacacgctatgttggcatgtgcacgactcctgatgctcctgggtcgcagagttggggcgcgacgcaggggtgcgcatcccttggaatgggagctcaaggctcgcccattcacgcacgatgcgaccgacaccatcaagctacagatcgctatgagatggctatggtaatgtgattgagaaatgtcgttgggccggtgtagcgtggacctccataccggatctgcaaccccacgcggatatccaatcccttgggtcctcgcgctctgtctgcggacccttgtcgccatgcgccatgaggggctctgaggacagtaatcccaccattcaaaccctcgctgatccacccggaagtcgaacatgacgaagagagtgggaaatttaagtttcactgcgtacatctgtcgcacctcgggcacctcttccttgtatgttgccccagtaaggagtgtgtcgcccagatagggctcagaccgcatcgcacgctgtggagcgcggtgcagaggtaccatgatcacggcgaagcgactggtgtcagctcaacaggccacaaaccgcaggcccaattggtgctcactggaagtgtcgggccgttggaggtcaaggtatcttcctacccacacaacgtcccggcagggcacaccctgaagacaaccagctgctggatcgtaccnnnnnnnnnntcaagtggtgctcaccggaagtgtcgggccgttggaggtcaagatatcttcctacccacacgtcccggcagggcacatcctgaagacaaccagctgctggatcgtaccgtcgttccctgctatccttccggagatcagatcagtgacgacatgccctgccctcggtgggcagctcgtggggaatgttgtcctgtgaccgttgcagggcgcaggcggcacagcagcactccagatcgagcaaattgcaagttctcccctccctcccgatctccacaccatcacaatcagccatgcgtattgctcggctcctgtgtctggatccatcacatgcagcgtaggggttgtgaccggaagagtaggaggacttgtcaagctccagatcatcttcagagatgactcatcctttaccaaacagatacggcgtgacgcatatgtctacgagagcacattcgtggtcgccagcactttnnnnnnnnnntaagctccagatcatctttagagacgactcatcctttaccaaacagatacggcacgccgcatatgtctccgagagcacattcgtggtcgccagcactttgtcacagggagaaatcaccgcatacgttaccttcctggacggcggtaccgctcaatcttcgacgatcgacctaagaccatacccttcccctccaccacccgccttgtcccaaccccctccctctccacccagcactcactttcctcccagcccaccacctgtgacaccgagcacatcggagagtccacaataatcccccacaagcccaatccctggtccgagtacaccccactccagcattccctcaccatcctccagcggccctccccctccccatcctgagacaagcatcccaatcccacccagcaaccgggcccctccacctcccaaagagagcgcccctcctccacctgttgagactccccctcacccaatcaagagcggcccccctcccctatccaagaagagccccccactcttgcccaagaagagtccctcaccctcgcccaagaagaggccccaaccctcgccaaggaagagccaccctccctcgccgaagaagaggcccccgcccccccccaaaaaagtcaccacctccaccagagaagaaatcttcacgccccaagaagtaatccataccagccaaatcgcagctatgtcggatcacttaatggtcctttcgaatgcgtctttgagtcccgtgcaatccttgaggctgagaccctcgagagcgtgccagattcgcttgctgccagtttgccatgagcggttggccgcacagcaggttccagcggatccacaccggtcgtggcccccctgtgggtagactctatccaccggccacgaccctgtgagaatcacaagtccccatttcttgctcctgcactccaaaagactttggtctgtggaatgtctcatcggtactctacagagcactccacccctcccggccatcatcacaaactgaacggttgactctcctccacactgtttcatcccattgtaatggccccatccatccagagacatgcatgcccaggattgtagtccaaagtgggatcagaaagtattacgggtggctattgcagtttgcgtctccgccacatgctatttctcaagcggaatcttgtgagaaagtcgcatggtgcaccggttgaggacgagaaaacggcacaacaccctccctgtgatggatttgtgcccgacctcgccagcagcagtggtacttgttcgtctgttgacttggagaacgcgtccccattctttcccgttgagtgcatgtgcgtggacttgactggacgatattagatcgactttcatccagatctccattgctcgttatatactcgcatctaggagaactgctgggannnnnnnnnnagttgacttgactggacgatatcagatcgactttcatccagatctccatttctcatgatatactcgcatctaggagaactgctgggaggtcctgaatccctagcaagcaaaatggtaacaagaccccctcctcaacctcccatttctgtttacagtcagcacacgagggacaaatgatataatcaacattttccaggggctgcagcgctgtatccgggtctcaaggccccaggctgccgccgccctgattcctccgccatggggaccttagcaacccgatcaagcaataatgtgcatctttgtaccttgaattaacaagtttaggctcgggcnnnnnnnnnnaaatccctaacaagcaaaatggtgacaacacccccctcctcaacctcccatttctattcacagtcagcacacgagggacacatgatattattaacattctccaggggctgcagcgctgtatccgagtctcaaggccccaggctgccgccgccgccttcctaattcctccgccatggggaccttcgcaacccgatcaagcaataatttgcatctttataccttgaattaacaagtttaggctcgggcgaggtcagactggtcgttagtattgccctcggatggccgcacaggcgacgagcacggtgactcccgtggtcgggggtcggcgaccttgaaaccgaacgtcagcacactaggttaagaacttggagtaagatgaagatccagagagggagtaccagcttccagggggcgactttaggctccacaagcgaccgttctccacggcgaagttggtattccaccgagacgagagaaagcagtgcgatttcaccccgtgcttgacaagcgactcccgtatgcactcgctcgcacgcttgtgnnnnnnnnnncttaggtgtcagcgaccttgacgccgaacgtcagcacacaagattaagaagttggagtaaaatgaagatccatagagggagtaccagcttccatggggcgactttaggctccacaagcgaccgtnnnnnnnnnnagagtaagactgactggttcattgttgtgtctgacttgcagtactaggcgaagttgcgtcgtggagacgnnnnnnnnnnggagtaagattgactgcttcattgttgtgtctgactcgaagtactaggcgaagttgcgtcgtggagacgcacacccgcggaagttacaaccttcgagggaggaggccacggagtgagacgcgagaagggttacactctcagggtcagcattcctgatttctccgttggcacagccccatctgcataagaacctcactgtgtgcaccgttgcctccttcggctcggcttcgggtgtccgccgaggacacctgtcctcacacacgtgtgacccctgcggacgccgggcggtctgagcctctgtgccgggagcggagaacacctgctgctcgcccagacttcgagcataaccaatgcaggaccacagcttttgaaccccaagagaaccgcagcgcaccacactgtaggttccgaaacgcttggttctgccaaattaatgacgaattgagaagggaaaggaagccagggatggcgcggcctggagccctcccactgaccctaggcctcatcctcgcgctccttactgcgcagactaattcggtgagttgtgtggtgtgcaacgcgcacatgtaggtgatttcttgtaaaaatgccccaattttcactcaccaaccgcgtcctccaccctccgcgcagcaactcgcgagcgccccctcccccgccgatgcccacaccgtcttggtcgaccatgcatattgctcggatccggtgtctggatccatcacatgcagcgtagcggtcgtgagtggtatgctggcggcccaaatcgagctcgtcatcatcttcaacgacgacacgagatttaccaaagtgatagaacctgactcacccgtctatgagaccacaatagtggttgagagttcccagtcacagggaaacatctttgcattcgcaaccttccaggacggcaccacagtccagtctcccaccgttgacctgacaccttaccctccccctccaccaccctctccaccgttccctcnnnnnnnnnncgagagttcccagtcacggggaaacatctttgcgttcgcaaccttccaggacggcaccacagtcgagtctcccactgttgacctgacaccttacccttcccctccaccaccctctccaccgttccctccccctagccccctttcccctcctcccagcccatcacctatcgcaccgagcccatcggagaagccaccgcccccctccacaagcccccctcctagtccgatgcattccccgcccagcattccctcaccttcacccagcagccctcttcctcctcctcccaaggaaacctccccacccccacctgttgagagtccccctccctcgccatctatgagcccccctcccccacctgttgagnnnnnnnnnnnnnnnnnaaaggaaacctccccacctccaccccagaagagcccccctccctcaccatctgtgagcccccctcccccacctgttgagagtccccct

SEQ ID NO: 39848 - DNA, 61 bp, Chlorella protothecoides
ggtgtgcgccagcacgcccgcgcccacgggttcgatgggccgcagcaggatcatggggtag

SEQ ID NO: 39849 - DNA, 147 bp, Chlorella protothecoides
tgcgtgaaggggccgcggggtggcaggcaggtggaggtgaggctgggcgcgcggcagcgcgctgctcaatgcaggcaccttgccggcaggacagctgcgtggtgtccaccagcctgcacttcctgccctgaggcagctgggctcaag

SEQ ID NO: 39850 - DNA, 103 bp, Chlorella protothecoides
agcccatgtgtctgcgatctggcttgccattgacatccccacgcacaccgaacccctgatcccctcccttttcgtctgcgcagctgtgcaaccacccgctgct

SEQ ID NO: 39851 - DNA, 113 bp, Chlorella protothecoides
gtcccaaaccactggcacccacccatgaccggatctcccgacccacccaccctctcatgcaggcgcttcccgggctgctggcagtcctgctccccagccagacctacctgcgc

SEQ ID NO: 39852 - DNA, 61 bp, Chlorella protothecoides
ggagtcaccttccccgagtcctagccccgaagagtcaccttccccgagtcctagccccgag

SEQ ID NO: 39853 - DNA, 100 bp, Chlorella protothecoides
ggggggggtggagtggagtgggggcgccttcacaccataccataggcaaacagcacccgtacaaatcgtagcatggtgaccgcaaccacccacggcctca

SEQ ID NO: 39854 - DNA, 66 bp, Chlorella protothecoides
ggctgggggggccagtcgagtggaaaggagcccggatccaggcgcgcggcctcgcctcccagtgac

SEQ ID NO: 39855 - DNA, 93 bp, Chlorella protothecoides
tatacgcctgacgaggaggcacggcgacccattcttacaggtaaggcccggccggcggctgtggggctgtgcatggtgcggtggaggggtggc

SEQ ID NO: 39856 - DNA, 878 bp, Chlorella protothecoides
  modified_base (194)..(203): a, c, t, g, unknown or other
  modified_base (268)..(277): a, c, t, g, unknown or other
ggcggcgtcggggccgggggtggccgcggctgggccggcagggggcgcggcgtcgggggcgtgctcgctctcgccgcactcgtcactctcacccccccccgccttcccgtcacccaccgcccccttcccgggccccgcgccaccgcccgcccccggcagccgtgggggcgcgcggtcggcgggccccaggagcnnnnnnnnnncacaaagctggtccagtccagggaggcgggggctgggtcccagacctccaggaacagggacaggnnnnnnnnnncccttccccggccccgcgccaccgcccgcccctggcagccgcgggggcgcgcggtcggcgggccccaggagcacgctgcgcacgtcgcaggcctccttgagcaccacggcgtcggcggtgaacaccacggcgtcgttgaccaggaaccccgcgtcggcgtcgaacagggtggtgagcgacacgaagtcgcgccagccccagtccttggcggtgcaggagtagcggttctgcgactccttggccacagaccgctcctccgcgcgctggttcaccaccgccaggcggtggctgacgaagctagtccagtccagggaggcgggggccgggtcccagacctccaggaacagggacaggcaggttgggggctgggcctggccacgcgggtacacgatcaggcggcagtcgcgcccgcccaccgtgaagcgccgcgacttgatgcacaggccctggatcttgcgccgcttcagcacgtccttcaggcgcgtgaagttgtcgatgcgccaggtgaagcgcgccgcgtagtccgactcgcgcgccgccagcttgcgcggcgcggccaggccgccgccgcccgccccgcgcagcgatccggggttgccgc

SEQ ID NO: 39857 - DNA, 79 bp, Chlorella protothecoides
ggagcgggagcgcgaggcgctggaggcggacaagctggctgccgaggcatggctggacaaggaacgggaggcctgcgcc

SEQ ID NO: 39858 - DNA, 103 bp, Chlorella protothecoides
gaccgaggagtagccgtaggtcagcaccacatcgtcgctctggatgcgcttggccgcctcgcccgccagatggtcgcccgcaaacaggatcttctcctggaca

SEQ ID NO: 39859 - DNA, 1314 bp, Chlorella protothecoides
  modified_base (360)..(369): a, c, t, g, unknown or other
  modified_base (871)..(880): a, c, t, g, unknown or other
  modified_base (954)..(1051): a, c, t, g, unknown or other
gcagcggccagcgccggcgcgcgtgcgctggcctaccacatgctgggcgcggaggtgcgggacgaggagctgtcgccacagacggtgctggacccgctgtcgccccagatgctgtcgcggcacctgcgccagcaacgcgagcggacagcacgcaagctgcagcagggagaggaagaaagggaggaggaggagggggaggaggcgccgcgcggcggcgtcttctgggacatcatcacccacgacatgttctgagggccctcgggtccctgtcgggttcacagctgccctgccggtacgtgaccgtgcttgagccagaccccgactcgacgctccaccggacccctctcaaggcaccgcacnnnnnnnnnnttgagggccctcgggtccctgccggggtcacagctgccctgccggtacgagaccgtgcttgagccagacccagactcgaccctccaccggacccctctcaaggcaccgcacacctcgttcccctgtgctgtgcccagtcccccttttcatgttgacgcgtgctccttgtctgcatgctcctgccttcctcccctgcccctgcaccgccccgtgtgcgcgcgtcgccttgcggcacagcgcaccaccgaatccctcgcttgccctcccctgtacaccccctccttgcgaccccctgatgataactgctccctgcgatccagcaccctgccttgaaagaacatgcacagcgatcgggcacgtgcgggggtcacagagggagggaggcaggcaccgagaggtgcccctgcccgtgcccaggcagggggatggcaacttcgcgtgaggcgccgcgtgcacccccgcaccggacagccccgtcgccggctaggcgcgcggcccgccnnnnnnnnnncgcgcgcgtcgccctgcggcacagtgcaccacccgacccccttgcttgccctcccctgtacaccccctccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcgggcacgtgcggggtcacagaggagggaggcaggcaacgagaggtgcccctgcccgtgcccaggcagggggatggcaactttgcgggaggtgccgcatgcacccccgcaccggacagccccgtggccggctaggcgcgcggcccgccatgcgccgccgcgtcgtcgatcttccgccgcacggcggccaggagggcgcccagcgccgcctcggcatggggcgagcccggcccgcgccggcgcgcgcggtgcacggcggc

SEQ ID NO: 39860 - DNA, 101 bp, Chlorella protothecoides
agcttggtgggtgcctctcgtgcggtggggcgttcatcagcagtacctccacgtgcgagcggtttgccactgagcaccctccccaatcctggtgcagccat

SEQ ID NO: 39861 - DNA, 109 bp, Chlorella protothecoides
gcggcgcaacgtggtggtcgtggacgcgcgcggcggcgggccgcgcgaggccgcgccgccgcgcccgttgcgcgagggccaagcgaggagcaggaacgtgaggcaggag

SEQ ID NO: 39862 - DNA, 61 bp, Chlorella protothecoides
acatcaggctattcaacttgagcatgcagcagctgtgcacatcctgcatgctttttgcacc

SEQ ID NO: 39863 - DNA, 69 bp, Chlorella protothecoides
gcttgcatcactcccggggtaacacggcgcgacctgaaccccaccctcacctctttccgccgctccttc

SEQ ID NO: 39864 - DNA, 74 bp, Chlorella protothecoides
tcgaggtcaactgccgcatgggcgggggcctggtgcgcaacaccaacctcctggtctggggcgtggacctggtg

SEQ ID NO: 39865 - DNA, 78 bp, Chlorella protothecoides
agcactgttttatcgtgagggatgcgccgtatactccccacagtcatcagagatgggtgcagctcaccgcattgaggt

SEQ ID NO: 39866 - DNA, 104 bp, Chlorella protothecoides
gcgtgagggcgacgccatggatttcgccaaaaagtacgcttaaccagatcatgcttctgtaggacgaatgcagggagctcctcgagtctccttgctaccctctc

SEQ ID NO: 39867 - DNA, 20197 bp, Chlorella protothecoides
  modified_base (155)..(164): a, c, t, g, unknown or other
  modified_base (3294)..(3329): a, c, t, g, unknown or other
  modified_base (3493)..(3502): a, c, t, g, unknown or other
  modified_base (4164)..(4173): a, c, t, g, unknown or other
  modified_base (4483)..(4492): a, c, t, g, unknown or other
  modified_base (5256)..(5265): a, c, t, g, unknown or other
  modified_base (5362)..(5371): a, c, t, g, unknown or other
  modified_base (5808)..(5817): a, c, t, g, unknown or other
  modified_base (6673)..(6682): a, c, t, g, unknown or other
  modified_base (9176)..(9341): a, c, t, g, unknown or other
  modified_base (11012)..(11021): a, c, t, g, unknown or other
  modified_base (11355)..(11364): a, c, t, g, unknown or other
  modified_base (11568)..(11586): a, c, t, g, unknown or other
  modified_base (12528)..(12537): a, c, t, g, unknown or other
  modified_base (15155)..(15257): a, c, t, g, unknown or other
  modified_base (15334)..(15343): a, c, t, g, unknown or other
  modified_base (15421)..(15430): a, c, t, g, unknown or other
  modified_base (15596)..(15650): a, c, t, g, unknown or other
  modified_base (16768)..(16777): a, c, t, g, unknown or other
  modified_base (16930)..(16939): a, c, t, g, unknown or other
  modified_base (17514)..(17523): a, c, t, g, unknown or other
  modified_base (18269)..(18278): a, c, t, g, unknown or other
  modified_base (18500)..(18509): a, c, t, g, unknown or other
  modified_base (19679)..(19688): a, c, t, g, unknown or other
  modified_base (19797)..(20024): a, c, t, g, unknown or other
cacccacccacccacatcttacaacgacaaccccaccccaaactacaacgccccccccccaaaaaaaacaaaaatccaacaaaaccgactcaccagatcggtggcgaccaggatacgcttggccccctccttgaactccttgtacacggccaggnnnnnnnnnntggaccccccccagaaaaacaaaaacccaacaaaaccaactcaccagatcggtggcgaccaggatgcgcttggcaccctccttgaactccttgtacacggccaggcgcgcggcctggtccatacccgcgtggatggtggtggaggggaagttgcactggcagaggagcttgttcagctcgcgcgcgcgcgcgacggacttgacgaagatgaccacctggttgaagtccagcgcgtccagcaggtcattcagcttccggttcttggcgtcctcgttcagcatgacgtagtgctgcaccaggccatgcagggtcagcttggcctcgtcgtccacgtagatctccatggggtcgcgcatgaagcgcttgcacacgggccgcacctcggccgacagcgtggcgctgaacatcatgacctgcttgtcgtggggcgtgcgcttgaagatggcctgcacgtctgcccgcatgtccaccgactccaggcacttgtcgcactcgtccaccacaaagtggcgcacgcgggacaggtccaggctgccctcgtcagccagggccttgatgcggccaggggtgccgatgaggatgtgcggcgccttctcgccgtccttgagcaggtcgcggtgggccttgatgggcaggcccccgaagaagttggccagccgcaccgacttgaggtaggtggtgaagcgctcaaactcgtgcgtgatctggaaggccagctcgcgcgtgtggcacagcaccagcacagacacctgcccgtccacgggctccagctgctgcagcgtggagatgacaaacaccgcggtcttgcccatgccggacttggcctggcagatgacgtccatgcccaggatggcctgggggatgcactcgtgctggactgcgtcgacggtacaagggggggatgggacgggggaggggggttgggagtctgggggaaggaagaggcccaagtaacatcctgtcgaggtccatgcgcgtctggagggggaggtcccacaaagtagcggctggagcggaccgaggtggacaccaaaactgtcgcctccggcgccgccccactcctcatcgagctgggtggatgcatcctcagggcgcttgtcgccccatcatccaccggttcgtagtcccatcagccacggctcgttcacccgtgcctgccctggagcgcaccctcggaggggtgctcgaaaccgcagtcctggatggcgcgcaggagctcgggcttcaggaggaaatccttgaagcccgaggagtggatgccgacataccccttcttcaccgtctcgcccttggccgtctccggctccaggacctcctcctcctcgtagtcgacgagctcctcggtgtcagccatgtctgcaggggccagcgccgggtgggtgaggcgggtcccgaggggagggggaagctgatggtggccgggacgggcagggccgagcaggggcgccgtggtccgccactccactctcgaggccaccggaacgcgtcgtccaggaacgcaaggtgcactgtccacggcatgtcaggtcagattccgcacgatcctcagctcaagatgaactcactgtctggcgtggctgtatgtgatggaccggctttttgagccggatgtgctggtagcagtttaatatactttgacgagtagaatgtgtagcgtcagtactctatgcccggctgcacccgctccctgggaggtccctgcggaactcagcctttttttcccgccatctggacaattgcagttgccatggcgagatccattcgccgcagcgtgaaggccccctttgaggattaaattgtttgacgacacctaatctacaactactgaaacggattgggaagatcactgacctgccgggctcacggcagagcctatgcgtgaacggcgatccaacagccttttagtggagtggctggaactcaaaaccccatctcccgatgagccacccttagcctcaggaacaaaaagagccatacaagaatgctcttggaaatcacataacggaatttcacggcagacagccatgcattctggtcaaagtacagcaactttacacgacaaacaggcctcgctcgacatgcatacatgactatcttaaacatacaatatgtgccttgattttcagtgtagcttgtgtgacttgctgcctcgcacgaggcgccattgtatgccaatgtttttatgcgtcgtccccacgaagaccctcgaacctacacgctcccgccctcgtccctcatcggcaagaagacatcctatacaatacgtctgtctgcattaaactgccgttgcttccttgcttttagtcagccaagcctaccccgattgtcagtcgtccttgctgtgatggcttcccgtcaggccaggggtgtgctcaacttcgtagcctccagcctggtgcgcagctcagctgcgccccgggcgctcatcgctcttccctacagcgcggcggtgcgtgcggcttgcgtgagctcggccactcgcgccggcggtgtgagggcgttgcacgcctccccaccttcaaggtcatcggccctcatcggcgccctccagtccgagctcacgtacgagaaggaggagtatgtacagcccgaggcaagtttgggtttgctacccaaggggcgcggggaagcaagactgttgattgggtgatcagttgggggaatgagtgtgacagaagggcgaggagtttcggctcatgcgtggtgactgagccgccgatgtggtaagccttttgacaattcctctctgaccccccactacaggaggtggcgggtggactccccaacggcttcacgctgaccgagtcccagggcgactgcttggtgacgctcaccaaggagcaccagggcgagaccgtcaccatcgagctcatcgcgggctcagaggtcagaacttagtcatggactggtgcagtcgatcgccagaatgcgatgcagggatgtgtgcttgcaaggggagcctgtgggttgtgtcaaacatcgacctcttggcaacatgatctccatgtgttgaactggactggcagctccatcccctcctcatgaccccacccgccaccagaccgaggacgaggagtttgagattccagatcacgatcacgaggcagaagaggaggtggaggaggggccnnnnnnnnnnnnnnnnnnnnnnnnnnnnnnnnnnnnaccgagatgaggtgggcagaggttgcaatgtggggtcatgtgtcgccaccaaatttgagcactcgccagccaagcattgtaggtaccttgcaatggaccagcacgcctgtgttctttgccatctccattcagatcacgctcgcctgttctccaaaaccctaacnnnnnnnnnnctttgagcactcgccagccaagcatcgcaggtgccttgcgatgaaccagcacgcctgtgctctttgccatctccactcggttcacgctcgcctgttctccaaaaccctaacctgcgcccttgcccctcccggactccctcttacaggtttgaggtgcgcgtccgtggcgacgggtccatggaggtggacgaggtgacgctgtcccccgccgacgaggacgaggaggccttcaacgaggtcccctaccagggcccccgctttgaggagctggatgagggcctgcaggccgagctgcttcactacctggacgagcgtggggtgaacgctgacctggcggtctacatcaccgccctcaactttgacaaggagcagcgggagtacacccagtggctggagcgcatgcaggcctttgtggcccagaaggcgtgaggggggcagggatgggccaggcgcagggtcgagggtccaggagctctgcgcgggcgcgcgcggccagcatcgaccctgctccatgacaaatggaaagggtgcacggcatcctgctcgctgcgggcccggcgggtgcgcctgaagcccttccaatcccttgccacctggcatgaaagcatcccaaacttttgcctctcatcgggattcttgcgctcatctgggcatccaatgannnnnnnnnncccctgctccatgacgaatggaaagggtgcatggcatcctgctcgctgcggccccggcgggtgcgcctgaagccctgccaaacccttgccacctggcataaaagcatcccaaccttttgcctctcatcgagattcttgcgctcatctgggcatccaatgaacatgcatgtaggcaggcagcctcacttgaggcacgccagaggtcacccctgtcgagaaagtgtgctgctatccgcggaactttggggagctggtgtgcattgactggcctgctcagctgtgcagtgcgatggtgaccctgcccctggannnnnnnnnntgagtgctgctatccgcgcgactttggggagccggtgtgcatggactggcctgctcagccgtgcagtgcgatggtgaccctgcccctggagcgcagcagcaaccagtggcttggtgtgtggtgcccatcgaagcctgcagcaccccatgtggaagtgctgcagccattgcagccccacggcctcagcacaggcctcgtgattctctgtccagttacactcaggctgcgctccagcgtacccaaacacagagcacgcgacagcacacgcccgcggcgctttcctttacccccttcctcctcaccacgtgcccacggcgtgcgcggcagggtccctgaacagcgcgtggtcccagttggtgggcagggcgaagggctcgcccaggtctacgccctcggccgacacccgcgcgatctggaagcggttgatgctgttcttgtcgcggtagtagcacacggtgaggcactcgcgcagcagcgccctggcctcctcctcgctcatgtcgggccggtgcttctcccgcaggatgggccgggccaggtggttgccgaagcctttgagccaggggggtggggtgcgggtcgaggcgtcgagggcgacggcatgggatgcgttgtcccctcgatcgaaggccctgagcaccctgaggagaggccagcaggaggcgcggagcaggcccctgcccctgacaggcacccacttcctctggcacagctactccccacccccctttcacccacctgtggccactgtgttgtcagtgaannnnnnnnnnggaatggtgcgggatggggtgcagcatgaacacatcacttgccatgcattgcgctcacccagtccatgtgccaggccttcctgcgcccccagcgggnnnnnnnnnncaagcaggcccctgcccctgacaggcaaccaactcctctggcacagctactccccacccccccttcacccccctccccacctgtggccactgtgttgtcagtgaagtgcgtcccaatcatgccgatggaccccaggaagggcttgccggcgtaccagccgcccaccaccagactgttccacagggggtccatcctgtgaatggtgcgggatggggtgcagcattaacacatcacttgccatgcatcatgctcacccagtccctgtgccaggccttcctgcgcccccagcggggagagagcaccggctgcgggtgtcatccacatcctgtgcctcacgccaccctggtccgtgccctgcagtgcacccagtcccagggcagggcatgcacaccccgcccccacccctcccgtgggcccctcgcacttgttgcggcggnnnnnnnnnnccgcaaaccccgcccccaccctccccgtgggcccctcgcacttgttgcggcggttgtagatgacccgcgtgaggtaggaaaacacctcggcgggcttcatgtggtgcccgtcgtccatgcagaagtcgtcatccgccagttcctccagcagcctgcaggagattggggtccatgcctgtcaaactcatggggcacgtgacaggcaaggtaggtgcatgacgactggcgaggcatggatgtgtggtgcatgcgctgccacattcactgggctgaagcaacccgagagccgcccaccgggctgcagcctgcctggagcccgatgcagtgtcgcaacctgcaccccagaccacattcagaagcacagccaccggcacctgacaatgtactggtagtcggaaagctctccgccggctcccaggacggtgcagttgttgaccttggtgagcctctggaacgacttgtaccgcttggtcgacccatacgcacctgtgaagattcaggctgccacgcgctccagtggggtctgactacagcacctcctcgaaacagaatgcactgggtggctgaccctgccacagccagcagccaaggccatgcctcccccacacctgccgtccatcaccctcccaaccctccggcaatgaccccacgcaccaagggtatcgcttgccaacaggatgccatccttgtacgtaatacccagcaccgaggtccccgtgacgtaggggtacctggagacggttggtgacaaggtgtgcgaggaaccttttgcgttgtagaagccagccctgctgacgatgctcaacaggccctcgacctccacacacactcactgcgtgtgcttgcgcgtaccgcnnnnnnnnnnagaggaaccttttgcgatgcagaagccagccctgctgacaatgctcaacaggccctcgacctccacatacactcactgcgtgtgcttgcgcgtaccgccaccggcagcgagggcagaggggtccaccataaaggcctcagatccacaggaaggcctttgcagggcgtggcccgctggctgatcgaggcccgctgtgctggggttggccatcgacggcccagcgcagcccgggcctatggctgcgctgtgtgatgtgggcttcggcaacatgatgatttatctggggggtgccaagcgctgccctgagcggcacagacgatcaggagggaatgtgatccccagccccacaacaaaggaacaggcggatacagatgaggttgcaggtccgtttttatcagttctcaaatactgaatggggagttcgatgggttcagacccggctgtgtgcgtgatcaagaacggtgggcaaccatgtctgattgccagcctggatggcgtccgcaacgcagagcaccaccttgatgacgacgccgggagatgtcgagcatctgctcatgcatgcgccactctccttacttgcatgatttgtctcggatttccgccagaaggtgttgagatacccagtgctgtgggcaaagagtaggtttggtatttgtcgaccgcggagcgcctcgttggcctcaccgcctttgccctccgatgggaaaacagcggaattctgtgcgagctgcaacagctcggtcaggaaagctggccaaaggatcgaagcgcagcccccaggttgctgcagctgctccaggtggggctatggaccgggagggagggggcctcgggcagggaagggcgaacccatcatcaaggacgctggggttgtgacccactccggccctagaatgtttcaagtcgacaatgctgcacatctgtgtcctgttgaggtcgaggcagaccctccgacgggtccttcaccgtgtcatccagctgcaggagtcagggagaaggaggccgccaaccccgacaaccctgcccccaagaacgaaacacaccccgccacgtcgtcggctgcagctgtcacgaacggtgagcccgtgtcggcccccggacctgaagcccccacgctgaccctggagcagatgaccgaggcagtggcgtgcgcagctgccgaacagggcgacgactgcaaggcggcccccgcccccctgcccaccctggtactggccgaggaagcggtcgacgtgggccccggctcatccacagtctccgtagcgggcactgccggggaccggctggcagaggtggcctctgtggcctctgcgggcgactacgctgaccccagctacatgcttggggactctgtcagtccccagacggcggccccgccagaggtggacgctgggactgcgagcgaggccgccatcctggtctctgacgccattgcctcggccctcaccccagaggtggtggcagaaggagcgaggggcgacgagcaggtggcacagagccatggcccagcacagcacgacttggcgtctgcgccgaatgaggcgagccctgtcgctcacgcacctgccgggcaggagttggcagtggagctggaggcagagggccagggagtctccgtcaaggtggaagttcccggagaagcttacaaagctgattcaaatggcgagcaaatggcgggatgcaacgaagctgatgtcaagcagacggcagggacggagcgggtcacgtcaaacgacaaacaggcagcaggagctggggaggagcatgcatcgaactcaaaggcgcccgccgcgcccgccgcgccctcatcgctcgacggcggcaggggttcacgcagtgccacgccgcgctccggccggcgcaacgtccgattcgaggacgaggagtgcaagccgggggcggaactcgccggtgccctggcaggcgtgctgggcgtcgccgccggcggcaccggtgccgccgctgccgcgacgccgctggctgaggagacgctgcaggccgccggcggcggggggttggtggggcgagaggtgggcatgaccaccgaggaggatccccgcaggaccaccaaggaggggccgtgtgccgccacccaagacccactgcgggagccagagacactggcgtcccagccggaggcgctggacgtctggctgagggagtgggcggagtggggacatgcccacgccgggtccctggcagttgcggcgggggccacggcggcgctcgtcggcctcgccggcctcctgtggggcggacccggcaggcggcgcggcagggccgcccccctctggcactgagggcctgccattgcatgtgtccccaagagccatgcggtgattcgccaagtaataatggccttctctttgaacccgtttttattgtggaggcctggaccttcccttgtcaagtttaagactggggcgcaggcggcgccgggaacccggaaagcaatcctgtagtcaatcaaagagcgtgccaggcagcggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacaggcaagtattgctcgagttccatggtgcaggaagtccctccactcgtcgttttggaaacagcctcaattctcctttttctcctcctcctcctccttgggggcctcctgccagtacaggaggtggctcaccttgcccttcagagctgtgaatggcagagggtaggaggtgagggaaaggggagcgaggaacactttatacagccttggctgcgcagcagccacctcagaccaaccaggcatggatacccaaggttgagccatacctgctgcagcgagcgtgaagaggaacacggaggggacgatgtacagcagggcaggctgggctgccttgaaggcattcatgaccatgatggtggccgtcaagcccaccacatatcccaggaaggagctgttatggaagtgagtgaggagggtgaggtgagtaattgccgcgctggagcttgtatcgacacatgtatatcaggatgtcagcaaagcttggcacagcacagcgacaggcacgaatgtatgcatcattgccctcctcacctcctgaaaaaccgcgtctggcggccatgggcgatgtcgtagcgaaggacgatggccacgaatatcccagggatgacgatgtctcccagtccgagcatggagaactgctccttgccctcggctagagtgaggaaggggaggtgggaggagtcacaatgggtcagacctctcaagaggcagaaatccacaatatcaagctctgcatgggactgtgtcacaaggggcccaaggactgcggagagggagcttgcaaggcagcgtcagcagaccacatcataacgaaagacacatctgccccggggatctcaacccccaaatggtccccaattctaacacccttccccccccaaacacacacacaccctgcgccgcccaccatcttgaaggaatcgagggaagaggagtttgatgggcgcatcaaaattcttggccaccgagaccattactggggtgaagaacacccagaagatgtcgtagaagaagagaccttttgaggggttggggggtgagtttgattgtgatcatgacggactgatgtccgttggcatctctgcggctggccgatgggaaggggggggcgcggtgcctgcatggccttctacctgcgaactcttcaccacaggatctggagaagaaaccattgtgtgaagtctacatcctctccctctccgcccaaccccaccccaaaacacgacacctacctgccaggaggatgaccccgacggccacagaccccagggacaagtgctcgataccctgaagcgagaaggccaggcccagaacattgctggcaaaccagtggcgctgcttcaggtaccaggcggagaacagggcggcgctggccgacaggacgatttccagggggctgaacgagaactctagaccctcctgtgaaggggatcgaacaagaggggtagtgaggttgagcgtcaaaagatggagagggagcttgggctcatgtatgaggatggcgtggtaggacgcgtctgcgaatgacatgcaggaaagccggcaagtaggtgtcagagactcaggcagagggcggttggacaatgtgccaggcaccctgtttctcaaaactcatcaacacagtaaatccagtcattcgcctaccttgagcaggaccggaattttcatnnnnnnnnnnagccctgtttctcggaactcttcaacacagtaaatcccagtcatttgcctaccttgagcaggaccggaattttcatgacggtgaagtgaaactgggtctcagacagcttgcgtggtaggaagggtgccacgagcgggtccgcagtggctgtgagggccagcagtcccagcagcacaaagtatgctgcagggacaggaaattttcgaagattattaagtttaccagctcgagctccaccaaccaggttcagcgacccagcatcccgttttgctggtcacagggagtacctccaacttgcctgccaacacggcattcacccagtcctttgggaggnnnnnnnnnnccccagcatcccgttttgctgatcacagggaatacctccaacttgcctgctaacacggcattcacccagtcctttgggaggtacttgaatgccaggaagagactgaagaggacgactgagcctatcagaggaaacttggctgcatcctgtacaaatatggcatggggggatggggtgggggccactcaggcggtctgcagtgcnnnnnnnnnnnnnnnnnnncacccgggcagcccgtcaccagctcaccctctttgtcatggagtcctgtggcgggctgtccttgacggatcgcctgctgccgacgtaaacggtggccgcggcagtggccacgatgttgaagttcaccggcaccggcaggaaaatcggggccaccgccaggccagccaggacggcatggccaattggacagggcaccttcagaggtccttcctcacttccagccatgtcgtgcaggggggtgcgctacgcgtcttggcctcggggtgggcaggcacttgccgcgatcaccaccggctaggccaggatctgcaaagtacccgctggatcacagtatcaggtatctgagattgtgtcgaaactgatcagcaggtaaatgtggttgttcttgctatcatgttgtgtcgagcaggcaccccgcggcatcggggaggggaaggggttgtgatcttgcaccagaatgttgcccaaatcccttgtgcggatctctcgggcaaaggaggtattcaatcatctgcaatgaccccttgcgaaagctggaagtactaggaaaacattgtgctgtaatggctctttcttgcagactaatgagcctctgttgaagcatgccaggaagaatacaccgtaccccagcggcttggacctggtgacgagttggtacaaagcctgttggccgccagactattttggagtgtcctccagccaccgagataaaaattccttacaggaggtgctgcatcctgtttttaataatagtcaattgccaagtttagcaaacaaatcctgtgcactaggataaaaacataccacattttccggttttcaacatgtgacaagcagacttgtcgcagtgtttcagagccaacgcttcatgctcttggtcagtgtcgctaaccaggacatcccctctctcacacacaatctcccagccgccgtgacaagaannnnnnnnnnaccaccgagataaaatttccttacagggggtgcagcatcctgttttcaataatagtcaattgccaagtttaacaaacaaatcctgtgcactaggataagaacataccacaatttttcgggttttcaacatgtgacaagcagacttgtcgcagtctttcagagccaaagcttcatgctcttggttagtgttgctaaccaggacctctcctctctcgcacacaatctcccagccgccgtgacaagaaactacgagcggggcaggcgaccaggctcgcggtggccgtgctccgcgccctgccaccaacaggacgaaccaaaaaccgctgtaattccaaccattcaacacgtgccccattcatcggctggatgcaatgcattaggcaggccacttgtagatcaggtggggagggcatcctctttcctggctcgcccgtgatggtgacacggccagtgctccatgctccaaggctatgtatacaatattctaaccctggtggtccctatgcccctcatcaatgtgcagtgaacatcgcagccctcccccgagcttcccaagtggcagcgcagtgcagagctcgtccaccccggcgctttttaggtgcccatttgcgcaaaagactgggatgcacctgcttggacatggaactgattaccccagtattccaactcgatcttgcctcacctcgcaggctccagcaccccctcgctccacccaagccgctcccgctcgtccggcatggcgaccctggccacccccactggcggcagcatccgtcaggagctgaccagcctctttggggcctccatctcctccacattccctgatgccggggtgcagccgtcggtggcccagaccaacgaccccaagttcggggactaccagtgcaacaatgccatggccctcttcgccaagtgcaagggcaaggtgagcagcgctgcctccctttgggccccgatccgcccggccgcttcatccgccgcccccacctccttccccccgcgaacagacgccccactccaaacacacacacaccagagcctcccctcccccctttccgccgtgcaggagggcgcgcccaagaacccacgcgccgtggcggaggccatcgtggccggcctccccgcctcggacctggtggagtccaccaccctggccggccccggcttcatcaatgtgcgcctgtcccacgcctggctgggccgccacgtgggcgacatgctggtgtccggcatcgggtcgtgggcgccgcgcggccaggccgggaagcgtgtggtggtggacttctccagccccaacgtggccaaggagatgcatgtgggccacctgaggagcaccatcctgggcgactgcctgtgccgcacgctggagtactgcggcgcggacgtgctgcgcctgaaccacatcggcgactggggcacccagttcggcatgctcatccagtacattgccgacaagcggcccggcggtctgtcggcggccgaggacgaggacgtggccgacctgcaggtgctctaccgcgcggccaaggcacggttcgacgccgacgaggggttcaaggtcgcggcgcgcgaggcggtgacccagctccaggggggccggcccgagtacctggaggtctggcgccgcatctgcgccgcctcgcgcgccgagttccagcgcatctacgaccgcctgggcgtggagctgcaggagcgcggcgagtccttctacaacccgcgcctgcaggccaccgtggacgcgctggtggagcagggcgtggcggtggagtcggacggcgcgcgctgcgtcttcttcgagggccgggatgtccccctgatcgtgcagaagcgcgacggaggcttcggctatgcctccaccgacatggccgccctgcaccagcgcctgaccgaggaacgggcagactggatcgtttacctcaccgacgccggccaggcggggcactttgagatggtgagcgcgtgtttcaagggagtgtgtgtgggtgtgttttggggggggaaggggggaggggggtaaatttcggtggcggggtgggggagaatgggggaggtgcgtcagaatgaaggcgtggtgctgggcccgtcgtggtctcccctggtccttagcagacaacaacatcccaaaggggggtggcgcagagtgtcacacgagttcaatgccatcctcccgcctcccaaccccagcctctgcattccgcccctcacatcgtccctgccccagatctttgcggcggggaggagggcgggttatttccccaaggaccgggaggtgcggatcgaccacgtcggctttggcctcgtcatgggagaggacgggaagaagttcaagagccggtctggagatgtgcgtggggatggaggggaggagggctgtgatgcatcaggcatgttgctcccagtgggccctatttatgacctggtcatcaggtcggctgtggtctaacgcgtcctgaggtggagaaagtgagctctctcccatggcatcctcttaccccccttgcatcctccccacccaattgcattcgccttgtcatcacccccccaccacccatcgtacccccccccccacacaccccttgcctcccttgcagacggtgcgcctggtggagctgctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctttaaatggatcatggctggtgaaggctgaatcttggcagagaatgtgtgaggcctgggcatgcgagggggcnnnnnnnnnngctctttgaatggatcatggctggtgaaggctaatatcttggcagacaatgtgtgaggcctgggcatgcgagggggcnnnnnnnnnnccgccttgtcatcacacccacccacccatcgtacccccaccccaccccttccctccctcgcagacggtgcgcctggtggagctgctggacgaggccaaggcgcgctgcaggaccaccatcaaggagcgcaggtgtgtgtgccatgtgctgagcgggcatctggtgnnnnnnnnnnnnnnnnnnnnnnnnnnnnnnnnnnnnnnnnnnnnnnnnnnnnnnnaacagatcaagtcatgcaacagtttgtcatgtgacaacaatgcatctgctggagcagggcagtctatgcacaccagctgccaagtcgtttgcagctcctggctgccatgtccccagcgcacgccacacatgctcccttgatcccaggcctgacatctctgaggaggagctggaggaggccacctcggccatgggctatggcgccgtcaagtacgccgacctgaagaacaaccggctgaccaactaccggttctcctacaacgagatgctgagcatgcaggtagggagggtggggtggcgggggatgattcacgctggtagtgaaggtcgagtggagggaatggaagagggcacagcctggtgtgaaggctcgacttgtgcagccagatctgggcaaggtggtggctcaggcatctgggcacatgcggggaggttgcccgcattggacttgatctcggtctcgatggcatgatgccagtgttggtcctgtgctggctcctggagggacccaccgcgcagtgaatcgccctcgaatcctcgcctccgccctgccagggagacaccgcggtctacctgctgtacgcgcacgctcgcatcgccgccatcctgcgcaagtctggaaaggacgtcgcggagctggccaacagcacgaagatcaccctgggcaatgacctggaagtggccctggccctgcacgtgtctcgcttctccggtgcgttttctggtggcgagggctggcacgggggaatgcgctgctgtggcgaccggcaggcgctgccgtgtgggagaggtgcagggcgcaggggttgtgattttcatctgcagaagatggccatcgttagccatgacgacctcctcctgcccggcggtgagcattcacgctgtgcactcgaacttcccctcatacgtgcagaggccgtggaggagatgctgacggacctgtaccccaaccgcctcaccagctacctgtacgacctgtctggtgagacccagggggagcgttggtgggtgtgctgacagggaagaatgtagggatcatgcaggggccttcatcctggagtccacatccgaaactcttgcagtgacatggaacactctgcggggatcctcagtgtccannnnnnnnnnaggggaatgcgctgctgtggcaaccgccaggcgctgccgtgggggaggggtgcagggcgcagggagtgtgattttcatctgcggaagatggccattgtcagccatgacgacctcctcccgctcggcggtgagcattcacgctgtgcactcgannnnnnnnnncgggtgtgctgacacggaagaatgtaggaatcatgcaggggccttcatcctggagttcacatctgaaactcttgcagtgacacggaacactctgcggggatcctcagtgtccacaccccttgcgccatgtccggaagtcagctccctctctcatgctccaacccctgttctgcgccaatgactcatacaggcgtattcaaccagtactacacggagtgccaggtcatcggcacggaggaggaggactcgcgccttctgctctgcgaggccaccgccgtcgtgatgaggcagtgcttccacctgctgggcatcaccccactgtaccgtatctgagcactgggggtgaactgttgaggcccctccccagtgtgcagccatgtgcctgggcatgtcagcaagcctgggagatgccaggagcgacacattcaacagggaggaaatggggaaggtatcgcatcacgccatcacactccccagaaccgctgcattgaccaatgccagacgcacgtcgcattctacacggtgttcacatgtcgttctggcgtgctggcaatgcttatcgcatcctcgggccnnnnnnnnnnggccaggcgcacgtcgcattctgcacggtgttcacatgtcgttttggcttgctggcaatgcttatcgcatcctcgggccccgtgttatctttcatgccccacacacctgcccaacttgatcaagctcgccgctgttgtgccagactgcctctgcaggttctcgcgaggcaagcaatatcatcaaagtggcactcattatcataattgacgtttgtgtgcgtgaaagggcttgagtctacgctctgggtggtttccgcccaccaggactggagcaggtgacgcatctcacctccccacagcccttgcaacataagtggctactggaaatgtgtccacgtgcttgccagctgcttcttgtacggatccacggtgcttgccatgccccaaagtcgtcatccaggctctgaagtgcccagctttgccccttggggcattttctggacacttccaaccctgtttcacctccggcatgagtgcagctgccccagatgcaggtccaaagggacactggagcccacgaacccacacagactccactgtcaaggccttcaaaagctgcattcagtgcaagtctggctcaaagctccacaggccgcccggtcgacgcctggacctgggtttactcgttttctgcgagctggacattggaggatgcaggttgggccatccaaggctcgactggcaggctggaggatgagcaggccgctagagcatatgaaaaaccgctgcaggtccgccgcagggannnnnnnnnngctggcaggctggaggatgagaaggcccctagagcatttgaaaaaccgctgcaggtccgccgcagggatcccggacggggacatcggctcccatagccctcttggctcatccctgcgccgagggcgggtctgatcccatcaggagtcagaagtttacagagtggacccgagcgtggtggatggctgctcttgccttgactcctgcatgaatgagccatgcannnnnnnnnncgatggggacatcgacccccatagccctcttggctcctccctgcgacgagggcgggtccgatcccatcaggagtcagaagtttacagagtggacccttgcgtggtgggtggctgctcttgccttgactcctgcacgaataagccatgcaagcacagcatgaagggctggcatacgatgtacccagcccttcatgctgtgcttgcatggcttattcgtgcaggagtcaaggcaagagcagccacccaccacgcaaggcttcacctggtatggctcagactcggagtgaaaatgggacctgactcgtcatagggggtaagcaggggggaagtctccatcgaggatcccagcagccgacctgcagtgggtctccatgccctgccgagccttcttgttctccaaaatccgccctgcatccatggagtccagctcgcgaaggatgtgtaaatgcagatccagtcgccgctctcgcaactttgggcgccagctaccaaacttgcgctccatacggcgattgtcagccctgaacaggcgaggtggtttggtttcacagcgtttaccgaaacccctgcccatgcactcacgggttcacgcgattcgctggataatagaaggcaagaaattacgtttgatgccattgagtccgcagaatcgatagcaaagggtcattccgggaagatcggatggggtaccgtaccacaccggctcggcgaataggcttgccaggcacgcctgatcattgcgaagcgctagcaggcctctctctccaccaagtatcgtaaacgtaccacggcttgcattccttagaccgtacattatgagatctcaatgaggagagtgtcgcccgtaactggggacaatgcatacgggcacccacgccattgaggtctcctgcttgagatgagagaaagtggtataattatgcgaatttgtgggagttgaaattaattaatcttaccagcatcatgcacctcggatgtggaggtggacccctcatgggaattttgcgcatggtgtgaagttgcgctctaggagtcccagatcggccaacccgggacaatactaatctcccagtcagatgccactcgagcccacctatgcttaaataagatattaaaatgcgcaaaattgcttgatgggcatccgagaggcccccgtccggcgggggccannnnnnnnnntaccattgaggtctcctgcttgagatgagacaaagtggtctaattatgcgaatttgtgggagtcgaaattaattaattttaccagcatcatgcacctcggatgtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgcatcgcaaggcatttttcaatttgttaatatcatttgaacgtaagagtatcgagtacagagcgatagaccccgtcaccacacaccggtcgtgcccgatgggcccctggaggcccaggggcctcccccctccttagctcgtaaaggggccagataccccccttcctatac

SEQ ID NO: 39868 - DNA, 79 bp, Chlorella protothecoides
ctgttccagcagatgaaagtgtctggtggcatttcctggccatgcaccttccacccgcgatcatcgagtgccaagatca

SEQ ID NO: 39869 - DNA, 75 bp, Chlorella protothecoides
ctggtttcccaagcacccccagcacaacccaccccacccccacccccccatcaccgccaggcggcgggcccacgt

SEQ ID NO: 39870 - DNA, 61 bp, Chlorella protothecoides
gagtcgtagtccagcagcctctgtgggagggggagtggtcagcgggtggcctacgacatgc

SEQ ID NO: 39871 - DNA, 3683 bp, Chlorella protothecoides
  modified_base (246)..(255): a, c, t, g, unknown or other
  modified_base (316)..(325): a, c, t, g, unknown or other
  modified_base (409)..(418): a, c, t, g, unknown or other
  modified_base (1212)..(1221): a, c, t, g, unknown or other
  modified_base (1518)..(1527): a, c, t, g, unknown or other
  modified_base (2706)..(2715): a, c, t, g, unknown or other
ggcgccgggggggcggtgcgcgccgcgccgccggccaccaagcagggcgtgctgcagtctttcaaggcggagctgcaccacttccgccgcctgcaggaggcgctgcggccctgggtgagcgacttcgaggcccgggccgggcgcaagccaaccatgcaggacgtgcaggcggcgggcgtgccctggctgctggagcggtacaggcactacatcctgctccgccagcgcctgttccacggcgcgggnnnnnnnnnngccaaggccacggccactgaccggctggcggcggcgctggagtaccgatcccggcaggctnnnnnnnnnnttcggtgcgcggcagcctggacggcggcgtggtggccggcgggccaggtgtgtgtggctggggagtgtgcacagggcgctgggnnnnnnnnnncacggtgcgcggcagcctggacggcggcatggtggctggcaggccaggtgtgcgtggctggggagtgtgcacagggcgctggggtggtgtttttgggggggctgcgatgtctcggactgggcaccccaggctcccatgctcactgacaggaagaggcatcacccgtcccacacgccgtcggacccccacctcccccgccggtgcaggcggggcgcctgttccgcagcaaaaccccaagaccaaggccacagccaccgaccggctggcagcggcgctggagtaccgatcccggcaggctgctgccgcgggcggtctgccaggcgccggcggggcggcgggcccggctgttggcggcagggacgaggctgccgcggcggcagagggtccaggcccggccccacccgcgggtctggagcgggctcagggcctgggtccgggtgcctcaacaagggtccggtcggccatgctggctgccatggagtacaaggcgaagagggagcagggcaaagcataggcagctccttgcccgggagcatgcactgcaggtccggcgcgacgcactcagccatgggctgaggagtgaagacggcatgtttgctgtgagagtcagtcgccctggttgctttccacgaattctttatcaatggttttggaccaccatttaaacttttttgaatcacgatctcttcttgtgttggcatcgtggctgtcacaagcaagctcctcagccagcaattaagtgcagagacaccggacaaactgtgcagggtatcactccgctgaagactacctgnnnnnnnnnnttgtcacaagcaagctcctcagccagcaattgagttcagagacaccggacaaactgcgcagggtatcactccgctgaagactacctgagcaaacccttctctccatttcaaattcgtacagccatggtgcggcggctctcgaggagggcggccgataaatttcactgcttcgacaaattgcgaggacgcacgaatcatgtgtgcaatgcacatagtgatcgtgcgccctagctgacttctataaggctggatttcttctcgacatccgttgcagttttgacaatggtgtgctagaannnnnnnnnnctgcaatgaccatagtgatcgtgcaccctagcttacttctagaaggctggattgcttctcgacatacgttgcagttttgacaatggtgtgctagaagccaatcaagaactcaacggttcattcttggctctttggtcacggagacactccggagggctgaagagaagggatatggaaacctcgatgattttcaagcaaccgcgtggtctctctcgatctgtaacacatcggcgtgagcatccgctcgtttcaggaaaattgcggcgcgagtcagccgtcgctggaggggcacggcctgtggatgtgccacggccatcctgggtctacaggagatttgaaaactcgccaacggaaacgcaccctaaacacctgaaatccatcttcttccaaggtaaaacacaccccattctgattgacaagcactccagcagcagctactggaagtactcggtactcctccagcacccccggtcccagtgctcggccattccccagcccattcttgcccgccctccttcgccagatcccgagctccagaggcatgccaccccacatgaattgcaccatggacgtaccacagaccacagaggctgccattgggcggcccagcgtccactcggcaaccaagggtcctcaggcagagcggaccgggctccatgacctgagccctgtcaggcgcgactcccccggcactccctgctgcgccgacatcgtcaatcattcggtaagctactgagacgaccactcttgccatcaatctgtttccgcatgcgttggtggattttcgaaatgcttgtccgttggccgaccaagacaccaccctcccctgcccctcctccgagcagggcgacgttgctgatcgcgcaagccccggcgacagccacgacacggaagatgtcaaggatctcctcccgataacccagctcttgttgaagctgcgctcatcgcacgagcgcaaggaggaggtgagcgggtgcctgccctgcaggatgcggggggtgggggttgacagctgtgaattcaaacagcctcctgggctgaagtgaccgctcaccaactacaactacctatgtatcgcatgactcgcacccccaacgacgtgtgacgatccatccacccagcccctgcccgtcccgcccctctcgaccaacataggaagccgaagagaagctgctggcnnnnnnnnnnttacctatgcatcacatgactcgcacccccaacgacgtgtaacaatccatccacccggcccatgccgtcccgtccctctcgactaacataggaagccgaagagaagctgctggcccaggctgtcgccgaggccgacgccttaggccgcctcctggctcgcagcatggcgtcctgcgccctgcagaaggccctcgccgcggacgcgcaggcagccgcgggtgcgcagacagactcgctgcaggctcagctgcaggccgtgaatgtcaggtcgtgcgccgccgccaagaacgtggcccggctgaccatggagctgtctgccgccaagcaccgcctgggcgtgcagagggtgaagacggaggcggtggactcccagcgctcggcagcggacgagcgccgcgaacgtgcagagtctgtgctgcgcctgaccatggccaaggttgaccgcctcgaggcggagcgagatgctgtgcaggcgggccgcaacgcggccctagcagggctggaggaggcgcagaaggagcgcgacgcggcgatcgcgctggccgcgcgcatgcgcgaggtggcgggctcccgtgcagctgagcgccgccaggcccgcgccgaggcgcagcgcgcgctccgcgagctggaggcggcgcgcgccgaggccggcgaggagcaggcggcggccgatgaggcgcgcgcggccctggcctgggcggagacggcggccgcgagcgaggccggcgaggcgcgagctgaggcggccatggcgcgggaggcggcagccgtggtcgtggcctgtgcgactgcggaggccggcaaggccatcacggaggccaacagggagcgggaggaggctgccagggccagggtccaggcagacaaggacagggtggacgcacgcagggccaggaccgaggcagacaaggcgaaggaggcggccgagaaggctagcatggcggtagcccgagcgacggcggaggccg

SEQ ID NO: 39872 - DNA, 80 bp, Chlorella protothecoides
tcgctgatctgcatgggtggaaagccggtgagtatgggtgtagggcccctcagcagagttggtacttgcctgaacttgtc

SEQ ID NO: 39873 - DNA, 85 bp, Chlorella protothecoides
ccggcttccatatcttgggaagggggggggcagttattgaaggcactttcagtgacagtttgggggggctagaatccatgggtgg

SEQ ID NO: 39874 - DNA, 112 bp, Chlorella protothecoides
ctccagctcgaagaggagctgccgcgcctcaccctcgtccagctcgtagctggcaggcaagccatgcagcttgctcacccaggccttgagcttcaggcggccgggcaggtct

SEQ ID NO: 39875 - DNA, 61 bp, Chlorella protothecoides
ttggacttggggagattgtccaggctcaggtctgccaactggtcagccacggcgggcgtgg

SEQ ID NO: 39876 - DNA, 133 bp, Chlorella protothecoides
accaagctccgctccctgcgcatacaggtgcatggggggggttgagggaggatggggggtgggggtgtgggtaggcagggcctgggaaggatgcggagggtcgcgggcggccgggtgaatccccatgtccaaa

SEQ ID NO: 39877 - DNA, 127 bp, Chlorella protothecoides
ggcctccccgccgccgcccgtgccgccgccgccgctgagcagcgccgcggggggcgggggcagcgggatggcgtgctcggccagcagcgcgcgcaggcgcacattctccgcctccatggcctgcatc

SEQ ID NO: 39878 - DNA, 2894 bp, Chlorella protothecoides
  modified_base (200)..(209): a, c, t, g, unknown or other
  modified_base (618)..(627): a, c, t, g, unknown or other
  modified_base (905)..(914): a, c, t, g, unknown or other
  modified_base (1392)..(1401): a, c, t, g, unknown or other
  modified_base (1465)..(1586): a, c, t, g, unknown or other
  modified_base (1658)..(1667): a, c, t, g, unknown or other
tgggcggggagcgcgcactctggcgccgacgccctctttgtcgtggatgaggaggaggagggcgagggggggggccgggcggggagttcaacctcaccgccgggccgcgcgtctccccgcgaccgtggggagagcgatccgggcgtcggtgcctcgcctcaagaaaccagtgtgcaacacccgcggcaggcgggggcctnnnnnnnnnnttcaccgccgggccacgcgtctcctcgcgaccgtggggagagcgatccggacgtcggtgcctcgcctcaagaaatccgtgtgcaacacccgcggcaggcggggacctcggccacgagcaccccgggcagggcgacgccggccggcgccgtggcgccggggtcgctggacgccgtgcctgagggccgcgcgatgcaggactcggagctgtctttgaacgcgccgctggtggcgcagagcgcccaggacgaagcggacgccgcgaagatggcgcgcaacctcaagtgaggcgcggggggtggggtggggggaggagccctgcactgcctaccgtgctctgctcgctgcatttcctcgcaccgcctgcaggacaacagagtggtcacctccatacccccaggaaaccaagcnnnnnnnnnnggggaggggggggagccctgcactgcctgccgtgctctgcgcgctgcatctcctcgcaccgcctgcaggacaacagagtgccccggggtcacctccatacccccaggaaaccaagctcgtggcagcgggatcgggcgctgagcaacttgtttggcgagccggggggtgccagcccctgaacgcttgattgctctgtgcagccaggagaatgtcgagcggatgggcccaatagatcctggcatgttgggagtccaagccgtgtacaatgatgtttcgtnnnnnnnnnntgcttgattgccctgtgcggccaggagaatgtcgagcggatgggccccatggatcggggcatgttgcgagtccaagccgtgtacaatgatgtttcgtgggagaagaaagcactggtgaacggcatgttctcatgtggcaagaggaaccagagctcccaggggaacagcatgcttgtctaacaatcaccgtgtgtgcagacggggaaaacctagacggtcccgtcagtcccgtcaattgttgatcacgcgcgctcggaattcgaaagttttcgccaacataccaacgtactcgctgatgtacagaaccaattgatcaacgtatgatcagctaatggaatcctgggctcgttgaagtgcggaaccgagactctcaatcgtgtcaccgacaggctacacccggtgggtaagcgtggctgaaagggtgacggatgggccttgggggcattgcatcccatgcacttgtattctgcaagaattnnnnnnnnnngctcgctgatgtacagaactaattaatcaacgcatgatcagctaatggaatcctgggctcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccctcccagcagtggagagccgggggcctgcctccccggctcatagcgctaaggagtcaaggggagacnnnnnnnnnncccccctcccagcattggagagccgagggcctgcctccccagctcatagcgctaaggagtcaaggggagacacagcatctgatgggtctgaggaggacacacccgtatacatgcatgtgagtggacctgcggggcttctggctgggaggcgcaggctggggggggtcactctggcatcatctttggagtatccctctgacacgcccccaccacttcttccaaattgccaggcaacatcctttgcggtgcagcaggaagacgagacctgggagttgccgccctttctgaatcatgtcgacaagccgatgctggagatgcaggtgggacggtgtgcacgcatggcagaggcttcacacccccaagctgacgagggtactgggttctcatgatctcccggcacttgaagtagagattacgtggcaggccccacttccaagtcaccccaggcacagccttgcgtgtcgagccgatccccctgtcatggctgaccccctcccaccaccccacctctcaggcaaattccaatgtctggtaccaagcccacattctgaaccacagcacaacggagctctacgtcctcttcccaggtgaactcttacactacattacgagctgatgcagctggtcctggggtccgaggaatcatgttgtggtgctggtgtcttctgcattcactcagctcgtcaatgctcttggccctcgctgcagccaccaagcagacacccgcgctgcagcagtggatagacaagaggagctcgcgcatctggagggggagcctcgcttccaggcatgtcctggaggggtgggaaatgccagcccttgagactcgggtgctgcctgaggggctggctgagttgcacttgtcaacttcttggctggcatcgagttcttcctgctcttcccaggccaccagtcgaggctatcgtctctcgagcctctgatcaacatgctcttgcaagtgcacgccccagccccaaccaccaggccaggcccctgtgcatttcattgtcaccctgcctccctgcactcatacattcccctctcaccatcccctccacagggcctggaagtacatcaagagccgggacggcgcctgggcgccgcgcggcgagcggggcgagagcagcgggggcgggggcgccggcgccctgatgcccggccccaccctgaccgctggcacggtcccccagccgcgccggccgggcgccggctcctcgtcccaggccc

SEQ ID NO: 39879 - DNA, 63 bp, Chlorella protothecoides
cgcgctcccacaacatgactccccccccccccacccccccctcactaaaatttgcaggcggga

SEQ ID NO: 39880 - DNA, 76 bp, Chlorella protothecoides
gcagcagcacccccgagccaggtgggggcgtgggcggcgccggcgcgccactgctcccatcatgctcgtcgcacct

SEQ ID NO: 39881 - DNA, 9867 bp, Chlorella protothecoides
  modified_base (102)..(282): a, c, t, g, unknown or other
  modified_base (4525)..(4534): a, c, t, g, unknown or other
  modified_base (4980)..(4989): a, c, t, g, unknown or other
  modified_base (5514)..(5523): a, c, t, g, unknown or other
  modified_base (6435)..(6444): a, c, t, g, unknown or other
  modified_base (6856)..(6865): a, c, t, g, unknown or other
  modified_base (6968)..(6977): a, c, t, g, unknown or other
  modified_base (7233)..(7276): a, c, t, g, unknown or other
  modified_base (7497)..(7506): a, c, t, g, unknown or other
  modified_base (7963)..(7972): a, c, t, g, unknown or other
  modified_base (8563)..(8572): a, c, t, g, unknown or other
  modified_base (8676)..(8685): a, c, t, g, unknown or other
  modified_base (8844)..(8853): a, c, t, g, unknown or other
  modified_base (8964)..(8973): a, c, t, g, unknown or other
  modified_base (9355)..(9364): a, c, t, g, unknown or other
  modified_base (9593)..(9602): a, c, t, g, unknown or other
ccccgcctctgcaacccgcctacttcgccccgcctttgacactcgccctgtcatcgtcaatctcgccccctccctcgatcacaaaatacacacacccatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgcgagttcagggccgccaccacgtcgcggatgagccgcgccagcgccgcgccgtccagcgcgcggccgcgcaccagcttgggcgcggcggcggcggccacgcgcgcctccagcgcagcgcgcgccgcgcggtaccccggcgccagctcctcgtcggccaggccgcagagcgcggtgcggtccaggtggggctgcggcaggcccagcgccgaggagttgcgggccagggcgtgcagcgagacgcggatgcggttgagctgcgtcagccccgggtcgcgcgccgggttgggcacgggggccagcgccgccgctagcgtctcctccaggctgtcgccctggagaaagtcgcgctggatgagccagagcatggcccccggctccagggccgtcgggggggaggccaaaccgccgggctcccggccagccgggtcggcgtagaaggccttggccagctccacggcaaaggacaggcgctccaggtccgactcgcggatggcctccggcaggttgtacaccagcacggcgctgatgaccgtggaaagcgcgaatatgcggtcgtcgtacacgtcggccttgccggtgctctcgaagccctccgtgtcgaagaagagcagctggggagcaggagagggtggggggttgctgggtgggtgcttgtgggtggatggggagaggagtgcgggaggcagatggatgcagaagaaacaggtgtgtttgtgaggggcgagattgtacacccagcgcaggagtagctgggggtagaaggagccggggtagaagctggccagagcgcctggcagcctctcggacttgtcaaccttctcagtaggatcagatctacccacacccatgtcaagcagggactgaagctcgcccatacaccccctccccacctgcactggatcgccctttgcgtccagccgctctgctggctcgccccacatccacacgcccttggtctgggtgtgcctgctgtgacccacaccgaagccttgatctggaaggtgtgaaggagggtggcacggttctagacctgcctccacctacctaccagatgaggcacacagtgcatcacactcagatcctgagccagaccatcaacagcgcagcgtaccgcagggcactcccatcagctgattgaggaggaaagacttcccggagcggtagggcccgatcaccacgactggggatactggaccctggatgccctccagcaccgccaggccagtctcatccagctccagcttggagtgatcagcaacaggcctcacgaccgcaaagctgcaccgggcaaagtatggttgatctgtctaccaaacaagttgaagcatcctcatgtgcaccatgcgggtgattggagggtccaccgaccacatcaccgcacgccaccactcacggcttgttcctgccctgctcggcaacaacgacgacaggtagactcgcatgcaggatcagggcgagcaagcatagccaagctcgcaaacttggcatgctagtaagcaattcgagccgtcgatccggctcagatcgaacgatcacggagccactcgggtcacagtcgacatggcgcaaccacccacttcccagggggaaggggcacgtaagcgggaaagacctccaccagacagctcgaagatggaggtaagtctctcttgagtttattctgtggtatccgtggggcacctgctccttccgcatatctgtctcgtgccctcgtcctcagcgcgcgcttggcattccgattggggtacggcaaatcagagtgatatgttggacgcattccaaggacaggagagcgaatgcaacagacacttactgagtctgtaatcacatcagacaatcttaacacagatactgctgctcccgagctctctccgtgtacccgcccccaaggcgccatggtggacgcggcacccaccctcgtggaggaagtctctgccccagagccttccgtggaggcagaggccgcagcgcccgagcagtcgaagagcgctaagcgccgggctaagaagaaggccgcagcagaaaacgctgcagccaacgacggggccggggctgagggcgccgaggtcccacagcccgggacgcccccagaggaggaggagggtgcaggggctgccgacagcgacgaggagccagagaccccctcggtaggggatgtggtgaccaagaagaagaagaagaagagtgagttgtcagagctgggtggtaatgagtcaggatgttgcactggtgactggtcacatgcatgtgggctgccatgcatacagcgcggcaaaccggcacatgtggtgtatcttgatgattcgcctccctcctttcagacaagaagaagaaggccggggctagtgcgggggccggcgctggggaaggagccgcagcgcccactgagcagaccgaccctccctccattcccatccgcctgctcttccccagcggcgtctaccccgagggagaatggcaatcttacaaggaggagtgagtttgcgctcgaggttggcacgaggtgcctgtatcaccgtttgtgatggggcacagcttggtgcaggtcgtccaatgaggtttgacctctccacgcaacaaagtttggggatacacgcccatctggtatcctttcacatggcgctcaatgtttctgcgatctcagtgtttgagcagcttccatgttccaacacccccacacccattgcccaacagccagctgtggcgcgagaccagcgaggagaagcgggcgctggaacggctggggaaggatgtgatcaatgaggtgcgccaggcggcagaggtccatcgccaggcaagaaagtacgtccagagcatcgccaagcccggcatcctcctgtccgacatgtgtgagaagctggagaactctggtgagtggggattcgatggggctgttgaagggttttgagaacgagaatggagagggcaggggtactgttattctgtcgggcccatgtccccaacaatgccgagttgagggagtgaaagttggaggttgtcttcaaggtgtaagagtctcctagagcacacactctgctcctctgtcgtccgacgctggacccccaaccctcacccacccaccccttcctccacaccaatcgacccccagtgcggctgatgatcgaggagcggggcctggcggcgggcatcgccttccccaccggctgctccctgaaccatgtggcggcgcactacacccccaacgccggggacaagacggtgctgggatacgacgacgtgatgaaggtggactttggcacgcagatcaacggccgcatcatcgactgtgccttcaccgtggcgcacaacccgcgttacgcgccgctgctcgacgcggtgcgcgcggccaccgacgccggcatccgcgccgcgggcgtggacgtcaggctctgcgacatcggcgcggaggtgcaggaggtcatggagtcgtacgaggtggagctggacggccgcaccttccccgtgcgcgcggtgcgcaacctgaacggccacagcatctcgccctaccgcatccacggcggcaagagcgtgcccatcgttaagggcggcgaggccactcgcatggaggagggcgagttcttcgccatcgagacctttggctccacgggcaagggctatgtgcgcgaggacctggaggtcagccactacatgaagaactttgatgtgggccacgtacccctgcgcctgccccgcgccaaggccctcctggccaccatcgaccgcaactttggcacgctggccttctgcagacggtgcgcagggtttggtgtgtgtatggggaaggggtccacgatactggtgtctggaatcatggggtgtgtcctctgcagcccgagatgccactctctccttttcacactgaaacattcaccccccatccacaaccacgagcaggtacctggaccggcttggggaggaaaagtacctcatggcgctgaagaacctgtgcgacgccggggtcatcgacccttacccacccctggtggataacaagggctcatacgtcgcccagtacgagcacaccatctacctgcaccccacacgcaaggaggtgctgtcgcgtggcgatgactactgatcatttgtgattggctacagtggaggttgtgatgtctccagcttgcaaactttgaaaagttggctggctgcaagatgtggacacgtggggtctgctgggcggaagtagcccgtttgcacatattcctgaggctggatgcccccacttgcttgctcctcnnnnnnnnnntacacgcaaggaggtgctgtcgcgtggcgacgactactgatcatatgtgactggctacagtggaggttgtgatgtctccagcttgcaaactttaaaaagttggcaggctgcaagatgtggagacgtggggtctgctgggcggaagtagcctccttgcacatattcccaaggctggatgcccccacttgcttgctgctcactcaagctgccgctttgtcccaagcaaagcgtcatgcctactgtacaacaaggtgtagggaaaaccacacaagggcacatcatggagttatatagagcctggagtagacatgttggtggatctcagcattggaaaagggagccgtttcaggcagtggcgaggaggtatcatgttccctgtcttcaggctgttccacaccagttgccccagcggggccccagccagaggtcagtccttggcctcggtnnnnnnnnnncccctgtcttcagggtgtcccccaccagttgccccagcgggggcccagccagaggtcagtccttggcctcggtcacgccctccggcccgatgccaaaggtggcatccgcctccggcagggacggcgaggccatgatcttggcgatgcgcgtgtccccccgccccttcctcagctggatgcgggtcgtggaggcgtgtgccatgatgttgccgccgatgggcttgacggaggggcccgcaaacatgctgccgccatccaggttggcctggaccacctggttggtgatcaccacccccaccccaaactcgtcagccaggcgctgcaaggagcgcaggaatcgacccaggtagttctggcgcgccgccaactcgccgcgccccatgtactccgacctggcgacgagttggagtggcggaggaagagattggttggtggtatgcaaggcgatgtacacagggggatggtgcgacccagactgctctgggatggagacattagaaccaagccaaggctgccaacccaaannnnnnnnnnagttggagtggcggaggaagaggttggctggtggtatgcaaggcgatgtacaaagggggatggtgtgacccagactgccctggggatggagacgttagaaccaagccaaggctgccaacccaaaaccgtggaccccacactccatcacccatatctcgacccttccaacaacaacaacccaggcgcgtgcctgaagagcgcggtggcgctgtcgacgatgaccaccgcgaaccggctctccgtcatcatcgcggcggcggagaggagcagcgcctgctgatgctccgtgttgtgtgcgcgtgcatatgccacgttgtccagcacatcctgggcattcagtccatacctggatcaaggaaaggaggaatagggcggtgtatgagattgaggcagtggtctggagggagggcatctcatattcatgtcactatgacattcaacatggacaagcaatgacacgttgatgctatgcctcatcgtttggtcacatctctggaaaacaaccccccccctctcacctctctgcaatctggacgagtcgctggggtctgaaggtgccctcggtgtcaatatagagggccttgccctcaccgccgcccatgtccacaggcagctggcaggtgacgcaaagggtgtggcacagctgggttttgccgcagcggaactcgccgtagagctcggtgatggatcccgtctccagcccgccgcccatgatctcgtctagggccttggacccggtggtgagcttgatgatctccccacgctgctgcaggatctggttggccgtggtgaagccggtaggaacatacttgtgcgctgcagtggaggatggacagggatcggtgatcgatgcgacgggttgcaaactgtcagagacagacagcgcaaggaagtcaggcctccataaacagnnnnnnnnnnagaggatggacaggaatcggtgagcggtgcaaggggttgcaaactgtcagagacagagagcgcaaggaagtcaggcctccataaacagcatacaaagaccatcgcatgcaggcagacgaaaggttgaatccccaatcatcctcgcaccgatttccttgatcttggccaccttggcgtcgctcatgcccttgatctcgcacagctccctcttgctcgcaaacgctaggctctcgatggtgttaatgcctccctccttgagcttcttgatgtccaccgcggcgacgcccagctcctgattcagaggtgacatgtccggagtgagagcaagatcccgaagccctggaaattgcagcacaagcaagggcaggcagccaagcacaatgcaccactcaatcccagccagtcactcacnnnnnnnnnnccggcaggggatgctcagcgatggcctgtgacgcgctctgacgccgttatataactaaacgatgaagtttaatgatcaagtagactctcattcactgtaaggnnnnnnnnnnatagaggtgccatgcccggagtgagagcaagatcccgaagccctgaaaagtacaccacaagcaagggcaggcacccaagcacaatgtgcaccactcaatcccagccagtcactcacctggagcgactcgatggggtaagggcccgagttttcatcgttctcaacttcctgcactgcttctgcggggcgttctgcttgcatgatgctcgaatgtggggcgggggtgcggggagcaggggtgtgatgtcggcgagcgnnnnnnnnnnnnnnnnnnnnnnnnnnnnnnnnnnnnnnnnnnnngggagcctatgagagctttcgacatctgtcatgctgcgacatgctctgcattcggaactttcaaggcacccccgggcacagcacgctcgcgcccccaggcattgaccactcatggatgggtttggtggcatgcacctgttctcgagagacagggcacatcgtaatggagccatcaatactgattgagtatatcatgtccttcaagaccacgttccaatgcnnnnnnnnnncgtttggtagcatgcacctgttttcgagagacagggcacatcgcaatggagcggtcaatgctgattgagtaaatcatgtccttcaagaccacgttccaatgctagaatcggagcacgagacgcacacctcgccgtcctccggtcaccaggaggtggtgtccgatgaggacacgatgtgcgcatcgccgggatatcacacaccagattcgagctccgagatcaagatatacattcaaacttcgagatatgccgtcggtgcgtagtaagtgcacaggcatgcagaacaccatggtgttaacattcatgactcatgcccgctaaatcggacacgcagtcggccatgcggtggcggcactgggctggaagcagtgcaggacgctttctgatgcagacatggtgtggaatgacactccaggaaatcgtcgcgtgcagagctcgggcagcaagccccaggtgnnnnnnnnnncgcgcgctgcggcggccagcgcagccgccaccaggggtcgcttcacctccgcgtccgccgccgtgtccaggcagagggagggtgaggcgttcacctccagcagccagggcttgagccgggcgtccaccagcacgtcgtagcccagcagctcgtaggcgggcgcggcgcccgggcgcggccgcgccgcgcaggccagccccggcgccaccgccagcaggctcagcgcgaccaggtcgcgcacgcggccccacagcgccccccagtccaggccgcggctggacatccagtcgcggagcgtgcgcagcgtccacttgtaggcgccgccgccggccgcgccggaccccgccagcgcgcgcgcgcggttgaccgcccagttggtgaggtgggcggtgtcctggcccaggctgcgcggcgtggggggagcgtaggcctgcgtgcaccgcctcaccaggccctgcgagggtgaggggtccgttgtttgcccatggtttgggcaggtagggggcatgaacatggaatcagcaggcacgcaggcaatgaaggtggcgtgctggcggaaggagggtcttttgggagagtgacacaggctcnnnnnnnnnngggagggggttagcagtactcttccattgacattcatccgttgtgaatctccaatgtagtgcttggatcagtttaggcgtctccctctcatctacgtcacacgnnnnnnnnnnaggaggagggtagcagtagtcttcaattgacattcatccgttgtgaacctccaatgtaatgcttggatcagtataggcgtctccctctcatctacgtcacacgattcaccagaattggacatgtccatgccctctcaacactctcacattccctccccnnnnnnnnnntcctctgccacccatcacagctttcctccccactctgcaaccttccacccccctgccccctgcctataaaacacacctctgtgaagatgctgacgtcgaggggtgcggtgnnnnnnnnnngtacgacttcgtaccgcgcaccctgctgctgccagagcagctgccggccctgctggcggcactggacgagaacgagcggccggggcgcggcgccccgctttccaccttcatcctgaagccggacgccggcagccaggggcggggcatcctgctggcgcagcgccgcgccgacctggaggcctggtgccccgagggcggcggcgtgcccgccggggtggcctcacgctacatcgagcgcccgctgctgctcggggacagcaagtttgacctgcgcctctacgtcctggtcctgggcaccgcacccctcgacgtcagcatcttcacggaggtttgttttatcaggcggggggaaggggggtggaaggttgcagagtggggaggnnnnnnnnnntggcgtccggcttcaggatgaaagtggaaagcggggcgctgcgccccggccgctcgttttcgtccagcgccgccagcagggccggcagctgctctggaagcagcagggtgcgcggcatgaagtcgtatcgctccggcatgacctgggcgagcctggccaggttgcgcgccagccccttctttcgcgtcagctcggccatgccgggcaggtggttgctacactgcggggnnnnnnnnnnggagctgtgatgggtggcggagggtttcgataggggaatgagggtgtgcctggcatgctgcagctttttggacggcagttcagtatccaagctgtgctggtgggccggatctgtcgtaattggccgctcctcgcatgagctgcaatgtcctcgagcctgtgtcactctcccaaaagacccttctccttccgccagcacgccaccttcgctgcccgcgagcccgccgattccatgctcatgccccctacctgcccaaaccatgggc

SEQ ID NO: 39882 - DNA, 61 bp, Chlorella protothecoides
gtcttttcttctccccaaagcatcccaccatgaatgtcaaccgaagcaacccatgtcctga

SEQ ID NO: 39883 - DNA, 134 bp, Chlorella protothecoides
ctgcctcggggatcccactgcatgcccgggactggagcgacgggggagactgtggagctttggggcgaggaaagcgtaggagatcgtaccctgcccagcaggctactcgcatcccttaaccacgcatcccaccc

SEQ ID NO: 39884 - DNA, 145 bp, Chlorella protothecoides
gccgcagcctgccctgggactgcggtggaagagggggggggggctgtttgagggagggggcccgagttgcgctcaggagagggtccacgactgtggagactgtgacccagggtgcgcagcactgctcacaggaagcatgcagggg

SEQ ID NO: 39885 - DNA, 70 bp, Chlorella protothecoides
gcagccccggggtcaaaaccccggccgcccccctcctcgatcccgggcgctggcctcagctccaagcggc

SEQ ID NO: 39886 - DNA, 79 bp, Chlorella protothecoides
gagtatctagccatgcttcggctcgcgggttacagagcgccgcgagaggacacttgggaagaaaactggcatctgcgat

SEQ ID NO: 39887 - DNA, 115 bp, Chlorella protothecoides
ctgaaggtgcggggcagcacaccaggacccagaggggaggacggcagggtgcaaggaacagcagcccaccccacagccaggcacacccaccatgcagggccgctgatatgccggc

SEQ ID NO: 39888 - DNA, 61 bp, Chlorella protothecoides
ttccccctttccaggccgccacggcggtgtctgaggcggaggagcgcgccgcggacgcgga

SEQ ID NO: 39889 - DNA, 61 bp, Chlorella protothecoides
catccccgcgaatccataggcgatgctatcggtctgtccctctcccgattcctgcaggggg

SEQ ID NO: 39890 - DNA, 66 bp, Chlorella protothecoides
ggacgctgggcccgagatagaatgcaggggcaagggagactgcacggctgtctttcctgcatgaaa

SEQ ID NO: 39891 - DNA, 632 bp, Chlorella protothecoides
  modified_base (124)..(192): a, c, t, g, unknown or other
gcggcgtcggccggcggcagcgcgcgcgccagcggcgcgatcgcctcggccgccaccgcccgcacgtcgtcgtcgcggtcctgtgggccaggaggaaagcgcggcggggggagaggggcacgtnnnnnnnnnnnnnnnnnnnnnnnnnnnnnnnnnnnnnnnnnnnnnnnnnnnnnnnnnnnnnnnnnnnnncagcggcgcgtcacggagctccgccacaaagcttgccgcagcgcctccactgccccagatgcatggtccagcaattccctggccaggttctccactcccaaaatccaggcacctggtccatcctcagcctggctcttgaaacccccccctcctttcccccaccccacacacactacactacacaccttgagggcggccatggcggcggggaagacgaggtggaccaggtccccggtcgccccctccccccggcactcggccatggccgtgacgacgcagcgcaggcccagcacgccgccgtggcgcgcctgccagacgtcacagcgcgccagcgcgcacagcgcgcgcagcagggcccgcaggcgcgcggggcccagtgcggggcagagcgcgcccagcgcctgggccgcggtctcccgcgtcggccccaccgcgccgtc

SEQ ID NO: 39892 - DNA, 62 bp, Chlorella protothecoides
ggccatgccgtgattgcaggggaggggagcgagcaggagggtgagttgggaggttgcactgg

SEQ ID NO: 39893 - DNA, 70 bp, Chlorella protothecoides
aatcaccagtcccaccccggcgatccggggtgggactggtgatccacctccgacaaccccggtacggcat

SEQ ID NO: 39894 - DNA, 69 bp, Chlorella protothecoides
gacagcagtgagctgctgtggctttagggcgttagtaaccacagcttctcacgaataggctgcacgagg

SEQ ID NO: 39895 - DNA, 108 bp, Chlorella protothecoides
ggggccgatcgcgcagtccgcctcgagggcctaatctgatcacggcgcagctgcaggacgggcgggcatcgaccaccgccgcgtccgtccacgagacagcaggtgtga

SEQ ID NO: 39896 - DNA, 115 bp, Chlorella protothecoides
cccagcctggagggccccggggggtgggggcgacgcgggcgtgccgggctggcgcgcacgccacccctcacgctgggtcccggtcgaggtcaggggcgggtacaccctgcgcggc

SEQ ID NO: 39897 - DNA, 61 bp, Chlorella protothecoides
cctttcccatcttttgtcgtagggatgacacggccaatggtttcaggctgcactgctcctt

SEQ ID NO: 39898 - DNA, 73 bp, Chlorella protothecoides
ggccgccctcctcttttgctagcggattgctggcggcaagctccacacctcttgggacagccgctgcccggct

SEQ ID NO: 39899 - DNA, 66 bp, Chlorella protothecoides
tttctaatcagaggcaactctccattacttgaaagtttactgtaatgatcgaaattaaatatacat

SEQ ID NO: 39900 - DNA, 70 bp, Chlorella protothecoides
caatcagtatcaccgccgcgacggacagcgcccaggcatcgcggggggggggggggggggggggggcccc

SEQ ID NO: 39901 - DNA, 417 bp, Chlorella protothecoides
  modified_base (112)..(297): a, c, t, g, unknown or other
gcggaagacggtgagggcggcggagagctcaggaaggctgtgtgtttttggaagggtactacttggtgatgtagacgctatgggcttggaggcgtcatgattgctgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagccatctgcccttcccacatcgtctggacacagcaagcctgcaacgagtcaggcagatggaatcgcgcacagcaaggctgcaccattgccagaggcagcgggtgctgtggagggacc

SEQ ID NO: 39902 - DNA, 106 bp, Chlorella protothecoides
gccgaccccgcgcgccccagcgccgccgcgggcacgccggcggcgagctcgacgtcggctaccagggcgcagacctccgccagcgaggccggtcgcgcgtccgcga

SEQ ID NO: 39903 - DNA, 64 bp, Chlorella protothecoides
tgccctcccagtccagaatctgggcatgcaggggcgtagccccattcgattccactccccttcc

SEQ ID NO: 39904 - DNA, 86 bp, Chlorella protothecoides
cagcgcccccgacctccaccctccaaaccacccccttccacccagccagccagcaaccccgcacctgcacaggctcgctgacccag

SEQ ID NO: 39905 - DNA, 74 bp, Chlorella protothecoides
cctccggccgccccgactttgccgccgtcctgcaggctgcagccaaggagacgggcgccaagcatgtgggagtg

SEQ ID NO: 39906 - DNA, 61 bp, Chlorella protothecoides
gtgggcgtggaggctgggtgcggcgcgctcacccggcgcgtggcccccagctgcggccgag

SEQ ID NO: 39907 - DNA, 16679 bp, Chlorella protothecoides
  modified_base (426)..(435): a, c, t, g, unknown or other
  modified_base (816)..(825): a, c, t, g, unknown or other
  modified_base (888)..(897): a, c, t, g, unknown or other
  modified_base (1068)..(1077): a, c, t, g, unknown or other
  modified_base (2251)..(2260): a, c, t, g, unknown or other
  modified_base (2644)..(2653): a, c, t, g, unknown or other
  modified_base (2950)..(2959): a, c, t, g, unknown or other
  modified_base (4287)..(4296): a, c, t, g, unknown or other
  modified_base (4892)..(4901): a, c, t, g, unknown or other
  modified_base (5342)..(5351): a, c, t, g, unknown or other
  modified_base (5615)..(5624): a, c, t, g, unknown or other
  modified_base (6441)..(6450): a, c, t, g, unknown or other
  modified_base (7522)..(7531): a, c, t, g, unknown or other
  modified_base (7633)..(7794): a, c, t, g, unknown or other
  modified_base (7877)..(7886): a, c, t, g, unknown or other
  modified_base (8273)..(8282): a, c, t, g, unknown or other
  modified_base (8738)..(8747): a, c, t, g, unknown or other
  modified_base (9346)..(9355): a, c, t, g, unknown or other
  modified_base (10447)..(10456): a, c, t, g, unknown or other
  modified_base (13116)..(13125): a, c, t, g, unknown or other
  modified_base (13633)..(13642): a, c, t, g, unknown or other
  modified_base (13791)..(13800): a, c, t, g, unknown or other
  modified_base (14495)..(14504): a, c, t, g, unknown or other
  modified_base (14700)..(14709): a, c, t, g, unknown or other
  modified_base (14906)..(14915): a, c, t, g, unknown or other
  modified_base (15123)..(15132): a, c, t, g, unknown or other
  modified_base (15821)..(15830): a, c, t, g, unknown or other
  modified_base (16355)..(16364): a, c, t, g, unknown or other
cgtggggccagcagcgccgcggcggcggccaggcccgccgccgcgccgccggccacgcccagcgtcagcgccaggttcgtgcgcggcagcagcgccgcgcgcaggaaggccaggctgttggagtcggtgcgcgcgtacaggtgggacatgagcaggaaggccttgcacgcgccagggtctgagcggggggtgaaggggtgaggggtgagcgagcttgtatgaggagaggggtgcctgggagtttgcgactggaggcggaaaccttggatcagtgccccgcggcatgcgtccagatccaggctcctggttcgcagaggcggcaagtgatgccgggcaagacggttgccacttcacacccccttcctccccctcccgaggctcgcaagccagcccacgtatgttacctgcttgcaggcggaccagcannnnnnnnnnttcgaggggtgaggggtgagcgagtttgaatgaggagaggggttgcctgggagtttgccactgcaggcggaaaccttgatcagtgccccgcggcatgcgtttagatccaggctcctagttcgcacagaggcggcaagtgatgccgggcaagacggtcgccacttcaatacccccttcctccccctcccgaagctctcaagccagcccatgtatgttacctgcttgcaggcggaccagcatgtcttgggcggtggcggacttggagtcggtgaccttggccacgagctgcgtcatcgcgtacgacatcatgcaatccaccatgtcggccgaagtccaattatcagctaggggttgagagggggggggggggggggggggggnnnnnnnnnngggctggcaggtcagggcaggctgcgcatgcgattgccctgacagagaaccccagcatgctgnnnnnnnnnnggggccacaaaggactggcaggtcagggcaggctgcgcatgccattgccctgacagagaaccccagcatgctgctgtccggaccacgctcgccattcaacacctttcaccgccgctacttgctcacatgaaactccagacttcccccttccacaatcccccatcaccgcannnnnnnnnnccaacttgctcacacgaaactccagatttcccccttccacaatcccccatcaccgcaccgaagctggcgtcccagttgtcatcggtgcagccggtggactcctgaaaggtgcgcaggcaggcggtgaggtggcccgggcgcgacaggtccacgatgaagtggccgcgggacacgccgctggccctcacggactcgttgtgctgagcataagccttctgcatgctcagccggatggtggtcttgccgcttccccgcctcccgaagaagatgtaggtggtctctgcacgcagggcatgggaaatggctcgcactggggtcgtgaattcggatactcattccacattataacctgctgggcctcttccttcacgcaccagagggggtgaagccatgcaggtcggagtggacgtacagggacaccgggtccagggaggtcttctcggcggtgcgatccacaaacggattgcgtgcgagcccaaactggcgcaggaggtcggtgtgattgccctgggccatcctgacggactcaagtgcctgatcgcttcagcgcatgtgccgggacccccaacgtcgtccgagaggctatgccgacaatgcaggtgatctggctttgtgcttggagatcgcatatacctgccaggcatgtgcatcccgcctggccggggcaaggccctgcgcgcatggtgacggggacagggtaccgagaagaaagctgggtgaaatcttctggctctgacgatgttgttcaaggggagcctgggcctgtcgagctctgacatccgggttacaacagccgctgtgctcgagttgcatgaagtaaggcgttgttactcctccgtgaatacacagcagagtgcgggggagccggctcctgtctatgctccattgcgggacctgctggtcgagtgctataggaggccgggataccgaggccagggcgccatgagcgaacagagcgccctggctcccgtggcgaacactgttgtagagattctttcagacacagattcagaagacgacgcgctgaggatacgggtgagtggcaggcccagagcggaggttgggtttctttgccgggcatgcacacgcctggtcctgattcgtggctgccctacctgccccacacagcagagaagggtgccaggagagttctctgggaggtcccacggcgttnnnnnnnnnncagtcctgattcgtggctgccctacctgcctcacacagcagagaagggcatccggagagttctctgggaggtcccacggcgtttcggtgccaagcacggtgtcccctccgctgcggattcgtcgagtggtccctccccggccctctgtccatgaggtggccctcgacgggtcgcctcccgcgtcccaggaggacctagtggtcctctcctccactgtagtccccgtgcagcgccccgccttcaaacgccgacgagaggggtctggctgggggcccctgaagctgccggctgtgccaagggccaaggcggctccacctgaactccagcaggcagtgctcgatcccgtgcagcccgggcccaagtgcggcatctgcatggagcccnnnnnnnnnnccccctgaagctgccggctgtgccaagggcaaaggcggctccacctgaactccagcaggcaatgctcgaccccgtgcagcctgggcccaagtgcggcatctgcatggagcccatgggagggagcactgggagaagtatggccagtggaccttgcgggtgagttgttgaggagttgtgaccagaggctgctccgacgaggggtggaactgggaaccgcagagaaggggtgctgttaaagtcagtctagcatgcagcccttccttcacgcacgcctgataccaagcatggtcgccaccnnnnnnnnnntgggtgagttgctgagaagcttgtgaccagaggctgctctgacaaggggtggaactgggaaccgcagagaggggtcgctgtgaaagtcagtctagcatgcggccttccttcatgcacgcctgataccaagcatggtcaccaccaccccactccaccacaggcatgtatactgctcagcgtgtctgatgagtgccatcaaaacacagaaacggtgcccgacctgtcgaaaaggcctcaacccacgccaaatacacaaagtatttgtgcagttctaggagttgcgtcgccactacagacttgggagcgcggggagatgtctctgcctctgtcaagaactgatgtaatatagacaggctgaagccgactctactttgctctccaggttgcccttcgagcgctcacaaaccaccgccagatgagccgctcatctcacagatgtgtgacctgcagtctcccagactcccaataggtttcgagctctcgagctggtacgtgttcaccaggacgaacctgttacaccacaggagagtgcatggcatgatgcatgcccaatccagtccagcaagacattgagggggaaccgctcagatgcccagcttggtgcggcgccagtgcctccgcttggcgttgtacctaagcgcgaaacggggaaggagaggggttatagaccagacctcgggccagcgggaaataactccttcacccggtgggtggtgcccgggcctacgtccccggctaccaggctggcaacgactcctcctcagcccatactccgcagctcccttgtatttagtttcctgcttaggatgcagcactcaccggatcttgttgtcggtcttgaagcggaaccacggcgcaatgggcctgttctgcttggccttcttggccagcttcttcttgatggcgaacgacttctgggacggctgcaaaaagggaagttaaagagcgttttgagccaatcactggatgctctaagcgcagtcagggcctccagcagggtcccgaccacgccaggccctccttcgaggccgcacggtgcgccaagctaagagcggtgtgtctccgccccccgtatgaccagcaacgcaccatcttgaccagtttcgccggagagagagggcacactggggtcgatttcctctatacgagcaccctgcgccatggcggcctttgcgcgttctttcctcctacctctcctctccacagtgtaggcgcaagatcggtgaaggggggaaccgcccatcccacatcgaaccctgtaaaaacagatagggaagtaatcgtcagtagacaacattatcgattacattacactgtatatctccctnnnnnnnnnnataggcgcaagatcggtgaatgggggaaccgcccatcccaaatcgaaccctgtacaaaaaaccagtgaagtaatcgtcagtagacaatactatcgattacattacactgtatatctcccttggttactgggaattgcaggtacatgctgtttgacgaccatggctgaatgctactgaggaagtccaaaactcccatcacacacttctcacttcccaatcatctgaatggctctccctaatccccctccagcagaaggactgccgagatttcattagttgagaagtccatttctctgtaacttcctcctcgatcgtctgtccatgttgggccccacactcgaatcttctcgtcgaatcgcatgacgacgtgacgccgtgatcggcgtcgacaagcctgcgttaggaggcaattagaagggataagcttgttagttacttcctccatatcacgccaatgtccaaggcagtcacacagtgcgctctcaccgccggtcccgacagcgggcgcgcaccagtccgtgcacgatctgagctgaggggtaggggttttcagagccccattcagcgccctggtagcagagcgcagtgcatgaggnnnnnnnnnnttttcacagagcctcattcaacgccctggtagcagagcgcagtgcatgaggggcagccttcgcgtccgagcaggtagatgcatggagcggtgggtcggggctgctcgcccggtgtttatggggaatcagctcggtggtgaccctgtgctccccatgcgcgcacccctcgcagccgagggcgagtcaggccgacagccctgggaatttggaaggttcctgcgcaccgtcaccttcttcaaccccctggacaagatgctgaaggacctggtcttgctccccacccgcctgctattcaagtccaatgtcgaggaggaggtgcgaggggtgctgcagcatgtcgttggaattggggcttggttgaaggggtgaattcctccctcgcccgcctgctcctagcagctagcacctcaagcctgtggcgcgggttcttggcacctgatnnnnnnnnnncggctccccacccgcctgctgttccagtccaatgccgaggaggaggtgcgagggttgctgcagcatgtcattggaattggggcttggtggaaggggtggcttcctccctcgcccgcctgctcctaccagctagcacctcgagcctgtggcgcgggttcttggcacctgatggccttgtgccgatgacgtcctacattcccctgaggcctacgtctcagcttcccctgtcgtgccccctccgccacgcagtcgccagcgccctcnnnnnnnnnnttgcgtctcagctttcccctggcgtgcccctccgccacgcagtcgccagcgccctccgcagtcaagctggtgaacgcggggcgggagggccccggcccctcaggaccagccgtccttctcctgggcgccgacagcgacctgggcgcccgcctggccacgaccctgctggaccacggcaggcgtgtccagatcctggaacctgccgccgcccccgccctggtatgtgctggggagcgctggatccggggcagtggtttgtaagaggactgaggtcctgcagggagggggaatgcctatttggtgtgttcttaccgccatgacaacacaccatgccctgcagccacccccccccaaacaaccatccacccaggcctcgcactccgcctccggccccggcaccgttgagctggtggaaaacgggaacggcctgcagcctgggcagctcgcggacgtgcgcttcgtggttgccgtccccggacagggcgccgagcgccagctgcgcgccgcgctctccgcgctgagcggcggcgacgtgacgctgtatgacgcggctgcgggagcccagggcgagcccacctggggctcgctggacgacgtggtcatgggcggcgccagccgcagcgcctggagctgggaggatgctgggggcgagggcggagaccgccccgccggcgtgttctccggcgaggtcaccaccgccaacagcggcggctttgcctcggtgagaatgataaatatgaggggaaggaggtatcctgagcaagagggtggggtgaaatgggttgcatgtgttgatgagccgaggagcgggctgcannnnnnnnnnaagaatgataaatatgggggccaggaggtatcctgagccagagggtggggtgaaatgggttgtatgtgttgatgagccgaggagcgggctgcaaggccgcatgggacgtgcgtagttgctggcctatatgccaccgtacccttccccatgtcggtcacatggtatcatcgccccccctcttcccatccccgccaggtccggacgcgcaactttgagccggcgctggacctgcgtggccagaccggggtttccctgcgcctgcagggcgacggcctgcggtataagctagtactgcgcacggactccaactgggacggcatcgcctacacctcgtacctggacaccaagccaggtcggttggtcaagggcaaaagggacatgggtcggggtgcaggccgtagggacgccgactgtgcctggccgccacaactctgcgcgccctgccgcctgacatccacactgcctcaccccctctatctcactcaccgcctctcgttccgatgcacgcaggggtgtgggagacgcacacggtgcccttctccagctttgcgcccatcttccgggccaagacggtgcctgatgcgcccgcgctgcagctggagcatgtgaacagcgttcagctcatgctgtccaagtttgaggccgacggcgcgctaaacccggccttcaagaccggctccttccggctggcagtgagctccatcgcggccaccggccgcacggtgagtctggcgcgtggtgcctgggcgggagttcttggattggggtggggtggggttgagaagaccggaggccagggagtgcttctcttgcaactcccttggggccgtggggaggcgccagggcccgggccatgccagcggccctgaccatgataccatgccatcccccatccatcgtcgtctcattccccctttctcggcgcagggcggcgagtcgcccaagcttgtgctggtacagactgacgggcagggacagcctgggctggacctggcgggtgcgaggcggggaatgagcatgggaggcgcttgcttgcaggcagattgtttgtggatgacaagcacaatgccannnnnnnnnncagtgcctgggcgggagttcttggatcggggtggggtggggttgagaagattggagaccagggagtgcttttcttgcaactcccttggggccgtggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagctgggggtgcagcggaaagggcggtctggcgctgggcgggggcatcgatggccgcctgacggggtgcgggctgcgtnnnnnnnnnncgcgccgccctcttcaggcatcaaggaggcggtccagggctctgatattaggaccctggtgatgcacacagggcggctggaggatctggtgcagtcccaggcagcgctcagcgtatgcagcgggcacgagacgggggcagggcccatcccaaagtgagctggggggtgcagcggaaagggcggtctggcgttgggggggggccattgatggccgcctgacggggtgcgggctgcgtgtcgaaccggaacctggcagggcctgggagggtggcttgctcgcactcgtgatttcctcatttgtacccctatgccccaaaatacgtcagcgcgtttgttgtggatgctgttgaggaggtgctggacgtcgatctgcccaagccctggaannnnnnnnnngatgatttcctcattcgtacccctatcccccaaaatacgtcagcgcgtttgtcgtggatgctgttgaggaggcgctggacgtcgatctgcccaagccctggaaggaggtcaccctcctgacatccgaggcggggttgcaaacgacccaggcttccaggaattggcagcagctgctggcttcggagtgacttctctgtatccaaaggtcctggccggcacatcgagtggattgaatggcagatttttcctttacaggctgcagtgcgtcagcatgcattgtgtgtgtcagtcattaacgtgtaagaggtgatgagtaatcaagggctgctcctgtgtgcacctcctgtggtcagaggggccgagcagaagggtggggatggcgagatcagggcgggggaatgctgtagaggacgcgccaagtggcaggcccgctggcgcgcgacagtcaggaggatnnnnnnnnnnggagatcagggcggggggatgctgtagaggacgcgccaagtgattggcccgctggcgcgcgacagtcaggaggatgccacgccgaggatggggccccggattctccgtgccagttgaagatcctttggcactgcgttgcaagaggggaggaggtggttgggacagagggatggtatacagtgccgcccagggcgactgaattgggtcaacggggggaagagcaccaatgaacacacggatccatgtgtgatgctcgcatcacacatcgttgggtccccacaactcactgatcgtgacacgcttcgcatggatggcacagaggttggtgtcctccaggagatgcacgatgaagtcctcggatgcttcttggagcgcgaggagcgcctcagccgtccatcggaacggctcggggctcatctcattggagatctcccttgtctgtacaggcacaggatgaatggtgtttagacagcggtagtcaacaatcactaaaggctgcacagcagtaggttgtgcatggagtgctaggaaccgtgtcatttaacaagcaaagctcgtgcagacacctcacagggagtcaaggtcacaaaaacacaccnnnnnnnnnnttgcacagcagtaggttgtgcatggagtgctgggaaccgtgtcattaaacaagcaaagctcgtgcagacaccccacagggagtcaaggtcacaaaaacacaccagacgggcaaaggggagcttggggatgagcatgtctgtggtcctctgaaacttccggatctctctcaaggctacggtccctggccgatagcgatgaggtcgctctgcaggtgcagggaagcggatcttggtcagcagcgccccagtttggtggatgggtgctcaccacataacacaaatgcgcggtctacaccccagcccacctcctccctggtgccttacttatttcgtagccatgtggtactgactttccagcggccttggaaggggatttggcagcctttccgaatcgctttggtggtgactgttgcaatacaagggggaaatggatgagaggggcatgcggtgccttcaaagatagggaaacgtgcggatgatctccgggttcccaccttctgcttttgcttggttcgggccattggcgtccagaccctgagaggctctgcgtacgtcagtcacccggtgcagctgtcggacattgcacggccctcactggtcagagacagcgcgcagagagagcggagccaggttcctgtgaacagtaatatgtgtaaacaatccctgcagcttcccaggatggggtgtcgcggcccgatggacctcgcccactcgatgcaagacgcttgtcgaccccgtgacgcggatgctgggcgggcacggcgagtgatcgtcgtttgaaacctgtccgacagagcacagatccacacaccggcaacgcactatctcgcgacacgaagaggtaaaatagtgtagcatcttcgttcatgtcatcttagaggtcactagagtacgtgccatacccaggagcaaaggagagaggctgcaagtcacacgccctcacttccatggtggcctccttgaagtattctgaccgcgagacatgcctgtaccctagcgtcctgaaaagagagagggaggcgacattggcctcaccaatcttggctcggaacgtttgcacaccctgcatggaggtgcattggatactggagnnnnnnnnnntgtgcaaagagcaagactgacaccctttgtccgtcagtgcagtcctagatggggctggcagtctgcggcacccaccacataccagcttgtcagcagcgtacgccataaacatgcccaacgcctctcgcgccaggccatgcctccggctccctttctccgcgaccatcaccttcaattggacaaaggggggttagcttgcagtcaaggccaaagggtgaggggtttcattgtctggatctcctggactaaatacaaggaggacgtgcaagagccataccatggagccttgcctacctcaatctctgcggcatttggatcatcatggtcattccagaacaggtttacgtcaccagccatgcctgtgtgagattgcgatttatcatcgaactgtacgggaatccgcagccatttggtgtgcgaccagtgttacagggacacggcacagacgccagtctcacctcccccgtggtttccacaccctggtgtgtccggccttgccttgtccagaatgatgaaagtgcactctatggtggtttgacgatgtgactggggtcatgccctttaaccgaagtcaggcagcacccagactgatgttctctccggaatactgcagcccaagatccaggaccagcaatctttggcaagacactgcatggtcagagtactccagacctactttgctcatcctcgcaccagctctgctgcatctcatactcctcttccagggtcaggggctctgaggcggtagcttcctgcaatgcaggacttgcctgcggaatggagaagggttcacatgagacccagggccccaagccacctgcaataccaggaggatcctgcatatgttttaagtcatgggggtccactcaccatccaggcatggtaaggaagcacatgctccctcctgtagggcacgaggattgacttgtgcccctctatagtcaggttttgattggccttcatcgcttgctgctggcgatcgacggccctgcacccgacgcaggaatacactatgcaagcattccggattctggaaagtgagtcagcctgcagcgatctgggctactgatggcagatttttgcgaatcttttattgtgtttcgacaccgcgcagaattcgttgcggaaagccccatagtctagggctcgcctgcacccccttccgagtgaagacgtgctgcgcgtgctcgcagcgcgcaacatgaaaatccatgccgcgacagctcgtgggagccctggctccctcgccctgcaggcatacccaaatcagttggaaaaagtacaatcgcagaatgaccaataataatgtgcgcgatcgccacctgacgtgtgtgcgccctgctgtgacctgactagcggtccctgctccccgccaacccacgacgaagtcccgacctcggacccctgtcctggggcgcgctgcgccatggaccccgaaattgacaatgagatggacctggccttggcccacctggcagcggagggcgagggccaccgcctgtcggtgctgaaccccaggtactcgatgcagggggcaggggtggttggaaggggtcactgtgcagttccggagctggtggggcggcacgcatgcgacctttcgtctggagcctacacatgattacagcaggcaccaaggtgctgcttcccatcttgacgggcccgtgggagggtgattactgccctggtcttcaacaggacctcgtatttccctgccgacggccagggaccagctcttgctggccagcccagcttcgaacacccatctatccctccacttgccaccctgcccctcaccaccacccccaacacaggaacctggcgagcctgtttggcgcggaccgcgggagcgggggcgcccccgccccccgaccgctcgccggccgcgcctgcgccggcgccagcctggacgaccagttcgacctgcgccagctggcggtgtgcgtgcgcatccgcccccccatcaccgccggcgcgccgcgctgggacagcgagaattgcatccacgccacctcgcgccacggcctggcaatcgcgccgccgcccggctcagcggcctacgcagcgggcgaccgcggccagacctacgcgttctccgccgtgtttgacgagcacaccagccaggccgactactacgcggccaccaccgacgcactggtgcgtgactgcctctccgaccccgcccactccagcctgatcatggcctacggcatcaccgccgcggggaagaccttcacgctggagggcagccgccgcgcccccggcctggtcccgcgcgcgctggaggcgctgttcgcggggcgggacgcgcgcggcgccgcgctgcgcgtcgtgctctcctactttgagatctacaacgagaccatccacgacctgctggatgaggcgggggcggcggcgccgggcgcccggcccagcctgcgcctgaaggaggacgccgaggggcgggtgttcgtggcggggctgtcccaggccgaggcggccagcgcggagcacgcgctgtgccttctgcgcaggggcgcgcggcagcgcgcgcgcgccgagacggggctcaactacgcctcctcccgctcccactccgtcttccaggtggggaagaccttggcttgtgtgtgtgcatgtgtattcagggggggggggggggggaggggagggggggnnnnnnnnnntgccgagacggggctaaactacgcctcctcccgctcccactccgttttccaggtgagggaggccttggcttgtgtgtgtccgtgtgtattcatgggggggggggttaagaagatgagtggaggtggtgtggggacgaggtagggagtgactccgggagtgtgcggaacaagaggtgcatcttatgtgcaggcgaagcacatgagcaccagataagaccttgtgaccctaacaaactctgtcctccgccatgcacagatcacgctgtacccgcctgcgcggctgggggagccggccaggaacgaccccggcgagcggctggggaccatgtcctttgtcgacctggccggctcggagcgcgcgcagcgcaccggcaacgtcgggctgcgcctcaagtgggtggcgggtggggaggccgggtttgtggagagagatggaaaccccataggcggaggtggttgttcccccaggcgccagcgctcatgtcgattgccttccaccaccctcgcnnnnnnnnnnggctcgcggaacaagaggtgcaccttttgtgcaggcgaagcacttgagcaccagataagaccttgcgaccctaacaaactctgtcctccgtcatgcacagatcacgctgtacccgcccgcgcggctgggggagccggccaggaacgacnnnnnnnnnncactcacccggttgctcggtcctcaatgctgagacgcatccccaaaccctgccaccgcacagagaaagcgtggccatcaactcctccctcatgaccctgggccgctgcctggaggccctgcgctggaaccagcagcaccgggagggccccctgcgtgtactgccataccgcgagagcaaggtcacccacctcttccgcgacgcgctgcacggctgggggcaggtggtcctgtccgtgaacgtctctccctgcgccaaggactacgacgagaccacccacgtcctgcgggtgcgtgttgagggttgcggtgtggcccggggaagagcacagtggctggggggaaggggtatgggggggtaggcgtgctactggcgcagagtgggcctgactttgcgggccgacgggagcgcgggatgcagtgcatcctgcgtcgaccacttcagatggcacgttgtcacactccatcaagccagcccccacctgcccctcccccccaaacacccttccagtacgccgccacggcctcccagatcggcacgttgcgcgcggtggatgcgccgcggcgcgtggtcaaggccgtgacccccgccgtcgtggcccgggccaagaggaaagcggcgctgcctgccgaggcccgccggtgggtggcggcctgtcccagtcctgttgagggatggacgctcacgctcgtttgnnnnnnnnnngggtgggtggcggcctgtctcggtcttgttgagggatggacgctcacgctcgtttggggagagtggaggggtacgtcgtgccgaaagcctgcgaccgacctgcggtctccgttgcagcatcacttcgatcaaatccgccaccctcctacgcggtcaatcaacacgcagggccgggaagaagagggacaagggcgannnnnnnnnnaaaatccgccaccctcctgtgcgttcaatcaacacacagggccgggaagaagagggacaagggcgatccagaggcagcgctgcaggcggcagacacgcaggcggcaggaaagggcgcccaggcggcatcccatatcgcaaagccccgccccaccacctctcccctcgaggacgagacggcaccagcctcgcccctgnnnnnnnnnngcgcaggcggcaggaaacggcgcccaggcggcgtcccatgtcgcacagccccgccccaccacctctccccttgaggacgagacggcaccagcctcgcccctgtccgaccgagtccagtcagctcttgaaaatggcactccgctgagcgcggaccagcagggcgagtgggcgacccctggctccggggccgaagaggaggaggtggcgnnnnnnnnnnccagctcttgagaatggcaccccgctgagcgcggaccagcagggcgaatgggcgaccccaggctccggggccgaagaggaggaggtggcggccctgcgtgctcacgtcgacctcctgctgaaggaggtgagatggggggagtggatatctggaagtggcgccagccctggtgatgtaccgcgaagaagacccaggcgggaagtgcctcctcttttggactcagcggacacacccccccgctgcaacctccaccagccaggcccgcccctcccatggctcaacctcctctccaaatctgctcccgcagctcaaggatgccgaagaaagggcggcgaggatggagttcgaggtcagggcggaggtggccgcggagatgggggcgctgatggaggagatggagcgcaactactctgcccgcctggccgccgaggccgggcgcggcgccgaggcggggccccgcggcggtgacgccggcgcggggctgtctgcgcagctggccgacgcacgcagcacggcggcgggcctccgcgccgagctggcagaggcatgcgctgcgctggaagagactcgccccgagctggcagaggcgcgcgccgagctcgaagcacgagaaatggagctggaggggtgccgggcagagctccatgacgcgcgagatcagctctcgcagaaggcggagcagctgtcgnnnnnnnnnngcgagaaaaggagctggaggggtgccgggcagagcttcgtgacgcgcgagaccagctctcgcagaaggcggagcagctgtcgagtgcagaggcggcgctggcctccgagcgttctcgttttcgagcagagctggtcgccgcggaagcaagcctcggggcggtccaagccgagctggctgaggaaagcgccgcccgggaggcactgcggcgccagctggcagaagaaagcgccgcccaggagcggcgccggcaggaagagctggagcaggccggggtgaatcgcgccatggaggtggagatgctggaggcgcaggtgcagcgcgcgcggcgggagcaggcggcgctcactgtgcgcctggagggcgccctctccgcgctggccagcctgggttccccaacccggcccctcgccgccacgctggccgcggtgagcagtatgtttgagggggactcgatcgctggggaggggcgttcctccatgtacgggggttggagaggatgtaggcgagcggacctcaagggcgnnnnnnnnnntagtatgtttgagggggactcgattgctggggaggggcgttcctccatgtacaggggttggggaggatgtaggcgagcggacctcaagggcggacgatccacgagtgcatgcgacgatggtgagggcagccggctcccagacacacacgcctggtcgtggcgtaggtgccaccactccctccctcaaaccgtccccccctacccctgcaggccggcgccggcggcgggcaagagcggggcccgggcggcacgccacacgacgtggcgctggccagggcgcgcgcggcctgcggaccccgggccccggaggcggcg

SEQ ID NO: 39908 - DNA, 101 bp, Chlorella protothecoides
gcgagggtggtggaaggcaatcgacatgagtgctggtgcctggggagacaaccatctccacctatggggtatccatctctctccacaaacccggcctcccc

SEQ ID NO: 39909 - DNA, 61 bp, Chlorella protothecoides
ggggtactcctcccccaggttctcgtacagcaccacgcccaggtgggccagcaggccctcc

SEQ ID NO: 39910 - DNA, 61 bp, Chlorella protothecoides
gcgccaggaagcgctccgcgctgcgggttgtgtttgcgtggaaggcggtcgggtgggggtt

SEQ ID NO: 39911 - DNA, 265 bp, Chlorella protothecoides
aactgggagtgtgaattgaaggggggggtgtgaggggtgtatgggtgaggactctgggctaagcttgataggatggggaagcgatggagacctggcgcatgctctgaccgtaagaacggcagggtgcgccccgggggaagccccgccagcatcacatgaccaggcactcctcaactggccacacacacctgccccagcatgttgttgtctccggccatctcgcgctcgccctggaagaccttgatgcccacctgtggttgtgtga

SEQ ID NO: 39912 - DNA, 77 bp, Chlorella protothecoides
cccaacctcccttcttccccccaacctcccctcgtcccccagacaactccctcaccagcttctcggaacttggcggc

SEQ ID NO: 39913 - DNA, 74 bp, Chlorella protothecoides
cggcgggtgctgggctgtggcggccctcacccgacgggatcgacgggccacctcggtcagtgaaccgaactgtc

SEQ ID NO: 39914 - DNA, 70 bp, Chlorella protothecoides
cggtgcatgtggcagcgcgctctgcgcgcgagagagcccccccccccccacgcccaggtccccgcgtaca

SEQ ID NO: 39915 - DNA, 73 bp, Chlorella protothecoides
catgtggtaggtcctggtggggcggccccattgcagggaggtcttggcggtgaggggtatgggggcaggcttg

SEQ ID NO: 39916 - DNA, 97 bp, Chlorella protothecoides
ggggggggggggggggggcatgcatagaggggtcagcgtgggtattcgccaaccacacgatgacctctgactgccctggcaacacccaccctccaga

SEQ ID NO: 39917 - DNA, 666 bp, Chlorella protothecoides
  modified_base (119)..(198): a, c, t, g, unknown or other
  modified_base (272)..(281): a, c, t, g, unknown or other
cgcgccccgcgccagtgtgggccagggcgggggcaggttcgaccccggggtcggccgcgccatactcctcgaggtggccgccgcggccgccgcggccccggacccgccgcttgcgccgnnnnnnnnnnnnnnnnnnnnnnnnnnnnnnnnnnnnnnnnnnnnnnnnnnnnnnnnnnnnnnnnnnnnnnnnnnnnnnnngggcagcagcaatggtagggggaggattgagggcgtgggtgggccgcgccacatcgacctcccaagcatcgggnnnnnnnnnnagtgtgaggggtggggtgggacttctggaagtgggagtcagtgtgcaacccactgatactgcatgccaaggcagcagcaacggtagggggagggttgagggcgtgagtggaccgcgccacatcgacctcccaagcatcgggcccgcctcttcccagggtccgcgcgccgccccgccccccccatgacccctgacgccccattcttcacctacctcgcaggaccggcatttccacctggtccctggctcgccccatctcagccgcccggtaccccacagccttccccccgcacccccccagcacccgctccagtcccgtcccagtcatctccaataaactcaccccaaccgctcacgcccagcaggccaccacccgccaccagccc

SEQ ID NO: 39918 - DNA, 61 bp, Chlorella protothecoides
ggagtcattcacctctccaacccgtttgcccatgtacagggcttccctgctccgtgatgac

SEQ ID NO: 39919 - DNA, 62 bp, Chlorella protothecoides
tgaggcccgggccccaccgcatgcccgcccatgacccacccttgcgcagcgcgggcggggcc

SEQ ID NO: 39920 - DNA, 73 bp, Chlorella protothecoides
cgccgtgatggccacgccgtatgcgcccgggtacgtcacggcgggggcctggagccccacccgcgccggcatg

SEQ ID NO: 39921 - DNA, 118 bp, Chlorella protothecoides
gtagcaccgtgcgcagggcctggatatcggcgggggtgaagcagacggtggaggcgtccaggcggaccaccttactcctgggagggggggtggggaggtgctaggatgcccatgctgc

SEQ ID NO: 39922 - DNA, 65 bp, Chlorella protothecoides
ggggatgcacggctgcgcgtttgagggccggccgtgacccgctgtgtgctgcatgcctcttcaga

SEQ ID NO: 39923 - DNA, 64 bp, Chlorella protothecoides
ccgctcaccgcttttgacttgaaggaggaccactccatctttgcggctggcaccgcaggtttgt

SEQ ID NO: 39924 - DNA, 137 bp, Chlorella protothecoides
gcgactgcgagcggtgtgcaaggggatggggggggcacgtggctctggggtggttggcatgacatcggggcggccgaggtcacctcatgcgagacgagcagttgcaagggttccgtgcatcttgtgagagagagggg

SEQ ID NO: 39925 - DNA, 61 bp, Chlorella protothecoides
cgccgcatccgctggaactacgccttcgcgttggggtacaacgcgctggccatccccgccg

SEQ ID NO: 39926 - DNA, 102 bp, Chlorella protothecoides
tgacaaccccgccaacccagaggtgtgccgcgggggtgggttgttccgaggcctgcctgcgcatgagcgtctccatggctgcaggcatgacggtgagggcga

SEQ ID NO: 39927 - DNA, 7453 bp, Chlorella protothecoides
  modified_base (606)..(726): a, c, t, g, unknown or other
  modified_base (1715)..(1724): a, c, t, g, unknown or other
  modified_base (1793)..(1985): a, c, t, g, unknown or other
  modified_base (2207)..(2216): a, c, t, g, unknown or other
  modified_base (2541)..(2636): a, c, t, g, unknown or other
  modified_base (3400)..(3409): a, c, t, g, unknown or other
  modified_base (4244)..(4253): a, c, t, g, unknown or other
  modified_base (4359)..(4368): a, c, t, g, unknown or other
  modified_base (4459)..(4468): a, c, t, g, unknown or other
  modified_base (4902)..(4911): a, c, t, g, unknown or other
  modified_base (5510)..(5519): a, c, t, g, unknown or other
  modified_base (6057)..(6075): a, c, t, g, unknown or other
  modified_base (6216)..(6225): a, c, t, g, unknown or other
  modified_base (6908)..(6917): a, c, t, g, unknown or other
cgccgcggccgccgctcgctggacgtgcgcgccatcatggagaagatggagctgatcatggcggaggacgtgaccctggtgcgcttcctggggtcgggcgggtacggcgacgtgtacctggggcgctggcactcctgcgaggtggcggtcaagtgcctggcgcccagcctcttcttccagggcggggacacggggcgcgtgaaccgcgccgccatcgccgacctcatccgcgaggccgacatgctgggctccatgcggcaccccaacatcgtctgggtgtacggcctggtgctgccggagctggcgggcgcggcgggcggcgacggcgccacgcccggcgcgcgcgagctgctggacgccatcgccgcgcgcgccttctcggccgccgcgctgccgggcgcgctgcgcccgcccgcgctggtggccgagtacatggccggggggagcctgaagggcgcgctggcgcggcacgccgacatggtggcgggcgtggccacccgggtcatgctggccatggacaccgccaagggcatggcgtacctgcacgcgaagaacatcatccacttcgacctcaagtcgggcaacctgctcctcggctaccgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctcgcctcgaccgcccagcccaccagccacgaggtgctcgacccacgcccccgccagtccctcgcacctcccccccctcccatccctgaacaaacaggtcaaagcagaaggtagacacgtacgtcagcggggtgaccagccagcgcgggacgctgccctacactgcgcccgaggtcatccgcacgcccaaccgcgtgacggagaaggccgacgtgttttccttcggcgtcatcatgtgggagctgtggaccgggcgcgagccgtacgagaacctgaactaccacgccctcatgcaccagctggcgatgcccgactcccacgtcaggccgcccctgcccggcgccccggactgggatggtgagtcgggttgtgggggtgttgggtgttggggggtttgggggggtgggtcgtggtggatgcgaaggggggggcccctggcgacgtgtgcctggacatggggagggggagtggaatcccgcgggggtcctccccatcacacagtccatcgccatgtgcaaaggggctggcggtggcctgcgtgccgaggtgtccaccttagtgggccccagaaaacctaccacccgaccccaatgccccctgcccccgcacctgcagtccctggcgaggccccgccggagttggccccgggctggcgcgtgctgctggaaaagtgctgggcggatgaccccgacgagaggcccagcttccctggtgaggggggggagggggtgggcggggatcgacagaaatcgtgtttcggcccgtacaaaggacgagggcgtgcgctcacggcctgcgggtcacgatgcatgatgccgactgcgcagctgtgctgggtgggggaggcgtgcatgccgggcgcttgccgctgggcagctgcctgggcagctcgcggggtccctgccacgtcgagcaactggagggtggaaggggaggggtgcgcagcctgctggtggaaattccgagtgtctcatgccccacccccnnnnnnnnnngagaacccgagtgtcagcccgtacaaaggacgagggcatgcgctcacggcctgcgggtcacgatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaaggagctgcggaacatggtgggggtgctgagggccgaggcccgcagcgcgtcggcccgcctggcatccaacgcctcgggctgaagtcgcaccatcgcgagcaggatgaggacggcctgcacgcaccccgttgtcgcctactgaatttcctggcctgccagtacacgcccccccttgcgcagtaccacaatcgatctctggaccccaagcggttgccnnnnnnnnnncgtcgtaccatcgcgagcaggatgagcacggcctgcacgcgctcccttgtcgcctactgaatttcccggcctgccagtacacgcccccttgcgcagtaccgcaatcgatctctggaccccaagcggttgcctgtttgggccccgcacggcggatccatttttatgcttgaatctacccctactactccatcgagcgtgtctttgatcccaactccccaggctgtgtctataattccacggttgctccccgtcccctcgttcccgctcccttgtctcttccacacttgcgagcctcctgacatgtctcctgccccccatgcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgacaggggaggagggggagcgccagggtgggggcgtccgtgggcccgcggggtccggtaagaagctgctttgaacttggggcatgctgcgccatgcgggccccattcgagtctgaccgccgtcggtgatagggtttctggcagggcctggcgagcctcataccaccccagccggcatgagtgaggccctgcatcggatcacgggacggagcagaggacagacaccccagcggagccccgggatccccaattgaggcagccgtggcagcccgaccagacctgcgaggaaacgaatcgccctccgcgcggtccccaagccccatcctaggccctctacagcctcccttctgcattcctgctgtacctaagggggagcagggctccccaaaggcccgctcgcgcggcgcccagtggaattcgacaggccgcgcggtgacccgtgtgtgaccctgtccccaggatcgcaccgccatgccgaaccaaggcgcctcccccgtcgcggaattcagcgggcgcagtgccagcgccaacgacagcttggcccccacgcacaccgtcacctcgctgtcggacgagcctggggacgacgacgacgacgtcgtggagcaggacccgtcaggtgtgcgcaagggtgtgtgcctgaccagacatgcctgcctgtgcaggagcagtgccatcgagcatggccgaccggggggatggggcgcccccatgtggacccctggcctgtcaggtcgtttgaagggtggcgcgggagcgcnnnnnnnnnntgggggggcagggcccccatgtggccccctggcctggcaggtcgtttgaagggtggcgcgggagcgcagccagcgcacgcataattcagccaccacacaggacacatgtgctcgcgacctccctcgttcccaagaagcctcctacctccacccccctcacctccacccccctattctcgcaggccgcttctcccggtatgccagccaggtgggatcgggtcggttcaagcaggtgtaccgtggctttgacgagaagcggggcctggacatcgcctggagcaagataacggcggccaccacgggcctgacccaggaccagatgatgcgggcggtggaggagatctccaacggcgtgggcctggaccaccccaacgtcatccgctgctaccagtgctggctggacgaggaggcggcgtgcatcaacctcatcaccgagtttttcacctcgggcaacctgcgggactatcgccagcgacacaagaacctggacgtgaaggcagtgaagaagtggagccgccaggtcctgctgggcctgtcctacctccacaacaacacctccgtcatctgccacggggacctcaggtgcgagaatgatctgtgaagcagccctttcctttggagggtgtggctgaggagcgatgcactgtcaaggggctctgagtgtgagggatgagagactgagcgggcgtactaaaggggttgcagcgcatcgtggctgcctccagggtgtataccaaaccatgggcctcagtgtcgacagcgatgggcggaagtgactcgtaatattgtcgggtgaagtggtggtcccacacctctgccgtcaatccctctttcnnnnnnnnnncacaccaaaccatggcccccagtgtcgacagcgatggggggaagcgactcgtgatgttgtcgggtgaagtggtgctcccacacctctgccgtcaatccctctttcnnnnnnnnnngtgatctgtgaagcagcctttccctttggagggtgtgggtgaggagcgatgcactgtcatggggctctgagtgtgagggatgagagactgnnnnnnnnnnggtgacctctgcccagcatcagcttgtcgctcctcacccctcccgccgcgcacagagcggacaagctgtacatcaacggccacagcggggagatcaagattggggacctgggtctggcagtcctggtgcccaagcgatttgcgcctggtacgtgtgctgagagggacatgagttgattgcttggcatgcggtcgggagatgggagtttgtgtcgcaaactgggtgtcgggaattttgttcttaaaccacgggtagagagggagagattcggtgtgcgcacccctgctttccacccctgaccctggcccatgctcccgaccccccagctcacttgatccaagtgacatactcgcgccaccgtttccactccagcccctccacacccccccctcaccccccccctgaaccaccttcttcgcagacgtgatgcccgnnnnnnnnnnggtgacatactcgcgccaccctttccaccccagcccctccacacaccccccgaaccaccttcttcgcagacgtgatgcccgagggcgaccccaaggaccagtacaccccgcccatcgacatcttcgccttcggcctggtggtgctggagctggtgacggggcgcaagatggaccgcgaccaccaggcgcgcggcctctggcaggcggcgctggacgaggtggccgacccactggccttggccttcgtggagcgctgcctggccagcgtggaggaccgccccagtgcgctggagctgctggaggaccccttcctgcagacgccgcgcaagtcggcgagcggggcgccgggggagggcgagggcctgcgccgcaaccggtcggaggccggggccactcaggtgcgggggcggttcgtgggattgggtggcatgggtgggcgttgccgtgtgatgcatggacccctgccctgccctggcaggcctggtcctctcctgcccaatcccctccccgcccacccactcacatccccgccagcctcccctcacacccaagcagggcgccggccagcccgaggatgcccccagccgcgccccgctttnnnnnnnnnnggggtggcatgggcgggcgttgccgtgtgaagcacggacccctgccctgccctggcaggcccggtcctctcctgcccaatcccctccctgcccacccattcgcacccccgccagcctcccctcacacccgagcagggcgccggccaggccgaggatgcccccagccgcgccccgctttcctggtcagacgaggagagacgcgccgagtgcgaggccggtttcgtgcgcggcgaggactacctcttccagttctccggcaagatccggggggggaagctccacttccgcttgcacatgcagtacgagggcgagggggggccggaggtggacaccagctccaagaccatcgacttcgtgtacgaccccgacgccgacacgcccgacgagatcgcggccgagatctccaacgagttcaacctgagctccacggaccgcgacatctgtgccgcggcccttaaggagtggctcgccaaggagatggacgaccgggactgaggggggagcgggtggccgatgaaggggaggggggggggggggnnnnnnnnnnnnnnnnnnngctgcaacatgccctgtcccgatctaccaggacgccccgccccatgtctggaaagcctccccgccccgaccctccacacccgccccggcgctgggatgtctgtccctcgcacggccgatccaggcccctgcccaatgcctnnnnnnnnnnacccgaccctccacacccgccccggcgccgggatgcctgtcccccggacggccgatccaggcccctgcccaatgcctccaccagccctcagccctgatttcctgctgttctcaaaccccttcccgctttccttccgtttcagcaaccagtgcctggccttgtatacatagcgatcaggtgtccactcgtggcgtggcaggcagtgggtttgggggtcactatcaagcctccatggcctgcgcggacgaggctggcgcctgctgcgattggcacagcatctgcttgcacacctatagccgtaatggggttgggagaggtgtgcatgcatggtgggggtgaggtggatgcagggcgccgctgacgtggtatggggcgggccagctcaaatggctgaacccccactccggccccacctggttggagaggcctttgatctgctcgctggccagccggacggcgtcctgcacgacgtgctcgagcttggtgttccctgcaggcagtcgaggaagaggggggcaaagctgctgtcttgagatgcagcaaacaatatcagcgcacaacaggcaaagagcctgtcctgcgcttcgctgggccgccacggacagctccaggatgtacatgccgtgtgacgctctttccaccaaggtgctcgttcttgagcctggctgcagtgtacatgcctnnnnnnnnnntcaggatgtacatgccgtgtgacgctttttccaccaagatgctcattcttgagcctggctgcagtgtacatgccttccacaccacccgcctgcctagcctcacccaaggcgggcggttgaggcaggcccgacctctgtgtgccgggtctccacagcgacttgtcagccgcagacagcttcttggctgccatgagggggatgcagaagggaagcttgaaccagggtcaggcagtcatcacccttgatgagacgctgagggctgtgaggtggcagctgtcacgtctccttgctcactgtatgtgcaccttgtcgactccctggaagccattgcgaacgcacggcaagtatcctccacatgactcacccacatcctggagctggcctgtcacgagcgcttggttctggagcaggggggaggcacacagggttttcacccagtagctgttccacagcgtgcccagcagctgggcatccaggctggacttgaagaaggagacgtccagggggtagtactgccattggtttgcggggggggg

SEQ ID NO: 39928 - DNA, 7720 bp, Chlorella protothecoides
  modified_base (133)..(142): a, c, t, g, unknown or other
  modified_base (379)..(388): a, c, t, g, unknown or other
  modified_base (3262)..(3271): a, c, t, g, unknown or other
  modified_base (4255)..(4264): a, c, t, g, unknown or other
  modified_base (4861)..(4870): a, c, t, g, unknown or other
  modified_base (5282)..(5291): a, c, t, g, unknown or other
  modified_base (5912)..(5933): a, c, t, g, unknown or other
gacgtggggaagggagctcggcaggctggaggtcgggaaagtagacctcctggccgccttggggcagaggctgggccgtgtaagctgggccgtcgctggcagggacccttgttcccacctgtgtctgcacctnnnnnnnnnncatcgagaaacgagacctcctggccgccgtggggcagaggctgggccatgtgagctgggccgtcgctggcaggacccttgttcccacctgtgtctgcacctgaggctccccctaccctacgcacacgctcgcctgggggggggacacacatgtgtgctgagctcatgtgccaggatgacaaccggctcccctcccgccctcgaatcccacagggacctgttggaggcgctgatgcannnnnnnnnncacgcacacgctcgccgggggggcaagacacacatgtgtgctgagcgcatgtgccaggatgacacccggcccccctcccgccctcgaatgccacagggacctgttggaggcgctgatgcacaagaatgccacgcaggggcggcccagctcgacgccggtgggcccgcccaccatggccgagcccctgtaccttaaacaggccgccagcctgagcaggctgggcgccaccaggagcaacggcggcggggccggcgactccgtgcccggcgacccacccgccccgggcagcacggcttgatgcagacaactgaaacatgtgtcctacccccagatgtgtgatttaatccatgtgtacatcccaggaacccactcggaatgagagcgccccttcaggtcgcacaggttctggaaagccggaatctatgatccgcacggcttacagctgaagggtgggctgactgcaacacccctcgatgcccggctctgcaccatcgctgtccgaggcgggcacggggtcgtggagggccacccaacagaatgcggctgctggtactcgccctcgagtttgcagcgtccaccttcagcggcaatggggtgtactgccagtcacaggcgaggagacggggagtctgatgcgggaggcaaccccgcgagctctgaagtgcgtccatgccatggggtgacacatcactttattatacgtatgcgcgcccatccccacccatgtctcacaggtgcgtgccctgcgtggcctgggacacgacgtcatggtggtgtcggggggcccagagggctgtgagcccgagccggagcacgagcacgcctccctactgctgcaggcatggcagggcgtgaatatgctcggggttgataggggaatttatccttggggggagcattgctatatggcgtggaacagtgcgcccttggcaagtaccatggccgaactctcaagttgaatgattcacagcgagtacgaggtgtgccggaatggtcttctgacaatccctacccgaactcgttctcgaatcagatccccctgccttcctggggcacgctggacagcagctgcagccaccgggagtttgctgcaggcgtggccgcctccgccatcctctccgccatcctctccttctgccccgacgccgtgctgggggtggactggcacgccctgcgcccctaccaagccatgaaggcggcctgggaggctacccatgccgcagcactgagggatgcgccgggctgccgagcacccccgctggtgtacatgaactaccgcctgcatggccgcaccgacccggcctgccaggccctggaggtggaggcgctcggtgcctccgcgctctccctgctgctgtgcagggccgatcgccgcgcggcgctggacatgctggggacaagcgatggtctgcgccccggcccagacctgcgcgtcctcctcccgccgctgcgatctgacctggcggggatcggcgccccggcggcggcggccctggccccgtgccgcaccttcctgacttgcgccgtgcgcgtggcgccggagaaggcgcccgaccgctttgtggagctcgtcgaagagctggcgcaccgtggcgcgctcggcaacctcacgcccctgatctgcggctcgggctggggcggcgcctggggtacgagcctcgcggcgaggctgctggcggccgcgccgcaggctgtagtgcacacccgcttcctggggccggcggggctggccgaaatcttcgccgccacgctgctcaatgtccacccctgcgagcacgacgcctacggcatgaccatcgtggaggccgccagccagggtgggggaagggaggaggggttgagcggggtttggaagtgttggcgatgtgggtgccatggtgcccggggggcggccgcagcacaagtgccgttggacatcacaccacccctcggccataggacctcctcacgatcagttggcaacaagaataacggggcgattgcatgtgaacggtcctttgacgtcgagcccaccactgcctccctttctttccctgctggcaggggcccccagcctggtgcagggagggggccaggtgggggccacagacctactagaccccgaggccggagaggtgtttgtcgctgacctggcgcagggcatcccgggactggcggcagaggtggagcggctggtggcagacccccaagccctgcagcgagtcggggcaaaggctcgggagaaggcgcggtcctggggggaggtggacaatgcccaccagctcgctacctgggtagaagcggtggtgcgagtgcacgcagcagcacaggaacgagaatcatcgtcgtgactcctgaggtcgaagggccatgcgcacgagcgctgggcaggctgactgggtaaggagacccgcctaggatgtcccctgaactatttacaaatgaatacaaggtccgcacacagcagaaactgcattggatgaaaggaattatgttgcagtgcccatgcacatcaagctgactgaaatttcatcagcacctctttccctagatcgccctgtatgctggacttctttgttatcgctttaaaaaatcaaagattagatcgatgctccggcaaaatcttcttctaaaacgagcaaaaacagttcgtcacggggacttcccaacgtggtcacccaccgcagtactattcccgcccaatccagcttaattaccgaggtctaatgggatcggatgcgttctggatggtatgaacgaaccataggagaagatggaaaactgtttactataatgtagcatgcgatgtctgaagtattgtgaaatgatccaacgctcgatgattctctcctgccgttcacaatgcagcccaggtctgatcaagaatctagcccnnnnnnnnnntggaaaactgtttattataatatagcatgcgatgtctgaaggattgtgaaatgatccaacactcgatgattctctcctgccgttcataacgcagcccaggtctgatcaagaatctagcccactcctgcatctcgctcttgccgggttgcagacatggtgttgcacactgctcacacactgcatgaactaagaggcaaggccctcaaggatcgatatgcacgtcccactctgggcgcgagagccaggctttaacggcctccgacctccgctgcatccacggccaggcgttggctccaactccctcatgcccctccgtggaccggcaagcacagcgcagcatctcacggacccccgcccagcccaggcccaggttggcttccacgttcctcgccaccaggccctggaactcccgcggcgagcacagcccacggcagtcctcgatgagggcctctgccgccgcggtctcctccgtcagcaggcgccagaggtggggcatagcgtgctcgttgatccagttgtggttgatgctgagcgccggcgaggcattgagcacttcatggtgccagccgctgggcacgaagatcgcgtccccgggctgctggatgacttctcgcgccgcctgcctggcctgagccagccccggccacccctcgccggacggtccatgcagcgtgcgggccagttgctttgtccccgggcggtacatgtgctcggtgtgggagggggggaccagggtccagtgcttgaccccagcgatgttcaccgaccagctgtgactcatcaacacgtcgtggtgcaggggggtggaggaccccttgcatcattttgggggaggggggtgcagtgaaggtgagagatcgggcatgcttgggtgcgggaggcaagggattcggcacctgtacacaaactaccagaatgcgcggcccccgagaggcctgatcattcaggacccaagagtgacctcacctcgggacccaggtacannnnnnnnnnggggtgcgggaggcaagggactcggcacctctacacaaaccaccagaatgcatgccccccgacaggcctgatcattcaggaccccagagtgacctcacctcgggacccaggtacacaaagcggtagtcgctggtgaccagagaggaccggctcgcagcagggggtgcaggtgagctaccatctccgttgcatgccggctgcccatgcctgagtacatcgtgccactcattcagccagtcgtccatgaagaggggggggcaggtgtaggccttggagaaggatgggtggagcgaccgatcgtgagattacttgtctcgacacactttggaactcaagttatggaggtcaccacacccctaggggtgcaaccccttcccacctggtactcgggatgctcggcggcaaagtgccagtccttgaggtatagaactccctcccggtctggacgcctccaccaggacacgtactccgccagggacatgatctctgcgggctgcgcgccgtactcggatgcctgggagcagtcggacacgcaaattcggctgtgcccaaatttgcggaccagaaagtccagatctgggaggccttccggcgtcnnnnnnnnnnctctctgcgggctgcgcgccgtactcggacgcctgggagcagtcggacacgcagattcggctgtgcccaaatttgcgcaccaggaagtccagatctgggaggccttccggcgtcacccactccctcactgctgcccagtcgtctgtgagcccacggacgatgacgggttccccgacagccatgtaatcgttcacaaagccctcataggtgagctctctcgcatcaactacgggtgtggcgaccggtgctgctggttcgggatgcgaggtgctcatcatgaaggcctgtaaggtgctacatcagatctcgcacaaatgcatgagctcccatggcaattagatacgtgaaggagctgttgttgatagctcgcctgcccatctctcatgctgtgtcgagccgctatgatttgtgnnnnnnnnnncacgtaaagcagctgatgttaatagctcgcctgcccatctgtcatgctgtgtcgagccgctatgatttgtgttgtcgaacctgtccgactcgcgcccagcagcttcatctccaccagaaatggcggcgcgaaagatgctatggttttcagcaagccgatcaccgactggactctcatcaagaaacgataaacctggtgtacagtaatgtattggaaactggcaagagggggactggcgtgaatcaccagcggcgtgcctgctggccagcagactgccgcactccagccaagcccaccatcctgcacagagtgacaacatgagcggcacccactcccaaaaaggactgagaggggtgatacagcagcatgggccaagatgagagagggcagcaacaggaccttccttgcagggtggcagaaaaatattgaggagaagacttgaaggagggcatcctcctggtcgtaccaagggaatccaaggcgcagcgtgcggagacacacgagcgggaacgttgttatccgttttaagccttgccaaaaaggcaagcaagctcacaagcctacaggtagcatacagcagcagcacttgggggggggggggggggggtttttccccccccnnnnnnnnnnnnnnnnnnnnnnctttcgccacgtccttccccactcggccaagcagctccacacacacttcgagcccgacagcagcggcagcagcgcctggcggccccatgcctcctcaccagtccccctccaggcgcttgaagcgcgagggggaccgcaggcggtggatggccttggcttctatctgacgcacacgctcacgtgtgatctgcgaccagtgagggggacagcgacggcgatgaggagggattggaggagtgggcaggtggtgctgggcgacggcggatcgagcctgccatgctgacgcacagcttgcactcgcccagatcattgcgtctgctggtgtgcacctcggtgccatgcgcctgcgcgccccttccgccctccacctgcgccctttcccccctgcccccgcctcacgtgcacttcgtgggaggtgccacactggcccagcgtgcgctcccgcccgtcctccagcccaaaccggtttttgatgaccgacacctcgcgccgcggcagcccgcgaagcacgtcgtccagctccacgcgcttcagcgcctgcatggcgcgcagcatggggtcctccgtggagtcgatgacgaaggcggcggatggctgcaggccgccctcctcgtcgcggtcgccctcggcctcgttcagcaccgcgggcttgcggatggcggcctgcacctggaccaggcgcttggcactcatgcccgccgccgcggccagctcgtcctgggtgggcggccggcccagctgatcgcacagcaccacctcggcgcggaccaggcgccggaagcggtcgacgacagagacggggagggagacgaggcggccctgggcctgggtggcccgccccagggcctgacggatccaccacgtgacgtaggtggagaggcggaagccgcggcgcgggtcgaatcgctccacgcccgtgcgcaggccctgcatgccctccgacacgaggtcggaatggctcaggccgcgcccagtgtaccgatgtgcggccgccgccaccaggcgcgcgttgcaggccaccatcatctcccgcgcctgcaggcccaggtgcagccgcatctggagctccgcgggcgtcagccccgccgccgcggcccactcgcgcggcgacaccgccggcggagcgcgcgcggtggtgatggaggcggcagggtctccgtggctggcagaagcagccgggcacgagcgcgcaggtgcggcaccatgcgtggcgtgcccgtcgtcgccggcagccgggcccgaggatgtcgcctgggggtccaaaccccctcctccctcgccccgcgccgcgcgcagctgcgcgcggacctccagcaggcccagccgcgcctggaccatctcgcccaggtcgcactcctgcgccgcggtgagcaggcgcttggaggacaccgaggccagcaccgcgcgcatcgtctcgatacaggcgcaggggtcgccgcgcagggcggcggccggagtcgcggcgccctcctcctcatcgttggcgtcctggtcggcggtcaagggaggcgcgtcgccatcctccgcatcctcgtcattgtccagcagtgcgggccggcggctgtcggacccggcctcgctcgatgcgccggcggcggcctcggcggcatcctcctcctcctcctcctcctcctcctcaccctcgtcgtcctctcgcgaggcgacacgctgcgcgctctccagcagcacgccgccgccgcccgcggcgagcagggcgggaaacagcgcagcggcggcgtcgccgcccgccgcggccacgcggcggctgaggcgtgccgagcgcgccg

SEQ ID NO: 39929 - DNA, 23379 bp, Chlorella protothecoides
  modified_base (462)..(471): a, c, t, g, unknown or other
  modified_base (1033)..(1042): a, c, t, g, unknown or other
  modified_base (4245)..(4254): a, c, t, g, unknown or other
  modified_base (4523)..(4532): a, c, t, g, unknown or other
  modified_base (5023)..(5032): a, c, t, g, unknown or other
  modified_base (5888)..(5897): a, c, t, g, unknown or other
  modified_base (6605)..(6614): a, c, t, g, unknown or other
  modified_base (7758)..(7767): a, c, t, g, unknown or other
  modified_base (8331)..(8340): a, c, t, g, unknown or other
  modified_base (8703)..(8712): a, c, t, g, unknown or other
  modified_base (9313)..(9322): a, c, t, g, unknown or other
  modified_base (10394)..(10403): a, c, t, g, unknown or other
  modified_base (10998)..(11007): a, c, t, g, unknown or other
  modified_base (11123)..(11132): a, c, t, g, unknown or other
  modified_base (11299)..(11308): a, c, t, g, unknown or other
  modified_base (11368)..(11377): a, c, t, g, unknown or other
  modified_base (11536)..(11568): a, c, t, g, unknown or other
  modified_base (12649)..(12658): a, c, t, g, unknown or other
  modified_base (12799)..(12808): a, c, t, g, unknown or other
  modified_base (13346)..(13355): a, c, t, g, unknown or other
  modified_base (13860)..(13869): a, c, t, g, unknown or other
  modified_base (14253)..(14262): a, c, t, g, unknown or other
  modified_base (15046)..(15055): a, c, t, g, unknown or other
  modified_base (15171)..(15180): a, c, t, g, unknown or other
  modified_base (16136)..(16145): a, c, t, g, unknown or other
  modified_base (16247)..(16436): a, c, t, g, unknown or other
  modified_base (17482)..(17491): a, c, t, g, unknown or other
  modified_base (18316)..(18325): a, c, t, g, unknown or other
  modified_base (19191)..(19200): a, c, t, g, unknown or other
  modified_base (20058)..(20067): a, c, t, g, unknown or other
  modified_base (20321)..(20330): a, c, t, g, unknown or other
  modified_base (20916)..(20925): a, c, t, g, unknown or other
  modified_base (21302)..(21311): a, c, t, g, unknown or other
  modified_base (21881)..(21890): a, c, t, g, unknown or other
  modified_base (22721)..(22730): a, c, t, g, unknown or other
  modified_base (23204)..(23213): a, c, t, g, unknown or other
  modified_base (23305)..(23315): a, c, t, g, unknown or other
ggcggccaccgcctccgcggcggactccacggcggcccggatgccgcgccagaccaggatgcgccccgaacggtcgcccgccgccagcgtgtcgtcgtcggggctcagcgccacgcaggtgaacggcttggtgtggaatagggacagcgcgccgcgggggccgtgcttggggccccacaccagcaccgtgtgccgctcgaaggtggccaccaggccgccacgcgagcccatctggagagaggagggagggggggttgttaggggggggccgcggtcataaagggaagggggacagtgagaagagattatcagagaacggcgtccgcaggtgcgtgaatgctgttgctgtcgcctgcctgccaggggccccactcccaattccacgcaccgacagggggctgccgctcgcgatcttgcggcgcaggggcccaggggtgccggtggtcaggtcgtagcggaagnnnnnnnnnntaaggggaagggggacagtgagaagaaactatcagaggacggcgtccgcaggtgcgtgaatgctgttgctgtcacctgcctgccagggcccccactcccaatcccacgcaccgacagggggctgccgctcgcaatcttgcggcgcaggggtcctggggtgccggtggtcaggtcgtagcggaagaggcggccggaggcgtcgttgaccgggcaggaaagccaggcgtggcccggcgggcccagcgcaaagctctccacgggctccgggacgcgccaggtgcgcaggaccaggccgctgcggaggtcccagtgccgcagcgtgccgtccagagaggaggtgtacacctggtgggtgggggggaggtgatgcaggctcacacagggggagtttggggaggatgcttcagacacggcacccccccgagcacagcagggaactccccatcccaggggctctcccagggccccgacatcgctgcttccatatgagacatttaggatatcattcattggttccatcacaggcgcgccacgcaccattcagttcgcatgcatgggaacnnnnnnnnnnaatgcaggctcacacagggggagttttgggaggatgcttcagacacagcacccccccgagcacagcagggactccccatcccaggggctctcccagggccccgacatcgctgtttccatatgagccatttaggatatcattcactggttccatcacaggcgcgctacgcaccattcagttcgcatgcatgggaaccccaaaccaggccgggcccccaccatccccccctccagacacgagacagcacctcaccctcttggcattgtctggatcggctagaacagcagtgacctcggcggtgtgacctgtgaggcggtagagtggctccccggtgaccgcgctgtgcgctcgcacgaagttgccgtggcagacgagcacggtctggccgtcgagggtgaggaggtgtggccgggcggtgaactggcccccacctcgcagctgcatgccatcctgctgcgtcatagcgaggaatgggccattcgtcatcctgccgagtctatgccatcctgccttatgttggggggccggccactctcaatatcgcgcccccgctccctcctttccacggccccccgtatcgagtcgggaggcctctcgcgcgcgagattggtcggagatgggggtccatcgcgagacaagtgggttgctgcgcatttgaccatcacccacggccctcccgaagagcagggcacgcgaatgggaccgctgtaaaggcgaggcgccttcatactcaccaccctgcaccctggacattccctcggacgccgatccttgacatccccgaattaaaatctacatggtggcggaaacaggagtccttgctcccggtctcgctgcccaggatgggacaggggccggtcccggaccgagtgatggcggagcacaggaagccaccccgccgtccatgcatagcgctgaaggcgctgaaggcctccgtggcaggtaagtgatgactgctgtaggactctgtatacgttcatgtgtcttccctgtcacacggcagcccatcactggtcccctacgcctccctctcgtgctcaggcgacgccacgtctggggccccattcctggtcaggagaacacaagcacaggggacgcctccacgaaaaagcgcaagaggcgcagtagatggggagagaaagaggaaaccaacgacgagaaggccatcatgctcatgcccaatgaaattgtgctgagcaatggcatgaaggtacagggggtgatctgggtctagggtgggagtgtgttgggggtcttgctggaaggagttgggagtacgcgttcaagaagcaccagggaatcagagcctgcctgcgccagcatcgcacatgctagctgtatgcgggggaccttgcgggggacccttttccgtgtccccgcctgcacctgcgacgatccctcacaatccccatgtctcgcctcacaggtgtacctcccgccctctgtgactggacgctcccccactggcgacccagaggtcctggttttccaccagcagctcaacgccctgaacaagaagatctccgagggcgaaatcgacatccctccagagggagagcggtcaccctctccccccccaacgtatgatgccatgggcatccggctcaacacgcgtgaagtcaggtatagacgagactgtgtgtggcaggggcaggaggatgtgttgcgtgcttggtgatcgccgggtctggctgggagaagactttgtgcttcacaaggggcgatggtgttcaggacgttggtgcagttccagtccagtgacagaggcagaagtggttgcgccagcaatgctccagctcactccctcgctcgacctcccgcccacaggtaccgcgagaagatgcagcgcaagcgtaacgagctcatcgagaccctgattgcgcgggatcccacctaccgcccccccagcgactatcgaccggagaagaagtggtgcaagctgagcatcccacaccgccaataccctggctacaatttcatcgggctcatcattgggccccgtggcaacactcagcagcggatgcaggcagagaccaacaccaagatcgccatcaggtgctttcgatgcgctggggttggggatagaaggggccgactgggatattgtgggaggcttgtttgcaccataggagggactggtgccacgattgggatcacctgcattggagcaatctcagcaacgcgcgatgtccaagcttgtgtcctctgtcgatcgccctgttcatcattctcctgtcgactcaacaaggctgcctgcatgtcattacaaaatgcagggggcgtggctcgatcaaggatggcacggctcgcgactccaaaggggctgctggtgaggacgaggacctacacgttatgatcactggagaccggcaggaggacgtgagctgggtggaggctgcgatgggggagtgggtcgaggggaagggctggataattagagggcagctgcaatgtaacggtaagggtgaggcctcaagggcatgtcctggcggaatagggaggagtggtagaaatgtttggcctgggaaggccaagatggcgctggcagactgcagcgcttgccagaatggcactggctgacatctttgcctcatttatgcaggtggatgctgcacggaggctggtggagaggctcctaaagcccctggacgaggagatgaacgagcacaagcgcatccaggtgaccactcaggctgccgcgcctgcctaattgtgcctggattgggtgtggttgggcagatcgcgtgcactctgtgcactggatagaacagaccgcgtgaggcaggcatcggtagtggtccaagagactcaggccatgctgatgagatttgcagcctgatgcccatgctctggaatccatccttcgcacacacacctttcctgctcctccccacccacaaacagcttcgggagctggcggcgatgaacggcaccctcaaggacacagagtactgtaccaactgcgcagagccaggtgggggtgctccaggatttgtgcctgcaaggagcaccgatctgtgcatgcgtcccaaagtctgagacttgcatgacctgtatgtggtgcctgccatactttttgagaggacgtgctcttccatatcaaacagacaggtgtgtgccattagcgccccgtcataccaacgacccgctgtcgacgagacttcccactcgtactgcaacacaggtcacaacgccgacaactnnnnnnnnnngttagcgccccgtcatagcaacgacccgctgtcgaagagacttcccacttgcactgcaacacaggtcacaacgccgacaactgccccaagtctgccctggacgtgttccgcctgcccgaccagattgctgcccgtgtggaggagcaatatgcgcgggtgagcgtatggctgctgtcctctctgcagattttttgtggcctgagaagcgcctgcacagctacccaggcaggtgccatgtgcctcgggctcctcataacccccatgactcnnnnnnnnnnctcgtggcctgagaagcgcctgcacagctaccctggcaggtggcgtgggcctcgggctcctcataacccccatgactcatgttttcctccacacccctccaggacgtggctcgcatgaaccccggcgagtctggcaagatggagcaggagttcagctccttcctggcggagctgggcggcaccgacccgcgcgccatgccctcggggggcgccggcttcggcggcggtccgtcctccagggcgggcctgggctctcgctcccgccccggggacgatctgccagactcctgcaagctatacatcggcaacctgtccaaggtgcgaggctagaactggctggcaggggtagggtgagggtcccggagcctgcattcactcacgtcgaatcgtgtcagtgagagcacggtgcatgcgccttgctcctgcctcacccaactgggccctcaccctcgcctcaacgtctgctccccgatctccagagcatgacggannnnnnnnnnggaactggctggcaggggtagggtggggggtccggagcctgcattcactcacgtcgagtcgtgtcagtgagagcacggtgcatgcgccttgctcctgcttcgcccagctgggccctcaccctggcctcaacctctgctccccgatctccagagcatgacggaggacgtgctgcgagatctgttcagtgtgcatggcaacgtgctccatgccgccgtgccacgagacatggcaacaggtgcatggggttggggttgggttttgcaaatgtgtgcgtgtctgttcctgggcgcgaaatggctgcccagaatgacgtgtggtgtggcagatcgtttgcgacggtgatctgtacctgggcgtgggcggcggggaagggcagcccagtcgagaggttccccaaccgctgcggtgatcagttcccctgcagctgttcatggggaggtcggaccgcccatcccacctctgatgaccactgcccctcaccgaccacaggcctggcacgggggtttggcttcatcaccttccccgacgacgccaccgccgcggcggcgaggagggccatggacggacacctggtggacgatctgcccctgatcgtgaggatgaagggcgagcccagctccggccccgccttccccatgcgcagaggtgtggtctgggggggtgtggctgtgatgtgaatgcctggagtgcatgcattgaggatgtttttgctcaggcgtgctcgtttgcgtcctgctggtgggcaggggtcctcaccagctccctgccgcggccgccttttcctcgcatcgcggggtccccaacaacatgcccacccactcccaaccctcccccaacaccacaacacatctcagnnnnnnnnnnggggtggctgtgatgtgaatgcctggagtgcgtgcatcgagaatgtttttgttcaggcgtgcttgtttgcgtcccgctggtgggcagggatcctcaccagctccctgccgcggccgcctgctcctcgcatcgcggggtccccaacgatatgcccacccactccccaccctcccccaacaccacaacacatctcaggtggtgggccctcccgccccgacgacgacctgccgccggagaacaagctgtatgtcggctcgctgccccccagcatcgacgacgccgctctccagcgggaattcgagcgcttcggccccatcgcctcctgccgcgtgatctacgaccgcgacaccaaccgcccgcgcggctacgcctttgtgaactttgtggacacggaggcggcgcgggccgcgctgttcaacatgaatggcttcacaggcttcgagggggggaggcccatcaacgtcaagatctccgggcagtccggggggccgggaggtgaggaaggaggcagaggggggaccaggatgcacgggatctctgtggggaattgttgctgaacacgaagagcttgtcagtctcacactgctcgtggcagcggcctccgctttggtgcctgttccaccccatgctcagcatcgattgccgccggcttcctccttccctctggggagcccagctcgttgcactctgcgcaccctcccatccagnnnnnnnnnnaatcaggatgcacgggatctctgtgggggattgttgctgaacacgaagagcttgttagtctcacactgctcgtggcagcggcctccactttggtgcctgttccaccccatgctcggcatcgattgccgccggcttcctctttccctctggggagcccaggtcgttgcactctgcgcaccctcccatccagacccttcagtcctggacccccagtgaggctcagtacctcacacccataccctgctcaaacactggtgctcgcaggtccaggaccagggccgaggccaccacccttccagaggggacccccccccccgcccggcgggtttgggggaccgccgccgccgccgtacggtggggggcccccgcccccaccgggccccggctacggtccgccgcccccgggcccaccctatggcggtgtggggggctacggtgcggtgccgccgcccccctaccccggccaccagtaccccccgccccctccccaccagcagtaccctccccagtacccgccgtatggagggccggggtacccgccctacggccagcaccccgccagcgaccccggagccggcgggcacccgccgccccctccacaccctggagcaggggatgggggcccgccgcccccgccgggcgcgggtgcctacggctacggccccccggcagacccataccatggccagtacggcgccgccccgcctcccccgcccgctgctgcgccgacgcccgccgacctctaccccggcgcgtacgcgccgggccccgcccagtaccaatacgctgcggcgccggcggaggaggcaccgccgccgccgccgccgccacccccggcacccgcacccccggcgcccgagggtggcagcgtgccggcccccacgccagcacccgtggagagcgagtacgagcgcttcatggccgaaatgtcctctcagtacaagtgattgcacatgtacatgtctagaacgcgagcgcgggccggcacgcaggatcactggctgggggggtggggttgggcgcgagatcggaggttgtcctcggcaccccaaccaccgcgatgtttcgggagcgcccctggcaaagtgctcgatcactgctattctattcctcaatacgaaccagcttgcaatgcacacaagannnnnnnnnnatgctcgatcactgctattccattctttaatacgaaccagcttgcaatgcacacaagatagcagtccgcgagtggcttcgagctggctttcaactccagggcccatgccggggcccgaacaggtgctctcctcgctgagcactgaactggtggcgcagaggtcctccaggtcagccgacagtcgacttgtggttccatcatccagtccgcccctctccccctcgctgcgacgagtctggggggacaaacgcgctcctaggtgggcccagggttgtcagcatgacgtgaccactccccatcagcacggcgcgaggcgccttgttccaagctggggcatgtgatcggatgcatacgtactgggggattttaggggatcagactgcgcatgctcccgatcgagcggcatgcgctctccagcaaggcgcgatcctcccgccccccttacccctcctgcagacccacatcccccctcccctccccggtgatgctgcggggtccctcgcccaccagcgtctccgacaagacgtccaggacagatgaggagggctttcccgtgctggtggnnnnnnnnnnttacccctctcgcagacccacttcccccctccactccccggtgatgctgcggggcccctcgcccaccggcggctccaacaagacgtcaagggcagatgaggagggctttcccgtgctggtggatggcgcccttgccaaggtttacctcgacctgcaggcggaggtgctgagctggacactcgagctaggggggcccctgtgctgtgctccgggccagtgctccacctccctacccgtcaccgagatcctggcggtggagatgcaggcggcccgcatgcgcagggtctggcggtcctggcccgagaaggcaaggagggtggggtggggtctccgggggtgcagccactgtatttggagattggnnnnnnnnnntgagaaggcaagagggcggggggggtctccggggggtgcagccactgtatttggagattggaagccatgcccacgtcgctgcgccgatgcacatccacctcagagcaacatgtccctccgtccccatccctttctcgccgggcaggcccatgcgctggtcatctacaccttccagcggtctccctccaacccctcctgctggcacccccgccaagtcacgttcacctccccgaatgaggtgcgggtggtcctcgtgcctggtgcctgggggttgctggggccgtggacagggtgggcgcagccatgcggtgctctgccgcctgcgctgcggagcgcatcggtgcgggagtgaggctcttgggggctttactgcgccccaccccgccaccgccacccacctttcgctttgcagagagtcccccccccccaaaaaaaacacacacacatgcacacacttctttgctacacccatgcaggccgtcctgcgcgcgtgggaggcggcggtgcggggcctgctgcagcgccaggcgcatcgcccccgccacctccttgtcatcgtcaacccgtacggcggctcgcgcctggcccgcgccacctgggnnnnnnnnnnatttcgctttgcagagagtcccccccaacccccaaaaacacatacacatgcacacacttctctgctaatcccatgcaggccgtcctgcgcgcgtgggaggcggcggtgcggagcctgctgcagcgccaggcgcaccgcccccgccacctccttgtcatagtcaacccgtactgcggctcgcgcctggcccgcgccacctgggccaccaccgtgcgccccgtgctggccaaggccggcgtgcggtgcacgactctggaaagcgcggcgcgaggccacgccgccgacctggtgcgccggcacctggaggccctggaggcgggtccccacgatcccgggccgcccgtggatggcctgctggccgtgggcggcgacggcctcttccacgaaatggtcaacgcgctgctggcggcgcgcctggcggcgggggggcggtcgcggcgcctggccgcgctgcgcctcggccatgtccccgcgggctccaccgacgcaggtcggctgtcgttcgcattcttcctggactgtgcaccggctgacctcttgttgttgtgccctgggaagcctggccgcagcgcctggcaggctgcatcgcatcgcagggcctgaggctcgcctggcccaggagctacggccccctccaggtttgttgcgccggaccagggccctcaaactccctcacacaatgtttcacagtggcgtgcacgctgaacggcacccgctcggccttcaccgcggcgatgcacgtcgctctgggcgaccaggtgcccctcgacgtcctgcgcatcgacaccgcgcagccgcacaccgagtttgcggtgtgcatggccaggtgcgctggtttgtcgggatgggtgcaggggaggtggggaaggggaagttcgtgtgtgtgtgtgggaaggggggaggcgccggcgtacgtttcgatcaggcagggacgctggtgcggcgtcccaacctgattcgattccctgatggacattgctcctgcgcccaaaatctgccaagccttgacaaaggacactcgaggtcccacccgatcacacctcccagctacggcttcatgggcgacctgatnnnnnnnnnnccggcgtacgtctcgaccaggcacggccgctggtgcggcgtccagacccgattcgattccctgatgggccttgctcctgcgcccaaaacctgccaagccttgacaaaggacacccgaggtcccacccgatcacacatcccagctacggcttcatgggcgacctgatggccgagtcggagggcctgcgctggctggggccgctgcggtacgaggtggttggcgcgcgcatgctggccgccaaccgctcctaccgggccaggctgtcctacctgccacccccgctcgaggcccagcccagcttcacgcgggcctgcagggcggggtgcgatgcctgccgcgcgggcttgcatcccgcgccgggcgacgccgagctggggcggccggccaccgtgctctggcagacacggtgggtcctggggtcgagcgaccgcgtcgtctggatcaggcgggcaggcacggcgcgctggggtcctctcaaccccgctgcatccccttgtgcacacaagcggggaaggccaaacccaaaccctccaacccccccgccccaaacccaacaggcggtcagagtgggtcacactggaggaggaggagtttnnnnnnnnnngccgctgcatccccttgtgcacccaagcggggaagacctaacccaaccccccaccccacctcgccccaaacccaacaggcggtcggagtgggtcacactggaggaggaggagtttnnnnnnnnnntgccaagtgaggcgggtgtgtgattttgtacttgaggacttgctgtcaagcggcagcatcgactctggctcggcacccaccgcagctgggactgggaattgagctggagggggtcagtggttggacccctcgtattccatgcaaaacccgcgcctcatctcccggtnnnnnnnnnngggtgttcagtggttgatcccctcgtatcccatgcaaaacccgcgcctcatctcccggtnnnnnnnnnngctgggttcatgatggtggtcatgccctgccgcagcgacaagtcaaaaaacggcgtcgccaagtgaggcgggtgtgtgattctgtacttgcagagttgctgtcaagcggtagcatcgactctggctcagcacccaccgcagctgggactgggaattgannnnnnnnnnnnnnnnnnnnnnnnnnnnnnnnngcaggtatggccacctgagcgacggcaagctccacctggtggtgatcaagcgctgcagtcgcctgatgtacctccgcttcctcctgcgcatggcgcacatcgggctggaggctgggggcgaccacggcgattacataaaggtcatccctgccctcgccgtccgcatcgagccggtgagagggggtgttaggggtggggtttggatacagggaacaaggggtcccatccttgggggtcggtggagggctgctgactgtgccatgcgcgatgcatgcggcctcaccctggcccctcccctgtgtcactcatgagaagccccttcaaaaatgtccgactgcaccccagatcggcaaggaaagccagtggaacgttgatggcgagctcctgcccagcagcattttcactgcacagctgcatcgcggggcggtagacgtttttgccagaggcgtggacggctgacaccggccctcgtggttgcttcacatgtatgccatgccagtacttatggcaagttgagtcaccccgtgttgccaccttggcaacctccctctttctttccctcaccatctgacacgccttgttcctaaccctgtctgacgccaagtaggtatgcactgtcctctgtcaacataggccttgactgccacgggcaattcccggcagcaatgcaacctaaagggtggacctcgggaggcacatttgcgcctgttgccccaacatcaaggagagtgagcatgaggctctggttgattagatcgcagggcttgagactctgccgccagcccaccacgatgatgcctcactccttctcggatggccgaacctggccctcccaggacgccttccactgcgaatgagatgtgcaagggaaggggcttagcgaggatgcaagaccacctgtgacccttccccatcaagagggatccatcacaaatcattgcccccactaccatctgcgtacatcagcatacctgcttgtcgtaaaatgtggcctcgtcaaacaggttcttgtacttgttgaagtcgccggtggtgcggaacaggagcactgcaattggacagggtcgggacttgacgatgnnnnnnnnnnaaatgagatgtgcaagggaaggggctttccgaggatgcatgaccacctgtgactcttctccatcaagagggatccatcccaaatcattgcccccactaccatctgcgtaaatcagcatacctgcttgtcgtaaaatgtggnnnnnnnnnngcttgccacaagtcccccacgcccagtcatatcacgcaaatggggccctcacctccaaagacggcgacgtgcagcaccaccttgccgaggaaggactcctgctgatccaacaggccgacacccgtcagcttgtccactcccagagccaggaagtatcccagcatggctgccctcccattcagcttctctgcctgtggggatttcataccgcatggggttgtgtgtgccagtttgagaggcgctatgatatcaaggaaagcacccttcccaacctggcatcacaccaccagatgtttgatagtagcgctgcatggtccattgagtcaacccacctctgggagatggaagcggcggacccaggcccaccaggggatctcagaggtgtcaaacctcacggggtcttcgttgactgtgtttgatggagtggggtgaagcaaggttgagagtgcaggtgtcgagcctgcatgacccaccagagaggatctgaggggctacagtcctgagtgctgaggccccctcctggaacatgttcagcaannnnnnnnnngagaggatctgaggggctacagtccttagtgatgaggccccctcctggaacatgttcagcaatcatccacacaccagaggggatggggtttccctccagcatcctccggcgagtcatctcggccgtgatgacggcatcccagtccatgttgcccttggagtcgcggaaggactccaggacccagcgcccctccttccagcggggctcggtaaacttgccgtccaccacctgtggctggagggaagccgtgctctcccctgcggccatggccttgaacttgtcagaggcatccttgcccgccgcggcctccccttgcagggttcctccccgcagcaggggcgatgccttgcgatcctgtcgcggtgaaagaaaagctgtattgtgagagaaggtcagccacttgagtacgcacccaggcgatgctcgtgaaacaggagtcaccagaggcggaaggagtccgcaggccatgcgatcagctcaggatcatgctcctccctctcagatnnnnnnnnnntgtgaaacaggagtcaccagtgcggaaggagtccgcagaccatgcgattagctcaggatcatgctcctccctctcagatactatgttcaccccaaatccatccctttgcaaaccttcttctcaatggttgcggtgttcactgtgttgttttccgcagcgccagcatgggtgaccgtcctgccaatgtggttcattgcgagatactgtgggtaaacaagatctgccgggggcgagatgtccggagcctgcgaatgtcgaggtccatggagatgtgcttaaccaatccagaaatgagaagggaccgctctcacctcgtgggtctccgaacagcgcgtgtggtcctcgagaatgcggctcccttcaagctggccgagcttgcacgannnnnnnnnntaaatgagaagggaccgctcccacctcgtgggtccccgaacagcgcgtgtggtcctcgagaatgcagctcccttcaagctggccgagcttgcacgagcgtgcaccgcagggcactggttcaggcacgccatgatgatccttctgccgatgcaccggtattctggtcaacttgattcccaccaggtgcgagcctccagaatcgcatgcccgtgcctctcggtgaagctcagctcgatcatgtatgcgcacattatcctcctgcatgacggtgagtgacagggtcccggggtctactgctatggtcgccccacagggacacagctcacgatgcgatgatgctgcatcgcgggcgctacccccttcggatcgtcaatggtggacgctgggaggtgtacatgcacagtttcgcagagcccatagctctgccttagatagttacaagtcctcagatctcgacaccgtcaaacccccctcctcgcccctgcattggctgcccttctgtcgcttcctcccttgcctccccggtcgaccctgccagaatggtgtgtgccctgggcgtagctgcacccgcttccagcaagcagtgtatcgcaggaaagggcttgaaagcgcgtagcaacgccctcggcgttcgtcgacgggcaggtgggaccggcactgctgtgcccggcgcggtagcgtaaaccatatgactgcatgcccgcacactcccctgcgctcctacgatgatgcccgccctccacaatctgatgccgtgcctgcattgctccgatcatgccctgtnnnnnnnnnnattacaatgatgtccaccctccacaatctgatggcgtgcctgcattgctccgatcatgccctgtctggggagcatgtatgccaccctgtccccccccccccccccccccccccccnnnnnnnnnntgagcccggtgctggccgtcaagcgggatgccgccgatcccaagagtcgggtggtgatcaccggccagggactcgcttccgtgttcggaaacgacgtggacaccttctacgactgcttgctggagggaaagagcggcgtggacaccattaccaggtgcagggctgcgctgagttgtgcgtcagggctggggtggttgagggatgggactggtatgggcgatggcaggctgttggtgacaatcatgatcccactcctccctcaagcgcctcctctgcatcacccaggtttgacatcaccgagttccccaccaagtttgccggccagatcaagtcctttgacgtggagggcctggtggacaagaagaatgctcggcggtacgacgacgccctttcctatgccatggtcgcatctaagaaggtgggttgattgtgcgagaggcggtagaatcgaatcgggaccccgccatggcatgccagggcgtaggtattcaacaccccccctccttccgcactgaatgcatgacctccagtcactcccctgctttctcacctccactcttctccctgccgctgcacaggccctgcgtcaggcgggtctggagaaggagacctgccccgaggggtacgagaagctggacaagacgcgtgtaggcgtgctggtaggctccggcatgggcggcctgaccgtcttccaggacggcgtcaaggccctggtggagaaggggcacaagaagatcacgcccttcttcatcccctacgccatcaccaacatgggtgggaggaggaagcggggccgacctgggtgggggaaagtctgcttgggtcagcgtggccgtgtggcgctcgtcctttctctgatcctgggcgcgtcgctggagcatgtctccccatcgcttcagagcccctcgggcccccgccctttcttcctcaaacaggcagcgcgctggtgggcatcnnnnnnnnnnttgctttctcacctccactcttttccctgccgctgcacaggccttgcgtcaggcgggtctggagaaggaggcctgccccgaggggtacgagaagctggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttgggtcagcgtgggcgtgtggcgctcgttctttctctgatcctgggcgcgtcgctggaacatgtctccccatcgcttcagagccccccggacccccgccccctctccctcaaacaggcagcgcgctggtgggcatcgaccagggcttcatgggccccaactactccatctccaccgcatgcgccacggcaaactatgcattcgtgaacgcggccaaccacatccgcaacggcgacgcggacgtgatggtggcgggcggctccgaggcctccatcgtgcccgtgggcctgggcggctttgtggcctgccgcgcgctgtccacgcgcaactttgagccctggcgcgccagccgaccgtgggacgcgggtcgcgacggctttgtcatgggcgagggcgcgggcgtgctggtgctggagtccctggagcacgcccaggcacgcggcgccaccatcctggccgagtacctgggcggcgccttcacctgcgacgcgcaccacatgaccgacccccaccctgagggcctgggcgtgagcacctgcatccgcctggccctggccgacgcgggcgtggaccgggacgaggtcaactacatcaacgcgcacgccacctccacgctggtgggcgacaaggcggagatcaaggccgtgcgcggcgtgtttggcgacatgcgtggcaccaagatgaacgccaccaagtccatgatcgggcattgcctgggcgcggcgggcgggctggaggccatcgccaccatccaggccatccgcacggggtgggtgcaccccaccatcaaccacgacgaccccatcccggaggtggagggcatcgacatcgtgcccaatgtcaaggcgcggcatgacgtccgcgtcggcatctccaactcctttggcttcggcgggcacaactccgccgtcgccttcgggccctacaaggaggcatgagccggcggccgagtgggtgggagtgcggggctggcgcggcgcgagggatggcaggccctgctcttccgcgcacatcgacgaccccccggcgcccgacttggctnnnnnnnnnntggggctggcgcggcgcgagggagggcaggccctgctcttccacgcatatcgacgaccccccggcgcccgacttggctgccgatcagcgacccgggcgccagcccgagagaatgagctttgctgcagggcgctcaatcgtgccaaccgcagcgcccctcagggacccaggcatgcccccccttccccaatccctaaaatcgtcttgtgtgaatccatctcttgactggcaaggactgtacacagcacaaaggagagtcttcacaccatatcatgtgggaatgcctggataacttatcagcctgtcatgcttgcagttgcggcagggaagtcgcaacctctgtcatgcatgggcagcgaaggtctgctcagacccagagaagctgcgactccaggcctgacgccgaacaggaggaatggcggatcccaggcaggcgccaacccaggacggtctacccctccccgccctcagaactgctcgctgcggctggccacggcggcgctcacccggcccagcacctcctgccaggtcagcgcgcccaccggcccgtcgcggtaggtgcgcaccgacagcgtcccggcctccgcctccgccggtcccaccacgcacatgacggggaccttggccttctccgcgttgcgcaccagctttcccatgctcatgcctgccgtgggtgtggggaggggtgtgttgaggctggtttcggtaccagagggggacacattatctcgcgccggcgcacctggggtaaccttcgcccccatgaacgcagccgacgaccttgcagaacccccctcccccccccccaggcctcgcacctcccgcnnnnnnnnnnacacctggggcagcctccgcccccatgaacgcagccgaccaccctgcagaacccccctcccacccccaggcctcgcacctcccgcgacctccacgcgaatgttgtgtgcccgcatggcggacgccacctcctccatgtacggcctcactgcgtcgctggtgggcagcagcctgacctgctcaggcgccagccagagcgggaaggcgcctaacaggaagaggggggggggcggacaaagcattgcacagcgatgagagggatgcgaggatcgagggcatggctgcctttgatcaataacagggcttgagttccaaccccaggctgccggcccagctgcaacaacacagcatgatcaaccaactgatcaccccccccctccctcgccaataacacccacccacccatacctgcgtggtgctcgatcaggatgcccatgaagcgctccaggctgccgagcagcgcgcggtggatcatgatgggccgctccttctcgttccctgcggtggtgtaggtcagcccgaaccgctccggcagattgaagtccagctgcaccgttgagcactgccagcgccggccgatggcgtcctggatcttgatgtcgatcttggggccgtagaaggcgccgcccccctcgtccacactgaacggccagccctgcgtgtggagggggagggagcgcgttacgcatgtgtatttggtgtgtcacaagaagggtagaaagggatgtgcaccatgcaatggtaggagcagggacgggccacacagggcagagccacatccgcgccagttggttcgcgccctgcgccagtcagtggtgaccgactgcgccactcccagggcccaagccaggccctcgagactccctnnnnnnnnnntagggacgggccaggcaggccacacagggcagagccacatccgcagcagttggttcgcgccctgcgccagtcagaggtgaccgactgcgccactccaagggcccaagccaggccctcgagactcccttgcctgcccgcccacactcaatgctcgaacccgtcatcccctcccgcgcccccccttccttccccttccccccacccaaaaaactacagctcgccttgtcctccagggccgacaccagggcggcctcggcctgggcccagtcggcgtccgaccccaccgactccgcggggcgggtggacaggttgacctcgtagcggtcaaagccaaaggcggtgaacaccgactggaccagatccagcacccccctgatctcgcccgcaatctggtcgggcaggcagaagatgtgggcgtcgtcctgggtgaaaccgcgcacacggaagaggccgtgcatggtgccggagcgctcgtagcggtacaccgtgccaagctccgcccagcgcaggggcaggtcgcggtagctggtctgccgcgccttgaagatggccacgtggcaggggcagttcatgggcttgagctggtacgactcgtcctccaccttgacctggccatacatggagtcgcggtagaagtccaggtgcccgcttgtctgccacagctcaccctgtgcggcgtaaagggggtggggagagagagttgcaagagatcttgaggctatcagggaaggaaatcgtgcccccaggcgccctctaagcgtcactcatctgcaaagcccaccccacccccactatcagcgtgccttggcaatgtgaggtgtgtacaggagcttataccccgccgccaggtgcatgtcnnnnnnnnnncaagcgtcactcctctccaaagcccaccccaccccacaatcagcgtgccttggcgatgtgaggcgtgtacaagagcttataccccgccgccaggtgcatgtccttccagaacgtttccagctggtgccgcacctggtggtagatcggtggggacggtgtgagaaagtgctctctcaaggtataaagagcaaaacaaagagtgtgggggagttggtgaggatgtcccccggccgcccgcaatcacagggcagcannnnnnnnnnaatcggtggggacggtgtgagaaggtgctctctcaaggtataaggagcaaaacaaagagtgtgtgggagttggtgaggatgtccccccggccgcccgcaatcacagggcagcaaggcagccacgcagctcactcgtcgagttatgagacattgcaacagcagactccactatgtacaagcatcacctcctctcccctctcaccatcgcgccgttggggtgccagagcacgaggccgccgcccacagagtcttgaatggagaagaggtccagctcagcgcccagcctccgatggtccctggcagacagtggtacaggagaggtgagatatatttggtcttgaggatggtgttgatgaaggctgtggcacgatgatttggcagctgcttgccgggtctaccaggatccccacaggtggtaaaaccaggacacgcgcacgctttgagacactaccatgtgtgtgtgctacaccacgttttgcacccagcgacgccacgagcgctctgctcattattgagcaaaactgcccaggctacttcgtgaacatgatttccgacccaaccaatccacgctaccccaataaatccnnnnnnnnnntaggctacttcgtgatcatgatttccgacccaaccaaccaatccacgctaccccaataaatccctgctgacccccgctccacctgcgggtggcctccgccttgaggtgcttgtacgcatccagctgctgccggctctcccaggcggtgccgtagatgcgctgcagctgcgcggcctgctcgtcgccgcgccagtatgcccccgccacgctttccagctcgatcgcctcggcgttgatggcgccggtgctggccacgtggggcccggcgcacagatcccaccagtgatccttctcgccctcctccccaatgtggtagatggtgatgggcgcgtcaggggtgttttttaggatggagtccaggatctccagcttgtagnnnnnnnnnngccgatgtggtagatggtgatgggcgcgtcgggggtgtttttgaggatggagtccaggatctccagcttgtagggctcgccgatggactcgattcgccggcgcgccacctcagcgggaacctggattcatgtgttttgggtagatgctgttgcatgcagtccccgagcgtaggaagctggctcacactatgtctgctggtggtccaggcacacatcctgggcatggggcatggcaaacgtcacgtgatccctccactcccagaaccctgtccccaagggacaaccacgccccatacccctggcctacctcctcgcggcggatggccaggttgcgcttgatcagcctcttcatctccttctggatctttgggagatccttctctgtgatgggctgttgtgcgtggaggagaagggagaatgtcaccaggcatgccagcgacatgggtccttgcaatggagggcaagccgagcagtccctcagctacaaagtgacaacataaacatcaggaacatgcgctcttctcattcaccccctcccaatcacctggggcatgtcaaaatcgtagtaannnnnnnnnngctcagctacaaagtaaccacataaatatcaggaatatgcgctcttctcattccccccttcccatcacctggggcatgtcaaaatcgtagtaaaatccgcggtcgatccagggtcctatggtgcacctggcccccttgtggactcgctgcactgccatggccatcacgtgggcagcgctgtggcgcactgccagcaggccgggggactcggagctggtggggaggtcgtccagggtcaggctggcctctggagctggagtggtctcagagggggccacctccatggctgcagcgggggctgctgcgcaggtacgcatctggtcggagtgcaggccgcgcttgctggagccgcataccaccctgggcgggaggctgggggaggaggagctcaaccctcgcaccgggccatgggatggcgctcgggcacgtggtctgctggccccgacactgaacggccttgggcacaccgcggtcggcacgacgtccagggcgctcatcgcacgtgcaaacatgagcatgccgctctgcctgaagcatgcactgcgcaggatgggggcactcatgcctcctctctgggtcgggtgacgagatgcacaggagctgggtttcaggcggtgtggctctcctctactgtgccatgcatggcccctgcatcttgaatcgatttttacggtggagtttcttcaaattccagcctcctgcgcgcccagctcgactgtcattgtgcgccatgctgcctcccgagtgatctcgctcgtgatttgcatgtcgagccgatggggccacccgttttgtcgtcatcagatgaaggcaatgcaacctcgtcacatnnnnnnnnnnccgagccgatcgggccacccgttttttcgtcgtcagatgaaggcaatgcaacctcgtcacatccatgaccgactttccttcatcaatgtgaaaacccaccctcgcaagcagcacaggtaattgtcgaaagtctgtattttgcagggcacccacatccaggcgcggcgtgatggaagagcacatgcatgtgagatgcgcgggtccaggagtgaaaaggtacagagggagagtggaagggaatggagaatacagaaaaggtctcactcggactcctcctttgccttcttcttcttcttcttctccttctgcaagatggattgtggacggtgtgccgtgggtgaagtcctgtcgagacgagggggatgggtctggtcgctgatgcacgcacacagcccggcatgctcatgcaggctcggtcgtggcctggttctccaagcctgtcccctcataggacatgacatccacgcaggtccnnnnnnnnnnaaagatggattgtggatggtgtgccgtgggtgaagtcttgtcgagacgagtgggtgggtccggtcgctgatgcacgcacacagcccggcatnnnnnnnnnnntctctgtggacgccgcccccggcgacagctccctcttcttctccttcttctccttcttctcctt

SEQ ID NO: 39930 - DNA, 75 bp, Chlorella protothecoides
ccccccatgccataccccgccatcgcggaaggtgggtgggggtgcgtgcagcagtggtagtaggctgacttgtgc

SEQ ID NO: 39931 - DNA, 98 bp, Chlorella protothecoides
cagtaagagattcaacccaccagttgttgctgctcctgttcattttttccgagcccatctcaacgtttacctataaaaaccaagtaagacaatcacct

SEQ ID NO: 39932 - DNA, 5439 bp, Chlorella protothecoides
  modified_base (380)..(389): a, c, t, g, unknown or other
  modified_base (1086)..(1095): a, c, t, g, unknown or other
  modified_base (1573)..(1582): a, c, t, g, unknown or other
  modified_base (1976)..(1985): a, c, t, g, unknown or other
  modified_base (2544)..(2553): a, c, t, g, unknown or other
  modified_base (2818)..(2827): a, c, t, g, unknown or other
  modified_base (3559)..(3568): a, c, t, g, unknown or other
  modified_base (4067)..(4188): a, c, t, g, unknown or other
  modified_base (4394)..(4403): a, c, t, g, unknown or other
  modified_base (4490)..(4499): a, c, t, g, unknown or other
  modified_base (4898)..(4907): a, c, t, g, unknown or other
  modified_base (5064)..(5073): a, c, t, g, unknown or other
  modified_base (5165)..(5375): a, c, t, g, unknown or other
ggggggggcgtggggggggccgggggcggggatgtggacgagggcgccgccccgcgggccgcccccgtcgccaaccccagcccccagcccgcgcccgccgaccagcacagctctgggtccccgccgacggacgagaacgagacggggaaggaggctggccagccctgctcgcagcccctctcgtgcagggcggagctggcggggagcggccatgcaggggagggccagcctctgacgcccctgctcacacagcctcggacagaagccccgcccggatgaaagtgtcgtacatcgactgatctcctgtgtggcacactggcaaccattcgggagattcttattccgaaactgggctcaaactgacagagtgcggggcctgnnnnnnnnnnccactggcaaccattcgagagattcttattccgaaattgggctcaaactgacagagtgcggggcctgactcccagatatctactgaattggggaggtggaagttcctgtcccactgggaggaagcgatctcgtcgaaggagaatgcccttcatgtcatccacgctcccaatgctggaacactcgccccacacataccgtcacgaaagcaaccgcccattttccattcatgcacatgcatgctgccgataccggtgtgagacaggttcctgacaccaccctctcccgatcacttccggcgccccacgccccgggcatgctgggagctgcttcctccctacagcactgccttaagacattctccaggctccgaacggccagccccctccccgcacaccgcccctcgctgcgaaggtcggtcgtcatgacggccacggctcagacggagcccgccccggcagacgtcaagggccgcagcctggacaacctgaaattcgacaacaggttcaccgaggacctacccgcggatgagaagaagctcaaccgtttgcgcgaggtgagtggcctcttgtcgcccgtagtggctgcaatttcctgtgttgccccctggggcgggctgtagctcagtgcaggctccatgcagcctcgctttccaatctcccttcctaccaggtggaggacgcggtgtacacctgggtnnnnnnnnnncggccccatgcagccccgctttccaatctcccttcctgccaggtggaggacgcggtgtacacctgggtggaccccacccccaccgacacggagccacacactctggcggcatcacaggaggtggcccggttgatcggcctggacttgggcgagctccagcgcccagagttcgcagccatcttcagcggaaacgcgccccttccgggggcaaagccctatgcgcagtgctatggcgggcaccagtttgggtactgggcgggccaggtgcgagggtgctcggcgcatctgcgagggctctcaggggtggagccggggcctggtgtcgccctgggcttgggagaggtttcgacgacagggcatctcatgagcacagaagaaagggatgtgagaacgtcagcagagggagctgacgtcgttgcaggagtgagcgggaacaggtcgcctcttcccccaccccctctgcagttgggagatgggnnnnnnnnnntcatctcatgagcacacaagaaagggacgtgagaacgtcagcaaagggagctcacgtcgttgcaggattgagcgggaacagatcgcctctccccccaccccctctgcagttgggagatgggcgcgcgatctgcctgggcgaggtcgtgaacgaggcaggcaagcactgggagctgcagctcaaggtgggttggtggagtgtaagaggggcctgtattgatgggatgggcctgttatttgccgctgatggcggtgctctggttgcctcttggacgatgatttgcaaccagcctgaatgctggttgtttggaccgatccatgaggacccgctcagacaacacgcaactgattccactcattcttaatgaatggaatcagtttccaacctcaccctnnnnnnnnnngtgatggcggtgctctggttgcctcttgcacgatgatgtgcaagcagcctgactgctggtggtttggactgatccatgaggacccgctcagagaacaccctatcgcttccagtcattcttgatgaatggaatcagtttccaacctcaccctgggcattgcgatccgaccgcacctcgccccatcatctgcagggtgccgggaagacacccttttcgcgcatggccgacgggcgggcggtcctgcgctcctcgctccgtgagtacgttgcctccgaggccatggcggcgctgggggttcccaccacgcgcgcgctgagcctggtcgcgactggtgccggcatctacagagacatgtagggccttgttcacttttggaggagacgaatcgggggaggacatgcggggtgaggactccagaggtgtggcctgatgtaaccctgcttctagagggtcatccaaggcagctgcatgctctgccaggctgtgggtcctacgctacgtctcgtcactccccccatcccactgcgctccaggttttatgatggcgacgtgaaggagnnnnnnnnnnggtttgtgggtcctacgctacgtcttgtcactccccccattccattgcgttccaggttttatgatggcgacgtgaaggaggagcccggcgcggtggtctgtcgggtggcccgctcctttgtcaggtttgggacctttcagctgcccagcgctcggggcggcgagcagctggggctggtgaggcgtgtggcggaccacgtcatccggcgccactactctcatctgaatggggacaatggcgaggtctccgcaggcaacggcgcggnnnnnnnnnnagcgcgtggcggaccacgtcatccggcgccactaccctcacctgaatggggacgatggcgaggtctccgcaggcaacggcgcggcgggggaggatggcgctgccagccctgaccccaagtacctccgctttttgaaggaggtggccgagcggacggcggccacggttgtccactggcaccgcgtcggctttgtgcacggcgtgctcaacaccgacaacatgagcatcctgggtgtgttgagcggtgtggcggagggcggcgtgtggctgtgggtgtctggatgggtccggggagaggacgtgtgtcgatgaaggctctcctgggtcctgaagtcggtacaggaaaccaaatggccagaggattgctgtgagctttgcggttcccagcccgtggcgggcgtgcgccggtaacgggtaattcacgtccgcatgcacaaattacaatgccgcaggtgacaccattgactacgggccgtatgctttcatggaaaggtttgaccccaactacacccccaacaccaccgacttgcccggccgacgatatgccttcaggttggtgggcaggcatggacggtgttcagaggggaaggcagagggcctgctatcatgccacccgcagtccttcatctgtcgtggcctgaacttgttcctacatgtgcgtctgcctgggcgccggccaagcattggaatgttggaagtgacggcgacctgtcgagtcccgcacagatcagannnnnnnnnnccatgccacccgcagtccttcatctgtcggggcatgagcttgttcctacatgtgcgtctgcctgggcggcggccaagcatcggaatgttggaagtgatggcgacctgtcgagtcccgcacagatcagatgtgtcaaaccccaccctctgatctccctcacacgcacaagaccttttccccaaaaaacattttcagggcgcagcctgccatctgccaattcaatgtgctcatgctgggcaaggcctttgtgctggcggggctgctggacagcgagggcctgcaggaagtggtggacagcttcacggtggccctctccggcgccttctccgacgcgatgcggcgcaagctgggcctgcgcgactttgaccccggcctgtacggcgacctcatggcgctgatgatccaggacaagccggactttaccaacacctggcgcgccctatcgagcgtcgcgccgggggacggggcggagggcctgaccccggccctcgccgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggacgttggcgtggcaggggctgagaggggcccgggcggtgaaggaggggagctggggggcgctggagaaggctgctggacctgaaagcagcaggtgtttggaaacgtgcacatgccaccctcattttcaccctcccctccccagcttcccgtccctccccttcccgccccacccttcttacacaggagcgggtggaggctnnnnnnnnnntctgggcgaagacctggcacaggtgccgtgtgtgggtgtggaggggtgttatatagtgaacggcctcgtgatgttttacgagctgcnnnnnnnnnntggagtgcgtgggcggccaagtaccgtgccgtgctggccggccaggacctgcccgccgccgagcgccgcgcgatgcaagacgctgccaacccggcgctgatcccgcgtaaccacgtgatggtgagcctgatcgccgaggtggagagcgggaacacgcagggcctggaggcgtacctggaggcgttggcgcgaccgtatgaggatgggctgggggaatccgcctggaaggtgcccgcgccccgacaaatccgcaagggcatcgagctcctgtcctgctcctcctgagcgaatggaggctgggcagtgctggacaggatgcccatggaccccatcccccttgggatatgtcaatctcattcgaccttgcatgcaagtgtcgcactacattcattcacacannnnnnnnnngtggacagggtgcccatggaccccatcccccttgggatgtgtcactctcactcaaccttgcgtgcaagtgtcgcactacattcattcacacaccccgccgcgtcggtgtccagagcacgaggtggctggctcctcctgcgaaccctacgtttgtggnnnnnnnnnnccatgtcaccctcattttcaccctccccttcccagcttcccctccctccccttcccgccctacccttcttacacaggagcgggtggaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcgcggccgtacgaggatgggctgggggaacccgcctggaaggtgcccgcgccccgacaaa

SEQ ID NO: 39933 - DNA, 128 bp, Chlorella protothecoides
gcctgacgtcagcgctgggccacctcgaacggccactgcacgcggccgctcgcctgcagtgatccctgatttctggcttggtcgggccccatacccacctggcccaccgacctcacgccatggcctcc

SEQ ID NO: 39934 - DNA, 74 bp, Chlorella protothecoides
ccccgccctcccagcctcggcagaccacagcatggatccacaaggccatcacgagcttgttgagtcaagccgtc

SEQ ID NO: 39935 - DNA, 69 bp, Chlorella protothecoides
cctgcccaggtcccacgggatcgacacgccatcccccgccccacctccctcaccccctcgcctcgcaga

SEQ ID NO: 39936 - DNA, 24420 bp, Chlorella protothecoides
  modified_base (615)..(624): a, c, t, g, unknown or other
  modified_base (820)..(829): a, c, t, g, unknown or other
  modified_base (1584)..(1593): a, c, t, g, unknown or other
  modified_base (2411)..(2420): a, c, t, g, unknown or other
  modified_base (2913)..(2922): a, c, t, g, unknown or other
  modified_base (3553)..(3562): a, c, t, g, unknown or other
  modified_base (3934)..(3943): a, c, t, g, unknown or other
  modified_base (4402)..(4411): a, c, t, g, unknown or other
  modified_base (5183)..(5192): a, c, t, g, unknown or other
  modified_base (5890)..(5899): a, c, t, g, unknown or other
  modified_base (7153)..(7162): a, c, t, g, unknown or other
  modified_base (7506)..(7540): a, c, t, g, unknown or other
  modified_base (7658)..(7667): a, c, t, g, unknown or other
  modified_base (7768)..(7777): a, c, t, g, unknown or other
  modified_base (7834)..(7925): a, c, t, g, unknown or other
  modified_base (8483)..(8492): a, c, t, g, unknown or other
  modified_base (9886)..(9895): a, c, t, g, unknown or other
  modified_base (10313)..(10322): a, c, t, g, unknown or other
  modified_base (10802)..(10811): a, c, t, g, unknown or other
  modified_base (11820)..(11829): a, c, t, g, unknown or other
  modified_base (12213)..(12222): a, c, t, g, unknown or other
  modified_base (13561)..(13570): a, c, t, g, unknown or other
  modified_base (14060)..(14142): a, c, t, g, unknown or other
  modified_base (14333)..(14342): a, c, t, g, unknown or other
  modified_base (14576)..(14585): a, c, t, g, unknown or other
  modified_base (14673)..(14682): a, c, t, g, unknown or other
  modified_base (14918)..(14927): a, c, t, g, unknown or other
  modified_base (15095)..(15104): a, c, t, g, unknown or other
  modified_base (15379)..(15388): a, c, t, g, unknown or other
  modified_base (15889)..(15898): a, c, t, g, unknown or other
  modified_base (17175)..(17184): a, c, t, g, unknown or other
  modified_base (17270)..(17279): a, c, t, g, unknown or other
  modified_base (17353)..(17362): a, c, t, g, unknown or other
  modified_base (17856)..(17910): a, c, t, g, unknown or other
  modified_base (18191)..(18200): a, c, t, g, unknown or other
  modified_base (18763)..(18772): a, c, t, g, unknown or other
  modified_base (19005)..(19014): a, c, t, g, unknown or other
  modified_base (19822)..(19831): a, c, t, g, unknown or other
  modified_base (21198)..(21207): a, c, t, g, unknown or other
  modified_base (21598)..(21607): a, c, t, g, unknown or other
  modified_base (22293)..(22302): a, c, t, g, unknown or other
  modified_base (22704)..(22713): a, c, t, g, unknown or other
  modified_base (23053)..(23062): a, c, t, g, unknown or other
  modified_base (24210)..(24219): a, c, t, g, unknown or other
caggcggtcgccggcgtgcggctggtcgcgccgggggggcgggcgcccgagagcgccgcgctcgccttccaggtgggcggcgtgtacctcctgtcgtgcccgaccgtccccggcccgcccggcgatctcgtcctggatctgggcctgagtcgcgccccaggcccagctcgagaggtcgccatgctgggcctgggtgccgccgtgcgcgggatcgaggtggtgagggcagagggctccggcacggacgcctcctcgctgcgggcgcacctgcccgcaccctcctcgccggccggccggctggcgacgctgcagacgctggcggcacgcctttcggcggcggcgatgacggtgcgcaccgtcgagcgcctgctcggcgcctgccccagcctggcggccgtgcgcgcggtgccgggggccgcaaccgcggcagtggtccccacgacggggctgccgctgcgcctcgtcttcctgcacctcgccgcgggtgcccgcgtcagcgtcgacgtcctcgccggaccctccgccacccagttcctgggagcccgcgtggtcggcgcccccggtgtgtgcgaggcggtggggcagtttgcgtttgcgaccgcggggctcgatggnnnnnnnnnnagtggtcggcgcccccggtgcgtgcgaggcggtgaagagggtttgcgtttgcgaccgcggggctcgatggcttgcgtgagggtgccccatgttgcccacctcagagccctcacacaactcctcgttctcgggtgcaggcaccgctcaggcaagcagcgagggcacgctgcgagccgtggaggcggcggcccgctcnnnnnnnnnncctcgggcgcaggcaccgcccaggcgagcagcgagggcatgctgcgagccgtggaggcggcggcccgctccctgggccgcagccccgcactgcaggcgctggctggggcagtgcatgcagtgctcgccgggtctgcgccgtctgccgccaccgactttgctggacccagcaacttccagaaccccctgtttgcggaacccctggcgcaatgctgagctgtctaggtggatggatgggccgggtccggcaccaccggtctcccccgaccctcatcggccaataccaccactgcgattgggttgcaaacaccagacacctcacccccactgacccccagacctgacactgtagctgcatgccacaattccttgtgtaacagacccagaagcagggggaaagcaggggacggagtcgtgggcccgacgtgagccgacgcccattgaaggtgatgtagtcagaagtggggagagaggggcctctcatcggcctgttttcttcctcaggcaatggcaacgagcacatgcctgttcttcgccggcagcagagatgccagggctcgacactgcacacacatggtccgacagaccagcccagtgctgcctctcaggtactcttgtgcatggccagactgatatcatgtgtgtactgcacgaagaagctggcacgctgcactgctcgcttgggtatgacatcctcgaaggtcaggtacctgcggggcaggggcggaggctgccgctgaggctggaacatttgcnnnnnnnnnnccgcttggggatgacaccctcgaaggtcaagtacctgcggggcaggggtggaggctgccgctgaggctggaacatttgcgtgcctgcaggtcttgcaatcttgggcgtccctctggagccgcagaccagctgacccttgtgagggccccatcccaaccactcgatcccgtcagccgctcacctgacggccgggtgcatgttgcccttctcattccggtgcacctcgaaggtggcctcgcagtagtgccggaacttcttctgcttcttcacgttgctcacaaagtggtactcggcatggaacttgccgcgcgtgacgtggaagagcatgaagccacgttgctgtgtgaggggcggagggaggtggagagcaggagttgagcaccatgctcgccgaatgggtgccaggagtaacaggaatttcacctgtcagtctgtgctcacatgcgctgctgggacttgcgcatgtgccctgtgcaccagaattacaaagcacagggggcaggcctgctgtgacactgccaacaggcactcccctcacacatacagcaaccccatgctcagcccaggccactcgcacccagaggttgcagtactggagggtgtcggggttggcggccttcagcgagtcctcgatccaaggggtgaagaggtacagggggaacgggttcagcagcggccccgcctgcgtgggggaggggggccatgtgaggcatgccaccccgggagctacgacggtgggcaaggtctgcggggggtcaaaagcgaagccgtgcggatgtgtgcccaccgtgcaccaaccttggccttgaagcggctgnnnnnnnnnncccatgtgaggcatgtgaccccgggagctacgacggcgagcaaggtctgcggggggtcaaaagcaaagccgtgtggatgtgtgcccattgtgcaccaaccttggccttgaagcggctgtagatgtcctcaaacgcgccgatgcaggtgacggcaggcccgtcaaactccacgcccagccgccgcccttcctcgtccaccaggttgtgcgcccaagcattgtggctgtccccggcaatgatgacggggttggcgccctcctggttcagggcctcaatcacctgatgtgcggggaggttgcacaggtgggaagaccgagacgcaggacggtggagctggaggggtggctttgcagacctgagatcgatctacgattccccatgtgcatgacaaatgcctcgtgcggggctccgggcccgccccaagacgtgcccaagaaagctgatgcaccagccaggcccatccacgcctgtatcagagccaggggccagccannnnnnnnnngtgtgcatgacaaaggcctcctgcggggctccgggcacgccccgagacgtgcccaagaaacgtgatgcaccagccaggcacacgcacgcctgtatcagagccaggggccagccacaggcaccccaccagaccagcaatcggtcccctcaccttgcgccgctcggcctggaagccgtcccaggcgtcggggttcatgggaacaccgtactttcccaggccgacgtacatgcgcgcctgctcggcgccctcctttcccgccttcttctcgtccatggccaggttcagcgccccgcccgacagcttgcgcaggagcttgggctgcaggtgcagcgtctcctggagcagcggcgccttgatctggctcatgatggtctggctcaacaggatctgccagggacggtcctccgcgatggactccgccaccaccttgcggatgttctccacctgcttctcccctgaggcaaggttggagatggtggcaagagagacaaaggtgagagcagggttgaaatggattgatgatgcgcgcctccccaacagggacatgccgtccataataaacgggactatactcaaaacatcgccccaactgccagctcacagatccctccctcaactcccgacgcgcacnnnnnnnnnntagggacatgccgtccataataaacggggctatactcgaaacagcgtcccaactgccagctcgcagatccctccctcaactcccgacgcgcaccaatcattttcttcttggggtccctcagcttctcgaggagctcgaccctggccttcttgatcgtgtcatcgttccagtcctcgagcttcttctgcgccgtctccttgtagaagctggtctctgcgacgtccaccggctcggaccgggcactggcccggttctcgatggtcacctgcagagggggaagtgtgcacttgaagactgtgagacccggtgggaaagggagaccctgggtctgacccgggaaggaaacatatccattggcctgctcatgtaacnnnnnnnnnngcttgacgactgtgagatccggtgggaaagggagacccggggtctgacccgggaaagaaacatatccattggcctgctcatgtaacatcacacacgctcctcccgtgccgcagggatggcggccagcatcccatcacccctgcatggcacacccttgcccctcctgcgcaccaggctcgcaaggttgccaaagtggaagctgcgatgcgcaaagtccagggtgatgttgtcatgatcgaaacccctcaccggtatccactcgccgtatgcctgtgtgcagccaggggatggaggggctggagcatggcggcgccacgtcattggtggagacatcgaatgacttctgctgcaggccctcagtccggctgctgtggccatgtcagccatggcagcaggccaggcatcacattggttgcaggagcatgttcaagtgctcaaaagacacccaccttgagtgcnnnnnnnnnnccgaatgagttctgccgcaggccctcagtccggctgctgtggctatgtcagccatggcagcaggcccggcatcacattggttgcaggagcatgttgaagtgctcaaaagacacccaccttgagtgcctggagcttctgcacaccccactcctccttggagcccttgaagtcctctgacccatgctgccatgtcgagtcagcgatctcatggtcgtccctgtggtgatcggagaggtgagtcagaggtgcttgcaggcacaagaataagaccacttctggagagaggcagtgccactcgcatgtgatgtgaatgctgttgcaagaggcagactgctgattgaaggtcgcttgcagacccctctcagcacagtgcaggccgtctctcatcaccctcgacaatacatggaccaccttgactacccaccagactgcaatcatgggcactttgcggtgcagttcctggaggtctgggtcggtgcggtagcacgcatagcgttctctgtagtcatccagcgtcttcagccggtgctcgggcttgagccctccgcggccaacaaaggggggatcagggtagaaaccaggctcatactcatagatgtagtcacctgaggcggaagtgcggcagtttctgcattgcggccttgcaaccaacgtgctagggggtctggcagagagcgagcagtgccatgaaacatgcaagatccaccacgaatgctctcaggccccacccctgattcaccctctccagcagtggcccaatgactcacctccnnnnnnnnnncgccatgaaacatgcaagatctaccacgaatgctctcaggcccccccccttgattcaccatctccagcagtggcccaatgactcacctccctgcacaacaaagtcaaggttatcaaccttagccagcctattgtacacatggaagtatccaaagcctgtgtgtgccaagggaggaggaatgtgatacacggtatggtcaatgagatagctcaccaaggaatgacagcaaggcttggcccacaacacctacagaagatgacaggaaaccctccagagctcgagtgaaaacacatgagcagaaaggagcatcctgctaactcaccccagttggcacagctgacggcgccaaagatcatgctctccagtggcccatgcgtcgtggtcttggtgatgccggtcgggctcgaaagcttgccatgggagaagcggtaatagtacctgcggtgcgttcagcgcgtttcatgaaaacgattcaatgtgcgagtacgaggatgcagcaacacgctccatgcaaggctggagcagatctctgagcgcagcaagaattcgctcccagctggactcgacgacgccaagcaacggctcacttggtcactggctcaagagaagtcacatcgatggcgacagtgtaatcgcggtgaggtccagtggcgtaggtcccactgtatgaggtggaagtgtgggaagggggcagtgcnnnnnnnnnngcgacgccaagcaaccgctcacttggtcactggctcaagataagtcacatcgacggcgacagtgtaatcgcggtgaggtccggtggcgtaggtcccactgtttgaggtggaagtgtgggaagggggcagtgctggtcatcagcaagggagctctccttgctggcacgcaggagactcgagcagcaaccctgtggtgcagagcgcatccacatcatcgccagctcctcgagctcggtaacgccgcacattgcgccttgatgcctcacctggactggatgctcttgaactcggggtctctgctgacgacccagtccacatcagccgggccgctgttgcctgccggcagggttagccgggtccagatgatgaccgcactggggaggggatcgaaactcgccacaccatggataaatcctacggtaggacctgtagaatttcggtagtgtttggagggtcagtcttgacctcacgcgctgggatggggattcataagtatcctccccagctcccgtaccttgcacggtcgaggcagagaagcacgacatgactggcgcctcgttcgggagagcacaggagtttatcaacaaatcaaatattcagaaggtacgaagctcggccaccggcgcactgcatgccccagcgagcctggaaattcagagtcgcggcggatctaacccccctgattatattacctcggattcggtacaggttccagtccagctcccgcccacgtgggacgaggggcactgcctgtgtcacggcacacctctcactcgcgtgacctccactcacatcgcccatggaggtgtgctctcctgttacacgacaccagcatgagagagcctttcagcatgcatgccggggcgggcggtttcccccatgtgccgccgccacccagggccctcaggacagcttggcccacacgatgagcccgatggctcccaggagtagggccacgatgccccacatgataatcttgttctgcatgatgcggcgcgacatgctggacaggatggcccgcgaccggctgatcccctcgtccacccctgccagcgcgtcgcgggagtgcaggatggtctcccgctgccgctgcaggtcccccagcaccgagatacccagctcctgagcatggttgggggtcgcgggattggagggttttgacgtctgttgaagctgagattcaggccaaaaactatcagggctgtcggctgccgtcttggactggggcatcagcgtcgccgccgtgactgccgnnnnnnnnnntagcaccgagatacccagctcctgagcgtggttgggggtcgagggattggagggttttgacgtctgtcgaagctgagtttcaggccaaaaactatcagggctgtcgactgccgttttggacaggggcatcagcgtcgccgccgtgactgccggctgcggacccgcaagaggcaccgtgcgcatcagccccacggctgccaccagggcttggcgagccgccgtgtcgcggcgtctgcctccgccaccgcccgccccacggacgctgccgagtctctgctgcgctggatggccgtccgctggcccgcgagctgctgcaggaccgccgcccccaccgcctgctcagnnnnnnnnnnnnnnnnnnnnnnnnnnnnnnnnnnntctccgtcggaaccgaggctgagcagagcagccgaggaccgaagcctgcccttgacccctttccaaccatgagcccctcccctatttcccagagcatgagaaaccaccgcccacctcnnnnnnnnnncagccccagctccgccctgtcgaacatgaaggtggcgacgtgagtgaggcacctcacctgctgatgaatgattgtatcattcccatcccccaatctaggcnnnnnnnnnncatggagcgggcaaggggggggggcccggtccaatgagcccaggatccgtgggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaccatgagcccctcccctatttccctgcacccagagcatgagaaaccaccgcccacctctgtctccagcagctgctgccgcccggcctggatgcggtcgctggtcttgcccagcctgtcggtggcggtgagcagccggtcccgctgccctgccgaggtctggaagtactcgttccctagccccagctccgccctgttgaacatgaaggtgacaacgttggtgaggcacatcacctgctgatgaatcattgtatcattcccatcccccaatctaggctcctgccacccaccggctctccgcgctggaggtccccgccgttttggcatcgctacgcagctttgcgatgtcggccttgtaatccttgagcttctgcaggagggccctcgaggtgaccgggggaagggaccgcgcctcgatgtccagccgttgcagctgcagcgggggggtggcggatggtgatggtaagtgagcaatgtcgagagcgacacaccgacgcctcaaaattcacaactcagaccgacttacaatgtgttcggcctccaggaggtctgctnnnnnnnnnnaggggggtggcggatggtgatggtcagtgagcaatgtcgagagcgacataccgacgcctcaaaatacacaactcagaccgactcacaatgtgttcggcctccaggaggtctgcttctgcctccttcactcgcttctgccgctggtctgggggtgcaaaatgggcttggtcctgactgctctgcgtgggtccaacacacacatcttccaccccgacgtgctgccctacgctcacctccccgcaagggacctagcgactgtatcttacgactggcctctgtgcttttcgtcgcgtactccctctcatactgagcaaagagcggggaggaggtctcggccatggcgaccgtgcagcggtcaaccgagctgaccgcgatgagtgtccccgagtcggagctcagatatgtcgagatgatacactctcgggaagaggtggactctgcgcgcccttggagtctcccttttatttggacttctcacgcctcgcgcccttaccaggcgcgtcgcggatcacttccatcgccaagtcaggcacacgattagggtgcaggcgacacctcaccctcttgttagggagatccggaaacatctatatgctaaatgcgcagttccaaagcattgagacctctgctgcgctcgcagtgcagccgtcgcaacagcgaagacgtacctagccaatatacagaaaatctacagtcataggcgagagttccatgtgcagagcaacagatcacgaccaagatgagacattccctgtccgcaggtacacccagggggatgccttctgtgaggtggggagtactggcgcggtgagcgactgccggcctcaacttgggtggtctccacaacagtacccggctggaggacgccactcccctatatccccatcgcaggcttctgttctggggtgccaaagacagagctgcggagctgaaggcattcgactgcctgctgtacaccctgctgcgcctgcaaggatcccaaaccggcccctggcgaacgcagtgtgtcagccaccgtgccgcgccaccagtcgatccctcgaccaggggcctggcctcccgcatagccatggacgaggtgtgagtcgatgggctctgtgtcgaggggccttgccacatggtatgccccaggatattgaaccagagtgctgtcccctcttctcacatgcaatccgatttgctcgcaggagaggcacacgggagtgcggggtaaggaggtgcatgctgtgactggctcccccttctcggaccggtcagctctggtgctgaggtgtgctggtgcggtcctggaggaccatgctgggtgactgtgtgtcagcgcaggggtcatattgcaacccaatcaacagccggcagagcctctttggcgatgatttcgccatctcatgcccatnnnnnnnnnngatactgaaacccaattaactgccggcagagcctcgttggcgatgatttcgccatctcatgcccatgtaacccctccctatttacacaagcagggaatcggatcaggtgatgatgggtgatgcccggatggcggacctggtcaccaaggcgggcgggtacaaggcacatgtgggactacatctggaggtgaggatgccttgtcaggctggcgcagggaagggtctgttcagtgcgttccatgatgggggtctgtatccttcccactgaagccaggtaatcctcactggcatcccatggccctctcaaatgcttaaggagcctccctcaggcatcagtggcattaacgttctcgctctctccccaagccttctctgtgcctacctcaccaactcgcagggctcacatgtccaggtgggnnnnnnnnnntgttccatgataggggtctgtatccttctcactgaagccaggtaatcctcactggcgtcccacggccctctcaaatgcctaaggagcctccctcaggcatcagtggcattaacattctcgctctctccccaagctttctctgtgcatacctcatcaactcgcagggctcacatgtccaggtgggagactttaacgtaggcatcagccgggccgtactgcgaccaggggagatctttacgggagtggtgctggacgtaggatatgcaccccttaccagctggacccatggccgggctattctggaggtgagccattcgcttcaacaccgtgtgaggttgccagacagagcaacatttgtagagatttttgaaaggagccgcccaaccagctgctcaatgctgtggttcttgccgactcccccatcctgccatcctccaggactttcaagggatgttgagcgaggctgtggaagcctcgggnnnnnnnnnnagttgccagacggagcaacatttgtggagatttttgaaaggagccgctcaaccagctgctcaatgctgtgattcttgccgactcccccatcttgccatcctccaggactttcaagagatgttgagcgaggctgtggaagcctcggggggccgcttgcaagccgtgccagagaaggagtctgattcaagtctgcagggaaccggtcgacatgcgctccagctggtgcgcctcatgcgactcctcgccgcatgacgggtaagtttcaatgctgaggccccgatcctctgctcaaactgcgtgtaaagaatgcacgcgctttctcgcaaatgtaaataactcttataccggaaattggtcgacacgctggtattgggcgctgcttagccatgtgatccgacgggcaccgtcgaggccatatccgatgccttggtcgttgacggaagaacagcacggctgatcaaatgtatcaggagcttgaattggccatggagccgcggcgatttgagggtatgtcttcgaggaaaggcacgccgccccgatgtcctagaggtggtggcccccactctcacgctgcatcctcctcaacgcaggactggccatggactggccggctcttgcactgtggcagagcagcctcggctactcgcggctgactgacctcgcaggggatgcccctgtccaggtaggcgtcgtcatgtttgtgtgtggattgagagctgagacagtgctctcaggacgaaacgttgatggtgccatgcattgccttcctgctgcacgccgtggtcctctacctcacccaacgcactatccaatttgtatatccaggtgatgcttggccaggggaccgagtttgtaggcagcgtggagggcatttgcctggcggcgaccactctgggtgcctaccttgccaggccccccgggtcgacgggcacctacctcgcagagtgccccctggcacaggcggagcccggggcggctctcagcccgggtcccctccacgccctcatgnnnnnnnnnntgggcacctacctcgcggagtgccccctggcacaggcagagcccggggcggccctcagcccgggtcccctccacgccctcatggcagacattcgcattcctgaggccgtgaagggctcccccctgacctccatcaacctttgggcgagcctgaagtgggtggtgaaggaggggagtggtccaggcttccccagcctcgctcatcacgtcgagggtagggcttcggcgtgccctcaccaacctcctccctgtctcccttcctcacactctccttctcctctcaacgtccagccccatcctcaccgccctccacacccatccccttgcctccccgcagccgcaccgccagcagcctgcactacgacccctactgcaacctcctggnnnnnnnnnncgtggtccaggcttcccccagactcgctcatcacggcgagggtagggcttcggcgtgccctcaccaaactcctccccgtctcccttccccacattctccttcttctctcaacgcccagccccatcctcaccaccctccacacccatccccttgcctccctgcagccgcaccgccagcagcttgcactacgacccctactgcaacctcctggtggtcatctgcggccggaagacggtgcggctgaccccgcccaccgccgaccccaccctgcgtgtccatccggtttggagcgactcactgaaccacgcggatgccgacctggcgcgcagcccacgcctgcccgtgacgtgcgtgtcgctgggccccggggacgcgctgttcatccccgagggcacctggcacagcgtggtcagcacgcccggcaccctggccgtcaacttctggtggcgctcggccgccggcgcggcgctggagagcggcgccacggcctaccacttgcgccgcagcctgcaggtcctgctggagcggcggcgccacgccatgctgcgagaggcggcggctgccgccgcggcgccgggcggtgcgggcggcacgaccgcaaccccggccgacgcgctgctgcgggctgcggcgaggggcgaggccgccgccctgcacgccctccgccgcgcgctgctggcgctgtcgtccgacccccccgcgctcatgcgctgggtgcactgcacgctgcaccgcgacgcgcacgctctgctcggcgcgctggtcggtccgggcagcgaactggcgctgggcgcggtgctggcggcgctggaggcgccgggcggcgacgaggaggctgtgcgcgctttcttccaggacctgtacgacgggctgccgctggagcggggggcgctgctggacctgatcctggagcggcggcgggccctctcgcgcctggccctggcggacgtgcttgcgcggcacgtgcctggtgtgccgtgacatgcgagggtacactgcggtgggggccagcagcggtcgccccctggaggagcccaacttgggtgggaggaacagtggcggcgagggaacatcaagcaaggcatgccgagaatggcaaagctgagggcaagaagagacgcagatggggtcccagggatgcagaggaggagcaggcaggcgcaggcggtggggtgcgggggcgaggtggtggatcccacagcattcaagcgtgtccgaatcgagcgcgtcgacgcgcagcagccctcccggcgctaggttgccccccctcgcgcaacctccatgcgcgcgaagaagtcggcgttgaggcgggtgcaggccgcctcctcacaccccaccnnnnnnnnnncgccccccctcgtgcagcctccatgcgcgcgaagaagtcggcgttgattcgggtgcaggccgcctcctcacaccccaccgccacctgcacgcctgcggcgcgcagcgcggccacccccgcgccgccgaccagcgggttggagtcgcccacgcccaccaccacgcgcttgaccccggcggccagcagcgcctcggcgcagggcggcgtgcgcccgtggtggctgcacggttccagggtcacgtaggccgtggcccccgccgcccgtgtgcccgcgccgcggagcgcgtagacctcggcgtgcggtgcgccggcgcgtgggtggaagccgcggccgacgacggcggggccggcgggcgagtcccgcaccagcacgcagccgaccgcggggttggggtgcgtctggcccaccccgcgcgaggccaggtccagggcgaggcgcatgtattcccggtccgcgctcgtcacgccgctgcctggagggagggagggnnnnnnnnnnnnnnnnnnnnnnnnnnnnnnnnnnnnnnnnnnnnnnnnnnnnnnnnnnnnnnnnnnnnnnnnnnnnnnnnnnnggcagggggctgtgtcggtcttgcagtcggatccggggggacagacccctcatttgggactacctgcgtcgttcaaggcgcggcggaagatgtgttggcgttcaccgcgttgtcgatcatttgaaacagagaatggccgtggcctggccaccgtatggggcggaagagcgcaggagctctggagtccccannnnnnnnnntggactacctgcgtcgttcaaggcgcgggggatgatgtgttggcgtttaccacggtgtggatcgtctgaaacagagaatggccgtggcctgggcaccgtatgggccggaagagcgcaggagctctggagtccccatgcggagcctgacgccaggatggcaggcattgagatgcgcgagtaatggaacgagtcaagacgttacgttcgcgctcgctggtcgggcatgagcccacnnnnnnnnnnacacggccatcattccccataaatgagatggagagtgctggaggatcggtggtgggcagatcggctgcttcgtgagttcacagggtgnnnnnnnnnnaccaagaaggcaggcattgagagtcgcgagtaatggaacgagtcaagacgttacattcgcgctcgctggtcgggcatgagcccacaagcgaaggatttggcgtcgggggcctcaaacgctatcaaggcccgtgggtatcctgcagcgatttcacggccatcattctccataaataagatggagagtgctagaggatcgctggtgggtagatcggctgcttcgtgagttcacagggnnnnnnnnnnactttgtacggcatccactgccatgaacagctgccaaccgatgcgtccgggagataacaccttcgccgcagggtattttcatgtgcacagtgcgttcctgtttcgatcccgtaccttgcggcatcgcactcacgaaatatcttctagggtacaggacaaccaccatgnnnnnnnnnncactttgtacggcatccactgccataaacagctgccgaccgatgcgtccaggagatgataccttaaccgcagggtattttcatgtgcacagtgccttcctgtttcgatcccgtatcttgcggcatcgcactcacgaagtatcttctagggtacaggacaaccaccatgtggtgtgtcacggacacacatgcgccgagcttccttggtacaaacatctggtcatgcaaatctaaacatcggaccgggctcgacgcatcaggtctgaagagctcagnnnnnnnnnnggagcttccttggtacaaacatttggtcgtgcaaatctaaacatcggacctggctcgacgcatcaggtctgaagagctcaggcccatcgggttgaaaccggcgacttgacccagacccgatgggccaagtctcacgtctcgaatgtacatgcaagcaagaaaatatttgtgttgttcatgccgatgatcttggcgcatcaggaatctcaaatgaactgtgccagcagaaaatgtgcgaggagtgtaagtggaggagacccaaagggagacagccttgcggggttggcagcgaggacagggcaggcgctcatcgtgcccctatgtagatctagcatcatggtgcaggactcacctctgccaggagttggcagaaccacaccatcctccacaacaatcggtcgtcagactggtgcgacaacatcacgtgtttcgaccccggcacattcccccgtccaactcacggtcccctaccccaaggggagccacttccgcgcgacttcnnnnnnnnnngtcacgtgtttcgaccccggctcactcccccgtccaactcacggtcccctgccccaaggggagccacttccgcgcgacttcctcagacgcatcggagaattgcttcactgcaactgccggaccccttcggatatcaatacttggcattgtcacacctggaattacatgagcatagcgcgattttcgtttcgtaattcttagtgactgcactgctcacgttactgctgcaattcgacaccaagtaccgggtgcgtggtgctcctgggctggggtcctatctttagcgagcgatcttcgtatctggggtgctccagtgtgctagggcatcgatgccatgatgtctgccaccgccggtgtgcgtgtccgactctcggcgggtgtctcgcgcagtcctcggctcgccggtgcccgttgtcacgagcgcgacgcctccaccccccccccactcggagcctcatgaattggacaccataccgccattctaaccacccctccccccctttgccgcgcagtcttctccctcatgcagcctccacccgtcgggtccgggccgggtcagcagggttacccgcccgagggcctgggcttccccccctcctccgaccccggccacatgcagcagctggtggacctgctggggtccaaggtcccccccaagtcgaccgcggtggtggagtgccccaagaccatggtggggcgcgtgattggcaagggcggggagaccatcaaggcgctgcagcagtatacgggcgccatgatccagatcgaccagtcctcggaccccacgcgcgtgaccatcgcgggcctgccccaggcgctgcagctggcggtgtccatggtcaacgacatcgtgcgtggcacctttaagggcttcgccatgctgcgccagatcgcgctggccaacgcctcctcgcccggcatggccacctacggtcagcagcacgcgcccgtgtacgtgcagggctatggcttcgtgcccccctcccaggcctacggcggtggggaggaccccctggccggaatgttcaggacctcgcccgcggggcccatcacgccgcccatctcgcccatgcgcggcgcgggggagggcagcttctcccccaacctggccgccatgctgctgggcggcggccaggtcggcgggcagcccggctacccgggcatggggccgggcgcaatgagccagggcaacatgtccccccagcaccagcaccaccaccaggacaacggtgagaaagtaatgcatcttgcagggcgggaaggtccatctggttttnnnnnnnnnnaggcggcagccaggtcggcgggcagcccggcttcccgggcatgggcccgagcgccatgagccagggcaacatgtccccccagcacnnnnnnnnnnttggtagactggtgcccccaaggctcacaccaacagcatcaggcccgcactcccgacgccatctccgtcctctnnnnnnnnnngtggtagagcggtccccccaaggctcacaccaacagcatcagacccgcactcccgacgccatctccgtcctctaccacctcgttttcatcgatcccttgaacgggcccctcgcatcctttcaatcccccgcagccagcacggacgcgatgctgtcccagctgctgacgcagctcagcttcaaccagcaggcggcggaggcggcggccagcatgcagcagcactcgccgcacgcatacctgtcccagcacggcacgccccccggcacgcccggcagcggcggtggcggcggcgtgctggacgccgccggcctgcagacgctgctggcgcaggcggcactgctggggcgcaccaacatggcaggcgggggcgggcccgggtacgccggaccgcacgacttgcccgccgaggcgtccgcggcgcagctggctagggccggcgcggggggtctgggtgttagtggtggcccaggagtcgcaagcagcggctcgggcgnnnnnnnnnnnnnnnnnnnnnnnnnnnnnnnnnnnnnnnnnnnnnnnnnnnnnnngcggcgcagggtccatgcgatccagccgcgacgggtcggcgggcgggctgtcggccctgctggcggggctgggccacggcctcggccccgcacaggccgcgccggggcctgggacggggtcccctgcgtcctcctcgccgctcacgggtgagccagggttcggaggcggggcggagggcggagggcgctggcccacgggggccaggggtgtcgaggaggctgggtcgagcatgtgctggggtgccacccggtcgcccgcccgcccgcctgcatgcctgtgnnnnnnnnnntggagggcgctggcccacgggggccgggggtgtcgaggaggccgagtcgagcctgcgctggggtgccaccccgtcgcccgcccgcccgcctgcatgcctgtgagggccgggcccgtcgtttgctgaccgggacccctcccccagggtcagggcgcgcatcccccaccgaggcgtcgctggcgcgtgcccgcgggcgctccttcaccgcgacgcacggcggcggggaggaccaggcgtcggtggccccctcccccctgggcgacgtgacgcggggcggggcgtcgggctccacctcggtgcgtgcgtgggtggtgtttctgttgcatggtgggtggtgtttctgttgcatggtagctgggcaggacgggcagtcccgcgcgcgacagctgttgggcgcatgcctggtgggtgactctgcaccgcatccagccccgaccggttcgacccgcagtccctgctgccgcgcatgcctcctgccctaacatcgacaccctttcccctgctcaatgaatcccttcaaccttcaccaataacaggcggcgacgtccagccggaactcgtgnnnnnnnnnngccctcccccctgcttaatgagtcccttcgaccttcgccaatgacaggcggcgacgtccagccggaactcgtgaagaccagcagcagctggaacgactgatgagcactgcgaggcttgccgccccaatctacaacgacgcccttcaaccctgcaccggctcacccgccagcgcatccacccaccctcacaacatcaccccctcctcactctcgccaagcgcgtcaccccgcannnnnnnnnnctcaaccctgcaccggctcacccgccggcgcatccacccaccctcacatcatcacccccccctcactctcgccaagcgcgtcaccccgcacccagaccctgttcatcagggtctgggtcgggggcatgggcgcctgctgcgggcaggcccctcactgttcttctactgccataaagttttgcacgagcctgtacctgcaaggacctgattgctctttggaagggcagcaagcgcttccgttgatccacttggggtggagagggatgtgcaggggcgaggccggtatcgctcgatgcgccatctggcccacctccccgcacactgtcccccaccgccccgatactgccgtcaagctcccttcgtattagaacactctgagaaatgagcttccatgcactgccactgccccttgcctccacctgatgtacaccctgtcctgtttcagcctgtagggtcagcgtcgcttcccctgcctctgctgcaatggcctcggaggatcggcatcggtaacatcaatgagcaaaacagatcagcgggcgaatcgtacagggtggtgtgtgtcgttgcaagcgcgccagactccacatcagggacagcagccgctcacggcgagcgggccgcagagaaggccgcctatccttggaacaggcatcttgggggggcgcatcaatcctctgcaggaatgtgcgggtggtggagtgccatcggcattctggcgcaagactcccgcctgatcatcatgaaggcacagagacagacccctctatatccaaggagggtatagacaaggcaccccaactcaccgtannnnnnnnnnccagacccctctacatccaaggaaggtatagacaaggcaccccaactcaccgtagacgcggcactcgtcggcatccggtgcgccctcgcagtactgctccaaggggtcggactgctgggcggtcttggcgttgtcccgcttgtgggctgcagccgcgctcagttcctcgaccgtgtcccaggccgcagcactgcgcggtcatggcgtgtatcgcgtcgtcagaagtagataacagtccgacggtggtgcccatggcccgcacgaagcccgcaagaatcctctggaaccgtccgggaccctactcaccattcgtcggtgctccccgtggcgcaggcatcctgagcctcggtgatggctccctcgatgggccccttctgtgtgtccggcgtggcacgggggaccatgcgctgcatgggcctgggacgggcacaggcgcgagacaggcccaggggcgagactggcacccgggcagccaggctggggcgcacggaggtgaaggacacggcagacatgctgtggatatgcagacagatgagcgccaaggaagggaatggagagaactcggtggcgtcaggccgagtaatgacgagtccggggacatgatagagtgagcgtggaagccacgatcgacccgggatctgaatccctgctgcagatgatggaccagtctccttggtctgtgtcggcaatgcgacagacccagggctttcccatatacacacagaagcagggcatggcggattcacagctctgatgatcgatcgactctcctccatctcgggacggggtgcggccctgcccggtcagcatgcatcactctgcaggacgtccatccgacccatcggcccagcatgcatgcaagcgcacagttctgcaatccaaggagcaaaatgccagatcatcgccccaatgcactcaagtgagctcgcctgagatgaccacgaggtcccagacggatatctccgccattttgccccattggtacccagcgaaatggagggtcccacgagcctcccacctccgatgcgcagatgacaaactgtgccttcccagtgcaagaggaggtcatgcttttcgcttgactcccagagcgcaccccagcccagtcctggggtctgtgggggaaggaatcgagggccccatccaggtggtgtacctctccatcctcctttccttcctcgtggtgggagcctacctggtagtgcggcaggtgctggcacgcagggagttggaagaggctgccaaggtgtttggagatcgcgtgcgatccggtgaaggcagtggcgaggtgagatgactctttgcgcgtgtgtgtatgtgtgtgtgttattgaatatggggcaagcaatgggcgggacagaatgcannnnnnnnnncccttgcgcgtgtgtgtatgtgtgtgtgttactgaatgtggggcaagcaatgggcgggacagaatgcagttgccgtgacacacctgaaggttgcagcatggccctcacgctgaagagctgtccccccctgttgtgtcatggtgtgcctccacgcaggattacttggagctgggcgtcattctgctgcggaaaaagctgtacacgcagtcgattaagaacctggagaaggccaagaaagcgtggaaggggccccaagaagagttggcaaaggtacagacatgtagagggttaccgtgtggcggcaagcactgtgcacaccgtgatgctgcactgcggttcgtattcccacctcaccgatttttggcatagattgtcctgggcccaaccccannnnnnnnnngcagacatgtagggggctaccgtgtaacggcgagcactgtgcacatcgtgatgctgcgctgcggttcgtattcccccctccccgattcttggcatagattgtcctgggcccaaccccaaacacattgaacaggtgtacaatgcccagggctttgcccacttcaacctggagcagtggagcaaggctgcagctgcctacaagcaagccgttgagctccaggtgctttgagatccctcagggtgccctccagatgacgggagaacgcgcaactggaatattcagcgtcgtcacattctcactgagaagaatccctcttccctccaaatctgtgcagcctcagtatgttacggcatggaacaacctgggggatgcctatgagaaggccaaggagtggcggcaggcattggacgcctacaaccaggccttggtggccgagccagggaacagcgtggcccaggggcgcgcgcagtattgccgaggaaaggtggaacgcatgcagctggggcagtaggggactgccctgtttgggagccgagtcctggagtcagcccctcgcgagagggggctgatgccgttgcggcccctcccccacgcatgcatgactgtgtgtggttctgcgcgtcttgccatggggaacagccctcaccagttttcaatgtcgaaatgccgtggtgcttacaaagaannnnnnnnnngtgtgtgtgattctgcgcggcttgccgttgaggaacagccctcaccagttttcgatgtcgaaatgccgtggtgcttacaaagaagcctgcctacaacgttgcaatcatttgcccaccatttcttaggtcggggccgctcagggtttcagcgggtgtgtgcacaatcgacagttcctggtgcagagaaactcatgcaggaagccagggatgcttgagtagggcgatccgtggtctcacagcgcctcccatcagatgtgggctccctctgggggaacgatcaccgtggcaggccctttcctgaagctgccaaaggagcgcttgcctgcacggtggaaattgccggatgagggtgtggggggtgacgatgtgcagcaggagattgactgtgatgtgctactcttnnnnnnnnnntttgtccgatgagtgtgtggggggtgacgatgtgtggcaggagattgactgtgatgtgctactcttgctaagccagctccgaccctccacctgccgagcagcagggcctctcagccacaacagcctgccctcctggatccaccctccatccccgttacctgcttggatgtccacctcggatctgccagaggcagaggtggtcatcgagggggccctcgcatccggttccttcgagaatgggttggtcatccagctcgtgggtccagcctgtgggaacagagccaatggggaatgggttcatgagggtgtgagggtgattctcgcaaggcccatgcatggnnnnnnnnnnatgatgaggcagacgacaggtgtgggtgggttcaaaggggggggtgactgacggtgtttcttgggagagccttagaggtatactggtccgccccccctggtgtgctaacagagctcaaggctcgcctgccctcgcacgatgaaagggtgctcccccaactcatttcaccatgtcctcccagcacaaatggtaccgccccacccgctcgcaggtactacgacggctacttggcccacctcatgctcttcgaccatgcggtgcgagaggagcaggtggcgcagctgtacaacgcctacgccatgtccgccccgcctggcgcctcgcctggcagcagcgtggtgaccacggccggcgagccgtccctgtttccgccgcccgcgccgccggtgcaggacacgtcgagcggcggcctgtccgcgggcgagatcgccggcatcgtcatcggctcgcttgcgggggccgccctgctggcgggggccgtcgcctttgccctcaagtcgcggaagcggcgggccgacaagttcgagcggtatgcggaggaccccgctggactgccgcccccgggcctgccgccctccctcatgccagcggtgctccccggggcgtatgctgcggggacagggggcaggcacatggaggcggagatgtccagctcggcctcctccatgaaatacgacaaggagggcgagggtgagagggaggtttggctttttgggtggaaggagggaggggggtcctgggttttgagggggggggatggggacattggtgtactttgttttcccgggaagcccctgcggtgaagagatcaagctgccaatcctgctaacccatccgcctctaattttgcaggtggaacacccgacagccagaacggggggaccaaggtgagcctgctgctggggggtgtatatcctccttgctttgaatacaaggccaaccttgatgcatgcagcagactgatacatgtgtgcaggcatgttcgtgccccaaccatgcatgggccttgcgagaatcaccctcgcaccctcatgaacccattccccattggctgtccccacaggctggacccacgggctggatgactaacccattctcgaaggaagcggatgcaagagccccctcgatgaccacctctgcctctggcnnnnnnnnnntgtgcccccgttctggctgtcaggtgttccacctgcagaattaaaggtggatcggttagcaggatcggcagctcgatctcttcaccgcaggggcttcccgggaaaataaagtacaccgatgtccccatccccccccccaaaaaaacccagacccccccctcccttcccccaccaaaaagccaaacctccctctcaccctcg

SEQ ID NO: 39937 - DNA, 95 bp, Chlorella protothecoides
gacggccgcggggtcgacgtcggggagggcatgaggcggggatgggcggcctgggccgagtgaggccccagccgagtcgctgcagaccagcgtgc

SEQ ID NO: 39938 - DNA, 109 bp, Chlorella protothecoides
gggcagggccggaggcgctgtgcgtcgcgcgctgtgcgacaccgagggcccgtgccgggcccagggtggagaccgtccacgtgagccgcgcgggccaggtcggcgagca

SEQ ID NO: 39939 - DNA, 61 bp, Chlorella protothecoides
ctggcaggatcgggccgggccctgcctcctcacagcccccccccgcccggctggggtcagg

SEQ ID NO: 39940 - DNA, 74 bp, Chlorella protothecoides
agctgtggccgccgccggcgggggagggagttgtccgcgccgccggcgcccgggacgggaccggcgtgatcctg

SEQ ID NO: 39941 - DNA, 76 bp, Chlorella protothecoides
ccccaccttttcttcccgccctcgccgcagaggtgagcgaggaggtggcggtggtgacggccacccagccgctccc

SEQ ID NO: 39942 - DNA, 61 bp, Chlorella protothecoides
cttgatgcccagatagggctgaggggaaggagaggcgtccaggagctctcgggcgtccaag

SEQ ID NO: 39943 - DNA, 61 bp, Chlorella protothecoides
gcttcgacgcaccccacatcaacgtgaaggagtaagcattgaacaatattattccctacac

SEQ ID NO: 39944 - DNA, 61 bp, Chlorella protothecoides
gcgaggaggtggggcatgttttggtgggggaggggggtgcatgctggtgtcgacacttctg

SEQ ID NO: 39945 - DNA, 121 bp, Chlorella protothecoides
ctgtggcctccgatggcccccgctgttgagcccacttgacccctctcatcatgcctcagaccgctatcagggcccaggccatccttcccagcccatcaatccctacccaatccacatcacg

SEQ ID NO: 39946 - DNA, 101 bp, Chlorella protothecoides
gtgcgcggcctgccggccgcgctgcgcgccgcgctgcgaggggctggagtgcgcacggggcggtcgacgccgcgcggcgcggtgacggcgcgggacggcac

SEQ ID NO: 39947 - DNA, 66 bp, Chlorella protothecoides
gggggggctgggtggaggtggtgacgaaggcggagagggggggctgggtggaggtggtgacgaagg

SEQ ID NO: 39948 - DNA, 179 bp, Chlorella protothecoides
ggcactcccccatacccaaccaccccacacctacccgctctctccccccgttcctcaccttggttggcccccgcgggcccttggccagcacggcctcaagctgggtccgcagcacgccgggattgtgcccggcggccaccaggcactggacggccagcagccagaggccctcgctcctc

SEQ ID NO: 39949 - DNA, 73 bp, Chlorella protothecoides
gccccatgtttggtgaggaggggcggcagacgtgttcgtgttttaggattccagagcagggggtgcatgccgc

SEQ ID NO: 39950 - DNA, 382 bp, Chlorella protothecoides
  modified_base (86)..(326): a, c, t, g, unknown or other
accgccaaagcccaggctctggatgaagtacaccactggcagcggaatttcgaacccttgtgtcacctgcatgcatgttgcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgcctcatcagggggggttgccgcgattggacgggtcactgccaccttcttca

SEQ ID NO: 39951 - DNA, 61 bp, Chlorella protothecoides
cctgcgcgatcagccccggctccggggtcaacatgcgcacgcggttgaaggctgcgatggc

SEQ ID NO: 39952 - DNA, 471 bp, Chlorella protothecoides
  modified_base (192)..(295): a, c, t, g, unknown or other
acccccaacctccagcccccccaaacctcgggccccgccgcccccgccccaccactcacctgcatggcctgcgcgatcagccccggctccggggtcaacatgcgcacgcggttgaaggctgcgatggccctgaccgggatccacccctcgccgtccatcttggagcggaggaagaggtcgcgcaccagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagaagtagtagtccacctgcgcgcgcactgcctcccgcacctgggccacgggcggccccggcatgcccaccaggttggggctgacgccgtaggcgctgggcgggtagtacaccgccgccggcgcgtacagcgcgtaggcggtgggcggcgggccggcggccgcgaagccgcgc

SEQ ID NO: 39953 - DNA, 134 bp, Chlorella protothecoides
tcccagcgggctccgacgacagcgctgtggacctggactcccctcggcccttagaacccgcctcgctttcctccagtgcggaggagctgctggccagcgcgccgtccagctcggtggcctcgcccgcgccgcca

SEQ ID NO: 39954 - DNA, 61 bp, Chlorella protothecoides
ccccatctcctcgctcacgcgcttggccaccgacatggccgccacgcggcgcggctgggtg

SEQ ID NO: 39955 - DNA, 104 bp, Chlorella protothecoides
tgtgttgtacattcaagtagcagagccagaagatggtttttggctgtgcttgagaatggtctggcccgccgagtatacaaaatcgcttgtggtgattccctgac

SEQ ID NO: 39956 - DNA, 80 bp, Chlorella protothecoides
gtatggagagaactgggttgacggtgcagggatgggcatcaagggacccggtctggccgcgctcaagcacgtctccgcag

SEQ ID NO: 39957 - DNA, 166 bp, Chlorella protothecoides
tcccctccctgaggtggcgagtccctgtggctggcatgagcgcatcgcatctggatgctgatgtaactatcgatgcaggtgagtaatgattgtcgggcccaaccaggggtgaagtgagaatgctggccgctgatggggaagtgctgtgctatgcagtccttgctgc

SEQ ID NO: 39958 - DNA, 74 bp, Chlorella protothecoides
cgtcctctctcatgccaaatccacacacacactcacactcacacacagggcgaggccgggaccggcaacgtggt

SEQ ID NO: 39959 - DNA, 5462 bp, Chlorella protothecoides
  modified_base (912)..(921): a, c, t, g, unknown or other
  modified_base (1570)..(1579): a, c, t, g, unknown or other
  modified_base (1758)..(1767): a, c, t, g, unknown or other
  modified_base (1855)..(1864): a, c, t, g, unknown or other
  modified_base (2282)..(2291): a, c, t, g, unknown or other
  modified_base (2550)..(2559): a, c, t, g, unknown or other
  modified_base (3804)..(3813): a, c, t, g, unknown or other
  modified_base (4188)..(4197): a, c, t, g, unknown or other
  modified_base (5237)..(5289): a, c, t, g, unknown or other
ccaacccctccccccactccccacccccaccccctaggaaacgcaggaaacacgaccccaaaaacctaccggccgggcgcggagggggaagatgtgcccaggccgccgcaggtcctgggcgcgggtggcggggtttcccagcgcgcgcagcgtgatgccgcgctcctcggccgagatgccggtggtgatgccgtgccgcgcgtccacggtcaccgtgaaggcggtgtacaacccctcctcgttctccgcgctgtgcaccatgagcggcaggcggaggcggtccaggtccgcgccgcgcatgcccacgcacaccacgccgctggtgtggcgcaccaggaaggcggtggcgcgcgtggtgatgcggtccgcggcgccgatcaggtcgccctcattctcgcggtcctccgagtccagcaccagcaccagctcccccgcggcgatggccgcaagcgcggcggcgatggaggcgaagccgggggtgggcgtctccaggtcggaagcggggagggcggccagggacgcgcccaccgcgccggaggccaggccctcgggcggtgcagctgtcacagcagctgcttcagcttctgggctggaggtggcccggaacccggagcaggggcgggggcgggggtgggcacgctgcctggaaggggtcggggcgcagtgtgaggggcggcacggtggtagtgtcgccccgcgcaggccatgggctgtggagggggacgagctggccaccgccagtggtctccggcacggcactacagccgccatggggaccgcaggagctggggaccaagcgaggacgagggcgtgccaggacggtacgaaactgtcgtgtggtggggagtgtggaggccccctcccccatgctccgtgcctaagtagatgcggttcccgtcacccggtcctcgnnnnnnnnnntccccccccatgctccgtgcctatgtagatgcggttcccgtcacccggtcctcgtcattacgtaagccctgcgcgtcgcgctactgcgggacgacccgtggtactgacgggcatgctgggccccggggccctgccccgtcacactcccgatcaggcaggcggggtacctcctcccctgccccttccacttctcccgtgccggcatcccatcctcccactcctgctcgatacgccctcagacaccggcgcctctcagccgccccatcaccaccgcgagcttggcgggggagccagcatggccagttccgcgggcatcagctttgcccaggcggcgcagaaggagcagaagaaggcggagctggtgagcgtgcaggtcgagggccaggtcatcctcaaaatcgccaagcactgccgggagcacgccagcgggtcctccgtggtcacgggacagctgctgggcctggacgtgggtcagacgctggaggtcacagactgcttccccttcccggtgggtggaggggttggactgtgtggaggggggaggctgggagggggcagcaggcctcgggagtctgccgggcccctttttgtgaatgcgcgcagagtgagggatgcccgcccctctcgtcgcatgcccctcctgcaatgnnnnnnnnnntgggagtctgtggggcccatttttgtgaatgcgcgcagagtgggggatgcccacccctctcgtcgcatgcccctcctgcaatgtacacgaagagatcagttgtcgagcgggcagtgtgccgcagggtcggcaatgcctcgtgctgttgccacccatcagtggccagtgctgatgatccnnnnnnnnnntagatcagctgtcgagcgggcagtgtgctgcagggtcggcaatgcctcgtgctgtttccacccatcagtggccagtgctgatgatccnnnnnnnnnntccagctaccccgcccagcgcccccccgccccacctcccccaccccagggcaacgtgggcgacgaggaggcggagacctccaacgagggcgagggctatcagctggagatgatgcgctgcctgcgggaggttaatgtggacaacaacatggtgggctggtaccagtccaccgtctccggctcctaccaggtggtggagatcatcgagacgtttgtcaactacctggagaacctggaccgctgcatctgtatggtgtacgacacattggcggcggcttcgggggggctgggcctgaaggcggtgcgcctcaccgaggccttcgtcaaggccttccgcgagggtgcgatgggaggtggtgtgggggggggttggggtatgccgcaccggcgctcctccagctgcctcatcagcgcctgannnnnnnnnngtgggaggtggtgtgtgtgggtgggtgcgggggtgccgcaccgtcgctcctccagctgcctcatcagcgcctgatcggacgcagggtgtgagctgggacgtggtcgggcctgtgtggattccttgttgccatcgcccgccgccccgcggctcctcaccttccctactaccaccgctgtactccttcacatgcgcaagcacccacacttcccccccaaccatcaccccttggcaggaacgctgacggtcgagaaggtgcnnnnnnnnnncccccactaccacccctgtactcctccacatgcgcaagcacccacaattcccccccaaaccatcaccccctggcaggaacgctgacggtcgagaaggtgcgcacctccaacctgtcctggcagtccatcttccaggagatccccattaccgtgcacaacacgccgctggcggtagcgctggcggccgccatcacgcctgtcgcgcacctgagcgcgcgcgacgcggcgcgcctgacgctggcctccgcgccggtgctggagcgcaacgtggagttcctgaacgactgcctggacgacgtgggcgtggagcaggggaagctgggcgcccaccacggcgcggtgcggcggcagcagcaggcggcggcagcgtggcgcgcggcgcggcgccaggagaacaccacgcggcggacggcgggggaggagatgctgggggaggagccgccggagggcatgttcaagccgccgccagagccgtcggcgctggacggcatgctcctgctcaagcagatgaccagctactgcgacgcggtcgggtccacctccgcccaggccatccagcgcctggtcatcgcggagggcctgcagcgcaggccttgaggagtggccgtgtgtgtgtgacttggtcgtgcctggtgaagaccggggaaggtccaccgagggccgtgcttgctgtaaggctcacccggacagcgatcaggagggggtgggtggggcgatgacgaggccacattgggggcccaccgctccgacacctgacggaagaagtcctcgctgcgtcgccttctcgccgtgtcacggccgcgtggcgcgttacaactcataaaaggcctcgatcacttcgcgcaataccaggtgggacacggctgaggtggggccagcttcctgcctatcccgagcagtgtgccaggaggtgataccagtggactcatgcgtcggggccggcccagctcgctcggctgagatccgtagatagaatcgggacagactatcattcaatcgacatggggacggacctacacgctgggcgggcggaccactccgtcgatcccctgagccatggggaggccaggggttccctggacgacccgcccccctacgagtccatcatcatgggcacagccagggtgagaggcatggtttggaggggcgatctgtgcgctgatcgatagcccgcccttgctggcaacctcaacacagagaccaccaccactgccaattccactttgcaggatgagccggccagcnnnnnnnnnntaacctcaacacagagaccaccaccactgctaattccactttgcaggatgagccggccagcaggggtcctgatgttgctgggaagcaggtgagctttgaatgaaggggacttcggtgctggaggttggctgctgaggtcgattcatccatcccagccgccccacctcttcgtcctgtagccgctggaggcagccatcaccgtctttgtcaccgatccagttcgccagctggagggggtgcgggtgaggcccatgcgagccttgggatgtgtgcgggaagcctaccgctgtgcggaagatatacggtttcggaattcgctgggcactgcgcacaatggtccaccattctctgtgccagtccccttgcgtgaaggtnnnnnnnnnngtacaatttcggagttcgctgggcactgcgcacaatggtccacccttctctgtgccagtccccttgcgtgaaggtgatgtgcccttggccctgattcctcacatggagcccacccacgccacctcacagtcgttcgtgtcgtaccgcgtcacgtaccgccctgcctcaggccccggctcctccgtccaccccgcgggcgtcatccggcgcttcagcgactttgactggctgaagaagcagctccgggccaaccaccggggtgggtaggatggcttggatgagggctttgtggcagtgtgatcacagagcagcttcacatgtgcggagctctgcagggcaacgccaggtttggggggtttccaagccctcgccatggcccaacccttgctctgctgcgtggctgccttcctgtcttgtggctgctcatcgctgccctgcgcccactcagcctcgcatgcggccccctccctctcatcggcccaggctgcatcgtcccccccctgcccgagaagaacgtggtcgaaaagtacaagctgacggacgagttcatcgagcagcggcgcgccgcgctggcggtgttcatgaatcgcctggcggcgcacccggtgctgcgacactcccccgccttccagctgttcctggacgccgacgaggcggggtttgcgcgcgaggtggcgcgcaccgccggcgaggccggcggcgccggcgtgctggcggcggccgcctcggggtcgcccgccgccgccgtcgcctcggcggtgtccctgctgcgcagcctgggcgccagcgccagcggcctggtcagccgccagctggcgccgccgtcggaggaggaggaggacggcgagtacctgcgcgtgcgcgggtacctgcaccgcctggagcgccacgtggcggaggtgcacggccaggccgcgcgcctcgcccggcaccaggccgcgctggccgacgcgctgaccgggtttggcgaggccgtggcagacctgggcgctgaccgtgaggtatgtgtttttttgggggggggggggggagtgaaaggnnnnnnnnnnnnnnnnnnnnnnnnnnnnnnnnnnnnnnnnnnnnnnnnnnnnngctttgggtgctgcacagaaggagggggagccaggggtttgaggtgctgttggcatccctcgggcgcgggccggggccgggcatgatgctccatccgcccgatccctcccacccacccgcatccacagagctgcgcgccacgggagctggcggccctgagcgagcggtcggag

SEQ ID NO: 39960 - DNA, 84 bp, Chlorella protothecoides
ggcgggggggcactcggcacaggtgcacggcccccccccccgctgcatcaggtgacagtggcatgcgacatcccggcacgggca

SEQ ID NO: 39961 - DNA, 99 bp, Chlorella protothecoides
gaccctgaccccccaggcggtgtgggcgtctgggtggccgcgactgtgcatacccctcagctgcccgtggtatctactccactttttcctattgggatc

SEQ ID NO: 39962 - DNA, 92 bp, Chlorella protothecoides
gccctcggtgctggccgcgctgcgcgcgctgcgcgaggacctgggcatgggcgcgcggcacctgaccctgagcaccgtgggcgtgccgggga

SEQ ID NO: 39963 - DNA, 88 bp, Chlorella protothecoides
cccggacgagtacgcgtcacccgaggacatcgagaggggcgtgcatgtgctggcacttgcgctggcgcagctggccggcgacgccggg

SEQ ID NO: 39964 - DNA, 824 bp, Chlorella protothecoides
cggccggcgtggtggggccggcgggggactgcgcccagcgccggcccaccgagccccccgccggggtccggccgctacgtgcacgccgagtgctcctggtcaggccgcctgcggcgcctgcatccgggggcgagtcgcacgcgcccgggcgcggcacgccggaccccggcaggttgagcggcgggacgacgcccagccggcgccaggggacctgccgctggggcgagggcggcaggctggcgacgctgtaggtctgtggtgtcgtggagaacaaggggggagtcggatgaatgagatcaggtgatggtctgcgggtctccctggactgaggtgcaacggggtaacccatcgacggttcgatcctccgcccaaccagaaacagatgatcccgccagagggccacggcatcccaccctggtggggctcccggagcaggaggactcgccgtcggaggcgtccggcagcatcagcggcgctggcagccgccgcgagggcgacctggcattggggtctgcgacgccggagggcgcggcgctgtcctcggcgatcctgcctaggcctgggccttcacaacactcgcccaggccaacagcaggcccgtcaatcattcggtccgcgaggccgctcgcctctcggcgggcctcctcgggcagcccgtgccgaaggtacgcgtgctcgagcacggcggccagccccgccgccgtcgcgtgcgcgcgcacgcgcggtgcggcgaggaaagtgcgacttagcgcacgcagcgcggcgaggcaggccgcgggctctgccgcgtcgcgcgcgccgcgcaacagcgccagcgccaggcg

SEQ ID NO: 39965 - DNA, 61 bp, Chlorella protothecoides
gaatgcgtgtctggctccatctatggcaggggcatgcaatgctttcaagtggtgctctggc

SEQ ID NO: 39966 - DNA, 74 bp, Chlorella protothecoides
tccaggaaactgcgatcgggcgggggggggggcggcggtgagggtagatgcactcgttgacgggccgcaaaagc

SEQ ID NO: 39967 - DNA, 66 bp, Chlorella protothecoides
gcggacctccagatcctgaagaacatcaaggcgggggtggaggccaggaacaggtgggtggcaggt

SEQ ID NO: 39968 - DNA, 66 bp, Chlorella protothecoides
cagaccagcctggacagaagccctcgcctatgcgactggagagcgctgcaacaagctcgagcgccc

SEQ ID NO: 39969 - DNA, 93 bp, Chlorella protothecoides
gcgctgatgtgggcatagtggtgtgtctgctgacgtgccgcgagatctggctagaccgtctagaagagctgtagcctcgatcacttctgtgtc

SEQ ID NO: 39970 - DNA, 74 bp, Chlorella protothecoides
gcctcggggggagggcggttcatgccgcccatgcccatgccgccactccgcatgcagcagcagcagcagcagca

SEQ ID NO: 39971 - DNA, 99 bp, Chlorella protothecoides
actggggccctcagcagcgcgcggcctgcagcatgcacgccccagctccatgtgtcaactagctagccttgggcgaccattcccaccctgacacaggag

SEQ ID NO: 39972 - DNA, 61 bp, Chlorella protothecoides
ggccctcctacattctctctatcctttaccaccctgccactctgtgtctgttcatccacat

SEQ ID NO: 39973 - DNA, 111 bp, Chlorella protothecoides
caggctcgaccccggcgaccactctatcgccgtgatctcaccccccgtggcgcagacacagggcgcgggcggtggctcccgagtgccctcgggaaagtcccacaggcgcag

SEQ ID NO: 39974 - DNA, 61 bp, Chlorella protothecoides
ggggcctgaccccggtggcggcattctttccttcttcttttttcaaacgcggcgcaggagc

SEQ ID NO: 39975 - DNA, 80 bp, Chlorella protothecoides
tgcctctgcagctcacggtgcgggatgccctaaactcggcactagatgaggagatggagcgcgacgataaggtgaattgg

SEQ ID NO: 39976 - DNA, 140 bp, Chlorella protothecoides
cctccccaaaagcaccgccctccccctccccaaaagcgtcgccctccccctcccaaaaggcaccgccctccccctccccaaaagcatcgcccaccacctacaaagcatcacccaccacctcctacaaagcatcgcccacc

SEQ ID NO: 39977 - DNA, 17142 bp, Chlorella protothecoides
  modified_base (361)..(370): a, c, t, g, unknown or other
  modified_base (900)..(909): a, c, t, g, unknown or other
  modified_base (1333)..(1342): a, c, t, g, unknown or other
  modified_base (1657)..(1690): a, c, t, g, unknown or other
  modified_base (1749)..(1758): a, c, t, g, unknown or other
  modified_base (2953)..(2962): a, c, t, g, unknown or other
  modified_base (3412)..(3421): a, c, t, g, unknown or other
  modified_base (6002)..(6011): a, c, t, g, unknown or other
  modified_base (6499)..(6508): a, c, t, g, unknown or other
  modified_base (7021)..(7030): a, c, t, g, unknown or other
  modified_base (9695)..(9704): a, c, t, g, unknown or other
  modified_base (10715)..(10724): a, c, t, g, unknown or other
  modified_base (11999)..(12008): a, c, t, g, unknown or other
  modified_base (12493)..(12502): a, c, t, g, unknown or other
  modified_base (13672)..(13681): a, c, t, g, unknown or other
  modified_base (15511)..(15520): a, c, t, g, unknown or other
  modified_base (15645)..(15680): a, c, t, g, unknown or other
  modified_base (15774)..(15783): a, c, t, g, unknown or other
  modified_base (16731)..(16740): a, c, t, g, unknown or other
gccggcggcaccgccgccgctggcgcggtcgggggaaggcggcgggcatcccagcagctgggagcgcaggagttgggcgtacgcccccgcactcgacccggggtcggcgccggggtcggcgccggggtccagggactggcgggggcgccctgcctccgccgccgcctcccgctccagcagcgagtagtcgaggcgggaggtggcggcgcgggaggggatcaggcggtcgctgtacacgactcgggacttgggtgacctaaaggatgcgggggcgggaaggtgttcaggaagggttgggggggaatgatttgtgttggtgctgtgattgacgagtgccccatggcagttgcacggcggatgnnnnnnnnnnacgggacttgggtgacctaaaggactcaggggtgggaaggtggtcaggaaggcttggggggggatggttcgtgttggtgctgtgattgatgagtgccccatggcagttgcacggcggatggggggcctcctgatccccaagggagttggaacaccatcttgcagaagagatcaaagaagagaatgaagcctccagatacacagctccctattgcaacaaccatataggcagcatggtcgacatactggaccctgctcacaaacaaaggaagccatacctgaagggcccgggcgtcaggatgctggccttcactggggaggagggtgcaggcggggcctgggactgaccattctccatctgcgagggattggagcaggccgatatgcaaagctatgcaggcgtacgccgcgatgtcgggcggtccctccgcggcgttttaggcggtgtactgcggagtttggacccacggccaaccccagctgcaggacagcccctctctccctggtgctgaatcgaccttggcagcgatnnnnnnnnnnactgcaggacagcccctctcaccctggtgctgaatcgaccttggcagtgattatattaccattcgtgtcccagaaatgctctgaatgcttcgaatcgcctgctgtcagcaggagacccctgctcccatgcagtaaccgctcggtgatcttcggctggagaggaccgtcgcggcgggcgctcttcactggtgaatcgagatccaatgcatggaagatctgttgggcagacttcgtctcttgcatcaatgatctggtttagcacgacgggcacccacccgagtctcggatcgccgggtcttggcgcgctgtaagcaggtccaccatcccggccatgcaccggccaaagtgggggaagcatccgggtttggcgagacggcatagagaagtagagctattgaacaggggcggattttcattattaaannnnnnnnnncaagtgggggaatcatccgggtttggtgagacggcatagagaagtagagccattgaacaggggcggattttcattattaaagcaaagggcttcgcgccggagaactctaccatcttgccgtggttcacgctctgctcaagaacaagcagtgcgttgcgcacaggagcatgggcccaggcatgctacaatgtagactgcacagtcagcgtcccctcatagcctcaacaactttgtcgcgaagacggacgcccgcgcgatcatggcgcggaggacctacagctctgtttactggtatgctcgtggtggggggggggnnnnnnnnnnnnnnnnnnnnnnnnnnnnnnnnnncggcacctgcctgaccctcacacgacaagatggcgacaccggctggtttgacgtcatcnnnnnnnnnngctttcaatcagacctcttcacacacgacatcttccgtgagcaggcattgtacaaggccaggccacggtgcgctccgtgtccgacgctggcgccttccgaagcctggagctggcctttccccaggaggcgctctccggcatctcgatcggtgccagcgtggcggtgaatggcacctgcttgaccctgacacgacaggatggcgacaccggctggtttgacgtcatctcagagacactcgcccggaccacgctgggtaatctggccccaggtaagcccgtcaactttgaaagggccgcacgatttggcgacgagatcggcgggcacaccgtgtctgggcatatatgcaccacggcatgcatagcagcagatgcggtgacagagctgaaccggcggcttgagttcgaggtgagggacaggggtgtgacctgaggtgcaggagggggggggttctcccgaaactttgacgatgctgggcgaggtgcaggtggtagctttgaacactgacgctggctgcgcccaacctgcacatgcaccttgggtctcattgtcgggtccaccacccatgcagcttgcggacgcctcctggatcaagtacataatgcccaagggttttgtcagcgtggacggctgcagtctgacggtgggagaggtgacctcgacgtccttctcagtctaccttattccagaaacccagaggtgagcagcagtgacggtatggcacttctttgatcatgggcccaaggagtgagcttagcctggatatcatgctctccagcatttgagatgggaggggccttcatgatatgtgctgattgtggggtgggtgtggcaatagggatgtttgtcatgggccaagtgtgcggctgtttgcagagactcaggtgagccaaactgttcgagatcttatcgatagcattccgcgtccacatggatgcactcctgacgtccaccccacagggtgactgttctggggtccaagaccgtgggcgacgctgtgaacattgagatcgattcacacacacagtcgatcgtcgacactgtggagaggactctgcagcgattcatggggcctgctgtatccacatctgcctcggcaatcgctggtgcatgagccggtatcgacatcccatatggctgaagcggttgtagtctgcagtggattctcctcgacgagggcagcgtgtgaccccaccnnnnnnnnnntccggtatcgacaccccatatgactgaagcggttgtagtctgcagtggattttcctcgacgagggcagcgtgtgaccccaccggtcggctgtgcctgcatgcagatgcggtgacatggagatcggtgttgtggcgcgcgcgcggcagagaacacatgctccctctgcgtctatgcttggaggcttgatggtttccatgtgcaccttttcatcgcgagttgtccatgctgatagcgcggcgtggacgctggggccgccgtgtttgtgagagagtccggtcgaccatcccctttgcatgtgtctcggtacccggctgtctgattccagccctcctgcgccgtgtgcgcctgccgatacacaagctttgaacttcgaatacgagtaagaatgtttttcccggctcctgtgtgcttccactcgaatctctgtgtgcgttgctgtgaatgactgnnnnnnnnnnatcccggctccagtgtgactccacgttaatctctgtgtgcgttgctgtgaatgactgtatcgatgagcaccaatgccgaggcctcctgccgtcataccctctcctccgcagcactgatgtggagcggaccatccgtcacgccaagcgtgcggcccggagcgagctgagcgtgaccggtgggggctggagcaagctcggcctggcccattcgaatgtcctgcaggtgggcgcagacttccccgacacaatagcacgcgtggatgcacgctccctgaccgccgaggagtttgccgtcaggttcgagtcccctggggtccccgtcatcctcaccgggctgacgtgcgactggccggcgagccgggaatggacggacgcccggttgctggagaggtatggcgaccaccgcttcaaggtagcgcggcggtgtggatgaccgggtggtgcttggggagtgagtgctcttccctctcgccggcgccctgatcccaaacctgctgcgcagcttgtcccaccccaaacatgctcgaggccccccctccctcgcgccgcttgcaggtcgggtcggatgacgacggctacgccgtccggctgtccctgcgtgacttcctgtactaccgggccagcagggagcacggccgcctcgacgactcccccctttacatcttcgacggcagcttcgccacccggcgcggcagccgcaggctgaggcaggactactccgtcccggccctgtttgccgaggacctgatgcagcatgcgggcgagcggcgcaggcccccttacaggtgcagtcccttgcgtgggatgggcgggcgtcttttccaagcacgcatgctgtgtgtgcaccaggcaaggccacatgcctggcccgcggagtcgtgcagcctccggtggaggtgcacacgctgacctctcccagctcggatccatcccggctccctctccacacccaggtggttggtcatgggcccggccagaagcgggagcggggtccacatcgacccgctcgccaccagcgcctggaatgcgctgctccggggtcacaagcgctgggccctgttcccccccggcacgcaccgcgaggtgctgaggccgccgggctctgaccgcgaggcctcctcctggtttgccaccgtcttccgggccatgctcggtgcggagggcggtcaggcgccagggtgcatgaacggcgatggagcggcagggggtggaggtaccggccctggaacgccaggcgctcctccctcgccgccgcaaccagtcccccaagacagctcacgaagcgtgccactcccagatcctgggacaccgccgggcgcgccgcccgggctcatacactgcgtgcaaggccccggggacaccatctttgtgcccgccggctggtggcacgcggtcctgaacctggatgacacactggcggtgacccagaacttctgcagcagcgtgggattcgcaagggtatggcggcacacgcggcgcggccgccccaagatgagccagcgctggctggccaggctgcgcctggccaggcccgatctggccgcccaggcggacgatgccggcgcccagccgggagaggggccggactccgcaagctcctcctcatcctcaagtagcagcagcagcggcagcggctcgtcttcgtcctcaagcagcgacgaggaggacggagaggcagaggtgggaggggagtctgccatggccaagaggccgagggtgggggccgtgcccgtggtagatcctccgcccagccacgatgccgtacagcagcctaccaaggaggactttataggatcagcgaccaatgtgggcgtggatgtgcaggcaacaatgtgaccagcacacgttacatgcattgtggcaaggaaggaattttgcagtgtagtaacgtgaacaggacgtcagtcggctctgtgagttaccatggcaggggcccacaagtcacatcatgccctcatatttcacccacttcccggggatttcattgccagcctcgttgcatgcatcggcttctcagcctgtactggactacccattccaaaaggccccttgttccgcacaaatacgcgtatcacgagccgtccctgcatacccgggagggcacagagagcacgagcagatgttcatgggggcaccagcacctggaaaatcgcccatgcagtcggaatggggggatactgcagccgatcgggaagaagtgtagagcgttgtacacatgatataccgttcaataccacgaccctcccctcatgtggccgtcgctgcgtccatcaggtcgcagcggttgcaggagtagaggcacgcgcccgcctgccccttctgcccgaccatgaagccagggttgttgtcacactcgccgccgtcggcccagtctgagcacgccttttgcgtgtccttgcaccctgcagagatgggtgcaatggggttgtgacagggcctgcttccagctgctgggaggacggttcctgaagagtgtgcatgccttgatgcacgcctgaggggctgcctagaggcccaaccccacgccatgcatgcatcgctcagacccctttccctttcctgtccggcaccctgtttggcnnnnnnnnnnttgaagagtgtgcatgccttgatgcaagcctgaggggctgcccagaggcccaaccccaagccatgcatgcatcgctcagacctcgttccctttcctgtccggcaccctgtttggctacctgggggcgctggtgggcggggggccttgaacactacatgcttcacagacttgggaatctctccgtccatcgcatagtgggccacatggtacctgccacgcgggaccaagggaacaaagggtgtggcgggtcagaggggagcagcccacccagccgtcatcggcagcgatgcacgagtctggctgtgatgatgcaggcacggccgcgcagcgcggccccgtgcctgcagggtcatcgcggcggcggccttctccacacacaccggcaggaagccctcccgaccttgccaacatgcaatctcccccccatgtcaatgcaaccatccaaccttccccccatatctcaccacttggtggcggcccacttggtnnnnnnnnnnttcccccccatgtcaatgcagccatcccaccttccccccacatctcaccacttggtggcggcccacttggtgcccttggtgacggggcaggacccgtgcagcgctccggcatccagcgtgccgtcggtgcgcaggctccagaagacgacggcgtcgcccttacgcgggcggtaggccaaccccgccatggcgcactcgctgtaccccgcctcgcggctctggctggcagggacagcagcgttggggaacaccgtctcgcccccctcctccacatccgacaggtacatgagtaccgtggccagacggttgccgccgttgtcggtccccgcctcgtctgcaagcagttgtaagagttggggggggcagggggatcaatggagggggaaattgatggcctcaaagggactgatcggcctttgcaggggcagtttgggaggcatgttatcgattgatgacaacaggtctgtgcgctgccgcatctcgatacactgctcccacgtcccccctctcagnnnnnnnnnngtggaatgatgacaacaggtctgtgggctgccgcatctagatacactgctcccacgtcccccctctcagttcatggccccaggccgccacccctcctcccatttcccccaccccgtccccagcctcacggaagaagtagtcaaagtggggcttgtactcctgcccattctcgtagcgcagcacctggatgccctcgccgtggccgacggggatcatggtggcctcgctcagccggttctccacccgcgcgagcacggggtcctccttgcggtcgaagaacatgccataggaggtgcggacgtcggagacgccgtctcgaccccggccctccacctccaccacgccgctgcgctccagccggggggtggcggccttgatgatgtggtcgcactcgtctgggaagaggtgggggtgcgggggtgggatcggcgctggcattccgcatgtctgggcgggcgctcgttgggcggtggtggcagcggcttgtgacccctttcatcactgacaatacaatgcccacatgcatgcagcacctgagccaggatcaggatcctcgtctgacccagccgacaccaagacatgccggccacaagcagttcctgccccggctgatgcttgggcgtacaacaaacactccaactcctcatcacgcaccgtcggtgaggacgttctggaggaggaaaatacggggactccaactgaggaccttcattctccccagtctgttccctgtgccaggggcagcattgtagtcctcgctccatccaatcaggttgtcctcgtcccgtttcgaccaggcggggtgtaccagcatggccagcgctgctgccatgaggagcgcatgtcgaaaatgtacccccaacatattattctggattcgagtcctatcctctcagcgatcgacgctgggagtggaggggccagaccaggtgacgtgacactgggtagtgcccggtcgttgggtatggcacgcgcaccaggcaggtccaattcgagatcccaacagtctcctagcggtgcaactacataattagggtaagtcgttttgagcgatcattcccgaggacgaccaaaccgtgcatgcacgctggtcacgtacctcgttgagatccctggatcctggcgggaagcggggccctgcgagaatgtgggtaagacgaactcaagggggtgccatgcaggatctgatgcgacacaaacgagtaccaactcgtagcatttgctcatcatctgaataaatcacacatggttgcaggcgcaatggcagcgacatgcgcgggtctgaagccttgcctttccacgtcgtgtcgccctgctggaatctcgacacggacacagtgtgtgggggggcccatggaatgggagtgtgggaatgggcacattaaaatggatttgccgagactagatcacgagagcctgcatcccttttccatcgcgcagcaagttcagctcgtctgccaggaggacgtgtctggcaagcccacaagctctcttcgggaagggcaaggaggtaggcgctcggagcgggacatgcacatgttgatttggctggacagcaccgataatcgctggagaggactacatcgcgccatcacctcccctcattcctcctctgcgcctggcaggaaggtggaggcggaggtggtaatccctttggcaactttggcaacatgatggagaagctgaaggacgcgcaaaacctcgtgaagaccgagacggccaggctgcaggcagaactcgcacagtgaggaagcgagagggaagggtcgggtgatgtctgcaggtatatccggttccctgcagggagcccccctccgggccactggtcgcatcctggggagatttggaaatggcgtccaagtttaaatcgtggttcgtggctgcttatgcagcgcagcactgtgcgcactccctcgacggctccatttcttcctccctccacctttgcttccacctgacccccttcacgccaggacggaatttgagggcttctccaaggacgagaccgtgcgtgtggtggtgtctggcaaccagcagcccaaggcagtggagatcacgcaggaggcatacaaggacggccctgaggtgggaggttgggcagcgaggcaggaatgtcatcccctgagcctccagccagcatgctcccgcagtggatgcaccccacttcaaagcgcagtctcgtgaatccttcacccaccccgctcacgacttactcttagcacgctcgcctccacatacaaccctcctgcaggccctctcccaggcggtgctggaggcggcgcaggaggcccacgccaccagcgtcaagggcatgcaggagaagatggcggggctggccaagtccctcggcctgccctcgccctgagcgggcgggccagcttggcgtgcgaccaggcgcgcagcatcaatcccatgctgaagttgccacgcggaccctggatgccgtacgggtcctgcttccctctgccatccccagtctcccatgctccccatgccccagctgtcacggcgcgctgcgcggccctcctcctgtggactttacaacacgctcactcatgtgcagagcaggggagggcacacttgagtggtcggtagtagaccatgggcgctcagggagggggagaggtgtgcaccgccggtgccatccactcgccagacgtggggnnnnnnnnnnaatgccccagctgtcacagcgcgctgtgcggcactcctcctgtggactttgcaacacgctcactcatgtgcagagcaggggagggcacactggagtggtcagtagtggaccatgggcgctcagggaagggagagaggtgtgcactgccggtgccatccactcgccagacgtggggtcgggaagagagagcaagggtccgactctgcgccacaggcaaggtgcccaggcgcacaacacgacccaggcgccgtctcaagtgcgacgcaccgaccgaaccaccggctgcctagccgccgcttcccgcgccgatgggcgcgcgacggatggcctcctcccacaactcccccgcgcccaggcccctgccctcgcccgccttcttggcctcccgctcggcggcctccaggcgctggtagcggtggaactcgcccaccatcccgcccatggcatcaaagtcgtgcgctaggcggggcacctcgcgcacgggtgccgcgggcggatgcgaggccatgatggcctccagctcctcgcccagcaccgtctcctggcgcagcagggcgtcggcgacggcctgcaccgccggctcgtgccgcgccagctcctccatgttgtcgttgtaggccgccaggatgaggtcgctggcggcgcggcacaccgcgttccaggtggcgtcggtgggctggaagccgccgccgggcaccgcgtgcccaaacaggttgtcgtcgatgcggtcggggttgacctcgaacccaaacatctgattctccatggaggggacggggggcggggagtagctgaccaggcccaggtcggagaggcagtaggcggtgaccgtgcgcatcgcgatgcgccgcgcgtcctgtggcgtccgaggcggtgggggtgattctgggttgcagccctgagcagggcgtaggacgccgtcgctgcagtcccgagcgctcacgacctcacacagtgtaacgcatggtctcccccctccatccccacgtcaaataccccaccctttccctnnnnnnnnnnaagcgctcacaacctcacacagtgtgacgcatggtctcccccctccttccccacgtcaaataccccaccctttccctcaaccacaccgactgaatcccacctggaggtccttgtcgcagtagctactggcctcccccaggaacaggtgctccgcggcccgccccgccagcgcgacgcgcatgcggtcgcgcaggcgcgcgcgcgtgaccaggaggtaggtctcgtcccgcccccgcgccagcacggtgcgcgacagctcgcgcccgcgccccaccaggctcatgcgctccacggcctccacgtgcccgctgcgcgcccgcagcaaggtggaaagcacgcccgtccccgcctcgtgcagcgccaggcggcggcgcatggcgtagtgcttgggcagcggcggcaggcgcacgccctgcacgacacggtccacgccgttgtcgacgtggcgctgggtgacggtggtgccgcgccgcctcaggcactccaggatgctctcgttgatcacgttgcccagctctgcgcccgacagcccgggcaggtcttttgccagctgggcgaggtccacgcccgggtccatgctggtccgccgcgcatggatgcgcaggatctcctcccgccccacctcgtccggcaggttgatgcggatgcggcggtcgaagcgccccgccctcagcagcgccgggtccagcagatcggcgcggttggtggcgccgatgaacaccacgcccaggctggggctgaagccgtccatctccgtcagcagctggttcagcgtctgctcccgctcctcgttggtgcccacccccgcgtcggcgcgcttgatgcccagcgcatcgatctcgtccacgaagatgatgcagggcgcgttcaccatggctcgcttgaacaggtcgcgcacgcgcgacgcgcccacgcccacgatcgcctccacgaactcggaccccgccatctggtagaaggccacgcccgcctcgcccgccaccgccttggccaccagcgtcttgcccgtgccggggtcgccctccagcaggatgcccttgggcggccgcgccttcatacccgcgtactgcagcggggccttgaggaaggccaccacgtcgttcaggtcgtggatggcggtgccgatgccgcccacgtcggcaaagcccacgcccgtggtgccatccttgcgcgccttgcccttggactgcgcaaactccagcgcctgttgttttgtcgtgatggtgcgatggttggggggggggattggggggaagatggagatggccccggggnnnnnnnnnntgtgatggtgcgatgggttgggggcgataattggggggaagatggagatggccccggggtgggggtgaggggtggcgggaggtggaggatggctgtgggcgcacggttccagccatgacagaacattgcgagcccccgaactgcccaccgcgtatatccagacgcaacacccccccgtcgtaccatgaagaggtcaatgggcatctgcttgcgaggcttaaagatgccgacggccagcaccacggcgagaaaagaaagcgcgatgccgtagatgccgtactgtgggatggccttgaatagccagcccagggagtactcctattgttatgttttgggtgggtgggtgggtgtggaaagggggaatggttgtgattgggggatgcagtggggaccgcacgatcctgtgaatggggagcccaaaggtcttccaatcgcacgcacaccccactatcgacagcaaaagtttccaagtccaccttgaccannnnnnnnnncatcgcacgaacaccccaccatcgtcagcaaaagtttccaagtccaccttgaccagtcatccctgtgcaccacccaccggcagggtctggtggaaggtgacggagagctgcttgtcggcagggcacgagtaggtggtccccttgcgcggcgagaagcccttgttgaagatctcgtgcatctgggccggcgtcgcctcctcctcaaaggcttggaacagctgtgtgggatgaagggggggcgcagacgacgggtcgaggtgtggagggagcacctcaaaaccagggggccatagccagccttctcacccagtcctggacctagtacagcgccaccccccgcgccatcatccccctccccaccaccatcggtactggcacccccttcccccgctcctgtccctccatttcccaatcagccggatgactcacctgctcgaaaacctgattgaagccgtactgcgtcggcgagaccagcacctggggcaggcgcttggcgttgtgcacggcgccgcccagcccaccgccggagtagtcgcggaggaaggcgtcggcccccgaccggtccagcgccacccaggcggagcgcccctccgcggggcactgcaccagcacgcggtagccgctgtacaccgggcgcagcaggcgggcggtgtcgcggaagaaggccagctcccacttgggtagcgaggggtcgtagcgcgggtgcgtccagttgcggcgctggaggccatcgaaaagctccatgaagggcatctccgggatgcgccgccagtcgggctcgggcgtgagcacgggggcggtgagcgcggagggggggacgaagtcgtgggtcagcaccaggggctccaccaccttgccgctgcggggttcgtagaccaccttgagcgtgcgggtgaggtcctggatggaggggccctgctcctggatgcgccgcaggtcctgggccgtcagcttcttgggctccagcccggcctggcagaagaggtggattcgaaggggtgagggatggagcggcgctgcatcgggagcctggggccggggctgggcagagaagcggcggagggcaggggctctggggaaggcgcggcagagcaaggagagcactttctgcatgccagctggtcattcctgggtatcataggccataccctcaccttcacgcggacggcnnnnnnnnnnattctgcatgccagctggtcattcctaggtatgaaaggccataccctcaccttcacgcggacggccaggtggcgggtggggcgggggcagcgggaccgaggcgaccgaaaacaggccgaggaggggagactgctgggacccagccagggcgaactcgcgatggagacacccatcatcgagcccgatcgtgttcaacaggcactcctagatgtaaccctctcctcaatgcatgctgggggctccaggctggggaggggcgtcagctagtatcccgcaacacccggctggacacgagctaagcgtcacctggtcgctcttcagaaatgcttccggcatgcggcccgcaccattctgatcgcgttacacagccacggattattgttctcgtcgtttgcgggaggttttcgttggcctggaccaggggatatggtgccgggcacccatgcaggctcatgggagatggacatcgagcaggaaagcgcgacccttactacccgagccgcgagcagtgtggcatcagcgtggaccgagggttgcatgacattgcaagcagacgatcgcagctgggattgcctgtacagctgagacccctttgcctatcccgtccctgtcaatctcccttgagcccgcccggcttcggtcccctcactgagtcacctgtgtgagcttcaggcaggcacgcacctgactttgcagcccttcagtgcacggttcgcaccgtataccggagcaccagtgtcctatatactgggtatccacccttcgctgtcctcccattctcgagatgaacccctacagcggcacgtccaccctcgccaaggtgtgtcccgcgggtggtccgtctcgctacatgcatgcaggcgttgagccaaatgtatctcagcactctcgtatcctgcccttgcaggtccttcgggtcggtgccgccggtttgggtcttgtgtacggagcggccacccttgcaacttacaaggtacaggagcaccagattgtggtagattacaccgggacattcgcttgcagatgatcgtctcagatgagcagcatagcgacgccaatcccatttacctcttcccatttacctctccccgcatcccaatccaatcaccaggcaaaggcagccaaggctgcagctgccaaggctgcgcaccagtgattgcccaagacatggtatgcaggaacgctggcttcatgagctcgttgtgccaaaactgaggctcgcgcgttccccccgatgaagccttacctcatccttgagccatgacgaacgggagtcactccgcaggcttgttaaaaaatcacagcagcaagcggaatcgattgtaggaaggagaagcgtacaatgtcagcacaagggattggacagaaaattttggaaggggagaggctgtagtatgtgacgatggttctcgtggcctcggcggttgccaagctgggtgcacagggggagggagagaaggacgggaccagcccaggcagtggacggaccctgggccacatagtatggtcggtcaagggaggggatgggagggctgagcgtgtattggatggggaggtgtgccagcagccaaacgatgggggcccctgcggtacagaaaggagagcaagctagaaatctgcccaccagggtgccacctgcggaagggggcggcagctgaccatggcagcgctattcttcaagcttggattcttcaagctcgggacaaatgggccggggatcgggggaggggggaaggtgtcagcatgagggaaggcccatttagcgctcatctcagaggggcgcccttgggattcgggggcatcgacgccgggttcctgtgcatcccacannnnnnnnnnccagcgctcatcccagaggggcgccctggagattcggggacatcgacgccgggttcctgtgcatcccacagccgggtaaagaatgctaggctgtaagacgtccccaggccttcagggtgagggtnnnnnnnnnnnnnnnnnnnnnnnnnnnnnnnnnnnnaggccacctccgagcgccccatgcgggaccccgcgcagctctcggcagcattcccggtgcttgatcgcaggtgcatcgagtctttgattctccnnnnnnnnnnatggaatagtcgtgctccatctgggaggtgctgggctccatcagctgcgccaccaaatcatctgtcacatggcagcgacggggaggaaggagtgagaggtcgatggcctgggtgcgccgaggcggggagggccacctccgagcgccccatgcaggacccagcgcagctctcggcagcattccggtgcttaatcgcaggtgcatcgagtctttgattctcctcaaaacgaagcgagtccccccggcgcgctcattcccctcctcacaccaccacacgtacacagcgctcacctccctcaccctccccctggttgccattcttgcgtggcgtgaggtggtccgaggcgtagcccccttccgccgcccgctcctccacctcctcaaaggtcggcagcttggtggcaaaggtgttgatgcggcggatgggatggcccagggggccgagcttggccccgcccgagccgtcggctgcgtcatgccagggagtttggactggagtgagtgggcggttcacctggacctcgcagccacaggcgtgcacgccaggcgacgcccacgaggcgcgtgagcgcctgcacccggcacagtggatccaccccgaactcacagtctggcggcgagtcgttccagccggccaggttgcccatggacacgctcttgctcatcttccggggcctgcccatctcgcccatccctgagtccccaaaatccatctctgttgggaaagggagggggtgaggggggagggggagagggttgaagagggtgtcctggccttgctggatgggagaacaggcatgtgggcaggccagacaacgtgtagcatgtatgtcggtgccacagtgcggccccgccgcccagtcaccggccgcctgtactctccagggtatcctttccactcacctcagcccaagggccccccccctcgcggcagaaatgcattgggttnnnnnnnnnntgtgtagcacgtatgtcggtgcctcagggcggccccgccgcccagtcaccggccgcctgtactctccagggtatgctttccactcacctccgcccaaagggccccccctcgcggcagaaatgcattgggttgccgttctcgttccgtgacagacgaccctccccaccccacctcttcatcccaaagcacaccctcgaccccacacccaccgctggccgggtcccagctgctgaggtccaccgccgagcgcgacttgcccaggctgggccccgcgccggcgtcgggcatgtccttgatgaagtccagcagccccgcggtctcaaagtccatgtcaaaggtcagggcggcggcggcgggacccgagccgcccccgcgcgccgggccggtgcccggggtcgcgcc

SEQ ID NO: 39978 - DNA, 78 bp, Chlorella protothecoides
atgatgcactttgagttccctctgcatccccgaaccttccccctcccgtccaccttcatgttgtgcagcatgagcccc

SEQ ID NO: 39979 - DNA, 109 bp, Chlorella protothecoides
gtctacacctttgggagacggagccccagggaatgcatctctcatgcattacccgggagcctactcgcccctctcctcaccgccgctcccctgcagagcaccaactgga

SEQ ID NO: 39980 - DNA, 371 bp, Chlorella protothecoides
  modified_base (110)..(293): a, c, t, g, unknown or other
ggggctggccctggagcagcagctggcgcgcatagcgcagaccgacctgctggttggaatgcatggggcggggctggcacacgccctcctggcgcggccggggacggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtgaggcacgggggcctggtcgtttgcggggtgtttgtgggtgtgaggagggagggagggatagggtccgggagc

SEQ ID NO: 39981 - DNA, 484 bp, Chlorella protothecoides
  modified_base (114)..(348): a, c, t, g, unknown or other
ccagaactgccaggtgcgctttgttcagggttttgggagcgacgtgggaaccccggttgccaccctggaggctcgggggccaaccatgcgccgctcgccaggcagtacacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggactgcaattgtatgcattgcgatggtggtgtgggcgtaaggcctcgccgctctggatatgcgagtgggtattggcgcctgcactgaggcccgcatcccttggatgaaatctgctgcctccctcgcacaca

SEQ ID NO: 39982 - DNA, 61 bp, Chlorella protothecoides
ttttgacaaacacttttccaagggctcaatcccgccataccaatcctgccttgcgatgcac

SEQ ID NO: 39983 - DNA, 102 bp, Chlorella protothecoides
gcaggccgccgccaaggtgagggaggagcatgagtgagaggaaagggagggggggagagggagtgcagtacggggcattttccgcgggcgggcttacttcct

SEQ ID NO: 39984 - DNA, 61 bp, Chlorella protothecoides
gcgacagacggcaacaagcgcgccagcacactcccaacttgaatgtacggcttgccagggg

SEQ ID NO: 39985 - DNA, 108 bp, Chlorella protothecoides
gggcggcagcaggaagacgggcagggctgctgccaggccaatcgccatgtagccccactcccccaggccctgcacaggacgaggtggaaagagcgaggtgggtcaccg

SEQ ID NO: 39986 - DNA, 126 bp, Chlorella protothecoides
ggcggctttgccgacggcagcgtgcgcctgtacgacctgggccagggcggcggcgccgccgccgtgatcctgcgcgggcacgaggcgggggtgcagggcgtggccctctcccccgacgccagcctg

SEQ ID NO: 39987 - DNA, 61 bp, Chlorella protothecoides
cgccccctgcaccctcgccgcccgtcccagctgacagcccgcggcccgtgcgcacaaacac

SEQ ID NO: 39988 - DNA, 61 bp, Chlorella protothecoides
tgcaatatgcaataccttgttacaggcagggactcattgctccaaaacatagttacacccc

SEQ ID NO: 39989 - DNA, 61 bp, Chlorella protothecoides
ggagcgccatggacatcttgtgcgctcgactcctgcacccctctttcacctccctctcgat

SEQ ID NO: 39990 - DNA, 70 bp, Chlorella protothecoides
cgcctcctgcgcagggcgccggatgggaggtgggcccattcgtgggacttgacggcggctggcgcggagg

SEQ ID NO: 39991 - DNA, 132 bp, Chlorella protothecoides
ggcaagcatgggaggtggcacagtgcagtcccctgcccgctgacatgggccccctgcacgagggcggggccacagcggaccaggactcccaccctcctcacccccccctccgcacctgctcaaagagctggg

SEQ ID NO: 39992 - DNA, 72 bp, Chlorella protothecoides
caccagtcctccaacgaagagatcccttgcaatgcatcacttccgctccccccccccccccccccccccccc

SEQ ID NO: 39993 - DNA, 123 bp, Chlorella protothecoides
tccggagcctcgcccacctcgcccggcgccctccgcgcctcgcggggcccgggcacctcactctgtgcctgcaacatgctccggccctcgacggccgcggggccctccaggaggccgcggacc

SEQ ID NO: 39994 - DNA, 77 bp, Chlorella protothecoides
gggggagagcgggtcctgtgtggcagcagcgtggagctcccgcaccttgcccactcctgagagggcctgatgctggg

SEQ ID NO: 39995 - DNA, 33991 bp, Chlorella protothecoides
  modified_base (428)..(437): a, c, t, g, unknown or other
  modified_base (1049)..(1058): a, c, t, g, unknown or other
  modified_base (2136)..(2145): a, c, t, g, unknown or other
  modified_base (2204)..(2213): a, c, t, g, unknown or other
  modified_base (2764)..(2773): a, c, t, g, unknown or other
  modified_base (3502)..(3511): a, c, t, g, unknown or other
  modified_base (4028)..(4037): a, c, t, g, unknown or other
  modified_base (4767)..(4776): a, c, t, g, unknown or other
  modified_base (4839)..(4858): a, c, t, g, unknown or other
  modified_base (5305)..(5314): a, c, t, g, unknown or other
  modified_base (5895)..(5904): a, c, t, g, unknown or other
  modified_base (6039)..(6048): a, c, t, g, unknown or other
  modified_base (6228)..(6237): a, c, t, g, unknown or other
  modified_base (6710)..(6719): a, c, t, g, unknown or other
  modified_base (6826)..(6835): a, c, t, g, unknown or other
  modified_base (7503)..(7512): a, c, t, g, unknown or other
  modified_base (8316)..(8325): a, c, t, g, unknown or other
  modified_base (8789)..(8798): a, c, t, g, unknown or other
  modified_base (9208)..(9217): a, c, t, g, unknown or other
  modified_base (11847)..(11886): a, c, t, g, unknown or other
  modified_base (12049)..(12058): a, c, t, g, unknown or other
  modified_base (12567)..(12576): a, c, t, g, unknown or other
  modified_base (13099)..(13108): a, c, t, g, unknown or other
  modified_base (13329)..(13338): a, c, t, g, unknown or other
  modified_base (13545)..(13554): a, c, t, g, unknown or other
  modified_base (13973)..(13982): a, c, t, g, unknown or other
  modified_base (15313)..(15322): a, c, t, g, unknown or other
  modified_base (16476)..(16485): a, c, t, g, unknown or other
  modified_base (17292)..(17301): a, c, t, g, unknown or other
  modified_base (19174)..(19183): a, c, t, g, unknown or other
  modified_base (19742)..(19751): a, c, t, g, unknown or other
  modified_base (20286)..(20295): a, c, t, g, unknown or other
  modified_base (22113)..(22122): a, c, t, g, unknown or other
  modified_base (25216)..(25225): a, c, t, g, unknown or other
  modified_base (26263)..(26272): a, c, t, g, unknown or other
  modified_base (26542)..(26551): a, c, t, g, unknown or other
  modified_base (27622)..(27631): a, c, t, g, unknown or other
  modified_base (28229)..(28238): a, c, t, g, unknown or other
  modified_base (29010)..(29019): a, c, t, g, unknown or other
  modified_base (29522)..(29531): a, c, t, g, unknown or other
  modified_base (31136)..(31145): a, c, t, g, unknown or other
  modified_base (31260)..(31269): a, c, t, g, unknown or other
  modified_base (31359)..(31368): a, c, t, g, unknown or other
  modified_base (32216)..(32225): a, c, t, g, unknown or other
  modified_base (32374)..(32383): a, c, t, g, unknown or other
  modified_base (32595)..(32604): a, c, t, g, unknown or other
  modified_base (32725)..(32734): a, c, t, g, unknown or other
acaggccaggcgtggttctgtggtctcctctccaggggtcttcaaagcccaatgcaaatggcgacttcccctcccattccgcgcaacacctcccctcctgccccttggcacaggtatggtgggtgctgaacgccatgaaggaggcgatgaatgccatcccggactgggaccagtacgagaaggacaaggtggccaaaaagctttggaacggtgtgttgtgagctagcatgggcctgcgaactgtgcggcgcccagcctgctcgtgttgccaagattgtctagttgctagttttatcacaaagatactcgcgtacctgtctgcgcgtgtctctgttctccgcgtgtccattccagtaagaaccagcccatgcgtagacagccctgtcgaggtcatcaatcaaaggtgtcagatctccagacctgctgcnnnnnnnnnncccattccagtaagaaccagcccatgcggaggcagccctgtcgaggtcatcagtcaaaggtgtcagatctccagacctgctgcgaccatcgaagcatgcggagcaaggaagcaacgagtgtgtcggcatgcagtgcaccaatgcaaggagcatcggcatgcaaaataaccatttgtaaaatcttaattctcatcaaatctggccttggccccgacctctgtcgtgcgcctcacgatgctgcggtgcgccttagccctcgtgccgaggcccagcgtggcattgcagggctggatcccggcggtgcgatgctttgcggtgggaggcaaccatatggccctcataagggagctccgagaggcgtccggtgcccccatctcggacgtgaaggctgccctgcagcaggccgactgggacatgggtgagtcatgggtatggtcagggtgtcgggagcggccgccccccaatatggcaacgctgacccctggcacaagtagagtgcccacgcattcaatccctggtcgttgctagacctggctgctcaggagctgaggaggaagggcgtcgcctctgctgggaagaaagcaacgcgcacggcagcagagggcctggtgnnnnnnnnnncgccccccaatatcgcaacgctgacccctggctcaagtagagtgcccacgcattcaatcccctgatccttgccagacctggctgctcaggagctgaggaagaagggcgtcgcctctgctgggaagaaggcaacgcgcacggcagcagagggcctggtgggcgttgcgtccagcgagctcggcgcagcggtagtagaggtgagcacaggcctcgtgcatgcgaaggtcggatccgagtgcattgcgcctgttgcagcccagccggtgagggctgtccgcccctcacccgacgccgcctccttcacccaccctggcaggtcaacagtgagaccgacttcgtcccccgcaacgacaatttccgggccctggttcgagccgccgccgcagccgccctggaggtcgcacctgcagggcccgccccctccccgagccacggtctgcccctggatcggctgctgtccgccaagacgccaggcggcgagaggtgagcaaattgttgatcctgccatgtcgggagtggccccacatgcacgaactgcgttgcgccgatccgcatgccggcaggcgctctggcgcgtcacccccatgtgctgctgttggtcaccccctcctcaaatttccgttcgatccgaatctacccgtcacaactcccgatcacccttgccagcctcgaggacgcggtggccaatgtggccggcacggtgcgcgagaatgtgcgcctgcgccgcgctttcttccttccccggcccactggcggcgtggtggcctcctacctgcatcagggcgcgggggaggggctgggcaggattgcggccctcgttgtcctggccccccgcgaccccggaaccgagttggccgggccggccgccgaggccgccgccgacctggcgcgcaagctgggcatgcaggtggtggccagcgcgccgcgctttcttgatcgcgagggcgtggaccccgtggccgtggaggaggagcggcaggtcctgcggagccaggccctgggctcaggcacgctgggagcggagcgcttttccagggggtggggttcaggggttgtgagcgctggaggcgcggtatgnnnnnnnnnnagtgcttggcaagatccgcgagtcgcattggcggcctgcagccatcctggctccctttnnnnnnnnnnaggagcggagcacttttccagggggtggggggttaggggttgtgagcgctggaggcgcggtatggagattgtgcgtccatgcaatgtcttgaaagggcctgggcctggcagttgcagacagggggtagtggcacagccagggctggcttggcgccgggcacggcgcccgtgtgcttggcaagtccacgagtcgcactggcggcctgcagccatcctggctccctttcagaactccaaacagcatcttctctccacccctgtgcaggcaagccggcgtccatcgtagacaagatggtgatggggcgcttgcaaaagttctaccaggaggtgtgcctcctggagcagccattcgtcatggacgactccaagagggtgagcgggggagtctggtgggaggcctgtgagaggcaggtgggcgagaggcaggggtaaggcaatagggcccacacaggaagagccactaggagggctatgcacgcttcatccatcaactgttcttagtgtgtgttccaccctggacgcatcccccgccacccctctggcccaggtgnnnnnnnnnntaggcaacagggcccacacaggaagagccgccaggagggctctgcacgctccatccatcaactgttcttagtgcgtgttccaacctgggagcatcccccgccacccctctggcccaggtgcaagacgtggtgagggagctgggcgaagcgctgggagtgcccctgcaccttccggccttcctgcgggtgaaggtgggggagggcgtggacagggacgccaaggactttgctgctgaggtcgcagccacgctggctgaggctggcaaggcctgagacgggcgcaagctgtgcctgtatttcctttcgtttgatgggttttcgtgcacgcccatcgtcacctctgtgcccagaggtcctgttcacttcatcactgccactgcctccttttgaccgttctgtcgtttgcaaggcaatccttcccacacaaggtgcatgcagcgtgggagcagggaatgtgtgagaagcgacttttagcgcctcatgaggcagacagtccttttgggaagccaagcctgacacagacaaaacctcaggtgcagggttttcgtcgcagtccttgtggtgcgatgctgagtgtctctcagaccctgcacgtgaagctgtcgtctgaggggccggctcacaatgcttgctgccgggtacagcagcaggcgactgggtgaaggtctgcatacaggttacagccttgtgtgctggcgccgcgtctagtccatgcggccatacagccannnnnnnnnnttgttgggtacagcagcaggcgactgggtgagggtctgcatccaggttacagccttgcgtgctgggcccgcgtctagtccatgcggccatacagccactccatgatggtctgcatgacgtcgctctgttccaggtcgaacatgccctcccgctcaggcagcagggtgacatcggtgtccagggcgggcagcgcaaggttgcgctcctggatgtccctcagcctcttctggtacatgcggtgtgaggtgtaggcaaacctgcacgtgtgcatgcgttggggaggcatcagcaagagccggagtttggcttcgaggggcctgctgggatcttgatgtgcagatcaggaaagaggtggagggccgccatgcaccttccacgatgaaccagcggccgcaggccatcttctggagcatcgcacccccaggtgggggcatgctgcatcacacgtggcccactctgacaaggggaagaggatgctcggcccttcctctaccactcacaaccatgcccctcctcnnnnnnnnnntatcgcaggccatgttctggagcatcgcacccccaggtgggagcatgctgtatcacacgtggcccactctgacaaggggaccaggatgctcggccctacctctaccactcacaaccatgcccctcctcacctcctccagaacctgccgatgttcctctgcagccgctcaatctcctcctggggcacggccttcaggatctcgggcagccggccgacctcgtcaaacccgacacgtactgggtggtcacacgggggagagcccatgtgagagttctgccagagagatagacatgtgtatgcgcagcatcaccaatactgccgccccgagccccatgcctcactcgacacatctgcttcatcgatgatgttggagagaatgggcttcacattgtccatgatcgcgactgggatgcagccgtggaggatggcatcctcataccgcgatgtccagccatcccctggggtgcagggagtgggggagggttggaccaactctacacttggtgtgagggcccaggcttgaaggggatgggacgatcccagagtctggcagtgcacccgagcaatgcgtgtgaggctttgcagagaaagcaggaggtcagctgccgccatgcctagcttgggaaggccccctcctttccccccctttccccctcgacttgccgatgatggccaggcagaaggtggactcgaccaggaactcgctgtacgtcttctgtgtgacattcgnnnnnnnnnngtgcgtgcgaggctttgcagaggaagcaggacgtcagctgccgccatgcctagcttgggaagnnnnnnnnnnnnnnnnnnnncccagtcctcttgccacgcctggcgggcgagcttctggcgcacaccccgtgagtagggcaggttctcgaactgcgtcggggcaggggggagggagaccggggtgtgatggggcgggggagtgcgagggggttgcagggccggcattcacggggacacccacactgtagggtgtgaatgcgggccgcgcccgagcgacagggagcggcccccagccccagccccgcccgatcacctgcatcctgcccttgaagaagccgaggcgggtgcgggggacgggtgggtagcccaggagcggggaccgagcatagtgcttcggggagcgcatggcgggcaccaccagatctgggggattcatgtggggagggggcgtcgaggcgaagccatgcagcgccggctgctctgctgcagagggccatgcgctgcgtcagggaggagccggctgcacnnnnnnnnnngtagtgcttcggggagcgcatggtgggcaccaccagatctgggggattcgtgtggggagggggcgtcgaggcgaggccatgcagcgccggctgctctgttgcaaatggtcgtgcgctgcgtcagggaggagccggctgcacgccacgcgtggagttgggaattcatgccaccaccaggcaacctccctccgagagccatcagcacgccctgccttgccctcggggccctcgcctttgacggggtcatagcaggggcccttggtgatgcggtggaggttgcccttgggtgcgtacagcgggtgtgagatgttgagcgagtagttgtcgggacctgggagggtggccagggggcagcggtgacgtgaggtctgcctggctggttccggccgtggccccgggagctgtgggcaccgagttcccggtgacatggacccaagtctgggcctgtgggacgattccccccccaaggggcgctcgcaccatagcccgtccaactggtgtggttgtggtctgtcctgccccagtgggagaagatgatggaggggcggatgacgtttgggacccagcaggagccctcgtcnnnnnnnnnnttgcctggctggatccggccgcggccccggggcctgtgggcaccgaggtcccggtgacatggaccctggtctcggcctgtgggacgatccccccccccaagggacgctcgcaccatagcccgtccaactggtgtnnnnnnnnnngtgtgtcgccagctgcgcaggggggccggggatgcacggggcgctgaggacggggcggcggcggcgagtggacctggccgcgactccccatcagagccgtgccctgtaccccgcagcatgccacggatcggatgcggttgcgtgagcatgctggcactgccccgccacgtacccagatgnnnnnnnnnnggagccgtgccctgtacgccgcagcatgccgcggatcggatgcggttgcgttagcacgctggcactgccccgccacgtacccagatgtggtccctccccccctttcgattccagtaggggtagtgcgcccggatccaatggaaggcgtcctccagcaggccgccggcctggacggtgcgccctccatctgggtcggccatgggggggttgggggtgtgaagggtgatcctggcgcgcgccgcgcaggcaggtgcgccgtctgcgctgggccctgcctcgccggacccccccacctcgtgggccggcggccaccacggcagagctacccccaggggcgcggtggcgagggaggcgccccaccgctgcttcgggccgggcagaccctcccacaacatcgcgcgggcttctgcggagcattacgccaaccttgccctccccccctgcggccacacccacatgagagcgggctgtgnnnnnnnnnnagagacgggtcactgggctggcccttgtggccatccggctggcattccctggtcaaagcactgtctgggaggaacagagggccatcccctgcgcgccctcctggccnnnnnnnnnntcccacaccatcgcgcgggcttttgcggagcaccacgccaagcttgccctcccccccccgcggccacacccacatgagagcgggctgtggtagtagggcccgtcgccaaagttctggaccggcatgatgaggcagcttgtgtacacggggacgtagaagaagtcggcctcctgcagggtcggagacggggtcgctgtgctggcccttgtggccatcgggctggcattcccaggtcaaagcactgtctgggaggaacggagggccatcccctgcgcgccctcctggccccacccatgcaggcacgccccgcaccaaggctcccgcatggcagagcgcccacctctggatccagggtccgatgggggctttgcagcagcatctcatgcagccccatctcgagctggtagtagttgtggtccttgaagtctgtcacattccccccggtgaactgacggtggttgcagaatcccctgcatggaaatgaggggagggggggagaacggctcaggagctggagagggggagccggatggcatgccgcgtggaagctgcccggcggcgcgccggcgagaggaggacagctccgcgagtcggcgccctgcctccccccatccaggcatgctgcggcccaaatttcccccgcgtcgccatccggtccaaacgcccgnnnnnnnnnnggtcacattctccccggtgaactgacggtgggtgcaaaaccccctgcatggcagtgaggggagggggaaggaacggctgaggagctggagagggggagccggagggcacgcagcgtggaagctgcccggcggcgcgccggcgagaggtggacagcgccgcgagtcggcgccctgccttccccatccaggcatgctgcggcccagttttccccgcgtcgccatccggtccaaacgcccgcgcgcctcacccgtccacccggtactggagcatgcgtgaggcataatcctccggcatctcgtacacccagatgaggggccgcaggcgggtggcgttggcggccggctcgtgggtggcgggggtgtacaccatgtctgcaatccagggtcgctccacctccaggcctggcggcagaggagaggcgggccacgaggggcagcggagtgtccagggagcagtggtgggtgctgggagggggccacggccaaccacccgccagctttggtttgctggcccatccatgccaggcagaacaggggtcgaccccagcagccacccgccccacctggcgagtcctcgacgccctccatgcgatatgcgcagtcgtggccgaaccagcccttgtggcactggcagtaccctatgtagcactccccatggcctgtgggcacggggcaggtggggcgatgggtcgagggatcaaccgggtactggcagtgtctgctcaagcttctgcgcaggcacttggtttcgctcagggggccgcaggcaacacgtgatgcagcgcagagttccccattctactnnnnnnnnnntggtgcaggtgaggcaatgggtcgagggatcaaccgggtactgtcagtgtcggcttatgcttctgcgcaggcatttggtttcgctcagggggccgcaggcaacatgtgatgcagcgcagagttccccattctactctccaaggcagcaggacggggcagagcctcttccccagcggcactccacacaccattgcactgattcacgcaggtgtgctcgtagatcgtctcgcaggtggcacccgagatgccatcctgcatgaaaccatgaccaagggagaggagctcgcagcggtcggtgggtgatggcgccaccttgttaggagaggctctgcccagggctccctgactcccatgggcaacccgcgagtctctatggacaatcagtgcatgttgagagggcaagggtacaccccctgtacaggcgtcgtggtcttcatgcggcctcgggggtccaggcggtgagnnnnnnnnnntctatggacaatcagtgcatgtcgagagggcaagggtacacccctggtacatgcgccgcggtcctcatgcggcctcgggggtccaggcggtgagcgattgggcacggcatgttggtggggactcaatgcgtggtcaccaaaggggccctgaccccattccccgcaccttccctcctcacctgatagcagtcacacctccccgctgggtgctcggcattgcaccagcccgttttatcgttgaacaggaaatcgtagtcgacagtgccccatcggatggggaaaccttccttgtcctggcagggtgcgttgcacacagagttgccaagcaggcgcttgctttccggtgtgccgggtgcaccttccaacccattgctgagaagcaagcatgggtggacggcagaggggcgggnnnnnnnnnntggtgtgccgggtgcaccttccaacccatttctgagaagcaaccatgggtggacggcagaggggcggctgcagcgtccctgcctggcacactcctctgccgcctccaggccatttccagccgcctcaaccagctcacctgctttggctggcaccattgccccatgggccgacccttccggatggggggtgcgcctggcgggatggaatgtgcgatggcaggctgtgaggggtgcatctgagctcctcagccccaccacaggaacggggacgccttgcccagccccatcgctaccctcacacatcaaagccgcatgtgctacctggcgcggacccacctgggagtgaatgttctccaggcgggatgcgaccgtacttggtgttggaggggcagtagcagagcgcgatgtcgtcgtcgcaggtccccgcacacagcgagctgcggccgccggcgatggggtgatattcggtgccctcctccaccctgaactccgtcaggttgaccttggggtccagcctggtgaagccccactgacgggtctcgtgggtgcaggggcggcgctcgcgcgtcaggcagccttccccagtccagcccgctgggcactggcagaagcccttgaaggccacgcacttcccagcatggttgcagtccctcaggcagctcatggtgcccttgaggggggacaccgctggcatgggttgctgctgagcaaaggcctggcacccggaacccatgaggcccccgcacagggcaaccgcctcggatgggctcgacgagtaggtctggaccaggttgctcgccttatgcccctggaatgggtgggtgttggaagaccatgatcccacgagtcaagtgatccctcaacccgacttgcgaccgccgtcacttggcaggaaactcaccaccgcctcccacacggtggacgcatgcgctctggcctcgtccatgcctaggggatacgaccgccacactcccataaatatcactgccgatgctagaagcatgacaatgccgatgagcttgatcctctctatgcggggggcagcccgccccttgtcctccgcggatcccatggccgacgcagccaccaggccgatctctgctcaaacactctcgcagtgcgatgtcatgctgtatccatcaacttcatcgtgctgcgcgctgtatttttcgaccgtgccggagcatgatggcctacttctttgttatgtgctggattctgctcaccggacacctcacccgtcagtcagattccgctgggtggcgtgccaacacccccagcatcgcagctcactgatagcatcgctgagctcacagcgatgacacaggtcatcaataggagcactattcaacagcatcccagataccttggcctgagggccaaaccagatcgtcccaacctgaggatgcacctccgcaggagcaatcccagggtctcgtccctggccattggtctgtgggtgtaaaaacattgcatctagctcagcaaacaggtcacacagtgcaaggggggaagatatcaggcgggcgcgacggtggggcggtaggggatgctgacgtcgggctgatctgacttgaggtactgctcagattgcgcctccagcagcagtgcctggcgggtggagagagcggggttgtcattggggtgcccaagtgagatggagcagcactctggctacacacacacacacacctcatcttcagcgcctcacggtctctggcacctgcctgccaacccaccccctttcccccccttcccctcacctgcagctcctccccgtccatctgctccttctccagcaggatctcagccgtgcggtgcagcactgagatgttgttctggatcaggtccttggccctgcggtacgcccggtccaccaagctctgatgttgtgcgattgggaggggtaggaggggatgggagtgagacatgtgtgatgcgtgggagtgggaagtgggtgttccccaagtctgggaggctcttcatttcatcaagcagcgtgtactggggctgctgcctgggcagttgcgggggtcgctgctgcgcctgctgcaaacccaaaataacatcgtcctgccaggcgagggatccctccgagatacagatgccgctgcggctgcgccagtctgacagggagtggcggggcccacccccttcgacgtctccaaccacccacactctgccccgcaccttgacctccttgtcgatgatatcctgcgtttcacccgagcagttggcgggctgcgccatctgcgcgcccaggaaggacccaccgccggactggctccaggctacctggcccagggagtctgagaagcccatctgctccaccatcatgcgcgcgacgcgcgtgacctgctggaagtcgccgctggcgcccgtggtcacgttgtccgggcccaggatcagctcctccgccacacgaccccccagggccaccgacatttggttctccaggtaggaccggctgtacagcccattctccaggcgctcctcgctgggcgcgaagaaggtcaggccgcccgcgttgccgcgcggcacgatggagatcttgctcaccgcgtcgtactcgggcatcagcgcgcccacctggggaacgttgggaggggggggggggggggggggggggnnnnnnnnnnnnnnnnnnnnnnnnnnnnnnnnnnnnnnnnactggcatgatgtttgcgtagggcagatctacattgtgctcacctgtagccagggctggcgcatcccgcttcatcagccacaggaaacggggaaaccactccaggcaagcagccatgaagcaacgctgcaacaccccactggtctcagtgcactgggcattgnnnnnnnnnntgtttgcgtggggaagatctacactgtgctcacctgtagccagagctggtgcatcccgcttcatcagccacaggaaacggcgaaaccactctaggcaagcagccatgaagcaacgctgcactaccccactggtctcagtgcactgggcattgtgcgcagcccgacagcctcctctcgccttcctcccccctcaccagggcgtggccaccctcgtggtaggccacaaggcgcctcttggactccgacacaacggcgcccttcttctcggggccagccaccaggcgctcgagcgcatccgcgatctcgtcctggggaatggggggaggcacgcggcgggcggggatcgaggggcttggaggagatgcataccacctacacacgccttcacgcctggatgcccacaactgcaacctcagcagagctgtcagtgtgcactgcagcccagaccctattgattggatcccccgaagtagcaaccacaccctattctccaagggcccccccccccnnnnnnnnnnacctattggtttgataccccgaagtagcaagcacaccctattctcccaagacccccccccacacacacacgcattgcaccaaccttgctgatctcgctgagtccccgccgcgctgccaggatggccgcctcattcatcaggttcgccaggtcggcaccggtgaaacctggggcatggacattgcggactgttgatcgagatacctctaggggacggaaacagcacgacaccagctcaacggtcaccctccttctcagcccaggcgcgtcaccaacaatacgaccccacccaccaggcgtccggcgcgcgatcttgtcaaagtcgacgtccttcccaatctgcttgccgcgggagtgcacctgcaggatggcgatccggccagacacgtcgggccggtccacggtcacctggcgatcgaagcggcctgtgtggtgggaggttgaaaagaggcaagggggggggtcctggtgaggccagtccagagcgcctgttgacatctcgacaggtcagccgcagcaccctnnnnnnnnnnagggggggggattcctggggaggccagtccagagcgcctgtcgacatctcgacaggtcagccgcagcaccctcgaccaaggaaataacgcaggatgagcacagtcccaaaaacattcagcacaggcctgggaagatgatggaaaatctgcaaattgcagcagccaattcatcacccctctcttgccccactgagaatgagacaccccacacccagcacccnnnnnnnnnntcgcagcagcccatccatcacccctctcttgccccattgagaatgagacaccccacacccagcaccccatcacacctgggcgcagcagggcggaatccagcacatccggccgattggtggcagccaggacaatgacccctgtgttcccctcgaagccgtccagctccgttagcagttggttgatggtctgctcgcgctcgtcgttgnnnnnnnnnncgtgtttccctcgaagccgtccagctccgtcagcagctggttgatggtctgctcgcgctcgtcgttgccgccgcccatgcctgcaccgcgctggcgcccaaccgcgtcgatctcatcgatgaagatgatgcacggcgccttggccttggccttctcgaacagatcgcgcacgcgcgaggcgcccacacccacgaacagctccacaaactcggaggctgcgcaggagaagaagggggttcccgcctcgcccgccaccgccttggccagcagggtcttgccggtgcctggcggagggggtggcggagggacactgattggtggttgtcaccctgagaccttgagcatgcagtggcagcagcgcccactttctatggacacgtactgacctgtgggaccaggaattcgatcggcaggcagannnnnnnnnnaagggggtggcggagggacactggttggtgattgtcaccctgagacctcgagtatgcagcggcagcagcgcccatttcctatggacacgtgctgatccgtgggaccaggaattcgatcggcaggcagacacacgtctgcccatcgactgccacggcgtcggcaccaccacggcacaaatcccagcacacgaaacaccccaaacaccagaccatgtacacacctgggggcccgaccagcagggcacccttggggatcttggcgcccagcttggtgtacttgtccgggttcttcaggaagtcgaccacctcctgcagctccagcttggagttgtcacaccccgccacatcatcaaacttgaccccggtctccgggatctccgcaaacttggacttggacttgccaaagtccatggggccgcccatgccgccgccaccaaagccgccgcccgcgccgtcgccggagcggcggaagaggaagaacaggccggcgaaggccagcagggggaagagcaggttgcccagcagggacacaaaaccaccctgtggtgagggtgagggtgaggggggcggggtgttcaggctgtggtcgcctggttggaccttgtggtgaacgagcacgctcctcgaaggactcacccccgcaacacattttcagcgcagcacatgaccctttgatgtccccccaccccaacacacacacacacctgctgctcgccctccgacaccgagatgtccaccccattcttggccaggcggtccaccagctccgggtcattcacggcattgaccagcgccctgcgcccatcgatggcggtgagctgcagctgggtgccgtccttggagaagcgcacacgctcgatcttgccagactctacggcgttgatgaagtcggagtagcgccactgcgtgccctccggcaggccctggtcagccttcttgacctcggtgccgtacaggggcggcgcggactgtgcgtcgccaggtgacagggaggtggtggagggcgcggtgccggggcgctccacgttggtcagggtgggcagggggggggtctggtagtccgtcgccgccagggcggggctggcagaggccagcaggctcaccagggcagccgcggccgcggcctgctgtgctgctggccctggtgcctgggggccctgtgggcgtggagtggggggagagactgtcagatgcatgcaccttgcatgccgcgcgggcacatgcggcgtggttgaggccatgccagggcgcgtacacccctcggagctcagggaccgcacacccatctccccgccaatcccgccgtttcacgccatcccgcacccagcccnnnnnnnnnncgaggccatgccagagcgcgtacaccccccggagctccaggaccgcacacccgtctccccgccaaccacgccgtttcacgccatcccgcacccagccctgcgagggattccatcgtacttttgctgcgcggacaatggtcctgaccagcgggcgcccggccctgacgggagcgaagggctgggtcccacggaacctcacccccacgggcgtggtgccgagtactgttaggctctgcatggacaacataatatcgttcacggggttgaaaatgaaattaatatgacatcggtggctggacactgcccctcttgggcgctctgtgaccaggcactccggcggaaggtgtcgatggtgtgagagcgatctagtggaccacttcccgcctcatatttgggtgcggtggatcacgtgagcatggggcaccccggatgccgtgggaaaccatgcctcctgtcacctttaacgattcctgcctgtcgcttccttacaccgcgccggggttcagagtgtgtgggtgacgacctccctgccctccccgcccacccccagcacctgccccgcccaggcggcggccagcagcttcccctcacccgccagcgtgtgcagcgggatgctggcccgcacgtcccacagccgcgccgtgccgtcgtgcgaagcggaggccagcaggtgctcccgcccgccgtgccagcacagcgccgacacccagccggcgtggccgcgcaggcgctgcggcgccacgtcctccccacgctcgcgcgggtcccacagccggagcggcgcctccgcgcccgccaccgccagcgcgccgcccggcccgcccgccgccaccgcgtacaccgccttgcccgtggtcagcgtgtccacgcccgcccccgtctctgcgtcccagatgcgcacgctgtggtcccaggagccgctcgccagccggcctgtgggtggcgcgggtggaaaggaggggggccgggtgcgtggacgctgtgtgtgctttggatggcggcctcggatggaagaggaagggtgagctttggccaggagggcgcacgaggcgcgcaaggctccccgccaggagcgcgctggccacgggtcgactgcggttcccggcccggcctcctctttccgcctgccaccatccccaccccctcccagaagnnnnnnnnnngcgactgcggtcccccgcccggcctcctctttccacctgccaccatccccacccccttccagaagaaacaacacgcaccttcccgcgtccagctcagcgaggacacggcgccggtgtgccccgccagctcggcggcgctggcgtccagcaccggcgcgggtgcggccgcctccgcgccctccgccttgcccacccgccgcttctttgcggccgcgggcgcgggcgcgcccgacgcggccgcctcggccgcgtcggcgctacgccacaggtgcaggccccggtcccagccgccggaggccagcagggcggagtccggggagaaggccagcgccgccacggcgtcggtgtgccccctcaggctgaccagctgccggggggcctccggcacggcacccccaggccccagctcccacacgcccacacagccgtcgtcgccggcggcggccaggcccaggccgcccagcgccagggctttgagcgggcgcgcgctcgccacgaacacggaggcgacgccgccgtcgctgcgcacgcaccgcacggcgccgtcgtagctggcgctgatgaggccctgggcaccgccgaccagggatccgatcctgggtgatgagaggaggggtgggtgtggttgagcaaggggtctggaagcgccgggcgtgaggagcacgccgccgggggcggcttgggtgtgctcggggacgcctgcacaccgcaggctggaggtaaggagagcagttggcctacccataacccctgcgcaccagtcgtcgtggggggtgcgggggccggggctgggcggcagctgcaggnnnnnnnnnnctccgatcctgggtggtgagaggaggggtgggtgtggtcaagcaaggggtctggaagcactgggcgtgaggagcacgccgccgggggcggctcggaagtgcgcgggggcaccggcacaccgcaggctggaggcaaggagagcagttggcctacccataccccctgcgcaccagtcgtcgtggggggtccgggggccggggctgggcggcagctgcagggggatgtactcgatctcagtgaccacctcggccgaggctccgcgggcagacaggtgctcctgcagcgtccccctcagcagctcgtggttgatcaggaagtcaaagggcttggccatctctgtggtgggtccgtgctcaagaggtgtctcatgaacccaggtttcatgtgcaagccgcatgacccatggtatagcccaagggtggtcctggagcaccctgattgcccctctgtcgagcagtgttacccactcatcccgacatcctcgagcatcgattcttcgtccatcagacgcagtgcggaaccctgtacaactcacccaggtccagcaagtggttgatgatttgcgacaggccataccgggtgaggttggctggcacggtctgaggggacaggcaggacagatgcaggtgagaagaggcgcgtgcatggtaacttcacaataatatatgcgcttctcacccagcctcctcaccagggcagcttcaggtacccgcagctccttcgggagcttcgtgacgaacttgcatgttagctgtgcaccctcgtccgccacctcggaagcgtccaccatgatgtatggaaggtgcagtatacacaaaagaaatggtaatgacctgtaataggttatgtcccgatgcattgagagagggaagcggtgtaaagtgccgaccgccccgtgacgtggcattgcgcgcgctaaattgagagcccctgtgtacggtgtacctgggcccaacgcttgatcacaggcaaagacaatcattcgcaataccgctgcattgtgcgtactctgcgattctgatccccgcttaggccccgcctgccgggcgatccttcaactctgagagtgactgcaccaccgctcacaagcgaggtagaatcacgatttgatcgccaatacagggacctcattgcctacaagcaatgccttcggacgcccaggaacgtattgcgcgtctcgaaaggacatgggaatccctgtgcgggcgtctggccgctctggagatggccacggggctgcccgctccccctgccatgcagccatcccccctagcagcctgcatgcgtcctgaggacaccaccccagccgaacacatgggagagggcgcctcccccactcagctgcgcctggcgcaggagttgctgttgcgcggggtgacccgctttgccttccagcgagtgcccgagccctactactcctggccgctggagggcagacggcaagcgctgggtgcagcgagtgtctaccacctgtgagtgattggagatggttgtaggacttgggatttgattgcatgggggtctggcgctttgttggcagcacgatgagcacacctccatccatcattgcttgctctcccccaggtgcaagagtatggtgatggtaaataccaaggcccatgccagcgtgacagactgctccgaccccctgaaccccaagtactacatgatcatcgtccaggcaagcagcttgggtgaatgggaattgtcttggtgcttgtctaggaacttgaatggagatgtcgggcgctccactgttgtcgagaccctggcagcacgcatcggccagagcgccttgcagttcattcctcaacaggccacccactgctaatcctctccgcttgcagtatgctgcgcgactgaatgcagagannnnnnnnnnccaggccacccaatgctagtcctctccgcctgcagtatgctgcgcgactgaatgcagagaagctcaaggcgtgggcacatgcgctcaagaacagcgagatccccaaaaagtaggctggcgtgtgatgtgtaggctccagggactcgggattactatatgaagaatccagttactgtccaaatcctatccctcatcaactgatgacggcaaagggtcccgcacgatacttacccgagtggtataacaacatcccatgcaggtattacaacctgcgccttgcacccgaagaagattctggacggctgacggggttcatccacaacgccgtcacgcccatcgggtccctcgcccaaataccaacagttttgtcgcacaggtcggggagggcgagcgggtcccctgatatgttgttcccaaacaatgcattgtacactgacactggcagttgtgcaaccatgttgttcctgcctgtggccaatgccactccaaaaatactgaaggctcctacacatgaatgcctgcaggatcgcggccctcccggaggataccttcttctggnnnnnnnnnntgccgtcacgcccatcgggtccctcacccaaataccaacagttttgtcgcacaggtgggggagggcgagcgggtcccctgatgtgttgtgcgcaaccaatgcattgtacaccgacactggccgttgtgtgaccatgttgttcctgcccgtggccaatgccacttcaaaaatcctggaggctcctacacatgaatgcctgcaggattgcggccctcccggaggataccttcttctggctaggagcaggagaagtggatctcaaagtgggcctcttcgtcaaagactttgtgcgtgcctatggcgcacatgtggtggactgcacctacgatgaggtgcctgaggacctccagagcatctcggactgaggtctggatgatggcagtggcacggtttgcttgagtggaatcagtttgtgctcgtcatattcggcagtgctggcctggggaactcccggatgaggtccccttcacacatgaaagatggtgccgaccatacagagcacccctgaaaatggccacgtgagccaatcctcatnnnnnnnnnngtcggcagtgctggcctgggaaactcccggatgaaccccccttcaaacatgaaagatggtgcccgaccatacagagcacctctgaaaatggccacgtgagccaatcctcatgcgagggacgattccggtaacgaccattaggctcgaccagcgagtccctcttgggtcagttgtgactcacgaaatcatcttcaggaatgtaatgcgagtcatgggacttactggacgctggaggcgtcgcgcagtgccgatccagtgagcatcgggattcccaccccgtcatgtgccccaccatgactggctggagggccacgtccccgcatgcgggaccggcgttcacctccagggcctggcacagggcgctggtaccctccagacacggcgcatgcctgccccggtgcagcagcgtgcacaccttccagtcccccggcagcccggtgtgggggtccgaggggcagcccggcccgggctgcaccacacgcatgctgaccagcatcggcatgtctcgccgggaggcccagcgcatggaggccctgtacccggcccaggaccagacggaggccatcctgaccctgctggcggacgggccgcgggtgccggtgcgcgttctgcccgaggtgctgctggcctgcccagacatcctggccctcacccccaaggcccttgaggagcaggtgcgggtggtgcggggtgtgtgggaagcagtgcctggtggacacaaagccactctcaggagagggcttgacgcaggcccagatgcacggctggccatgccgggaccaatgggcgtggccaggtcctcgaccaccccccgccccccccgatccaacgcttcaccgcctccagccacacccctccccgttccctctacagatcgactggctgcgcggcatctggaccacgggccacgggctgagcacggcggtgcaggtggcccccgacctcctcctcccctccttccccgaggtctgggcggcgcgccaggccgcgctggagccgctgggcttcacccccgcgcaggcggaggccatgctgcgcgcctgccctacgctcttcaccgcgcccgcggacgaggacgcggttcgcgacgcgctgctgggcgctggcgtgcccgaaggggacctggggtcgctgccgccggccttcctggccgcgctgtcccgctcgcccgcctgcctgcaggcgcagggcgccatggccctacgcgcgcagctggcgcgcctggcggcctggggcgtgccgcacgccgccgcgcgcgaggtgctgggcgcctgccccgccctgctctccaccccgcccgccacgctggccgcagcggtggcggcgctggagcgcgcggggctgggtgggcccgcgctggcgcgggtgatcgccggctggccggccgtgttgcgcgccaaccccaacaccatcaacctcacgctgtccctgctgcgcttctgcgccgtgcccctggccaaggtggtggagtcgcccatcgtcttcaagccagaccccatggccactaccgggccgcggctgagctacctggccacctgcaacccgcaggggtgagggtgtgcttttgtgtgtgcaggggggggggggaggaatatcgagggacactgggcatctaggtgcggacgcagtgccacgcccaggactttgcaccatggggccgcttgccgatgcatgctctaagaaggagaggaggggtggtgtcagcagctaggtaacccttggcctagtaggagtacacactgattggacactcccattcttacgcgcctctccctcccacaccaacaacactcgtaggttggagaggtacaagctgannnnnnnnnnctgtgtgtgcagagggtgggggggggaggaatgtcgagggacagcctctgggtgcggacgcagcgccatgcccaggactttgcaccatggggccgctcgccgatgcatgctctaagaaggagagggggggtggtgtcaacaactgggcaaccccttggcctaggaggagtacacactgatcggatactcccattcatacgcgcctctccctcccacaccaaccacactcgtaggttggagaggtacaagctgagcagcattgtgaccacctcggacgaggagtttgcgcggcgcaggacctcccagcccgtggacgagtacaggtgcgcacggtggtccatcaggggtgacatcctcgcattctgttccctacctcatgcgcaccgtcgctcctgcccccgcccagccatcacttcgcacagccttaaccatacacacaccctgcctacctgacctcactccttcacctgcccctgacattatccacacccactggcttacaatacaacagggtgttcaaggagaggtggctgcgcctgacctggcagaagctgatggagcgggcggggaagggcgacgcgcaggtcccgcccgacggcgagtcactggcgcgcgccatccggcgccaactcctcgccctgccccagaaggctgaagagccccgcgaggcgccatgacggcccattgaagcaaggatgactcatggggggtccctcgccgcgtcgcccgcagcaggaaccccacctcccagggcgccgccgccagccccgcccccgcaaccccaaagtcacagcctctggtggtgcacccaggagttgaagaggtgcagcgcgcgctcgggctgggtgtatggcaccatgtggcccgccccgcgcaccgtggcgaaggtcagcccgtgcgagtagcgcaccgtccagccgccgacctggcggctagcgctggtccaggcccgccatggctccgccacctccagggccaggccgtggatccaggcgcgggtgccggtcacgggcacgatggcgtcgacatcgcctgtgcatggagaggaggagagctcttgcagttagggagggcggtgcgtggaatgctggcaggaccctgcacctgcctgtgagggggcaggcgcccatgccccgttggatcgaggagtggccccaggcagggtgcacattcccgtgcaccattttcattgccatcccatgttgaattgtcagttgctgtcatggggggaccccagggacgaccagggccctcctcagtgccgtcgatcaagcgaagtgtgagcagcatgtacttgagagttaggcagggcgacagggactccataacccagcccggccatctcccggaaaactcctctcagctcaccgctgtacacaaggagctccaggtctgcttctaggaggtggtgccagacagggagcatggagctcagcaggtcctccctggtgaatggaaagggagggactgggggtggatgaggcaggcatctgatgcagcggagacgcgctggcgccagaagcgttgggttccgaagccataccaatgagcagcccgctcccactcagcccagcgccgctgcagctgtctgggccctccctctcctggtgaccctcccgcctcttccctggcaccctcccggcagcccacctcgagtactggatttcgtgcgtgcagccggtccagcggttgggcgccaggcccggcacaacgtggagggcgcgctgcacatcctccctgttcaggtaggtttccacctcgttgtcgatacctgtgagggcagagggtgcaaattatgtggtggatgggggggtgctgagatctgagcacattgcccgctgagatgtgtgcagaccgcggcctccagataaataatttgaaggagttgtcagactccacctctacgcgccacgcctcctctctccccggctcctctcactcacatgggtcgtacttgttcttcagcaccgcggcagccgtggacaggcccagggggtgcccctcaagcgcccggccaagcgccagcgcggggttggaggcgtcgggcgacaggcacacgtccgcaaagatgtcgtagatgttgatgcccctgatctggtccagggccaggctcacgaacttgtcacacttgggggtgttgacggcggtggcgttgagggtgggggcggattcctatgggcagggtgggtgggtgggtgggtgtgggtccaatagggtacagaggcagaggtgacaggatgaaatagacgatgcaggcaatgcattcgaccactttcaaggtgactcggaccatctgaacctctcctctctaccccacttccacccaacccctacccatcacacccatcacacccacacacaacccacctgttgcaggggcccgacactcccaaagtcgcagtacttcttgatgcccttgtaggcggtgaaggagatgaggccgtggctgaaccaaaactccagggcaccgtggttgtccagctgggcatccgtccaggcgttacccaccagcaggcccttgaggttgatggggggggcatcggcgccttcattgcccctgaggatctccagcgccagggtcgggacgtagtggcctgcgggtggttggaagtgtgggtggcgagggctgtgccaggcaccctgaatgcctaggtcatgaactttgggacagtggaatgctcgtaagcaggtctggtcttccaagacatcctccattcccacagaccaaccatcccgggacttacgcaccagcataactctcgcccgacagccagaacttgtgggagcggtagtgggggaagcggtcgaaccagcgcagcaggaactcgtggttgtcctccgccgtcctcttgtcgcctgggaatgttggacaagtaaatggagagagcgcctcacatcaacatggtcaacccccccccctccccgggggtgctgcttcaacagccacagcatgacaatcccagccagtcacacccattcaatccaatggagctgaacaacaaggctttctcacggtttcatcaccccatcacctcccccaaaacacaagactcaccgacgtcccggtcggcggtggtgttggagtaggaaaagnnnnnnnnnntcgaggctttctcatgatttcctcaccccatcaccccccccaaacacaagactcaccgacgtcacggtcggcggtggtgttggagtaggaaaagccgacgaaggcgggggcctccacaaagaggacgttggccttggtattccaggaatagtcgttggcctgtaggttgccgcgcgtggtagggaagaagggccccagctccgacatgaagcctcccgccagcgaggagcagcccggacccctgccatcccgggtggcccagtggaggagcgctgcggcttggacaccaggcacacctggacggacatgcaccagatgccacgggtgcagaagttgacccaggtttcaccccacacccacctacccattcagccagagcaccagcgggtcggcggcagggtcgtcctgggactccacaaacacatagaagaggctgcggccagcctctgcgtccaccgtgatgtacctgcgaacggcaaggggaacgcatgtgagatcaagtgtgcttcaacaccgcctggaaggtgagcgctgctggcaaatggtccggatccaccatgggtcgacaggctgtggcttggggtggggccatcatgcggaggaccctgcgcccacctcacccggagtagatgtcgaactcatcatcctgcaggtttccccatccagggagactagacaccttatcagcagcggcctccttggtgagatgattcttcgtggcgcgtgatcgcaggaaaaacggagcatctccggaactgatcccctggacacacgaggcgagagcacagaccgcaagggccacccacaatttgtgcatcttgccacaagccttcagagtattgtgaggggtggatcgtgcgaccctgtgcctcgcaccgatgtaatggatgtgtggactggcaaatcgcgtcgtccagggtttctccatttcccatgtctcctgcatcactgatccaaaatcttgtgcaaggcctccggccagtgagcgatttgcaacagagcgaggaagaggagtatgatgcagcagcgtaggtggcnnnnnnnnnntgccagtgagcgatttgcaacagagcgaggtagaggagtatgatgcagcagcgtaggtggctctcctttcagcactccttgtcatcgcttgtccttcttgtgtttcttatccttcttgtccttcttgtccgacttgtccttcttgtgcttcttatcccgcttgccatgctgcaagggtacagggtgggtgaatgagaaattgcaaagtcatcattgcttcaatcgccagcccacgccattcaattcaggaaatgcccaggtctcggcctnnnnnnnnnnttgagaaattgcaaattcatcattgcttcaatcgctagcccacgccagtcaattcaggaaatgcccaggtctcggcctgcctaccttgcccccaagccgttccaacaccgccagtgcgtcttctatactggatatgccgccgccttcccttggtgtggatgtggatggcgcacttccagggaccttgctctctcctgtcatccaggcggggaggacgttgcccctacctcgtcccctgcaaagtgagggcatcgggaggaggtagaagtcgggtgaagcacagcatgcccagcagcgaccgggcgacccatggatgcacacatcgacgtctgcacagtgttgtgccgattggagatagcgatggcactgtcccgagtattgctgctgcggcgccgcatgtgagacgtgtctctgaattgggctcgacgccatggctcgagcgagggtcccagccggtcgaccggggcggtcccgctccacgaaggccggtgcgcccaccacctccccgctggactggctggatgactacgaagctgtcagcgcctggatggcgcggcatgacctgcataccgcgctggaggctggggacgggctcgcctgggtccccgacttcctgcccggtgcagtggctgaggctgcgctggcctgcctggaggccattcccccctccgcctggaacgccacggcggctgccgaggacgcaggcgccaacaatattgcccacgagttctggtccaccaagtcggcgccggggacggccctggcccagctcctgcgcgccttccccctgctctccccgcgccacgacttcaccaccttttccgccgcccgctacgacgcccgccaccacatcgcgccgcacgacgaccgagcctacacccccgtgctctgcgacgatggtgggtggaggcatgggttggggttgagtgtcggtggcacaagggtgaggtagggcagggatagtccaggcaggcaccggccgtctgctgtccagcacgcacttcctgcacctgctacactccccaaatgcacccccaaaacacacaaaacacgcctccaggggcaatcgtnnnnnnnnnntcagcgcgcacctcctgcacctgctacactcccaaaatgcaccccaaacgcacacaaaacacgcctccaggggcaatcgtgcagtgctcgcgcgacatcgcggtcgtgtactaccttacccgcgactggaggccggagttcggcggcgcctttgtggacatcgccggcggcggcagggagtactgccccgccttcaacacggcggtcgccttcaccatcccgcgctggcacgcggtgacggcggtggtggggcccaggccgcgcttctccgtcttcggctggttcctggtgcccgggatcgcctaccccctgggggacggcgagcgcgatgcagcggcgggcaaggggccggcccccgagcggtggttggaggagggcgaggtgggccgtttgccgcagcgctgcaagctaggccggcggcttctccgactggagtcccgtgggctgagctagccggctgcccacggcacggctgagtcgggccggcgcccagctgctggttgctggcatggactttccagcggaaggcccgaggcatggagcgcggccgccgtggcagctggaggtacgccaccccttgcgcatgccagcgctgagnnnnnnnnnntggaaggcccgaggcatggatcgcggccgccatggcagctggaggcacgccaccccttgcgcatgccagcgctgagcccgccactcgccacctccacccactccagtatccccccctccttccttcggcctcccccccaacccctgcatcaactgcgcacctgggcgccaaggcagctgctccgttgctcccgctgcccggagccacaggtccatcttggccagcccgcgccgggcccgccgccgaggccctcactcccgcgccgcgcggcagaggcctctcctcctcgcggaccatgtcgtagcgcttgtcctgcccgccgtactgcaccacgtctgcccccaggtggccccagtccaccacagcgtcgtgcgtcgtcgccgcggccgccccgatgggggcctttccctggggaatgcagcggagggaagggcacctgaggtgcagcactgtctcgcccacacaccagatggagagggggaggggagagcacactgtggagcgctgtgcaccccccaggcatgcagctgaggctccccgtcctgccctgccttgctgctgcaccagcgcatgttataagcccacaccatgccaggtcaggccacaggggctgggcagctcgcggggcgggcgggaacggagagataccccgcacccgggcagggcgacacttgaaaagagagggtcgtccgcgccccgccctgccctcaagctcagcatgccatccctgctccctgtggcgacgagccaccccccatcaccgccccccccnnnnnnnnnntgcagggcgacactcgaaaagagagggtcgtccacgccccgccctgccctcaaggtcagcacgccatccccgctccctgtggcgacgagcaaccccccattacccccccccccaagttcccactcagcaccgcacacctgcatgggcccgcccccggcgcccctaggcttgtacttgaggccgttggggtccaggtcggtgccgtcccgctgggagacgagcttgatgctggcggagacgcggggtccacgctcgtcctcgcccacctccacgatcttgacccacacggcctcgcccacggccagcacctcgcccatctccctgaccttgtcctcatcggtgtcctcctttccgaagaacaggtggtcgctgatctgcgggggtgcaggacgtggtgctgggacagggggttggtcggaagtgagtggcagcggtgctgggccggccaggttcgccctccagaagcatgggtggagtggtgccctgcgcctcttgcctcggcnnnnnnnnnnttagggtcgccctccagaagcatggggggagtggtgccctgcgcctcttgcctcggcacgcgccaccctggggtgctgacttgtggaccccgcccccaacacagcatctgcttcggctcctgaacactcccctcccggctcggcaccgtgccaccctccatgaccagagagccccactccaaccccctgggctacccgcctcgcctgggaggagtggacgagggcgtacttgcggaacccctccagctgcacaaacacgccaaaggggcggatggactgcaccgtgccgcggtggacgctgtccagctcggggggcaggtcgctttgcggcgcgcccccctgcccgccaccgccggtgccgccgccgccggggacggagagcaggcgtccctcggggtccaggtccgtgccgtcctcctgggacaccgcccgcgtgctgcaggacagccgggtctggccggggccgggtccgggcgcgtgcgcctggaccttgacccagacccgctcgcccggcgggaggaagaactccatggcgtgcacgcgcgctgcatcgtcgtcctcgcgtgtgaagcgcacgtcctccgccacctgggtatggtgcaccagaccctgccgtcggaagccgtccagctccacaaaggcgccaaaggggcgcaccgacaccacccgggcatggtggatgctggagacgggggggagttcctcgtgctggggcaagccgggaccgccgcggccctggtgccgaccgtaggctcggtctgagggagggtaggggagcatggttgaggtgctgaaggggaggggagggcacagcccgcaatcagaggcagggacattctacagccaacgtggcccgttgagcctcgtgatccggcgacaatatgatcgtatcgactagcactgtagaataacacccacaatctatcgacctggactgggagagcggcggtagcgtcgccttggggggcttatggaccgggcaggtctggagcgaggcggactcctggagcggggacgtcgctctctgcgccgatccctgctcctgctacgagatcttctcctctgattccttggagagtctggtgatcgcctgccccgctcagcatctcgccggctatctcgccggggagactgactcctgctcctgctccgcctcttcgcccctccatcccaacgctcaggagagggcgatcgaggagccatcgcacaaatcaatattgtagcatcccgattcacatgcagtggacatgcatgcgcacatgtctctttcaagtgaattcacaagctgccggcagtgccacgctggcaagccccgagatcacttctgttgtagctccccaagcatgcaattacatcggacccatcacctggccagcaatcattgtgcgaacttccaagatgtatgggtgccttgcggattagagggttggatacccaatctcgcacatgttggaccagcttctggctcgacagacggcgacgtgcgcgcatgaggtggggctggctggtggctgcgagcagggcttgaccatgtgcataggatgatgacagaatcacatcgctgcggtcggctaggagcaagctgcgggggcatccgctcacctnnnnnnnnnncgaggtggggctggctggtggctgagagcagggcttgaccatgtgcatatgatgttgataggatcacatcgctgcggtcggctgggagcaagctgcgggggcatccgctcacctnnnnnnnnnnttgatttagtccttcccccatgacagctgctgctcctgaccctggaagtgggtacctcggcgctggcccccctcacaacccccactcccnnnnnnnnnnccctgcagggccacctctcagccagcgtgctccaggaggccatccacctggtggatgtgcgccaagaggaggtgcgggtcgcaattgaagccaggatccagctgatttgtccttcgatggctttgtggggtggcctgtgagactgatttcgtccttccccgatgactgctgctgctcctgaccctggaaatgggtacctcagcgctggcccccctcacaacccccactccctccctctcaaaatcaggtgctggtgacactgtttgctggcgtggcggagcggtatgcatcgccctcagaggactggcccccgcccgccgaggaggctgcgcactgcgaaactttggcgtccatcccgccgggcgctgacgccgccctgggcgacctcgttgcccaggcccaggccctggccggcctgtgttgcaccacgcatgccgtgcagagcaggctggaggccctgcgggcggccgccgcggccgcatccaggctggccgacttcgacgctgcgcggtcggccgcccggctagaggccgcggccgacctggcgctgggcttcgacgccggctcggacttcctggacgaggccatgctgcgcacgctgcgcgcccggcgccaggacctgcacctccacctgctgcgggaggcggcagccgccgcggcagagccggggcccgccggctcaggcgtgtgggccgcgctgcgcacgctgggcctggtgccggaggccgtgcgcggcgctgcggccgcctttgcggaggcgcgcattcccgcggccctcggcgagggcctggccgccggcacgggcgcgggcgagggcccgccgtccggccccgtccgccgctccgcannnnnnnnnnacgcattcccgcagccctcggcgagggcctggccgccggcacgagtgcgggcgagggaccgccgtccggccccgtccgccgctccgcacgcctgctatcccccgcgcctagctcaacatcctcctgcgcgagcgggctcggcgcggggnnnnnnnnnngtcccccgcgcccagctcgacgtcctcctgcgcgagcgggctcggcgcggggcccagtgtggagagggccctctactccgccctgaagacgctctgccgggaggtcagccgatgagggctttgagatgatgggggattgggtcttgtcctgaaatgctgttcccctggcaagcggccacggatggatgcggagcgggacttgcattgcacgnnnnnnnnnnccccctgctgccaacccctgattgcgctgaggcagaggtgtgcagagggggttgcacatgggtggtgctcttggggaataccacacgactagccaacgtcatgacctcagggtcattgggnnnnnnnnnnttcctgggatgctgttcccctggcaagcggccacagcatggatgcggagcgggacttgcattgcacgtgcgattcctgggcagatcctctgccctcatgcccaccaccacgaaacacgcagacgatggaaggggatgccgagctggtggctgccctgggagagagcctgtggcctcagcttgcagaggcctacatccaggcctgcctcaggcccctgctgccaacccctgattgtgctgaggcagaggtgtgcaggaggggttgcacatgggtggtgctcttgggggataccacacgaccagccaacgtcatgacctcagggtcattgggacacacctgctgcttgctgatgcattgtggcatgcctgcatcccttgtcgattcgcatggcgatgtgctggggatcctctgaggtcttgaacccccctgcatccctctttctaccaggacctggcctcgtttgggcgggccgcgggaaggggcagcaagctggaggccaaggcgcgcacgctgggcctgctgggcccagatacggcgtcagaggggcccatcgctgcgtacatccgcgaggccatggcgcagtatgccctcagcagccgggccaggtggagtggtggggagggattgcatggaggagtgataggggttacagagcccaggagctgggggagggggggggggatgatatcttccacccatataccaatctcgccagccaaaatccaccctcatcaggctggtggaggcctcggcggcgtgcctggcgtcctgggactcgcgcgacacgcgcctggtcagcctggcgcggcccgggtcggaggacggcgcgccgccgccggcagaccagcccagcctcctggtcagcgcggcaacggcgcggctgctggcgctggcgcgtgccgcgctggcctccgcctgtgaggccgggtcgcccgtcttggcccaggccgtggcggcgggggtggtggaggtggcggcgctgatcgccgagtttcggccgctcgaaggcgctgaccagctgctgctgccctggccggcggcgctgcggcacaacgactgccaggcggcctaccagctgctggcggggctgccgcacgacctcgcgccgcggctgcaggcactggtgcaccgagcggtgaactttgccaatccgggcgcgcgcgtgcggcgtgcagggtccgacgcactggcggccatgctggccgcgcagcgcgccgagctgtgcgcgctggcggccgacgccggcgtgggcgtggg

SEQ ID NO: 39996 - DNA, 93 bp, Chlorella protothecoides
ttggttctgacacgttcgacgagtgccgggctggggctcccccttgccttctgaattcgcagacccttcttcgataaagggggcactgccata

SEQ ID NO: 39997 - DNA, 64 bp, Chlorella protothecoides
gcgcctcctcgtcgtaccctggtgtgtgtgggtgggggggggatgcggggttgcatgaagacaa

SEQ ID NO: 39998 - DNA, 70 bp, Chlorella protothecoides
accgctgagagagcgacacgaaaggagcacacctgccacggtggagggcggcaggtctgtgaggacgacg

SEQ ID NO: 39999 - DNA, 78 bp, Chlorella protothecoides
ggccggtcacggcggacatttttgtttgttaaccgtccactcgattcgaatgagagggtgaggatggagctggaggcc

SEQ ID NO: 40000 - DNA, 2392 bp, Chlorella protothecoides
  modified_base (623)..(632): a, c, t, g, unknown or other
  modified_base (784)..(793): a, c, t, g, unknown or other
  modified_base (1513)..(1522): a, c, t, g, unknown or other
cccctcatcatccccccttccctcacttgcgggggttgacgatgttggggtactccagcgtcagctcctgggtgccaaacaggatgttgtccacggactccacgcccagcatcagggagtggtcctggttggccacctcgtacttgtaggagccaaagcggccgcgcgaccagatgcccgcggccttgagctcgggcagcgcctgcttcagcaccgcgtcgcggcccaccgagggcgtggggtacccgtgctccagcctggcagtggatgggagcgcgccgtgtgcgagaggatgtgtggtcggcaggagacccgtgacgagccagcagagggctgcagcggcggtcgggtgcagcgccgccttccatctgtggggagcatgggcgctgctccctgcctgccacacaccataccccccccaaacacacccacctgcggtggtagatggagacaatctcagagccggcctccaccagcttggtgttgatggcgccgatcaaggtctcgcgcacgatctcgggccaggtgcctgcggcggggtgggcggggagggtgggctcgggtgggagggccattgagtggggcgtggagtccgctcacagtcagcagccgtcaccgcatgnnnnnnnnnngcattgagtggggcgtggggtcccgctcacagtcagcagccgtcaccgcatgcactgcggtcgtcgaagggggttgctagaccgcccctccctgccctgcaggctcagccaactgcccatcctccatcgcacacactcctcaagtgcacagnnnnnnnnnnttcgaagggggttgccagactgcccctccctgccctgcaggctcagccaaatgcccattctccatcgcacacactcctcaagtgcacaggggacaggaggcgagctgctgcgaggcagactgagtaccgagaggatcacccaagacctccccttgtcacggggatctctccccccctttcacacccacgccccctccccacacctgcgctgccgcccagcttggtgtccttcatgctgacgggcttgtactgggactcgctgatctcgaacatgagcgaccagtagggcccctcggcggcctcgcccgaggcagggtcctcgccgttggccaggcacagcgtgggcagcttggaaccgccctccgggcagttcttggccgcgtagtgggagaagacggtggtgcggtagaaagggcagtcgtcctcggggaaatagagccagcacttgaggccgtgggggcacttgccgcggatgcctgcggagcagatttgggttcggagcgagtgtgggatgatggacggggggacgcagcagcggcccccacgcctgattgcggggcggcctccccaggggagcaggattcctcgtgccgaggttggcacctcatggacacatgctgggttccccccttgcagaggattgctccagtgacgggggacgcctcccacacacctgcccatgcctgcgggctccttccacccctccaaagcccccccccnnnnnnnnnngcgaggttggcacctcatggacacatgcttgggcccccccctgcagaggattgctccagtgacggggaggcttctcacacacctgcccatgcctgcggcccccttccacccctccaaaggccccccccccacacacacagaatcagagacacaagcacgcccactcaccgatgcccacgatgtgggtggaggagtactgcaggcccttggccaggtcatcgcggcccagccagcccagggagatgtccagcgggatggtgctgatcagcgtgtcgtaggccagcttgcgcccgtcccggaaggtcaccgtcttggccgccttgtcgatgctggtcacggtctgggcgggaccgtagcgttgacgctccgcgggcaggagcgcggccacggccttccagatgccgcccgtgccgccctcggtggggaagcggaagacggcgttgggcccccaccccgcgtcctccttgttgtggatgacgttgttgatggcgcgctccacgtccaccgtggccacacgctcacccagccactcgcactgcatgagcgtggtgggcaccgcccagaccttgaagttgtaggggcgcatgaacaggtcggcgatgccggggcccatgacgcgcaggatccactcgtcgaagttggcgggcttgccctgggccaccgcgttggccaccttggcctccacgcagccagccaggcaccggatctggtcctccttgtccagggcggagatgttgttctggaaggggtaggccacccaccggttcttcagccagacgtaggacacgcgctccagtgtgttccaggcgtccttgccgctgcccacagctgggagaggggtggggggaaggcgggtgtgtgtgtgggggg

SEQ ID NO: 40001 - DNA, 80 bp, Chlorella protothecoides
agcaggagcatggcgtctgtgctcggaggggtgcccggcacggtgcataaaaattatgttcttcagggagccaaaggcac

SEQ ID NO: 40002 - DNA, 7027 bp, Chlorella protothecoides
  modified_base (422)..(431): a, c, t, g, unknown or other
  modified_base (3947)..(3956): a, c, t, g, unknown or other
ccccccaagcccccccagcccccctctccacacctgacagccagaagttgtaaccgatgcagcccaggaagaagggaatgccggcgtagagcatgaggcgaggcgtggtcttggccacgccctcccagcccaggcgcgcgaagagggtgggcgacaggagcatgagcgaccccgtcacgatgccggtccacatggcggtgtctcccaggatggcagagtaggccgcgggagtggtggccaggcggtgcaggtggtgcttccatgccaggtccaggaggttcgaggtgatgccctgggacgggtgggaaggggggtgggatgagggtgggggacgagaaaaggggcgtcggaggctggacatacgtgggaggactgatgggtggggtttgtgggagtgggcatggcagatccaggccccacgnnnnnnnnnncgtgggaaggagggtgggacgagggtgggggacgagggaaggggcttcggaggctggacatgcgtgggaggactgatgggtgtggggtttgtaggagtgggcatggcagatccaggccccacgatcagggcatgaggcggagatggcgtgccgaggggagtcttgcaatggtacagcatctccccgtcagacccacccatttccttccctcctcaaccccagcccatgcaatcaatcttacgccctgcccactctctcgcgcggtccccgcccccccttttcccccctccctcgaatacacacacctggctgatggccaagagggccaggcaccggatctgcggcgactggcgcaggaagtgccaggcctggcccagcgacatggccgccggcgagccgccccctgcccccgcgccgccctcctcgtccgaggacgagtcgcccggggcggggtcttcgaaggtggcgacagcgcgcgcccccgccggcggcggcggcgcgtggctggccctgaaccgcgccgcgatccagctctgcagcgccatgatggccaggcacaggccgcagcacagccccagcatggcctgcagccgggccgcgtagccggcacgcgcgcgcgccgcgccggagaaggccaggcgcatcgtgcgccccgccagcgtctgcgcgatgttggccccgatgccgaacagcgggtataggacgggggcttcggccatggaggtagtctcgttggccaggccccagaagagcaggctgaggcagacgtcgccccacagctccgaggcgcagtagaagagggtgaacatccagttgcgcagcatgcccacgccgcccgccagccccagcgggagccgggggccgagccaggcggccagcgggccgaggtgcagggattcgtggaccgggtagaacagcgcaaacctgggaggcgggaggggtttgcggggggcggtggtgtgtgtgtgtggcggggggcggagcggcggaggagcggaggcggtggagccgtgcatgcgtgcgagacagagaggcatctggatctgagcaggcgcaggggtaggcagctgaggcggggggggggcgtcatgcgagggcggggtccaggcagcaccagggcggcggcggcgagcccataaccgctgtgagctcccaggatcccagaaaactggctcgtacccacccgcccaggaagcagaggaagcaggagatggtgatgttgaacaggtggcggcgcgccagtcgctgggtgccccacgaaaaggcgaggaggaaggcaaaggaggccggcagcacgccatagactgggaagggtttgggtggggagaaaccgtggggctggctgctcgcagggtgctgatgcagtgcgcatgccatgcaggccgggggcccagggccatggcgactcgtgctgaccgctcggagccccacctcagcctcgaccacgccccgcgtcgccacccacctgtgatgaaggggatgacctgtgtccccccgccgaccgcggtgatgaccaatgtgtccttcagcgtgtccatcacggtgttgacaaaggccatgaggaagaagagggtggccatgggtaggaacctggcgggagtgggggaggaggggcagtcagatccaacttccagggcggcgcacctgtgacaatggagcagcgagtcggtctgtgccgatccaccggcgggcgccgagctgcaggtcgaaatgcgaagggctcctctgcttcgtgatctgccacccccagactcacttcctccacaggctcaggagcttgggccgggcaggtgcaggagcgcggccgctctcaggcggcagcgcaccattggaggcaccctgactcgatgcagccggggtcgcaggccgggccggccggccaccagcgctgccggggcctgtgcagaggcgccagggcgcactccttgcattttgaggcagcctcgagtcaagccaggtgcctgggcctcggaggggcttgctgctgctgaacggtcccgatgtgcatcgcggcactgtggccgcgcggcggcccagcgcacacggcctgaccctgtggttgattgggaggcacaggattcagcttctacctgctacgcccctccttggggtcccctggtctgcattgccatgcagaaaccctacagcaggatgggacaggcacaggcggccgagacacagcagctgacatggtacctgagcaggctcgggcccgtcgtgagagcggatgatgccatgatattcgtcacaacaattcctccatttcagcgaggttgtgagcccagtgagggctgtgcccgcggagggagctcgggtgtcaggtgtgagtggcctggccgacagcctggaggcgaggagcagaaagtgggtgcatgcgttggcagccaatgtcctcttcgtccagaccccgctcacgtcaaaggaggagctgctgtacaccgcgaactgccctcctctccagtgtggaggcatggtgagttcgagcgcggtggggtgggatgcgaggccctggctttgctgagctggcgcctcggcagagcgagtggaggggtggtgaggatctgcgtttcatagcgtcactgagggattctgcatctaagacacaacatttaacccgcagacaggcatctaggaggacctgctgcgtgtggatgccaggcgcatcccggcgggatgcagatggacacaggggatggcccctcacgacgaggtggtcgagggccacgccgagggggaaatcgtcccccacaatccactggccggcacaatgatcagtatagcaataacagacccgataactatcaaggtacgagcggtgctgccctgcggcactgtgcgcttgcgtgatgctgggcaccttgctcactgttcctgcaattcatcggttccaagcacaggcggaacgagtgggagacagaacgacacatactacaactctggataccaagatcagtaccaccaaggctggcagaacgggagagggcggggccgaggctacttcggaggtgtgcctgggtgtgtgtcaggagggggtgctacctcttgctctgcagatgcacagccgtgcaggtggggtgcacgaaatcccttccttgctcccacaacctgtgtcgtgcttccgtttgtcacaggccgaggctcgcagaaccccggctaccagcagcagcaaggctacagcagcaaccgggggggcaggggccgggggcgcggtcggagtcagcctggccagtcccagcctgcccctgagcccctcccagacgacgtggagttcctggccgagctgaaggggcacacaggcaaggtcacagtggtggccatggatcaaggatcgggccaactcttcacaggcagccacgatgggaccgttcgggtctggagttgtgcttcaggggaggtgcgtgtttgcagtggtcaggggtggacagtgagtggatgaatgtggcggtgcgtgtgtggagggcagggcacatccgtcctgtggccgtctggaccgcagcatcggcgggatgctgtggnnnnnnnnnntcggaggcagggcacatccatcctgtggccgctggaccgcagcatcggcgggatgctgtggtggaatcgcttgccctggggcggagatgcccgtttcgcatgcactgcctcatggcaagtacaactacaatcgactgtgcagtgcgtcagcacggtggatgtgggcggcgaggtggactccctcctgctggaggctggattcttgttcgtgggcatcaagacccctgccaaccagggccagatcaaggcctggaacatgtccaccaaccaggagaccgtgctcgaaggccacacggtgagcctgggcgttcatgaggaggggagagactctggaggcagtggggccggtgacagaagtgcagcactgggcttgttcgagtacggcagaggggacgagaaacgtgcagaggagggtgactgttgctgcgtgtatgcaactgtcgtcgtggacgtgcaaagctttgttccaggcccgagccagtttgcccagatccagttactggcatgcttggcatcctctgccactgcccgacatgcgcacgccactgctcagatcgaaaactctgagctgccacaggctcctcaaccccctgtcgacccagagccaaccctcggcgccccactgcccacactctcccagggtcaagtcctgtccctggcggccgcgggcgggatgctcttctccggcgcccaggacgccacaatccgggtgtggaagcccagccccctcgccggcttcgagtgcagtgctgtgctgcgggccgacggcggtgggcattcatccccggtcagctgcctctgtgcctccgggccgtacctcttctccgcagacttcaagggcaatatcaaggcacgcgagtggcatgttggagtgggcgggtggcgccgcttcccatgtccagtgcccggggaatggtgtgtaaggggtaggcaagccgatgttggacaacttcctgggcccatgctttgacgtagtgtgcgtctccggcagccagctcatcccccacctactgcaaccacctggccaagcagtggctggccgggcgcagcaggcgccctcccacaccctcgccgcgtccaatccatgcacacccaagcactgccatggatcaccccagtcccaccccgcaatcccccacccccgcctccatcccaggtctgggacgtgactgccggcgtgctgcgccaggccgtggaccgcgcgcactcgggcgccgcgctggcggccatcacggacctcttcgtctggcagaactgcctcttctccggatccctggacgggtgcatcaaggtgtgggaaccctgcccagacccctcggcggtgatcaacgccgcgccctccttcgtcttcccggacgcggcggagggcggcgcggcggcgaggtcgcccacggggccgcggccgcgccccggcgggccggcccccgccctgcccggcatcctggccctggcggggctgaccgacccggcggggcgggcggtgctcatggtctcctacaacggcgagcccgtcattcggctctgggagctgccctccttcgaggggcggggggtcctgtccggggtcaagaacgtgcgcgccatgaccgggtacagcgccgggaacctgctgctctccggcgacgagcgggggcaggtgaagatctggaggtggcgcgagctgccccaggccaacgccggggccttctgaatggggtctccggtggcagcctcccctcctgctcggcctcgccgggcctgatgaacatcctccgggccgtgccctgtacacgctcgtgcctgcccacccatgcccccgggaccatgcacggtgcctgctgctgctgctgaggactgtgcaaggaaagcttgccaacagggcgacaggcatgggcgcacaaggggtatgcattcaggcaggggaagggagtgagcaccggggcccgtgtcccagccagcggccctggtgggaccacccaggagctctcttgcgggtgccagcttggatatccggggaggggtctggaaagctccagcacgatccacaggccccacctggccaggagggtgccctccagccctcatgcctcctctggcctcgccacgacggccacgcccatggccctgcaggtgccgaccagggacttgcagacagacttgagagggatgtgcggcacatcggcctgctttgccagtgcgatctcgtagatgtgcttcagcgagatcgtgcctgccacatcgtgcccgggcttctggctccccgactccaatccagctgccttcttgatgaagtaggaggctggcggcgtcttcatgacctgcatcggatggtggaggggttggacatccctgggtcgaatcccaacaagcttggcaagggccaaggggggcacccgcatgcacgcaggggggcggctgcccgagcgccgcgccctgcagatcactcacgtatgtgaacttcttgtcgggagtcgggaagatgacgacgggaatagggacgtcaggctgcatggcgtgatggcggagaatccgcagcatgttgggtgccactgcatgcatcctgagaccatgctggatgccagacaagcgccactgcaggtcaagagccaggcgtgcaagccgatgcaggacccccagcaccttgatgtcggcggtcttcgcattaaagtccttgcaaaagtccatgatcttcaggcctgcctggccgagggccggacccacagggggggctggcttggcttggccggcattgatgactacacggattcgtgtggcagcagccttcacggccttggacatgctccttgggccccacgccccacaggggtgggtgggcaggggggtgcaggcgcgcaagcgtgtgtgtgtcggtgtgcacccctgcgttcctgcactgaatagagtcttggagcaatgggcgctatgcagatggttggaatgcaaataataatctcaacatgtaaggctccctttctgtatcgtgaccatttgtgtaagggcgagacccagcgcgaggcgcgagcctgtccctcattggatacgtggaccgaaaagaaacgatggagtgaccgtgaaatgcgcgctggtcactc

SEQ ID NO: 40003 - DNA, 61 bp, Chlorella protothecoides
gccagggcccccgccggagggttgggttgtataatttctcagtacacactactctgaaatg

SEQ ID NO: 40004 - DNA, 61 bp, Chlorella protothecoides
gaggccgggaggcgctgccgttgagggagggggccgcagccgccgcaccctcgcggctggc

SEQ ID NO: 40005 - DNA, 429 bp, Chlorella protothecoides
  modified_base (194)..(300): a, c, t, g, unknown or other
cgccgcccgcgcccggcgcgccgcccgcccccgccggccctgcaccggggcggatgctgtcgcccacggtgcccacctccgccagcgcgcgctgcagcttgaccagctggcgccgcggccagcgtcggatgcccaggcggcggcaggagcgcttgagcgtagtcacacacacgcccaggttccgcgccgcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtcgcggagcgtcagccggcacgcgccgccgccccgcgacgcgtcgtcgcccgggtcggcgtcggggtcctccgaccccgcctcggagcactcgtcgtcgctggcgctgcgggccggccgccggcc

SEQ ID NO: 40006 - DNA, 61 bp, Chlorella protothecoides
ggcggtggacttgcccgaccagaaggactcgagagcctttttcatctcgcgattgggcccg

SEQ ID NO: 40007 - DNA, 82 bp, Chlorella protothecoides
gctgaggatgtacttgtattactcaggagaccttgacttttgtatccaatcactgtagcgatagtgtacgtgtacctgcatg

SEQ ID NO: 40008 - DNA, 61 bp, Chlorella protothecoides
tcgagctgtgggaagcatggcatgggcgggtggtggcgagcctgtccggtgctcgcgtcac

SEQ ID NO: 40009 - DNA, 5571 bp, Chlorella protothecoides
  modified_base (97)..(106): a, c, t, g, unknown or other
  modified_base (174)..(257): a, c, t, g, unknown or other
  modified_base (4943)..(5004): a, c, t, g, unknown or other
gcccgcgcgcaaacgcgttggcgttgtcccggaccgagacgggcacggcgatggtggtgggcccttgggtgggggcgttggaggcaggggcgggggnnnnnnnnnnggagggagggggccctgcagcatcggaaccggcggacgcggcctccgccttcgcaccggcgggggccnnnnnnnnnnnnnnnnnnnnnnnnnnnnnnnnnnnnnnnnnnnnnnnnnnnnnnnnnnnnnnnnnnnnnnnnnnnnnnnnnnnncgcggcgacacccccctcctggccctcaccgacgagtccctcggcctggcgcgaggcggggcgggaagacgcctgcccgaaaaagtggtcgaccaggttctcgcccgaggcggcggccgcagccgcgggggtcagagcctcgccgccctccgtcgccgccgcagcagcggacccggcaccgggcccggccagggagggggggccggccacggacccgaccacggggccgaccacggcggggtcgcccaactggcggcgtgggcccgcgcctgggccctcgtgctcgtggcctgggcggggcgccgggcccgcgtccccagccacgccctgcaggttgggcaccagcgccacgtagtccagggcctggatgctcttcaccacctcggccaggtcggcgcccgtcgtggcgtcgcccagcagcggctcgttggggtggagcagagccttgagggccaggtccttgctcaggcccagggcctcctgtgggtcgtggggagggggaggggggtagcggggtgggtgaccgacgcgagatgatgcgagggtttttgggtgtgtgcgcagaatcacgtctcctcctccacatcatgggcacccgcaggagccaggaagatgcaaacaactgtccagtgaacgtcacacttgaatggttatcacgagaagtagactgcctcagatcctaggcaacccttgggccccacattcacacaaacctgcacaccacgcccgtcatcccaccccacatccactcacggcatggctgagctgggtgttgaacacgcgactggagaccatgcgcgcaaacacggccacgttggtgatgtcggcgggggtcaggggaatgcccgcctgctgggcgtacatgaggcagacgtggcgctcgtagtgcgagacgtcgtgctgcagcgcaaaggggtccagcacctgcgaggggatatgcgacggggaatgggtggaggcgtgggggacgaggggggagacccagggtctcagtcacaggtggaggaacccatcccggagtcagtgctgtctcctcatgaccactagagtcaacgcaggccttccggccctggagtaaaagcccacgaggtcccacaccctctgtaaacacagcccaccgtggcaaagtacaggagctcgaccaggcgccccaccagggcctcgccctccttcttggcagctgcctctcgggcggccgcggccagcttggcggccttggcgtctgcggcggcgttcgtcttcgcctcgctcagctgctgacgcagggggcccacagctttggccacggcatcctccctctcggccagccactccgcatcagacttggtgggggaaggtggggctgcacggaagtagtgggatgttttagttgtttaaggcacagttcctgtacagaaaagaacaaaaagatgagtccagagtctgataaggcagctcagtgagtaggaggcatgatgctccccatttgatgccacatccccgggggcactatgccccagtccattcacattcccagcccaatgcagttaaactagacaaatttgtgattcactagaccgtagggacccaccacgggcggcagcagcagcctcgccctcctgcctggcagcggccacctcctcggccaggggctccttcagcagcttggtcagccgctccagctcctccaccgctgccacgatggacgccttgctggccagggctgcctcctatgatcgtgacgcatgagtcgtatgaggataccgggcgtcgacactcctcgaaagccctctccaccctggatcactcgccatcacctgatcggcgttgagggccttgccgacatcagccttggcttgaatctcatcgatgccacgcagcttctttcgctgattgcgaagacgcttggccaaggctaggagcacgggtgaggtggtctcggcgtccatcgagtgcccgttgctgggtgccctgaccgcccgttccccagccatagctgatgcgcagttggctgaggggcgattcccgttcctgaatttgtggggcatggcacgtcccatgacgtttgcatggactttccgaatcgcttgacggctccctggcatcacctatctggaaaggacgggaagccctttgatgtgggggaatggtcttgcctgtgtcgatatccctttgcctggcggacgatggcacagacagacatgctcgactaaatccgtttcaataccgaaacgcatctcatcacgtcgatctgttagttgaagactgcccggcggacactgctccatcactgccgttctgtcaagcaggctcaccactccatacggcccagggcggcagcatgctccccctcgtgctgttgaaaacagcacaaggacaccccgtggtgcgttggacaccgttcccccgcctgcagccggcctgttgcattccgcaggccacttccgcactggttgagcgacctcccctgatcaaccccatccactgcccctctgatgcagctcatagaattgaagagtggcgagacatacaatggacacctcgtgctgtgtgatacttggatgaacatccacttgcgggaggtcatctgcacctccaaggtgggagagtttggggaatacggggattgaggtggagttgtggcaccatcacctccagtgaaggccgcatgctcaactttccaatttccttggccccgcaggatggggacaggttctggcgcatgcctgaagcatacgtgcgcggcaacaccatcaagtaccttcgagttcctgatgaggtgcattctggggtggcacacgggatcccgcgtctagtattgcaccaggtccataggggaaggatggtggcgctctctgcaagtttccagcctcttctcatgcgttctctgcaatgcaggtcattgacaaggccaaggaggagacgctccggagggatggtgagcttcgctgtggtgatgccttcctgattgggggcgctgggatcacctgtcacgggcgtgaggatcgccagctgcattcctctgttgttccctgtccggatgtgtctcgtgttgttccatcaggtgcttgttggttgcactgcagacattccttccacaagcccatcctccatcccccctctactgctgcagagaagcgaccgagtgtcggcagcaggggacgcggccgggggccgggccgagggggccgggacggtggcggcggcaggggaggacgggacggcggcggcggcaggggaggccgagatggcggcggcggcaggggaggccggggtgcccccaatggtggcagagggggcggtggcgggaggggaccccccgcagacctacagtagtacttttctgcacacccctcatatccgcagcagatggacctgcaaacgaccccacacacgcacacttggaggtttacgctctctttgcacagtattgtaaatcgatgccacagcaaggaaggtgaagcaagggacagcatgcaagcctggacatgtgagtgcacatgctgctggcaacgcctgaccacagcacatgcgagcatgtcatgcctgcggcaaggtcacgcttcaagcataaagacagaatcggtggttccagcctcagccccgcacgccacagtgcgtgagcggcaggtcgcgccgcacctcgcagctcgcccggggcgcctgcaggaccatgcgagctccgacaacattgccgcgcccatcacagtattccccctgtgccctcctaccaccaccccctcactcgtcgtcgttatccacctcccccctcgccagcttggccatctccgccttgccccgcgccagccgccgcttctgcgccagcgcctgcttgcgcagcagcgccttccgcgcctgcagctcccgcgcccgctcgcgcacggtctgcgggtcgaagggcccgtcctcgtcgccggccacctggtcccactccagcacccggtccagcagcagcttgagcgccacctgcgcggccagcaccaacgggatgagccacttgcgccggcggtcggggttggccgcccgcgccgcggccacggcgtcgtggcgccaggcgccgccgcgcgcatgccgcagctcgcgcagcgcgcgcaccagggcgctgacccaggccacgcccccaggcaccaggcgctcgccctcgccgttctgggggcaggccgagtggttctccagcagggccacgggcagggcgggcgccggcgcggccttgccgccctgccgccccccaccgtaccgcgcctgggctttcctcaccagcgccgccagctgggcggggcgctgctccacccaggcggcaaagtcggtgcccagggggggggcctcaggcgtggcgcgcgtgaagcccagcacggcctggtcccagatgtcggcgccgaagtgggcggtgatggcgtcgaccagctgctcgtcggtcccgtcagtagcgtagacgtccaggcggtcgaggtagagcaccgcgtcgatgggcgtatcgcggatggcctccgccacgccctccagacgctgtggggttgtgtgagggcgtgtcttggtgcaggttcaaggggtccaagaaagcaggtctcgggcatcaggaccggaagtgtctgtcgagaaccgagtcccacagcgcctggccgcgcacaagactcctgcgcagagatacgcacatggcgtgcggtgcttgccgcagccttgactcaccaggctttgcccccccccccnnnnnnnnnnnnnnnnnnnnnnnnnnnnnnnnnnnnnnnnnnnnnnnnnnnnnnnnnnnnnncctcgcccccgcctccctaatccccactgttgtacttccccacgtcgcaccatggtagacaccgcgtcctgctccagcaaggagggcgtgtcaatgacggtgaacctgaagccgtcgggcagggtgcgtgtgtaggccgcggggcggttggtggtggcctggaaccccgacacgatcgccgcgcgctcgcccaggagggagttgacggtggcgctcttgcccactccaccctttcccaggagcaggagcgtgaactcctcgtccccgcgcgcgtgcgcgtccacggtcaggcccaggatggccgactgggtgggctccggcagctgcctgaagccggcccaggcgcgctcgccgacctcaggttgaggggcctggcggggggggccgccgccgccgccaaactgctgcgtcagctggcccaggctggacagcgggacgttgccgatgccggggatgtagatgttgatgccttctgagcctggggggaggcctgggcggcctgtggaggcggcgggcgggccggtctcgccctcgctgtcctcctcctcctcctcctcctcctcctcc

SEQ ID NO: 40010 - DNA, 170 bp, Chlorella protothecoides
ttgtccacagataggcttcctggcagtggttttaatggtacgctcatgaccatgaccccagcaccccagccattcacagggctgctgctgccacgactatctcagccatgttaacatgtacgccaagcacagatgagagaagaggcatgttcatcaccagggcaccacct

SEQ ID NO: 40011 - DNA, 146 bp, Chlorella protothecoides
gcttggaccacaccatagagtgcgtttgggttgggggggacttgccaatgcttgccacaggcaggcggcggcgaggggtgttcagagtgtgcgaggggcagcgccaggaggccggcagatccagggcggccggcgagatgtcctgc

SEQ ID NO: 40012 - DNA, 79 bp, Chlorella protothecoides
catttgcgggcgctgccaagccatcctctccgggagggagatgagtcagccttgcggcgcaaccctgatcgtgtgcccc

SEQ ID NO: 40013 - DNA, 61 bp, Chlorella protothecoides
tcgatgacaaatgtacatgcatatgtcgggggtgaattgcaggcaaagtattccccgtgtg

SEQ ID NO: 40014 - DNA, 79 bp, Chlorella protothecoides
cctcttcttcgacgcggcggaggatgagctccgtaccgtgcgcagcggtgagctgagcgtgcgccgctcggcctcgctg

SEQ ID NO: 40015 - DNA, 67 bp, Chlorella protothecoides
cgcagctcgttcacctgctgctgcagctccgcgctctggccgcgtgccacggccagtgcctcgacca

SEQ ID NO: 40016 - DNA, 61 bp, Chlorella protothecoides
cctcgcggtggttgtgcaggagctcttccgcatggtcaggcgggaggagggtgcggcgagc

SEQ ID NO: 40017 - DNA, 61 bp, Chlorella protothecoides
cgcctctgggctggggctgggcgacgtctccgggctggggctgggcgacgcctctgggctg

SEQ ID NO: 40018 - DNA, 10713 bp, Chlorella protothecoides
  modified_base (115)..(124): a, c, t, g, unknown or other
  modified_base (672)..(681): a, c, t, g, unknown or other
  modified_base (1192)..(1201): a, c, t, g, unknown or other
  modified_base (1605)..(1646): a, c, t, g, unknown or other
  modified_base (1837)..(1846): a, c, t, g, unknown or other
  modified_base (1915)..(1924): a, c, t, g, unknown or other
  modified_base (1993)..(2075): a, c, t, g, unknown or other
  modified_base (2912)..(2921): a, c, t, g, unknown or other
  modified_base (2982)..(3088): a, c, t, g, unknown or other
  modified_base (3153)..(3162): a, c, t, g, unknown or other
  modified_base (3796)..(3805): a, c, t, g, unknown or other
  modified_base (4403)..(4412): a, c, t, g, unknown or other
  modified_base (5583)..(5592): a, c, t, g, unknown or other
  modified_base (6389)..(6398): a, c, t, g, unknown or other
  modified_base (6497)..(6506): a, c, t, g, unknown or other
  modified_base (7245)..(7254): a, c, t, g, unknown or other
  modified_base (7522)..(7531): a, c, t, g, unknown or other
  modified_base (7605)..(7614): a, c, t, g, unknown or other
  modified_base (7936)..(7945): a, c, t, g, unknown or other
  modified_base (8151)..(8160): a, c, t, g, unknown or other
  modified_base (8360)..(8369): a, c, t, g, unknown or other
  modified_base (8857)..(8866): a, c, t, g, unknown or other
  modified_base (8942)..(9190): a, c, t, g, unknown or other
  modified_base (9302)..(9311): a, c, t, g, unknown or other
  modified_base (9530)..(9656): a, c, t, g, unknown or other
  modified_base (9775)..(9784): a, c, t, g, unknown or other
  modified_base (10328)..(10337): a, c, t, g, unknown or other
accgcttctcaggtacccgcagagaaggggaagcgggaggcatggatgtgggcacgcgagtgtgtgtgtgtgtttgtgtgtgttccggggagtgtgtgaggtcatgagggagtgnnnnnnnnnngtgccgcagtggtaccagagcttcctcacgcagtaccagagcgaggtggggcggtacgtcatcgaggaccgcttctcaggtacccgcagagaagggggagcgggaggcatggatgtgggcacgcgtgtgtgtgtgtgtttgcgtgtaccggggagtgtgtgaggtcatgagggagtgggaaggcgaacaaggagtgctggcactcatgaccccatgacggcgatgcgacccctgcctccaggcgcggccctcaacccacagaccctcatctcctctcttccacaaaccacatccagccatccgtgtcgccatcggtatggccaagcccaaggacctgatcctggtcctgggcaaggggcacgaggacttccaggagtactggggggggcaggagctgggggagaccgtcaaggtggggtgttggggataaggtgggggctctgaggaggcaagagaggcgaccgaacggtccatgcggttgcgaagatgcacatgtcgctgcgctgacaggatgtggcacacctgaacgatccagtgggtgacggcannnnnnnnnnatccccagatgcacatgtcgccgcgctgtcagtatgtgccacacctgaacgatccagtgggtgacggcatcgcggagtcagggtgcagaaaaaccatgtacatgcatgcatgcagcactgagtgttgccggggtcaaaactcgacagcaaaacacactcatgcgcagggctggtttgacgaccgggtggagtgccgcgctgcattgggcaggctgccgtccctggaaaagctaaaggacctggacaggtccttcctgccctggaccaggtgcgatgagtgtgtggtgggagggggagagagggaagtagaagggtcaagcagtccactgaatgatctgtccatggtggcagcagactggtggtgagatgtacgtctgtgtgcctcatcccagcccgctgccaacccgccattaatgtgttcggcggccccactgtgccgactcccatgaccctgaattgttgcccacccctctcttcccgccaccctttccatctttcaggtacccggagnnnnnnnnnnccagtccactggatgatctgtccatggtggcagtagactggtggtgagatgtgcgtgtgtgtgcctcatcccagcccgctgccaaaccgcctttagtttgttcggcggccctactgtgccgactcccatgaccctgaaatgttgcccacccctctcttcccaccaccctttccatctttcaggtacccggaggagcgggagggcatgctggcctccatcctggaggaggagctgaagagcaagggcacggcggagccggccatgcggcaagtcttcggccccacgccggccgttgctgcgggggtggatggcgccgacgacggcgcgtgatggccggtcttgctggaatccctgacagtgagggagagcttgcatgagagttgcaagcatggaaaccctcgcannnnnnnnnnnnnnnnnnnnnnnnnnnnnnnnnnnnnnnnnnacatcgtgcatgggcgtggtgttgcagagctgtaatcgcagagctgtgatgaatgggagaggcgacagcgcggtagattcgctacaactaacaatctaacaaagttctccaccaccctctggaggcgcccttgagagatgtttccgcgcgcgatcaccgaaacgcactagcacgatcgtcctgcctcattnnnnnnnnnntgcatgcaattcctaagttcgtggacattcagaattgaccagtgccgcatgggagctccccacagagcnnnnnnnnnnggcatgcaattcataagttcgtggacgttcagaattggccagtgccgcatgggagctccccacagagcnnnnnnnnnnnnnnnnnnnnnnnnnnnnnnnnnnnnnnnnnnnnnnnnnnnnnnnnnnnnnnnnnnnnnnnnnnnnnnnnnnnagtagattggctactaacaatctaacacagcaccccctggaggcgcccttgagatgttttccgcgcgcgatcaccggaacgcactagcacgatcgtcctgcctcattgccacagcaatgcacaggcgatctgcgtttcctcacgtatcaaaagttcatgctgtaaatatgacgtcggatcaggccccagcatcgggccgtggcatccagtggacgggagacggcgactctccggcacaggacgagtcagtgctgcagcaggaaagagaaaagcatcgaagaaggtaggagtctttacatcgagtggtcccatccatcagcagtgggatgtgtgcagtgccctccagggcgctcagctgcatgtaattatcacccttcctctacacaaactgcagagctgagaagttcggggtggacttcgtcgagcctgggcatcggcaagaactgaggctggcgtcaaagaaggaaaggttgcagcgccccggctttgccacaggcgttgatctcttcaccgaggtaaagcggagggtggggcgtagaatgcccatgagagccaagctggccatgcgcgattttcccagcatacctgcacggccctgcccggcatcgaccgccctccccatgcaacaggaggagattgccaagcgggagcaacgggcaggtcggttcgggatgtctgacacgggcctgaagtgggagccccccgccaaggacgaggcagaggagaagcgggcgcagcgcgccgcacgatttggcaccgagtacaagcccgccgatgccctcatggacgtcggtgggtatgggcggcagggaggtgtgccgtgccagccctgggcannnnnnnnnncgccctcatggacgtcggtgggtacggggtcagggaggtgtgccgtgccagccctgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgcctcgcaacttctcctcggcaccttcatgtatcaccaaagccctccccacgttccacccnnnnnnnnnngcgggagcgaatgaatggacacaggccgctgttgccgcctttccattcccagaatctgcggcaaacttgtgctgtcgttaccccgtattgcctcgttttactccgtactgcctcgaaacttctcctcggcacctccatatatcaccaaagccctccccacgttccacccctgtgccttcacccccccttctcctcagacctgctggaggttcgggcagagccatcgctccacaccgccctgcgacgagaggctgtgtatgtgtacggcgtggacctgctgtccaccgctgacatcctgcggcactttgcagactatggccccacctttgtggagtggatcaacgactcctcttgcaacgtcctcttcgccgacgggccgagcgcgaagcgagccctggcaggcctcgggaaggccctcccccccgctgaaggctctgagctccaaggtgagatgggtggggagtggttctttgctgtggcagagcaggggcagggctgggttttcgcttcgtgggtagatgcattggtgggtggagaaggtgctgcgcaggcccagtcacagcttgcccggctgcacctgctggtgcatgggtgtgcatggagcagactccagcccctcgttgctcccgcctcnnnnnnnnnntcagggctgggttttcgcttcgtgggttgatgcattggtgggtggacaaggtgctgctcaggcccggtcacagcttgcccggctgcacctgctgctgcatgggtgtgcatgggtcagactccagcccctcgttgctcccgcctcggcggctggcaccttggtatcccaagcctcctctgcacacacacaggtctggacgccgcagacccctccaacatggaatacttgtggcacaagaccgcggaggaggtgcgcggcgccacctccgacctcctcatgcgcatcgccaacgtggacgacgtgcggccggagggcaaggtgcagtcgcgcaggctgtggcaggcaggccagcgcggcaggggccagggcgggcggggcgcccaggcccggaagcggcagagggacggcgacgaggaaatggcggacgctggggagggggccgagcagggggtgagtcacggctggggcgtggctgaagaggtggggggatgtctggtgcaggagaggagcgtgaatgatggatgtggcactggagatcggggaggaggcaaaggggaggtgtctgggcactgcgctgcacagcaaggcatgcctccannnnnnnnnntgctagggaggggggcgagcagggggtgagtcgcggctggggcgtggctgaagaggtgggagcatgtctggtgctggagaggagcgtgaatgatggatgtggcactggaaatcgggtgggaggcaaagggggggggggtgtctggacactgcgctgcacagcaaggcatgcctccatagaaatgaacgccccagctcacaacaacctccctgcaggacccggggcggcgacggggaagggacaggaggccgcgtgccgtgccggcgggcatccccgcagccatcttctccaaggcgctgggaggcatcgcggcggaagccgcggagcgaaaaccagccacggcgcatgcccccgcgccggcccgggaggcggtcacctacggcgacgtctagtggggcttgggcgtgtgatcagctgcaaggacggcgtggggcatgccgctccccacctcggcatctgacgccgctggccgggcaggcgcaggcgtatgcgcgctgcctgggtcgccgaatcaccgagcggaatgggcgacgagaggtggagccatgtgcacagccagcaagccactccctcgagggtgtggcagactgcagggcagggcaaagagggataggccgatgtcttgagacaatgttttcgaaaggccctgctctcacgctgggggacagccgaccctttacattgccatgcttttctgtgactacccaaaactgccaccagtatggctacagacatgcctggtccaggcaaagggtaatctgaaaagatagctcgagtggaatgccttgaagcgaggtggcaaggtgtcaaaggaatagcgctgtgcagaagcctggttgtattgtattggaagcatgcactcccgagcccgctctctgccgagttctcaggggactatctgccattcctcgatgtggaagaggtaaaagagggcgtgagaaatgcccgcagccagggtatcacccgtggtgtcttgatcgtcttgcaggtatctcaatgcggattgccactccgagatgcccttggatgacggcggcgcgagatccaaggtggcgagtccttatatcacacaatgcacgggataaaagtcctccagagccgagcgagagtgaactggtgagtgtataatagggaagattctcaagaactcgatgaggtaataccacatctnnnnnnnnnnttaaggtggcgagtccctatatcacacagtgcacgggatacaagtcctccagagccgagcgacagtgaactggtgattgtgtaatagggaagattttcaagaactcgatgaggtaataccacatctagaaggacactcccacgactgttctccgtgacaatgcaaacgggtatcgcgtttggcggcgcacgcgattgccggtacctaatcacggcatcattttcggtccccatggctcgttcatatcatccagaacacatccgatcccattagacctcggcaattaagctggattgggcgggaatagtactgcggtgggtgaccacgtgggaagtccccgtgacgagctgtttttgttcttgttgctggatctggtcatgctcttcaaccgtgccttgttgaattttggggggatgtttcagccccccttcccccgaaatctgcctccgcttgacaccctgctcacttcctgcacagccacccatggtatctctggcgcgacaccaggctgcattacatgtctggcccgtcctcatcagcatctggcctgcccaggccgccatgcttgaggctcaggaacaagggcttcagctcgggcatgaggtgcacagccaggatctccagcgcaccgtaccctagctgcaggatcagcgtctcgctctgcatcatctcgatcacgtcctccatgccactgctccagtgaaggggaacaggggaagagtgggcatggcaggagatgagggagtggggtcagagcaccaccctacggccggccaccgcctgccgtgcccctgatnnnnnnnnnnttgaagggggacaggggaagagtgggcatggcaggaggttgagggagtggggtcagagcaccaccctgcggccggccaccgcctgccgtgcccctgatnnnnnnnnnnccctcccacgcatcaccccacctggtgtacgcagacttgcccaccagcccgacgagggtggcgggcgcgcacgtgagcagcagctgcgccacggcttcccgcacctcctcagcgtccagcggcgggggcccgtttggggtcaggaagctgtcggcgcgcgcggcggggggccgcgcgcgagacccgggacccccagcgcccagcaccccgattcccgctcccaaccccactccctgcgccgcgcggtactgcggcgtggcctggtaccacacaccccccggccagagcgcggcctggatgccggcgatggcccggccgatggtgtgctcggagcgcagggagcgcaggcgcgcggtcaggtactcgtcgatggtggtgccggccacgagggacagcacctggcgcgccacggcgaagacctggcgccggaagaagccgcgggtggccagctggaacacgcagtccaccagctcgtagagcggggcggagacgctgaggccgtcatcgggcgggggagtcggggggcgggggggagagggagcccccgccagggtggtcgagggactgcacggaggggccatgctgccgttgctggcttggcgcggcctggggggggggaagtgcacgtgggagatgatgggttggggtggctgggagggaccgattctgcagggggactgacaagcagggcggcaatgggtcgccgggcagcccccagcctggctcaagcccggcagcnnnnnnnnnnagtgcacgtgtgagatgatgggttggggttgccgggagggaccgatcctgcagggagactgacaagcagggcggcaatggggcgccggacagcccccagcctggctcaagcccggcagcttcaaacatatgtacgatttccctgtcatcctcgcctccttcactcaccctcgctccctgcgcagcgctgcgtctgcggcctggatggcagtgtggtccccgtgagcctggaaagaacggagtgtgagtggtcgtaggtgacagggggnnnnnnnnnnggtcagaggacctccaccccgcgtggctcagggatgaacccccgctggcccccctggaggtcaggctggaggannnnnnnnnnagctgcaggcatgaggaacgcagccgaccctgctccagtcaccccacctcgtcgaagctggagtcaaaggccttccaccctgcgtggctcagggatgaacccctgctggcccccctggaggtcaggctggaggagctggggaagatgggcagcgccctgcctttcttgagccctgctttgaacacgctggcgctgtccaggacggcgtccgtcgatgcctgggggtccaggagtaggatgtttgcaaacgatgataatccgcatttctgagggggacctggcgtgcatgtagcgttcggtgcctgcctccttgcgggcgcannnnnnnnnnagtttgagttcttcatgcctgcagccggtcggtccccctgtcacctacgaccactcacactccttcctttctaggcacatggcgaccacactgccatccaggccgcagacacagcgctgcgcagggagcgagggtgagtgaaggaggcggggatgacaggaagattgtacgtacatttgaagctgccgggcttgagccaggctggnnnnnnnnnnatccgtcgatgcctgggggcccaggatgtttgcaaatgatgataatccacatttctgagggggacctggcgtgcatgtggcgttcggtgcctgcctccttgcgggcgcaccccctccatgttcaggctgcacaacccttcccctgccttccctcgtcacacatgcatatcgcgctgcatccccgcccacctggactgcannnnnnnnnntccctccatgttcaaggcgcacaacccttcccctgtcttccctcgtcacacatgcatcgcgcgctgcatccccgcccacctggactgcagacttggtgacgtctgacagcatgtccttgacgttgaggataggggttgtcagagacaggctgcgtctcacggggttggactcactgctgattcgcggaagaggtggggtgattgttgggtgcaggccgggtcgtcgaacgctggctggctgaatgattcaccactccgcctgcgatgcctccacccagcaaccatggctggccagcatgcctctgtcgccgatcctgccgtccaggcgcgactccgccaccacagcatctatggtggcccaggtccccactggacgcacctcccttcccaaccccctgccccagcccccatccacccacttggagttttggtgcatcgggcgcgtgcagggggacagctcatacacctccgagccaggccggcaaaannnnnnnnnntgatcctcacaaatcgcccgtcaggctacaacctggtggctggcagagggcagcatgtgcgagtccggccgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtggatggatgagggggaggatgtggatttgaagcgtcgagggggactgcaggaggcagcaccaggtgcgacagccggggcccagccaagatcccaaggagggcaccnnnnnnnnnntccctgccccagccccctccacccacctggagttttggtgcatcgagcgcgtgtagggggacatctcatacacctccgagccaggccggcaaaactcaatcacgtcctgcgtgcctgcgggcaggggggggtgggcgtgttgtgatcctcacaaattgcccgtcaggctgcaacctggtggctggcaggagggcagcatgtgcgagtccggccgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaccaccccacttctcctcccatttcccccagccccagcttgccctgcagcaccgggtgcgccagcaccgtctggaggtaggcgttgagcgcgacgcgccgctcctccacaaagtcnnnnnnnnnnaccgcaagcccgcccagcctggctgcaagcagttggtgccgggagcattgtccactgttgccgctccagtccccgcactgaaccaccccacttctcctccctttccccccaaccccagcttgccctgcagcactgggtgcgccagcaccgtctgaaggtaggcgtcgagcgcgacgcgccgctcctccacaaagtccacgttctgggagtgcacaaacacgcgcttgggtggcagcttgagcctttgggagaggtgtggagggatgagggggagggtgtggacttgaagcgccgagggggattgcaggaggcagcaccaggtgcgacagcccgggcccagccaagatcccaaggagggcacccttgcgaccccaggagggcacggagacttgcactgccctacatgcccacacactcccactccgttctccccctttcagccttcttaccccttctccccccctttcccgcccccccccggaaaaaatgaaacatcttgcctgtagcaggggtcctgcttcagctggcggtgcaggacctcgannnnnnnnnnactttcagccctcttcccccttctcccccctctcccgcccccccagaaaaaagaaacatcttgcctgtagcaggggacctgcttcagctggcggtgcaggacctcgaagttacggtaccgccgcgccaccgtccactcgccgacgtcgtcgccgacgcgcacctggtagacgacatagtccttaccccccgccgcgttgaggtccgcgaccaccacccgcgcccgcagcctgccgcggaagggagaccccggcccggcctggagcgcggcgccacgacgggcacgctgcgcggccagcccgctctccacgctggccgagtcggccgcgccggcgatgaggtgcgcgccgccgtccggcgcggcggcggaggcgttg

SEQ ID NO: 40019 - DNA, 61 bp, Chlorella protothecoides
gtcggggagggggagggcgcaggagaagggacgcggtgaggtgcaaggactggcgggcagg

SEQ ID NO: 40020 - DNA, 136 bp, Chlorella protothecoides
cagtcttggcccagggacaactgggtgcaacagttcaccccaacatacgtaagcaaacaccccccacccctaccctacttcgcccacaaccgcgccggcccctactcaccacagatggccagggcagaggagatga

SEQ ID NO: 40021 - DNA, 106 bp, Chlorella protothecoides
ggtggcgggtgcaggcaggaacttggcggctggcgggcgagtggatctgtcccgcctcagatggcaggctggggcatgcggcgacggcgctgccagaccccgtgct

SEQ ID NO: 40022 - DNA, 80 bp, Chlorella protothecoides
agcaacctcatcccaccaaaggcaaaccccaccgcaaaggctgccctcacgtcgcacctcctgcacgttggcggcgacgc

SEQ ID NO: 40023 - DNA, 61 bp, Chlorella protothecoides
gactggcgccgccagcgcggcgactcgccctcgcagcccccgtacgggggagggcccggcg

SEQ ID NO: 40024 - DNA, 142 bp, Chlorella protothecoides
atgaccccggggcctccggcgtcgacagacgtcggcagcaaaagcaggaagacggcatcggggagcacagcaggagcgtcgacggtgatggtttgggctgccgatgacagcagggcgtgacacagacagcgcaggtgacctg

SEQ ID NO: 40025 - DNA, 73 bp, Chlorella protothecoides
ggcgcagggatcttaggacgggaggaaggggccacacatgtgaccagaaaccttggcatcgggcttgggtgcc

SEQ ID NO: 40026 - DNA, 67 bp, Chlorella protothecoides
ggaggggatcgcatgggtgaaggaggggaccgtttttgggggggaggggatcgcatgggtgaaggag

SEQ ID NO: 40027 - DNA, 73 bp, Chlorella protothecoides
ggaggccgactcctacctccagggcgcggtggcgggctgggtacgcgacccggcctgcagccgcgtggtggtg

SEQ ID NO: 40028 - DNA, 75 bp, Chlorella protothecoides
gtgagcagaatggtgaagctgcatggggccggggcccgggtggcaacgcagacgagaggactctgcatcagcgaa

SEQ ID NO: 40029 - DNA, 1149 bp, Chlorella protothecoides
  modified_base (134)..(143): a, c, t, g, unknown or other
cgcggggcccggacccgcgcgactcgccgccaccgccggctgcgcggtgcccacgcccgcctgggccggccccgtccccgccgagtttgaggcggcggcggcagaccccctgctcggcttcccggacgccgccnnnnnnnnnnccccgtccccgccgagttcgaggcggcggcggcggaccccctgctcggcttcccggacgccgccaacctcctgcccggctacgtgctggggcccgtggcggggaagggcggcttctgcaccgtgcgacgcgcgctgcatgccgccaccggcgcgcaggtggcggtgaagatcatcgagaaggcgcgcctgcgcgacgccacggaccgcgagcgcgtggagcgcgaggtgcgcgtcatgcgcgcgctgaacaaccacgtgaacatcgtgcgggttctagagagcgcagagaccgccgacgccgtctacgtcgtcatggagcactgcaccggcgggggggctgagcattgtttggcatttcctcggccagggttttgaggcgggtcaggtgctgggtgtgtccatgcaccgccatccctgcacccactttcacgcctggctcctcaaaacctcttctccccctcccccctgctccccagttccctgctggaccacgtgcgggagcgcaagtgcctgcgcgacggcgaggccgcgctggtcttccagcagctgctggccgcgctgggtcactgccatggcgcgggcatcgtgcatcgtgacgtgaagctggagaacattctgttcgacggcgccggcggcgtccagctcatcgactttggcctctgcggcttcttcgtccccggccgccgcctgcgctgccactgcgggtcgcccagctacgcggcgccggagatcgtggcgcggcgggagtacgacgcgccccccgtggacgtctggtccctgggcgtggtgctgttcgccatgctggcggggtacctgcccttccacagcaaggacaagaaggcgctgtcggccaagatcgtggcgggggccttccgcttccccgcctgggtggacccgcaggcgcgcgacctcctgtcccgcatgctcaccgtggaccccggcgcgcgcgccaccctggccgagtgcgccgcgcacccctgggtcgcgcgcgggccgcgctgggcg

SEQ ID NO: 40030 - DNA, 67 bp, Chlorella protothecoides
acgtagtccatgccgtacatgacctgtgcatgagggaagggggaatgatgggtgatggggatatagg

SEQ ID NO: 40031 - DNA, 188 bp, Chlorella protothecoides
aacagggatgtacttgatggcttgtaataacgttgcccattggggtgtggggtattcggcacaatagagcatgaccacggcagggtaatttgaactgacgcaaccacgtttagttggccaaggttgtgaatgaagccatggtgaaggggcaatgggaaagggatttgcctgccgaaacccaccgatat

SEQ ID NO: 40032 - DNA, 112 bp, Chlorella protothecoides
cacgctggcagtggtgaaatccgagggcgcgcaggccacagccgcgcgagcgtcctcggccgcccccgccgcgtcccccgctgccagccgcgcccctgcccgattgctgaga

SEQ ID NO: 40033 - DNA, 61 bp, Chlorella protothecoides
cagagaaatccgctaatttttctcagcaggggtggggacccgagggaccccttgctcagtg

SEQ ID NO: 40034 - DNA, 78 bp, Chlorella protothecoides
cttgacatagatgtggtgggtaaaggaacagaatttccaggtctccatttccatgttgctctgtgcctctgctgggct

SEQ ID NO: 40035 - DNA, 61 bp, Chlorella protothecoides
catgacccagaactcctcaccctcccctctctccaatcgctcaggctggcttgcaacacgc

SEQ ID NO: 40036 - DNA, 105 bp, Chlorella protothecoides
gccgtgcggggctgggcgcggtttccttgtagccccggcactttggtgggtgggagacgtgtggcacggcgcatcgctgaaactcagctcatctcctcctctacc

SEQ ID NO: 40037 - DNA, 61 bp, Chlorella protothecoides
ccggcagaagaggtcggcggcgggggggccggcgggcagcgtcgcgatcaggtcctggaag

SEQ ID NO: 40038 - DNA, 108 bp, Chlorella protothecoides
cccctggaggccgcgaggtgatttggtattgggggtgaaaggggggtgggaggatgttgggtggacggtgggagggggttcaggcatcgcacatgcggatggcctggc

SEQ ID NO: 40039 - DNA, 99 bp, Chlorella protothecoides
gcgtggcctgggcggcgggcgtggtcgccgcggccccgctcgccgccgaagggctggtttccgccgcgcgtgactccggcccggggccggggatgggaa

SEQ ID NO: 40040 - DNA, 65 bp, Chlorella protothecoides
gcgccccggcccccgccgcgccctccccgctgccagcctcccgggccagcagggccttgcgcgag

SEQ ID NO: 40041 - DNA, 61 bp, Chlorella protothecoides
ggctcacaggcttgccagaccaaccccgcaccgtgctccgcaatgcacagatgaacccgga

SEQ ID NO: 40042 - DNA, 64 bp, Chlorella protothecoides
cgtaaaaccccgcacacaccacatgcacacgagccttcattccatccgcgcaggtgatcgactt

SEQ ID NO: 40043 - DNA, 71 bp, Chlorella protothecoides
gctgcgcaggtcctcctccaggtcatgccgctgcctctcggaggacatcagctgtgtctgcgaggctcgag

SEQ ID NO: 40044 - DNA, 75 bp, Chlorella protothecoides
ttcggcatgatggaagggttcataggggggtctcaaggatggcccagtgccagacgcagcggaccctcaagggcg

SEQ ID NO: 40045 - DNA, 61 bp, Chlorella protothecoides
agtcgaaggtggtgggcagcgagatggatccaagacctgtcctgcctgcatttgttggagt

SEQ ID NO: 40046 - DNA, 61 bp, Chlorella protothecoides
ctgtaaccacgccgtggaccccagctgcctcgcatgtaccaatcttgtcgctggaggatca

SEQ ID NO: 40047 - DNA, 70 bp, Chlorella protothecoides
agcagccgccgatggcgacgcagcagccgctgatgtccacgcagaagccacggagcccgaccggcggaga

SEQ ID NO: 40048 - DNA, 70 bp, Chlorella protothecoides
tgatctgggcgaggtgttaagctgtgccgcgggggggggagatcgggaggatagtttacgcccccctcaa

SEQ ID NO: 40049 - DNA, 61 bp, Chlorella protothecoides
aaaaaacccaaattcaatttcaggctacagccaagcttcatagggtctttctgtccaggtg

SEQ ID NO: 40050 - DNA, 61 bp, Chlorella protothecoides
cagcatgcccagcagcaggaccaggttgcctctttgggatgtgcacgctgcggtcccgggg

SEQ ID NO: 40051 - DNA, 114 bp, Chlorella protothecoides
atccggagctgttggaggaggcctcggcgctgtccgcgccagggacggccggggcgcccaatgagcagcaggcccacgacgcatgcctggacagggcctggcgccacttcgaga

SEQ ID NO: 40052 - DNA, 13784 bp, Chlorella protothecoides
  modified_base (499)..(508): a, c, t, g, unknown or other
  modified_base (1352)..(1361): a, c, t, g, unknown or other
  modified_base (3010)..(3019): a, c, t, g, unknown or other
  modified_base (4182)..(4191): a, c, t, g, unknown or other
  modified_base (4924)..(4933): a, c, t, g, unknown or other
  modified_base (6141)..(6150): a, c, t, g, unknown or other
  modified_base (6769)..(6778): a, c, t, g, unknown or other
  modified_base (7324)..(7333): a, c, t, g, unknown or other
  modified_base (7391)..(7400): a, c, t, g, unknown or other
  modified_base (7499)..(7508): a, c, t, g, unknown or other
  modified_base (7823)..(7832): a, c, t, g, unknown or other
  modified_base (8347)..(8356): a, c, t, g, unknown or other
  modified_base (8704)..(8713): a, c, t, g, unknown or other
  modified_base (9806)..(9815): a, c, t, g, unknown or other
  modified_base (10963)..(10972): a, c, t, g, unknown or other
  modified_base (11532)..(11541): a, c, t, g, unknown or other
  modified_base (11960)..(11969): a, c, t, g, unknown or other
cggggaggccagggggtcgcacgccgccccggggcccggcgacgcgccgggcagcgaggccggcacgcgcccgggggggccgtcgtgagcgacgcccgcggtcgccgtgctttccagctccaccaggaccaggagccaggtggggtccggggtggaggacaccatctccgcgtccgtcagcgtgccgggcgtcagcaccgccaccttctcgcggcgcacgacgttcacctggagcgaggggcgcggtggtgggtgtgcatgtgtgggggtggggcggagggtttgatgtggcggccgtggaggtcatcgacggctggagtgggtctgggagcatgcgcatgggtgtggtgccccagagaaggccccatgcagcattcggccgtccccgcgaaagaccatcgcttccaatccctcgtccttctccactcctccatctgcatgctgcccctccgggggtccctccaccgtctccccctctcccgcacatgcaccaaaacannnnnnnnnngtcggccgcccccgcgaaagaccatcgcttccgatccctcgtccttctctgctcctccatctgcatgctgcccctcgggggtccctccaccgcctccccctctcccgcacatgcaccaaaacaagaccccatgcaccttcttctggccgctctggcgccgcttctcgttgcgcgcggccagtgcctccggggtctcggtctgctcgatgaccaccaccttgaccccggcgcgcgccagcgtggccgccatacccgcgtaggcggcctcggggaagccggcgtgcggctgctcccccctcatgtaggtcaggcccagcagctccacgcccacgtgggcgtccatctcgaacagctcgtagaacttgcccatcttgaagagcaggaccgcgtcaaagttggccgccttgaaggcccaccactgacgctggccctcggaaatcttggcgtcgtgcagccatgtggggggcaggaagagggtggtggggtcgtagccggggtcgccggggcggcgcccctccgcgtcccgcacccggtcgggctgcaggaaggggaagcgggacgtcgagcgcacgccaaagcgctcgctggggccggcggacagcgcgccgcccagcgcgctgccgggctgcgtgagtggtggtggcagcggatttcgtgatggggtgggagtgcgggcaagaggccgcagccctggaggagaggcagagctgggtgagaaagatgcccacctcctgaggcggctcacaagatgtgagaggatactcctctgagccatgctcgcgtggccgagcatccccagggacgcattcagaggtccccttttccactcagcaacccccactgnnnnnnnnnncgcaggaaggggaagcgggacgtcgcgcgcacgccaaagcgctcgctgggaccggcggacagcgcgccgcccagcgcgctcccgggctgcgtgagtggtggtggcaacggatgtcgtgatggggtgggagtgcgggtaagaggccgcagccctggaggagaggcagagctgggtgagaacgatgcccatcccctgaggcggctcacaagatgtaagagggtactcctctgagccatggtcgcgtggccgagcatccccagggaggcattcagaagtccccttttccactcagcaacccccactgcccagcacccctcaccgtcgcggccggcccagaggtggccggcgtggcaaagctcggggtttcaagggcttccgccaggttccttgcagctggtctcagaccggaggctggggtcgccgggggcagcccccccttggactgcgatgcggggcatggggtcgcctgcgtggtggccgaggacacccgctttctccctgcagcagcaccggctccaggggaggcctttgccgccgcgctggcagtcttgccgcccgccggctttcgcgcgggtttgacgtcgctctccgcctcgctgccctcctcttctgcctcgctggcggccatgctcacgctgtcgtcgtcgctctcctccccctcctcctcgctggccagaaattcggagccctgggaggcagagggctcggcctcggagtcagagtccagtacctgggcggccttggcgcgggcgcgcttcctgcccggctccagcacctcgaagcggtcgcgctccaggtccacccactcctcatctccgtcgtcgtaggcaacgtaggcgcgccgcttgcccttgcgctcctgcacctcgcctacccggccctcgaaccaggccttctccgccggccagaagacgcgcagacgctggccctcgcagactgggggggcgttgcgcttggcggcccgggcgcccggcgcaggcgcggcgccctgcgaagatgcatcgcccgcaggaggcgaggccttgggagtcggctgcaggcacccagtggtcaccgcggtcgctgcggctgttggtggctcagacccggcctcgaggtccaaggctctggctgggctggccctgcccttctgcctgctgggggagggcttcaagcgagggctcgagcgcttgccagccccaaagaatgaggcaatggacctctgtccactgcccatggcgacaggctttttggagctagacatctaggtggactatacttccacagtgtgcaaagggaaagccctatttaagcttgtctgggtgtgagctacgtgtaagcgtccctgactattcaagcgacccggcctgccggaacagagcgggaggcagccagctcgggccactcatcaaattgacaagcggaacgaagcagagtgtatgatgtcaagtgaggaaacatgcccaacagcttaggaggtcttgtcatttgaagccgagaggccccctcgcacgagatcgatgtccgtgatcggttttgaaaacttcagggcgcacgcgccattgtcctgcgagcatagtaatgctgattcgttcgcgaggaccaggtcatgcatgattcctgaaatcagttccaagttatacattcgacggcatcgcggcacccgtccnnnnnnnnnntaagtcttgtcatttgaagccgagagggcccctcgcacgagatcgatgtccgtgatcagttttgaaaacttcagggcgcacgcgccattgtcctgcaagcctagtactgctgattcgttcacgaggaccaggtcatgcatgattcctggattcagttccaagtgatacattcgacggcatcgcggcacccgtccagaccttgcattcgtctctgtcacgagtgctggagcctgcgaggcgaccggagagctgagctcaagtggctcgctgcagtcatagtagatcctctgaagcaatacccacgagtcgcaggccttttagatcgcgatgacggagtatcacacgatatacaaagggccggagggggagaccacacagtgggatgacatccagaggaagctgggcaatcgcccagaaaaggtgtgggcggctccgacgaccgtggtgtacatgggatttagtgcaagatggaacatgtagcgcccatctggaatccggggaccttgttgagggacgatggcctgcatgctacttaacccccatcgcctccctggcccactctgtgcatgatgcgtaggacccggtctggaagccccaggcctacacccccgaagcagagccgacccgtggcaccgagcgcctggacggggaggacgcggaggggctggaggaggcggaggacgagttcagcgatgaccgcttcctggagcagtaccggcagcgcaggatccaggagctgcaggccagtgtctctcagccgcgcttcggcagcctggaggagatccgccgcgacgactttgttgcgcaggtcaccaacgccggggagggtgtctgggtggtctgccacctgtacagcgacaggtgtggcggtgttaaagatggtttggggtggggggggcagcagtaggggggcgcatagttggactttcccctctgggtgttgcagcggtagaccttggaaagttgtgattgggccttggaatatcccagggcgggggtcaatcatgtcagtgcatccaggttttgttcgaatggctcatgctggcactacacagcaggcagttagtgaggcagggcatctggctgggcgtgtggtcccagctgctcggcatctcgctcccacccccccaaccccccaccccccttggagtaataagcagccnnnnnnnnnntgtcaatcatgtcagcgcatccaggttttgttcaaatggctcatgctggcactacaaagcaggcagttattgaggcagggcatctggctgggcgtgtgctcccagctgcttggcatctcgctcccactcccccaccccccaacccgccttggagtaataagcagccccaccccctccacacaccacagcacgagggcgtgcggcatcatgaaccagtgcctgatggagctggcgccgcgctaccccgcaaccaagttcctgcgcatcgtggcgtcaaactgcatcccggggtaccccgacgccaacacccccacgctgctgctgtaccgggggggcaagtgcgagcagaccctggtggggctggagcgctttggcggccaggccaccagcccagacctgattgccatctcactgaaccggtttggggcggtgtgcggcgaccccgacgacgccgcggtggcggcggagcagctcgcgggggtggtggcggccgccgccgctcggaggggtgaaggcgatggggagggggactcggactgagagcccggggcttggacgcgttgatgtaatgacgatgtgctcacatgcctaagccatgtaccgccaatgatgggagaagaatagcataccgacggagtagggacaggtctgattgggttacagccaagggaacaaatcatggtgggaagagtgagttgtctgttcccagtcccggggtgcccctggggtccgnnnnnnnnnncgggcttggacatgttgatgtaaggacgatatgctcacatgcctgagccatataccgccaatgatgggagaagaatagcataccgacggagtggggaccggtctgattgggttacagccgagggagcaactcatggtgggaagagtgacttgtctattcccagtcccggggtgcccctggggtccgccatggggtccgccatgggatccgccagcgcctcctactcgagttgctctgtaaaggcatagagtggcgttgcatgtcggcatggccgttgcagatctacacatgctcttccctggtcagtattcatgaggagcatcaattcaaattctcgcctagtcggacccatgcctgcatgaacccctccccagcccgacccatgcatggcggagcgcgctcggtgctggcatcggggccgccgcatggcgctggagaatgccggacccccgaccggctcttgaagggtccttggcgtggtcgaccatctgtgcatggccggtcatcaacgcaggccagcccccaccccggcgacgctgccggcaatgatgcgggctcgggcatcctgtccgtggacgaactagatcggattgcgaggcacaggtgccacatgaaggtgtttgtcgaggtggtagagtattggttggtgctcatgacagcatgtcggtctctgctggtgtctcctcgtcatgggtcaggggggaaggggggggattaaaaacccctctcacgaactgcgagtctcactcgctgttggccagccgtcaccgcctcacccagtgcacatcatccccagctgcgttctcccatgcatttacacgcaggggcctcagcatccgcttgacatcgcttgggcccgcctaccgaatagcatgccgcgatgagggtggtgccatcctgggagtcacccagggtttcaaggtgcccctcttcccaattctgcatgcggacaccatgcaagtccagcgtccccgccgcatgggagcaggtagtttctgggccgtggtggaattgctgcgctggtgaccagggcaatgatgcaaaggtggggtgctgcctctgaacccccaccctttacctgctcttgtttcagtcagggttccccacaccggtgcaacatgaggcttcccacatggcccccccgggccgcgcctggtcatgcaggtggaaaaccagccggcgggccggcacccaggttcaagcggcannnnnnnnnntgctgcgcctggtcatgcaggtggagaaccaggcggcgggccggcacccaggttcaagcggcaaggcctgcacggcctggggctgctcctgtttgtggccacgctcgcccacgccgctgcgtgcggctgccagcgcatcgagatgctggccatcaacgacgcaggtggaggagattttggctggcagaaggtatacatgcattctgaaatgttggcacgttgacaggagcccggccaggaccggaacatcacgcatatatggaagacctttcaggccctgcccgcctgcctcctgcagaggacacgcatgcccgcctggtgcggtactaccggcgcctgggcttcgtggcgcgcagggacgtccgcggcgagcggctgtcggatgtgccgcacctgctcgtctggggcgggcgggggctgcgcatggacggcgacgtggcggccctcacgcggcggtgggccccagtggtgagggccggggcccagtccgaggtgtgaggactactacagcactgtgggccagaactgctgcgctcccgcgtcctccgctccgagtctcgccagcgagccgtggagcagcccaggccagtcccgcctcacgccgccttttgcttgacgnnnnnnnnnnagcgtgaagactactacagcactgtgggccagagttgctgcgctcctgcgtcctccgcaccgagtctcgccagcgagccgtagagcagcccaggccggtcccgcctcacgccgccttttgcttgacgaggcgggcccacgatttcctgaggctccaccccaggccggcctgcggttatcgtgccggggcgggctggtgtcgctcgcgggcagcatcagcatcaggggccatgctccccaagcactcctctggaaccctgagcagtccccattgctttgatgaataaccccgatataccacctcataaacgcacctttcctcgaagaaagactgaaacaggtcgaagttgtaccttgcttggattgggctgacccttgagcgggggcttcgtcgtggcccattggtgaccaccgtggagggcccggatccctgagacctcctcctccaacgcgtcctttgaccgccgctggcggatgctctcattcatctttccagcattacaaacgcaccggggctcattggggttgggatcataaacatagggtnnnnnnnnnnattccagcattacaaacgcaccggggttcattgggactgggatcataaacatagggtnnnnnnnnnncgggccccgatcgcaacaggccccaaaggggggctcgtttggtggcacatgggctctggaatccgacacgcagggaccagatgcagaggcttgtaaggnnnnnnnnnngctccccccggctcgcccgcgtttggactgtcgagactgtcgagggcgagagatgcctgctgcgggcccgatcgcaacaggccccaaaagggggctcgtttggtggcacatcggctctgtaatccgacacgcggggactagatgcagaggcttgtaaggtcttcattcctcgctcttccatccggagttctgccggagtagctagtggcccaaccccacgatcaagggggagagggcggaggctgacacccccacccgccgctgcgatgtcccgcctgttgctgttggcattgcttcttgggatctgtgcggccnnnnnnnnnntgtagctcgtggccgaaccccacgatcaagggggagagtgcggaggctgacacccccaccagccgctgcgatgtcccgcctgttgcttttggcattgcttcttgggatctgtgcggccgctcccgcctccgatgtcgagaccctggagatcacgagcgcagatcgcaaggtggttccagcaggcgggcaggaccggtgcactgcatgtcttgctggagcggctcgcaaccctcagaccctacccgccacccctctgcccagctccgcgcgctgggctaccgtgtccagatcaggaccagcatcgccgttgttaacacgggcaaggccccggtgagcagcttcacatactgcgagcccgccagccaccaccgctccagcgccgcctttgaggcaagttttcacaattcgaccagtggaggagggtctggtcctggagccttttcatgaacagtgccccttcggtaactttccacaccgatcccgtgcccggtgtgccatgggtcgtccccaccacnnnnnnnnnngacagtgccccttcgataagtttccacaccgatcccgcgcccggtgtgccatgggtcgtccccaccacaccattgccgcccctttcaaataccagatcgcgtcgtccagctccgggcagagggagacgccgctgaagggcgccctggtggtcctccccgaggcaccccacaacgtcacctgcctgcgattccagctgaacgccccccttccgcccaaaggcaccctcgactttgaggtggtgggcgtgtatgtcgggaccctggagccctggcccaggcaggcccccgccgacgcacccaccctggccctctatcgtgacagtgccgcgctggtgtcgccctacccgnnnnnnnnnncaccctggagccctggcccaggcaggccccggccgacgcacccaccctggccctctaccgcgacagtgccgcgctggtgtcgccctacccggtccgccagcagaccttcaaggtggggcggcacgcttgagggaactagatgtacaggggttgcacaggcatccaagtggctgacgccgctgatttggatggccgccgtgccgggcggtgaccgccagcccttccatggagccccaccacaactcgagcaacttcccccccccctcccccccccgcgtgccagatggaactgggcaggattgagtcggtggaggcgcccggcgcggaggtcacaacgaaggggcagggcgccgaggtgcgggccccgggcgccaccccccccttccgccagctccccttcgccgcccacttcgaggtggtgggcctgtttgtgaagggccgctcggcgcgccgccgcgtcgacgtcagccccgtgggcgcgtcccagttcgacgaggagtacgaggtggtgagtcggcgggatggggaggaaagggcagcagggtcgccaggcggcacgactccctgccaggggcgggtgctgggtaggggaggtgtccggtgcaccatggggcggggccgctccctttgtaggccttgcggccgaactctgagctcttgcagaggggtgcactggctgccggacccctgcaaacagcgccccagcccagctggaccgcggcaggcactcaggtgcacacactcaggccaggctgaatcccctcacacacacatgctcacgcatacacacgcacacacacacacgcgcaacccccgcaggagcaccgaggcgcggcgctgaagggcgagtggtcccggctggactacatctcgcgcacgaagaagtacggccccggcgccgtcagcggcctgcatgccacgggtgcgcgtcggtggtggtcgagtgggccgagctggggtgggtcggggccagctgtgccgagacacagccggcgtggcatgccccctcgcgcagctagatcgccggcgtgcatcgctgcggcagcttgccctccagatgccccgccccggactcctgggtttcctgcgtctnnnnnnnnnnttgcatgtcacgggtgcgcgtcgatggtggtcaagtgggccgagctgggctgggtcggggccagctgtgccgagacgcggccggcgtggcatgccccctcgcgcagctagattgccagcgtgcatcactgcggcagcttgccctccaggtgcgccgccccggactcctgggtttcctgcgtcttgaccccctgtcctccctgcctttgccaggcttgccagccaacgcggccaacctctacttccgcgacggcatcggcaacatctcctcctctgccgtccaacgcactgataccggggtgggtggccatgacggcggtagctcggattagcgtgccttgctggcgaccttgtgtgatggtctgcagccctggggctggccgaggcaggctgggtatgccgcattgagcgtgccgcctgtcagagccatggaggcggagctctccgtccctggcgcccgcgacaaaacctgcgccttgttcatccagatcttgaaaggccttcccatcctcgacccccctcccacaggtgcgagtgctcctccagccccgctaccctctctttggcggctggaccacagacttcaagtttgggtggtctgccgagggcgtcgtagcgcccgggccggcgccggggaccctcacgctctcgatcacctttggtcccagcgtcaccgaggtggcctttgacgaggcggagctcaaggtaaagtttcctgggcttgatgcgacggcacgaatcgcttgctgtcagcagtgtgtgcggggctggacatctgaggagggcccggctggaccctgaaactgaagcacgcgctgcttcaccctcacaggtgattctgccgccaggggcaactctgctcaacgtggagcttcccatggaagtggagcggaggttggaggtcacgtgagttgggtggtgtcaagcgaaccccctggacaagggcatggcggtcttgacctagaatgcttcaagggcacctgaggccgctgtgacccccatgaggattgcaggggttgggcgcaggatctcaagatattctcccgaatctctgcagtcgagctgtgaggcatgtctacgggcttgctctgtgccgtttcacagccagaatcttgctcccccactcccacccctacttccacgtcctannnnnnnnnncgccattccacagccagaatcttggtccccactcccacccctacttccacgtcctaccccctattgccgcaggcacgacttcctttctctggtcggacggactgtggtcgtactgcgaaggcccatgtacgtacccgaactcaacgttcccctccgcgtgaccttcaagccggggggcacgatactggaaaagtctaccgcatggctcgtgacgggcgcggccctggtggcgggagcgagcatcgtgcgacggatcgcctccagctgaaggacgaggcggtcgcatgccgcattttaatgttaacaggccctatccagacattccgatcttgttagggggtcggggggaatgaatcaccaacaaggtgggtatggcgggggcgagatcagccccgccaagaaaactcgggatggagccgcacgtcggagccttgctctcacgcgcgcatgcatgcgcaagtcccagacaccatgcaacgagttccattcgtgaatgtgcctttcgacacaaagtgcaactcgtgccccgggtgcacgaatggcattacgcttacgtaagnnnnnnnnnntaacgagttgcattcgtgaatgcgcctttcgacacaaagtgcaactcgtgtcccaggtgcacgaatggcattacgcttacgtaagcttcaatgtacggcgctgcaggtgtggggccgaccaatacaaaaagggaggagggatcaattctgccggtgcagcgacggcatgccagcagcataagaaaacattctacggaatctttgggcaatggacgcttctaccttctcgagtactcttgtccacccctcagtgactgtgtgggggatctgggagaggcatcacgggcacatcgccatctgacgccagggcgaagctctgtcttcatggcagcaggccaggcagtgagtgcatgtcaatccgtcatgctttcatttgtttactaattcctcgctccgactctacaggtcatacgcgaggnnnnnnnnnnaccaggcagtgagtgcatgtcaatccgtcaggctttcatttgtatactaatcaatcgctccgactctacaggtcatacgcgaggccctttcttatgtgtgagtaaggttggcgaagcatggccaaaatgacctggcaagcaagcggctgctgcccatcgggcccgcgaatagactgtacaacaatcaaatgatgtgccgcgcgtcgcgtttgatctgcaatgcagtttgcagacgctcaatgaatgggaagacggtgactgccttgaacactggaggccgtgcggcaagtcttcccaagctggtatttgaacgtgtaccaagtgaggagttcaaaaagtgactgcatcgaattgtgccgcacaaggaatccggaagaggctccttcttcgtaggtccacggcgacctggtttgtcaagacggcaatcggaaggggggtggggtgggcccatgccggcttccaagatcctgccgtctggctccccctcccagccgttggagggcgacatgccgtgcacccacatgtcactgatgtgaaaagggcatcatatcttcaacaagacaaccatttcatgctcgattcgaccgaagccccttgcatgggcgcacgggtgtctgcggggaagttccaagactttcgcgagagcgccgcgcctttctttctattggtcgctcccatcaacctgtgtgctcggcgccgttcatgagcacaggagcgcgtcgggacagggcaactcgacgcatgattgaaggtttattgggcgtaattgatgcctttcgagctccatcacagcagtggacaggcctgagtgatcgcgagagcccccaccccgtggctcccccccaacccgacttggatcgagcaaggtgcattggacggcgactaggggctctcaggcacgtcgttctagcttcttgaacacattacatggtacttggtgtattaatatcggcccacccacccagtgcaggtcggcgttgcatcgaccgcggcttatacagctttacgagggcaatcgttaggcacccccaagagttcgtcccgtcacccctggcatggcctaagagctagcaggcctgccgcaccagtctcctgaaggctcgaaacctgggctacacccccgccatgttccctttggctgcctcgttcggcggctactacgccctgtacgtggcggttctgactgcgtcagtccgcctggcggtgttcctctcctgcctcgtctccgcggaccggctcatcaacatcagcaaatttgtctacttcaagatccgtgccaggctgacgggccacctcccggagcacgactgggccttcccagacctgccccatgaccccgctgcataccccaaggtaggtggacgagggactctggggggcaggtctgtgctagctttccgtccaatgtgaaacaaggggggcattgacgcgtgcctttgggtccggggctccgcccagcaccaggggtcgagttgctggcgtgtgactgccatgctgagccgccgcccaaccacccaactcacaacaggtggcggtccagctccccatgttcaacgagcgcgccgtgtgccaggccatcatcgactgctgctgcgagctgcactggcccacgcagcgcctgaagatccaggtgctggacgactccaccgacactgtgacccgccagctggtggatgacaaggtgctggaatggtcggagcgcggcctggacatcgagtgcctgcgccgcaccaaccgccagggctacaaggccggcgcaatgaaggaggtgggtgtttcaggggtgtttttgggggggggggggggggggggggg

SEQ ID NO: 40053 - DNA, 109 bp, Chlorella protothecoides
ggatcccagcagcaggttgtaggccacaaacggggtggtcgcggccaggaagcggggccagcgtgcgtcagtcccgacgacttcgtgcatcagggccgggggtgccccg

SEQ ID NO: 40054 - DNA, 126 bp, Chlorella protothecoides
cctcgcagggcacggggggagccttccggacgttgccgcccggctggcgggcgagcggggagagcacggcgccgctcggtgccggatcgggccccatcgtgggcgccgtcgcttgcgacacgccgg

SEQ ID NO: 40055 - DNA, 61 bp, Chlorella protothecoides
catttcagagtagtgtgtactgagaaattagacaacccaaccctccggcgggggccctggc

SEQ ID NO: 40056 - DNA, 376 bp, Chlorella protothecoides
  modified_base (115)..(295): a, c, t, g, unknown or other
agctggtactcgtacatgccgggcctgggggtgtttgggtttcggaagggggaagtagtggggtggggggatgcagggcagtcacactctcctacaccgaggcaaggtggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacacacacacacaaaaaaaaagaaacccacatacctgaccgcttgcaggaccctgatgtgggcacttgcagccacgcg

SEQ ID NO: 40057 - DNA, 130 bp, Chlorella protothecoides
gctctttgccgacgagcgcaacgtcgcccacgactcgccggactccaacctgctggcggctcgcgagggcctgctctccaagatccctgtgccggccgaacaggtgctggccatccgggagggggtcggc

SEQ ID NO: 40058 - DNA, 449 bp, Chlorella protothecoides
  modified_base (120)..(378): a, c, t, g, unknown or other
ccagcaaagttttctttcttgaaagaagtacagtggatccctcggacagcccagacagcaggttggcaaggttctgaaaaatggtgatgttgatcaggctataatgctgccaaaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcagcagccctaattaagggctttcgatgtatgtgcaggcccatgcaagccccaaaccttgcgatatg

SEQ ID NO: 40059 - DNA, 62 bp, Chlorella protothecoides
ttgatagctggtcatccttgaactggagcgccgtggagggtggggagggtttcagtgattct

SEQ ID NO: 40060 - DNA, 75 bp, Chlorella protothecoides
ctgcgaacctctgaagagcgctcaccgagctctacagattggattgattcgtgtagcattccgttgtcgactgcg

SEQ ID NO: 40061 - DNA, 77 bp, Chlorella protothecoides
ccccccccccccccccccccccccctgggcccccagcaacactccttacactccctcacccctcgtgcacagacccc

SEQ ID NO: 40062 - DNA, 80 bp, Chlorella protothecoides
tgatggagtgacggctgccttggtgctgccaaggacagcgttgacaaagtttgccctccaccctgagctactccccacat

SEQ ID NO: 40063 - DNA, 1439 bp, Chlorella protothecoides
  modified_base (256)..(265): a, c, t, g, unknown or other
  modified_base (399)..(408): a, c, t, g, unknown or other
  modified_base (1033)..(1042): a, c, t, g, unknown or other
  modified_base (1132)..(1264): a, c, t, g, unknown or other
cagggccacttggaccgccaggtccgcgcgcaggcgcgcgttctccagggtcagggcctgcagcgggtcggcggcctgacagggcgcgccgtcggtgccgcgcgccggggtccccggctgcgcgcccgcgtccccgccctgcgatccctccccgcccggcacggaccgggcgccgctgctcagcagcatggccgacgcgtcccagggcagctgtgtgaggggtccagagaggaggggggggggggggggggggggnnnnnnnnnncccactcacgacccgcacatcctcccccttcctgactcccaccggcgcacatacctggaaagcatacacgtcctccacgccgacggccagcacggcgccgtcggcgtcgcccggcacgtggatctggcagtgcnnnnnnnnnntgctggtagacgaagggcaggggcaacactgcttgcacacggcggcatctcggcaccacaccgttcccacccccctggcacccaggacaccactcacgacccgcacgtcctcccccttcccgcctcccaccggcgcacatacctggaaggcatacacgtcctccacgccaactgccagcacggcgccgtccgcgtcgcccggcacgtggatctggcagtgcggcggcggcgcgaccaggcccatggcttccagcagcgcgcccgggacgaagcgctcgatgtgcgagcggaagcggtcgcgcgtggcggcctccttctcgcggaaggtgcccaccttctccgccagcgtggccgcgtactgcccgtaccgctcgatgaaggtgcgcctggcgatgaggtgtgtgtgtgtgggggggggacagggtctggtgggaagctggggcatgcctcgacctccctggacgtgcgagaggccctccattaccccaatcccccaagacacacacaggaacacacgtcaaccaccctccctcgcgcacctgcgcaggcactcggccaggcactgcttgtaggcggcggggacgcggcgcagttgacccaggcgcgtcacccagcccgcctgccnnnnnnnnnntgtggggccctccattacccccagtcccccaagacacacacagggacacgcgtcaacccccctccctcgcgcacctgcgcaggcactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcggtagagcgccaggcggttgcccaggtcccgcatgcgcccctgctgcaccgcgatgctctgcagctgggccacggcctcagcggccagcacgtgccgcgcgcgcgcgaccgcgctcagcagcgccgccgcgcccgcgtccagctcggccaggcgcggcagcgtggcgcccg

SEQ ID NO: 40064 - DNA, 61 bp, Chlorella protothecoides
caacagtgccccgattgcagctgcggagggtgcaaggacagggcatttccccgcccagatc

SEQ ID NO: 40065 - DNA, 61 bp, Chlorella protothecoides
tacgcgggctacgccgcagcatcgcatggcatgccccccgatgtcgttcatgtggccctag

SEQ ID NO: 40066 - DNA, 84 bp, Chlorella protothecoides
gctgcatggcatgctcccaaaccctcaccagacaccaaacggccatcttgtattccccgtcccttcctaccacttgcaggagaa

SEQ ID NO: 40067 - DNA, 75 bp, Chlorella protothecoides
gagagtgcagggccacactcctgcctcaacaacattccgatagctgacccccccccccccccccccccccccccc

SEQ ID NO: 40068 - DNA, 92 bp, Chlorella protothecoides
tatgagattccccctcccccttcgacatatccactacctccgtcaagtcccatcatcagctttcccacctctgcttgggcctctccacccgc

SEQ ID NO: 40069 - DNA, 61 bp, Chlorella protothecoides
cccccctgcaggtctacctgtcctacatgtggaaccccctgtcctgggccatggaggcagc

SEQ ID NO: 40070 - DNA, 76 bp, Chlorella protothecoides
gggtgtcgacgaatctgctggcgcagcgttagcgtcgcgctttaaccctttcaacctgcgtgggcgtcttggctct

SEQ ID NO: 40071 - DNA, 61 bp, Chlorella protothecoides
agctccatccacgcaacgaccctgctcaccagcaaagaagatgaacacgccccacttcatg

SEQ ID NO: 40072 - DNA, 68 bp, Chlorella protothecoides
cgatgacccccaggccagaatactcacccctgggcccgcccccccgtctcctcacgcccggcaggtga

SEQ ID NO: 40073 - DNA, 67 bp, Chlorella protothecoides
ccacgaacagatacaggtgcggggcgggcgggcgtgcttgtcagtgggagggtctggtgcccgggcg

SEQ ID NO: 40074 - DNA, 156 bp, Chlorella protothecoides
ctccgcagcagccagggaggtggggttcagggctggaagggggtgggtacggggtggagatgggggaaggggaaggggtgccggagcacagcccgcaagtcctgatcacacaaaagttgccagcgaagctgtgatgatccactgcaatcatggtag

SEQ ID NO: 40075 - DNA, 87 bp, Chlorella protothecoides
cctctgcagcccgagatgccactctctcctcctcacaccggaacattcaccccccacccacaaccacgagcaggtacctggaccggc

SEQ ID NO: 40076 - DNA, 16206 bp, Chlorella protothecoides
  modified_base (923)..(932): a, c, t, g, unknown or other
  modified_base (1648)..(1657): a, c, t, g, unknown or other
  modified_base (2350)..(2359): a, c, t, g, unknown or other
  modified_base (3166)..(3175): a, c, t, g, unknown or other
  modified_base (7109)..(7118): a, c, t, g, unknown or other
  modified_base (7300)..(7309): a, c, t, g, unknown or other
  modified_base (7730)..(7739): a, c, t, g, unknown or other
  modified_base (8723)..(8732): a, c, t, g, unknown or other
  modified_base (9519)..(9528): a, c, t, g, unknown or other
  modified_base (10001)..(10010): a, c, t, g, unknown or other
  modified_base (10182)..(10231): a, c, t, g, unknown or other
  modified_base (10474)..(10483): a, c, t, g, unknown or other
  modified_base (11132)..(11141): a, c, t, g, unknown or other
  modified_base (11582)..(11591): a, c, t, g, unknown or other
  modified_base (13462)..(13471): a, c, t, g, unknown or other
  modified_base (13801)..(13810): a, c, t, g, unknown or other
  modified_base (14248)..(14257): a, c, t, g, unknown or other
  modified_base (15158)..(15225): a, c, t, g, unknown or other
  modified_base (15554)..(15563): a, c, t, g, unknown or other
  modified_base (15643)..(15850): a, c, t, g, unknown or other
gggtggtggggggagggtgggggggggcaaggtctcccacgcggctccgcttgcgggttccatggcaggtgtgacgcatgggcgcccagggaagggcgccaggccctgctctccagcgcctgaacggcccaccgccacccacttcaacacgccaggaccgcccgtcacctgacggcagggatgcgccacagcgaggtgtgctccagcgcggcgtcggcggcggaaccctgcggggcgccgccgccgcttgccgccccgtccaggccctcggtcgcatcctcctcggtctcgccctcctccgcagcccccccctgcgtcgctgcatcagccgccgcctcggtggccgcccggcgcatgcccagcatctcggcggtccgagcgtccaggccatcctccagctccctgagacgagccaggagggggacggaggatgcctggtcgacaggcggtccacggtctccacagcgccacatcagcagagcgacccctcggggagccatcagctcagcgccccgcgccggcctgccacaaccctgctcaaccgctcacacacacgcacgcacacctctgccgcgccagcgccgcgtccagcttcccctgcagggccagcacctggccgtcgcgctcgcccagacgctgagtcagcgcggtcatgatgtctcgctgcttgcacagcagcacgcggtaccgctcgacctgggggcgggtggaatgtgtcccagggatggtgagggtgggggtgcgagtcccggtctgcagcgccgggcaggcacgttgggtttgacagagggtcgcatgcagtgtggcgccccgccagcgccgtgcgcgggcggctcagagcgatggcaggcccagaacagcaccccaccgaccctcggcccatccaccgtcatcccacccgggccatgctctctcaaacaatnnnnnnnnnngtgcgagtgccggtctgcagcgccgggcaggcacgctgggtttgacagagggtcgcatgcagtgcggcgccccgccggcgccgtgcgcgggcggctcggggcgaccgcaggcccagaagagcaccccaccgaccctctgcccatccaccgtcctcccacccgggccatgctctctcaaacaattctcccgctggcgggactccctccgctccccctcccagcacacctgggcgtgcccctcggccatgacctcgcgctccgcctccagctccgccaggcgcgcttggtactggccccggatccggtcctgctctgcggccagcagctggcggaactggggcgtgtcctccacgcggtgcccccccaccagcagctgggactgcatgagggagatgcggccctgcagcgccgccatggccgccttgtgccgcatgatctccgcgctctgacgctccagcgccgagatggccgccagcttgtccgcctgctcgcgccggcgcgccgcgtccagctgcacgtgtcggatcgattttgcgtggagtgccgaggctgggcatcagtgtcccggggatgcgctccgccccccggacacaggcgccggcggcgtgcagggcgccggccctggggccctcctgcgctgacccggtgatggcatggcgatcctctccacccctgccccccccggcatccactcacctccaggagcaggcgcttgnnnnnnnnnncgtcccggggatgcgctccaaccccgcacacaggcgccggcggagtgcagggcgccggccctggggcccccctgcgctgacccggtgatggcacggcgaccctctccacccctgcccccccacatccactcacctccaggagcaggcgcttgtccaccaggtccttggacttttgctggagctcggcgcgcagcctgcgcagctccagctcgtacttcctcagcagcgtccggtggtccaggtcctcgttcaccgtcggcgcattcctcacgttcttcgcccggttggcaaacttgagcgtggacagcgactctgtgcggtgcagggcgccggtcggggtggagggagatggtgtgtgtgggcgtgacgtcggacgattcacaccgacaaaccctgggtgcacacttcacgctcgaacgcgcccctccccgccgcgtccccgacctgagtaggcctccaccgccgggctgatcatggccaggaaggtggtcttgcaattgccgcccaaggagtcctccaggatcctcgtcagcttgctgtccctgtgagggcagggagggggcagggtcagacgcctcatggtgtggggctgcaccggagcgtgggcgggtcgggagggctgcctcgctcggcagtggagcagagcgcgcagccccgtgagctccccccctccctcggcactcccccggccgnnnnnnnnnnggctcgtgagtggagcagagcgcgcagccccgcgagatccccccctccctcggcactcccccggccgggcggtgctcccgcgcctccgcacccctcgtacacccctcatccaccacccggtgcccctcgtcccagcagcacccttctccaccgccattcctccgacacccccacccgccggggcgcagcctcaacccccccccacccacctgtagggcacgtggggctttccctcgcgccctgcgcgcgcgccgcccgccagcgcggagatgacgttgcccagcgtggacaggctctggttgatcttcttgctctcctccaggcgctgccccgtggcccccgtcacgtgcacgcgctcgctgccggccaggtccaccaggttcagcttgcccacgcgcaccgtctgacgcagggcgggccccgtgccgggcacgccggccagctccatggccgccgccaggccggcggccgaggcgccgcctgggccgtcgtccagcagcaccgccttctccaccgtcagcatgaagatggcgtgggagcgggagctggcctcgttcagcttggtggcccccgtcgtgcgccccgcggcgcccttgcgcatcagcatgaagacctggcgtgcggggcggggggtcagcatccccggcagggccaggggcagggcatgcggcgcgggaagacaggggcacaggcaggccacggggcgtgcccggcaggacaccccctcttccgcaccaggcctcgccggcacccgccggcccccaccatgccctgcgcggccaggaggagccgcacccgatccccggnnnnnnnnnncacctggcgtgcggggcagggggtcagcatccccagcaggcccaggggcagggcatgcggcgcgggaagaaaggggcacaggcaggccacggggcgtgcccggcaggacacccctatttcgcaccaggcctcgccggcatccgccggtccccaccacgccccgcacggccaggaggagccgcacccgatccccggccccccgacgcccgccccccgacgccccacctcgcccgggctgcgcacaacccactcggagaggccctccacatgcacgccgcgtcgccggtcctcccgaacccccaggttcccggggccgggcttgagcaggtccgatatgacctgcaggcatgggtcggggggttgagggagtgaggtgtgcgtctggatggtaccccagccaccacctgcccccctcaccggccacaccatggacgtgccatctcactcctcccatcctttgcccaaggcagacccgcccgccctcccccctcgcacacctcgttgtagatctggaggtaggaggcccgcaccaggaagcggcagcgctcccccgtgtcccgcgcgatgctggagaagacgtcctggatggcgcgggggatgatgccagaccggtcgctgccctcctccccctccatcgtgaaggtcttccctgtccccgtctggccgtaggcgatgatggacgcgttgtagccctgagcgggggaggcacgtgtgagcagggggagggggtgatggcgggggtaaacatgtcgcacccccgccgcaccgccgcatgccgagtgcggcgccccgcatcccccgtgccccgcccacctgcaggacgttgaggaccgccggccgggcgcactgcgcatacacctcctcctggctggagctggggccgtacacggtgtcaaacgtgaagcggtaggagttgtacagctgcaacgcagggaggatgggaggcggctccgctgagcatgcggaggagatgcgggcgttcggccgtgtcggcagagccactgacaggccaccgagattcagggatggtggcaggaagacgtggtgatccaaccatctggcacacgaccccgcacccaccatgccattttccacgccattgttgctgagtgccgccaggttctcggccagggtgatgatcttggaggaggggtccaccgccacagcattctgatacggctggtacccattcagttccctggggagcgggggccgcaccctgacgaccacctgtggtggtcaggggtagggcaacgaggtgcgagggcgcggcacctgcggctaccgtggggggtgcacactgcgtgtgtgggaagaccacgttgacaccttcatgcacggctgagcaggttgttccgagatatgtgccctgtgcgagtacatttcccaacgctaccttgaccgctccatcgtcgtcgctgtaggtggtgcgcgcggagagcgggccggactcgttggaccgcgacagtccgtgctcgctggagctggttggcccggctgacgcactggtctgggccaggctcagcccggtcaattcggttccaaaggatggattcattggtttgtggaagttcaagatggctgaggggtgtcagagtcaatcggaaagggcaattgcggcatggacgcccccacgacccaaggcacttgagagacagactgcgaccagggggtgctactcccgtagggtgcgaggggtggctgactcctcgaagatggactacgaattccacatctcgagatgcgacccagattccgagtcccgtgcatcttcattatccgactacgacctgacggacgtgaatcgaaaatcgaagaggctcctgcgggtggaaaggatgggtccgctgcaacattgtgccccatggggaccagcacagaggtgcgcatccatccatgccatatgtacatatacatatgtcgcactcacacgcgtttttcatggtatggcggttccaaatgtgcatgaggggtgcagcgatggtcacatcgcccatgccctgctgcctcgtcccggcagcttgtcgctgaccgacaggggcctcatgggagcagatcatacaagcatggaaggcctggccgctgaatttgcatcatgccttcttgtaatgcggctatctttgccaatcaaagtaggtggaaaccgaccctgtggcggggtaaggagagggtgcttcacccagccaaaagtgatgacgccctctcctgtcctgtccctaatccagagagggacattggtggcccacctgagtgcaaacacgtcccgaggcctgacagccctgctggccagcacagctctgggcggcatcgcagttccactgaaccgcaggtggagtgcaaagcagagcgctggggcgctgcatcgcttaggctgccgcatgctggtgacagaccatggccttgccagcagggcatgtgctgtggtacaggaattgaaggcacgggcgggtgcagggcaaggaccagatgtggagttgctgattctggatggtcgtagtggccagaggggtgcgtcagaggagctgtccttgctgtcccctccaggagcaagaacggtcaaggaatgtgagtgtgtcttggtctaatatccttcttgcaggcatcccatttgggtccaatgtactgaattgcaagcacctgctctgcccaggcgctgcggctcatcccttgctcccatgtgcaactttctgtacagcccaacttctactgccggcatcgccgacatgcctgggtccaccactgaccggcccacatggagctgccgttctcattttcacctctgggaccacaaagcaacccaaggcggtggggctcagccatgccgccctcctgtcccagagttgcgccaagattgccacggtgaggatggtggtgtggtggggaggtgtttcttattacagggtcgctccttgggggtttcagcttgggcccttggtgcgaggatccactcctcaccagctccacgctaccactcctcccgcgagtatcccccatttccctgcccaccccttacatgaatctaaagctgggtctatcgagcagtgacaccttcctgcactgcaccgccttcttccatgttgggggcctgcactgggcgctgaccggactggaagcgggtgccagccaggtcttcctccccgactggtcgccggcggccgccctccagatgatcaaagacgccaaagtcacggccattgccctggtgccggctatggcgtatgaccttgtcgctgaggcgcgaaggaaggcaggcggggccaccacggcaccgctggcgggcatgagggtggtgctggtgggcgccggccgcctggaagacgccacgctggcgggcctggcggccctcttcccgcgcgctgtcgtgtgggcggcctacggcctcaccgagtgcgcttcctccctgacctttgcctgtctgagagaacccggggatgacccgggcccggcgatcctggcgccagcccgccgccaggctgggggatgggccgtgggccggccgccagccggcgtcgaggtcgcggtgctgggaggctatggcgacgtgacccgctgcggggagggcgagctggtaacaaggggaccgcacatcatgatgggatactgggcggacggcggtgcgcatcggagccagtccatggcgcagggttggctgaggacgggggatgccggcgcagtcgccgaggacggtgagctggatgacgtcgcagcatgtgtgggttgaggggttgcagtgaggtttgactgcctttggcctagctatgagcatgctccacatagtttgggctggtaacacaactctgaatgctcacgagtcgagatgcctcgcccaagccggtgaggctgtcaggggaaagtgcaacccttttcgagcgggtgtccgctgccgtccaccaccccctgtttccaccgccccagccctgcaccccacgcctcnnnnnnnnnngggggaaagcgcaaccctttccgagcgggtgtccgctgccgttcaccacccgctgttaccaccgccccagccctgcaccccacgcctctcttcaggttcggtctacctgtctggcagactgagcgacaccatccggtcagggggggagagcgtccctgccgggctggtggaggaggccctcnnnnnnnnnncggcagactcagcgacaccatccggtcggggggggagagtgtccctgccgggctggtggaggaggccctccttgccatccacgctgtgcaggaggcagtcgtggtgggcctgcccgatccccgcctgggtcaaacagtggcagccgtcgtggtgttgcgccccgaaccgacggctggcgacgctagtggcccagaaaacagctgcaccaccagcggggcggtgctgcagcgactgcggcagggcggggccttggcgggcttccagcttccgcgcagcatcacaatcatgggtgcaggtgacataccccggacagccacggggaaagtgcggaagcaggagctcgtggcacaactccaggctgtccgggcatccaagctgtaggtggttggggaggcacacagccatttgataccctctctnnnnnnnnnnacgcagcatcacaataatgggtgcaggtgacataccccggacatccactgggaaagtgcggaagcaggagctcgtggcgcaactccaggctgcccaggcatccaagctgtaggtggttgaggaggcacacagccatttgataccctctctaccccttttgtgacacccctctgcgttggctgtttgagaagcagcagccctgcccatcaggcctctcactttgcagtgctatgccgtcatgtgaatgcatgtgttcaatgctcttccctgcaaccacgcagctgtacacgagcactggtcactcaaaataaaaggcaaagacctgcaagtgaagaagaacatgatcccgtctgagtaatggtgacaaggccagggtctaggcgatgttcattatggtgctcaagtcacccagcgaagccctcacctctcccacatcacacatcacacatgccacctggcaactgcagaacaaggtctcgttcacgatggttgccgtcacataaccatccgtctggccatcccagaggcacttgctggaaagcaaggagccttgattggcccgctgaccgtaggtgacgtggacggcgtacttgtatcgtgagtggcccaaggcaacacacatgtctctgacggcggccacgagctcctgcgccagctgcagacattgaggcaagggatgggtgtgtcgcaggatgccaattaaaggagtaggtttggcatctgaccaggttgagagttggtataaggcgctgcagctcatattatggggtgctcggcatgtgctgatgccctttggggcactcaccttggactgctccggtgggctgtacgacgctgactgacatgtggcctggagcaaattctcaacctcccgctgcagacggtccggctcgaacttgctcccctaaaattggagggggatagattctctatcttgtaaaagtatatcatggacaccgcggcagatcgtaaactggttttggnnnnnnnnnngaaattgaaggggggtagattctctgtcttgtaaaggcatatcaccaacaccgcggcagatcgtaaactggttttggcattgcgacactcaccggtccgtggccgtccggccccacgatgtaagtattctcgtatataatgcggcgactgggttcccctaccgatgacatcccgctcatagtattctttcagggggtgtaagatcatctctggatcctcgagaggatgtaccgtacaggcggagacctgccgtggcgcccatgcagaagagtcaaaaggtcaagggagatcccccgtccgccccggacggatccggacggtctggcatgcttgcccaggcatccacatttctcacatgacagattacacggttaaataaagagcgtaccagtttgcggccagggaatcgcatatcgatcacggggaggtgaggtgccatttcctcatgagctcggccccgtcacttcttcctgcttgggaggcaaggtggcgcactgctcgaccctttccacaccctcgcgccctcccagctgctcacagcctccgggggtggccgttccagccgtgtcctgctcctcccactgctccttgccaggagggtcccggcccagccccacatcaccggggacgtcatggggcggcccctctttgggtcgcagcaaataggcgaaagcgtcccgacacgtcggcggccgctgctgcgcctcctgcacacagccagggcaagagcattgtgaaggggcctggcttttgcaggttcagccccggaatgcggacagtggccatnnnnnnnnnnggtcaaggcaagagcattgtgaaggggcctgggttttgcaagttcagccccggaatgcggacagtggccatggcagattgggcaacgctcaccacgcacttgcccaaacatgaagcagcactctttggcactctcgctgcagcctgacctgcttgtttcctacttccctcaccccctcccttcacacatccccctcacctggcacgtggccagcacctccgacgcgcgcgtcagggccgcctcggccagctgccgcgctgtgcacgacgcgcatgaggcggtgtagagccgcgccaggtcaacgtaggccctgcccacggcggggtggcccggcccgagctccgcctccagccgcatcacctgcgcctccgccaggcgggctgcagcgtgcagcgggggcggcggcgctgggcgctcggcgtccgcatccctagtggcgcccgggtcgtccaggcggagctcggcacccgcgnnnnnnnnnngggcggcgctgggcgctcggcgtccgcgtcccgagcggcgtcggggtcgtccaggcggagctcggcacccgcgccgtcgggcgtcgtcgggcgggcgccttcccggcgcgtgaggcggtcgccggcgtcgcgctgggcgtctgaggtcctggccgccgcactggtggcaggnnnnnnnnnnnnnnnnnnnnnnnnnnnnnnnnnnnnnnnnnnnnnnnnnncggcacccgcgcccgagcccactgccagcgctcctgccgccgccggtgcccccagcgccgggtcgggggagctggaccggcgcaactcctctgcggcacaaaggagatccatgagtccgctcacgtctcctgcctcggggggcactgctacagccccgggcggccgggcgaccccagcggcggcctggactgccacagcgaggccgggcaaaaggccgggtgcataccccggcgcggccaggnnnnnnnnnngcccagcggcagcctggactgccacagcgaggccgggcacgaggccgggtgcataccccggcgcggccaggcccagggccgatggggggacgcccgggacggcggccaggtagccactatagccgtctcggacgcggcgggccatgtcctccgcatggtcatcccggaagccaatgcccagctcgatccactcccgcagccaaaacatgccctcgtgggggcggatgaacacgctgcgcccctcccgccgcttgatgtcggtgtacagcgcgctggccatggtggcctcgggcgtcttccccgtgcagcggaccagccgccgggccagggccaggcgcgtgatctcgcctgtgctcatcagccgccgctcggcgcgcagcacctccactgcagcctgcttgaagatgccgccgccctccgggccagcaggcgggcggccggggccggcgggggcgggaggacgccgaggccaggcgccatcgtccgcctcctcgcgcgggctgctcgccgcctcctcctccctgcgcagggacgaggctcgaggttggagccgggacaaacgagtccccaccattcacacaggcatctggcgggcgatcgaccagtcccacgctctgcagccccaggccagtgtcgacaagcagcgggnnnnnnnnnnacattcacacaggcatctggcaggcgatcgaccagtcccacgctttgtagccccaggccagtgtcgacaagcagcggggaggcgatgcattcagaccatctgccctgcaagaccactcatgcctatgctacgcctccatcacccacatcccccccctcccacgcacgatgcagttgggccaccggctgtcctgccggagctgccagagttggcctcggcctcgccatcagggtcggtgccagccccgcctgctagcagggtgggtaccgcggctagggtgccgtcgccccacacctgagaaggggccggcaacgtgaaggctggcccagagcagctcagggagcacggtctacgactgggatgacatcccggccacagacaggtttgttgggggtttgtctagttcatacgacaccaaccactcacaccttgggtttgacnnnnnnnnnncccggggggatgtctagttcatatgacaccaaccactcacaccttgggtttgacgattcgtccactgcggctggtccgcgcgggggcggctagggtggaagcctcgcgctttggcatcctggcaaccaatgcctcagctgattggctggctgctgcgaccaaggatcccactctatttaccagcgatcacgtagaaatatgcagctacctcaggcgccatgccatgccgctcaggacgccgcgctctgctcccgaaaaaggggtcttgccaagaactgggatggggtgcagggtgttggggtcagcagtgtagtgaaaatatcaacgaagatgatccaagttgtgggtcgaaggcttggcaggagggtgtaggggaccttgggtcacgctcgtgtcagacgtccaacacgactcgaaagtccacccatgccgtcgcaaaaatgcgaaagtgcatgcaatatgccagctcctcagttcagggaatcctgtagaccacgttcgcattcgaccttcgcgacatgcacacttgcgacggacatgtcgggtcacagcccgagagcaggaatcagcaacaaggacctgcataccttcaccaccgtgtatgcgcccggaatgtatgttgtatgccaagctggacgtctccagagtcgcactcagaccctggcaggacacccctgatctgcacgtctttcaaacacgaggcctttcccagcagctggatgcacgatccgaaggccggtgtacgtttcgataccgtgttgcattagctcaagcacttttatagagccgagccgcaagccgcaaccaagcaggaggagggacctgggcaacatgctggggccgagggcacgcacgaattgcacggagcagcgtgatgcccgtgagcaaaacacccggatggacgccaatacaccttgcacagtcgacataaaagtttgatgtttctccaactgctgatctgtcttttcatgcgtgcataggaaggttgtgggccttgcagcaccccgcatgtcatacatggtgcccggccggctgaggtgagaggggctggtaggccagattggctcgctcgctctagaggttgcaaggctagcatacggtgctcatcggaccgatgcgggcggtggagttctacagcggccttggaggtggggatgctgataggggtatcggtgggtgtgaggcagctctgctggctgggcttccatcgcggatgcctttccttccctctctccactcaacaccctctcctccaagctgtgactcctctcgcactttccccagccggtgcacacgaagcccgcctcactaaaccaacccctccctccctcgctccaggcttgcactatgcgctggccctggccgtccctggcgcggaggtggtgacggcctttgacatcaacgacaccgccaacgacgtctaccagcacaactttgggcgccggccctcccagtccaacatcgactcgctgaccgcggcgcgcctggaccggctgcgcgccgagctctggctgctctccccgccctgccagccctacacccggcgcggcctgcagcggcagtcggccgacgggcgcgccgcctccttcctctccctgctccggcggctgggggagatgcagcacccgcccaccgccctcctcctggagaacgtggtgggtttcgaggcctccgacacctgcgccgccatgctgcgcacgctgcgcgacctgggctatgccgtgctggaggtgctggcctcgcccaccgacctgggcctgccctactcccggccgcggtactttgcgctggccacgcgggcgcgcggcgccggcctcgcacggcacacgctgccctttgtcgtcgtgcggaggggggagggaggggagccnnnnnnnnnncgcgcgcggcgccggcctggcacggcacacgctgccatttgccgtcgtgcggaggggggagggaggggagcccaccgtcctgccggctcgggagcccacgacgcgccggccgctggcggaattcctggaggccgacccggcggcggagctggcgggcggcgtgcggctcaagctccccgacgacatccgcttcaaggcaacgaatagagggagtggggatgtgcaggcggaggtgggccgcggcgacgcagcagccgaggatccaccgccgtcgccgacgggagcggcggccgcggcaccaggatcggggccgcccctcgcagcagcagnnnnnnnnnntcgtcgccgacgggagcggcagccgcggcactgggatcgggggcgccccttgcagcaccaggatcgggggcgcccctcgtagcagcaggatcgggggcgccccttgcagcagcaggatcgggggtgcccctttcagcaccggcgtctgcgacatgcgacgaccccttccgggtcccagatgtcaccctcctgaagaatggctggtgcatggacgtcgtcaccccctcagcactgcggacctgctgcttcaccaagacctatggccagtacatcaaggtgggcgggagggaagggcggctgggtgggcgcggagcccggggtcttggtccaaatgtccttagcagcggcggggaggcggcacgggctcctccccgccggcgctcgcacaccggcgggcctgctttctacccactggcgcacacccatggatgggacgcnnnnnnnnnntggagcccggggtcttggtccagatgtccttggcagcggcggggaggtggcacgggctcctccccactggcgctcgcacaccggcgggcctgctttccccccactggcgcacacccatggatgggacgccccaccgaccggacacccccatccctgcgccctgcacgcgcaggggtctgggtcggtgctcacgctggccagcgaggacagcgtgcgtggcgtgatgcagcgcttcccctgcctggtgccgggcgggggcggcacggggggggacgcccccgcgcccagcgcggcatccctggccgaggcgctgagggcgctggacctgcgcttcttctcgccgcgggagatcgcaaacctgcacggcttccccccggccttcgccttcccgccagccgtcacgctgcgccagcgctacgccctgctgggcaacagcctgcacgtgggcgtggtggcgaggctgctgggccacctcttcgctggtgcaggggaggcaggcgcgcccggctgagcggtgggccgcggtgtgttggtgcgtgctgcgcagcggctggcgcgccccccacacatccccaggtgcaaggtgttgtggtgccggccaggtccccccgcaacgtgtgctcatgtgcttggtctgcggtggagctgctacagccaaggcgcatgtgcatagggtttcgtggacatgggcggccggcgcgggcactgcgcagagcacggatatcgatgagcagggagggagggctcggggagagcaccacatgacgacttcatgctcgatctcttgctgagtggggctgccacctgctcccgccccggccctgcaacaccatgccgaacatcgaccaagagaagagtgacaatgggtgtgggaggcgtgtcctggccagagcatcacccnnnnnnnnnnnnnnnnnnnnnnnnnnnnnnnnnnnnnnnnnnnnnnnnnnnnnnnnnnnnnnnnnnnntgaagcagacctgtgagagagccctgctgcagcacacacttgacctctcccagaagcaagctcggggaacattcgcttgaatctcttcctgaaagtacacagcgggatccaactgtggggaatgttcagccttaacaggcaagcatgggattgatttgagcagctatgataccattcgcatttgagatgcaaacctcagatcgctccaaatcagagagcccactatcctgtgctcaaaagatctactgtggaagtaatctgcgcgtagagaacaatgcgcggtgatcccgaggtatcaagcttggtactctttgcttggagcttctcannnnnnnnnngcaggcaggcatgggattgatatgagcagctatgataccattcgcattcgagatgcaaacctcagatcgctccaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcatgtatcagactttaaagaaactggctataaagggcgaagaagggaagcgttccctttcccgtgcggcacctgctactgatggcttaggcgatgcagtaccgcgtcctcctcattgtccggtcttccggtgcaccccatggatttcgccgagggggagtgtccggaaagtgccttatactggggcgacaatgaattgcgaatttcaccccaagatgagactttaagagtgtcgatatattaaacgcattgcgtgcgacggaacttctcttggagggagatgtcgcgcactatagacaacatgacccctgaagactggcgcaaagtgtacgttatatacattgatcaaaggc

SEQ ID NO: 40077 - DNA, 61 bp, Chlorella protothecoides
acgcggtccagggccggcccctgcgtggcatacacgcggaaggtgaccagcaggctgtggc

SEQ ID NO: 40078 - DNA, 97 bp, Chlorella protothecoides
caggcacaatggcttggggccagcaagggtcggaacgcatgcggcaatggttggtcaaccccttaccctcctccccctttcctgcacagccatgctc

SEQ ID NO: 40079 - DNA, 69 bp, Chlorella protothecoides
tagttgtatcaacatcaccccgccacacctgtcctgtaaccttgcaggctactgggaacccacatggcg

SEQ ID NO: 40080 - DNA, 148 bp, Chlorella protothecoides
ctgggaaataccggaggtggctggtgtgaggttgctgacggggggggtgatcgtgtgtggctttggagcgtagactcgggcacagcagtgtggcgagctgcctcattccaagcgctggtccatgggtcaggctatgcagtgttcagtg

SEQ ID NO: 40081 - DNA, 80 bp, Chlorella protothecoides
ctcctgcgagccgtgggcagcacaggtgcaggggggatgggtcctggttcctccatgtgctccaggcctgggaggtgccc

SEQ ID NO: 40082 - DNA, 71 bp, Chlorella protothecoides
cacctgtccccatcgcacaggttggggctgcgcaggcaccagctgctgctgctgcacggggacgtacccag

SEQ ID NO: 40083 - DNA, 61 bp, Chlorella protothecoides
gcgtggaactcctttgatgaacaggatgtcgcgttggcgtgttcgtccaccgcggtgaaca

SEQ ID NO: 40084 - DNA, 61 bp, Chlorella protothecoides
cttccagaagcgggagaggacgctgcgctgtgcggcgccgcgcagctcggcctgccgcttc

SEQ ID NO: 40085 - DNA, 70 bp, Chlorella protothecoides
ccctcatcccctcgctccatccctcccccctccctcttcgtaggcacatcgtgatggcagaggatggcgc

SEQ ID NO: 40086 - DNA, 1167 bp, Chlorella protothecoides
  modified_base (241)..(250): a, c, t, g, unknown or other
ggagaatggtggttgcccagcgaggaccctttcttctgtccatgacactgcctgcattgcccatgaaaggtcacgatgtagtcatcgtgttcctcagcgcagtcccctgccggcaacacacgtggtgccaggtccgtgcagcgagcatcctcgcccaccactcagccctcccctcccttctgctcaccttcaggcagggcatcgaggtgcgccaggcccgcgtcggccaggcagcccacgnnnnnnnnnnccagccctcccctcccgtctactcaccttcaggcagggcgtcgaggtgagccaggcccgcgtcggccaggcagcccacgtggaactcgcgctcgcactggtcacagatcatgatggttcgtgggccgaagccgccacgctggaagtcgggctcgtggcacagcacgcagccccccgtcgcgccatcctctgccatcacgatgtgcctacgaagagggaggggggagggatggagcgaggggatgagggcgaggagtgtgcggacctgtgaggcaggcgtgtgcggggtattggcctggcagaccagaccaatcgagggtcaggctgctgccctggacccgccctcggcacgagcctggggccctggccctggtatgacgatgggcacgctccaccatgctgccagccgcacccctcgagcgtgccctggcaccacacggtacacaccccgacagcacaccccctgcgcatgcaccgaccccgctcacccctcgcccgcgtcgtcctcggcccccgcgtcctcccccccctcctccaggtccggcaggaggagggccagctgcttgagcgggatgccgtcggcggtgtagatgttctcgtacggctggcgccgctgcgcgcggccggcgtgcgcctcgaactgggagcaggacacgacggcgccgcagcagtcgcagaggatgccggagggccccatggcagagaccaccgcggtgccgcgcaggagcacctccccctgcgcggtctggtaggacagcgcgtcgccctggcgcagcgcgccctcgcccccctcgaacagccggcggtgcttgttctggttgcgcacgccgcgcgcgccggccacgcggaagtcgcgggagggcgccgccatgcgcacgcggccggggacgtggtcgggcgccgtcgggcgcacgcctc

SEQ ID NO: 40087 - DNA, 104 bp, Chlorella protothecoides
cgccgcgtcgtacaagtggtgcccagggaggggcgggccgtcggtcgcgtgcctggtcctggcaggcgccggggaggaaaggctgctggcgctgcgcggggggt

SEQ ID NO: 40088 - DNA, 61 bp, Chlorella protothecoides
ttggtatctcatccatgcgcctaatttcttatccggcaacctggctatgatgaggtcgtgc

SEQ ID NO: 40089 - DNA, 78 bp, Chlorella protothecoides
atccactgcgactcacaaggccgtcgcaatgccaggggattgagtttgtatcgtgtgtcgccggggtcggtaaagcag

SEQ ID NO: 40090 - DNA, 102 bp, Chlorella protothecoides
gcttgtgtatagagggacgtggagaccctttgcaagcaacgacaagtgtgggagatgccagcccacgcgagtccaagaacatgacctccgaaaggactgcgg

SEQ ID NO: 40091 - DNA, 79 bp, Chlorella protothecoides
cagaaaaggtagatgtcatctggtccatgccggagctgggctcccacacctacccgcccagcaccccccgatcccagcg

SEQ ID NO: 40092 - DNA, 125 bp, Chlorella protothecoides
gtatggcgttcccgccgccacacccatcattcacaaaccatctcctcctccctcccatagccaaggagcccagctgcccgacctccagggtagcgcgggtgtagagctccgtcatcctcctctgg

SEQ ID NO: 40093 - DNA, 61 bp, Chlorella protothecoides
caccacccagcgtacccaccacccagcgtatccaccacccagcgtacccaccacccaactc

SEQ ID NO: 40094 - DNA, 71 bp, Chlorella protothecoides
gggtgggtgccgtgcttgggagtccccacgctgcccagccagggtgtgcccagcggcgactgcggctcctc

SEQ ID NO: 40095 - DNA, 63 bp, Chlorella protothecoides
ccggggcgcacaacattctgatcctggacaacacgaatgtcacacagaagacgtacagcgagt

SEQ ID NO: 40096 - DNA, 103 bp, Chlorella protothecoides
gctctcctcccactgcagctccttgcagacgtgggcgtacaggggtcccgcatctgcaggtggaggcgggtgtctgggtcgagcgccaagagagaggagcgcc

SEQ ID NO: 40097 - DNA, 61 bp, Chlorella protothecoides
gactatgacgacctcggccacctgattggattccatcttgggccggccagggttgaggaag

SEQ ID NO: 40098 - DNA, 789 bp, Chlorella protothecoides
  modified_base (100)..(109): a, c, t, g, unknown or other
  modified_base (446)..(455): a, c, t, g, unknown or other
ggccagcacgccggcatgctccaccttggtttggtgggtttggagggagggagaaaggagagcgagggttggagaagtgtggcgagggggaggggtgcgnnnnnnnnnntccagcaggcccagcgccgcgaggcccaggtcggccagcacgccggcatgctccaccttggtgtggtgggtttggagggtgggagaaaggagggcgagggctggagaagtgtggcgagggtgaggggtgcgagacagccctgacggcccatgccgcacgcggggagcaggcatggtcctggcacccttcctcgatgacccgccacaactctgtttcggcgggagcaccgccgtgagccccttcaccaaccccagactgcccaaagcggctcacccgactgccaagagaatcactgccgccccccttccccctctccaccatctacctggactgccgnnnnnnnnnnaccacaactctgtctcggcaggagcaccgccgtgagcccctccaccaaccccagactgcccaaagcagctcacccgattgccaagagaatcacagccgcccccctttcccccctctccaccatctacctggactgccggcgcggggtcacggggcagcaacgacagcgagggcaggacgtactccagcacgacgctggcgtcccccgccgggacgcgccgcacctcggccagcagcgccacgatgccgcgcagggccgcgcctttgaccccggcgccgtgctcggcggcggccgacaccagcgcgggcagcgcgcgctgcaggcgcacgtcgtc

SEQ ID NO: 40099 - DNA, 62 bp, Chlorella protothecoides
caccgcggacccctcctggattccccaccccccagtttccaaggcgctctgtacctcctggc

SEQ ID NO: 40100 - DNA, 90 bp, Chlorella protothecoides
gagctgggggtggctgtgcgagcgaggggaggctgtgcgagcgaggggaaagctcactcagggcacagggtgctggctggggcatcagag

SEQ ID NO: 40101 - DNA, 61 bp, Chlorella protothecoides
ctctgtccaacctcatcagatcctgcaggcacgggagaaggcggcccgccagcactttgcg

SEQ ID NO: 40102 - DNA, 63 bp, Chlorella protothecoides
ggcagcagccgcgcagcagggctttgcaagcacccccatcatccagccgggctttggggcagc

SEQ ID NO: 40103 - DNA, 101 bp, Chlorella protothecoides
ctggagtcttaagagagagagcatgcgatgagcagcaggcaggccaaggctgactgcagcacggtgccggccatcgcatggggggcaggagacatgtcagg

SEQ ID NO: 40104 - DNA, 125 bp, Chlorella protothecoides
accttttcttctggagtcaggaaccggcggacagccaggccggcgcagcgctgcttgcgctcatgcgcccctcaccctcaccccctccgccggctgagccgcccgtcgcggatgctgccgtcccc

SEQ ID NO: 40105 - DNA, 97 bp, Chlorella protothecoides
tcggtgtctcatgcgcattgggctcttggtaagtgtctcatgcgcatgggccccttcacgttccccatgccgcgatccagcccctctcgtagcccgt

SEQ ID NO: 40106 - DNA, 61 bp, Chlorella protothecoides
gaccagagaggaccggctcgcggcagggggggcaggtgagctaccatctccgttgcgtgcc

SEQ ID NO: 40107 - DNA, 79 bp, Chlorella protothecoides
ggcctggccgatggccttgtcaacctgggggtggatgggtgtgagtggtgctgaggcaagcgctcggccagctccgagt

SEQ ID NO: 40108 - DNA, 89 bp, Chlorella protothecoides
tggaggtgggaagggcggtgcacaccgcaaggcaccgcccaggggcgcaggttcacacccccaaccagcatccagacctgtaccgtggc

SEQ ID NO: 40109 - DNA, 176 bp, Chlorella protothecoides
ggagcgggcggtgcagccggctcgatgcaaaagcagggcactgctccttcgcacgcctcgggctctggccaggccaggccgcaggctggcgactggcagactgctggaccgcctggcgcccagctcgcgacatgcgcgccggcagtgggaaccgtcctcggccccgccctggccct

SEQ ID NO: 40110 - DNA, 61 bp, Chlorella protothecoides
tggcatcatgggtctctgcgtagactgactgtccaggagaagtatgtctggcccttcatcc

SEQ ID NO: 40111 - DNA, 61 bp, Chlorella protothecoides
ctcttctggctcctttgtgcgccccgtcgctcaccatgcaatgcctctgatcgtccttccc

SEQ ID NO: 40112 - DNA, 91 bp, Chlorella protothecoides
gggcataggccgccccgccggcggccgcgacgtcgccgactttgtgctgcaggtaggcacggcaggagtggcggggggggggggggggggg

SEQ ID NO: 40113 - DNA, 61 bp, Chlorella protothecoides
atgtagacagtggatggggaggcgatgggggggtcaagattgtatggtccaattgagttgt

SEQ ID NO: 40114 - DNA, 69 bp, Chlorella protothecoides
actagcccgggtacacggcgcgtaaggagctggcccatacacaccttgtccgatatgagcaccccattc

SEQ ID NO: 40115 - DNA, 61 bp, Chlorella protothecoides
caggcacttgcgcagcggcgggaagtgggggcccacgtcgttcaaggaccggcttgctctt

SEQ ID NO: 40116 - DNA, 61 bp, Chlorella protothecoides
ggagagcatgcgcgggtgtggcatgccggcgcaaggtgcgagcgaccattgtttggcatcg

SEQ ID NO: 40117 - DNA, 97 bp, Chlorella protothecoides
ttgagcacctgtgcataccagtggcaggaacataataagaaaaatggacaagacaaggggcgttctgcgctttccgcgactgctcctgctcacctcc

SEQ ID NO: 40118 - DNA, 78 bp, Chlorella protothecoides
ctgcccgtaggcgtggcaagccattgtcttgttcagtaggcggtccaatgggggcaccgggtcgatttgcccccgccc

SEQ ID NO: 40119 - DNA, 74 bp, Chlorella protothecoides
agacgcgcccgcggggcccgaggagctggcgcagggcctgttcgccacgcagggcggcggcgaaccgcccgagg

SEQ ID NO: 40120 - DNA, 22500 bp, Chlorella protothecoides
  modified_base (4194)..(4203): a, c, t, g, unknown or other
  modified_base (5388)..(5397): a, c, t, g, unknown or other
  modified_base (5676)..(5837): a, c, t, g, unknown or other
  modified_base (5950)..(5959): a, c, t, g, unknown or other
  modified_base (6651)..(6660): a, c, t, g, unknown or other
  modified_base (7471)..(7480): a, c, t, g, unknown or other
  modified_base (8286)..(8295): a, c, t, g, unknown or other
  modified_base (9433)..(9442): a, c, t, g, unknown or other
  modified_base (10040)..(10140): a, c, t, g, unknown or other
  modified_base (10192)..(10201): a, c, t, g, unknown or other
  modified_base (10840)..(10849): a, c, t, g, unknown or other
  modified_base (11399)..(11408): a, c, t, g, unknown or other
  modified_base (13665)..(13674): a, c, t, g, unknown or other
  modified_base (14044)..(14053): a, c, t, g, unknown or other
  modified_base (14143)..(14152): a, c, t, g, unknown or other
  modified_base (15033)..(15042): a, c, t, g, unknown or other
  modified_base (15658)..(15667): a, c, t, g, unknown or other
  modified_base (16052)..(16061): a, c, t, g, unknown or other
  modified_base (16133)..(16142): a, c, t, g, unknown or other
  modified_base (16927)..(16936): a, c, t, g, unknown or other
  modified_base (17421)..(17430): a, c, t, g, unknown or other
  modified_base (18136)..(18145): a, c, t, g, unknown or other
  modified_base (18574)..(18583): a, c, t, g, unknown or other
  modified_base (19276)..(19285): a, c, t, g, unknown or other
  modified_base (19682)..(19691): a, c, t, g, unknown or other
  modified_base (19929)..(19938): a, c, t, g, unknown or other
  modified_base (20825)..(20834): a, c, t, g, unknown or other
gggggggaaggggggcggcgggcggttggggttccaacccaatgagttgcctcatatattgctcgggctgccacaacgctaccaacccctggcccagggactactgcgagggtctgcacgacaccctggacctcgtcgtgatcggcgcatggcacggaagcgggcgcaaggtgggctggtgctcccccttcctcatggccgtctgggacccagacacggagcagctccagagcctgtgccgctgcatgagcgggttctctgacgcattctaccgcgaggccacggagaggtgacattgggcgaggtggtgaggaggggttttgtttgcggagggaagcgtgtgatcgtggcagggggtagaagggatcgttgtgttacgcgcctgcagatgtcacaggggtccatcattccagttggaatgggtttcatgctctccctcatcgcggcttaccgttccctgcacatgcctgctgcccttccccaaattgtgtgccatgctcaatccctcttccaggctgaaggccaccgagattcctgggcccaaggcgtactatgacaccagcgagtcgccagacatgtggtttgagccacgcgaggtctgggagatccgcggggcagacctcagcctgtcgccggtgagtgtcatggaggagttgtgagggggagaaccatgcaccggcgatcgcccagtgattgtgcctgctcctgatctaccagtggtgctggcaggggaatgcattcttcctgcagttcctgtctgagagtcggctgagggccttcattgggggctttcaaaaacaaggcctaagatgacagtgtaatctcaagctgctatgctaggtgcaccgtgccgccgctgggcgggtgcatgccagccgcggcctgggcttgcgcttcccgcggtttctgaggatcaggtgtgcacctggcggggtaggcctcaggtgcatgatggtggctggcgggagatagcttgcagtagcacactggcagcatcatggcacacctttggaaagcccagtgcttcatccccactcttgttcagggacgataaggacatagaggctgccagcacggccgaggatgtcgccgccatgtacaatgcgcagtcccgcaaggccaaggcaggatcaacggtggctgcccaggccgcgaccgccgcctctgatgacgaagagccccatgggaaggaggcgcttgatgatgaggcgcttgaggataaaacgcacgatgagaaagcgctcgaggactgaccccatgcccatatcacgttaataatgaaggctgcagacagccattcctcgttcaggctctgtgtttatgcactatgcgcgatttcaggcccttctctgcttgctcacggcgcccatctggttgggttgttgagcactgttgccatctccttctgaccgtcaagcttgtcgaaacccgccccactaacacgtcaaccatgtaactgactggtaacagggtgggttcgttgacgggagcaacacagaaaactgtttgggtgtacgaaggggcaccctgagcatgggggcgagtgctgcgcacggctcagagacgacagccatactactgcagtcgccttgcctacaaagcaagatggtccgcagtaggccaggggagcgtgcggtgcaggatactctttatccaagggcgtgcgactgttctgaacgccccacaggctgcatgcgtaagttcagtaccgagagggagagagagttgggcactcctgccaccggcgtcacgagccaggctgccaagtgcaagggcggttggacgaagtggggcctcttgtggggtcagggatggatgtctgcatgggcacaggccttgggtggtggtggctcgcagccgcctgcaggagtctgctgcttcaaaaggtccccgaggccgcgagggaccgcctcggccccacgcgggagccgcacccatcccgtgaccggcgctccgcccggcggcgcccctccgccccccactcctcggcccctcccgcacccaccgccgctcagcccgcgatgcagcgcaggaggtcggtgggcgtgaccacgcccaccgcccgccccgcctcgtcccgcacgtaggcgcggtgcttggagtggcggacgagcaggtgcaggacctcgcgcaggggcgtgtcgcgcggcacggccaccagcgcgcggcgctgcagctcggggctccactccgcgggctcgcccgcgggcggcgcgcccgcgtcacggccccagtccacaccccgccccgcgcggcgcagcaggaaggcgcccacgggcagggccagggtgtcgaagcgcgcggccgtgatgccacgcaggtcggacatggacaggttgcccaccagcacgcccgtgcctgggtcggtgacccccaggccggacagcgcatggcggtgcatgtaggcgaaggccgccagcgtcggcgcgtcggcgggcagcgtgcgcaccgcgccggggccctgcaccaggcccagcagcgacacgctggcgtcaaatgcggagtccaggcgcgccaggttggcggccaggaagcgcaccacgtcggtctgggacacgatgtcggtgatgcgccaggcggggacggggccgtcaggggtctcctccccgggcaggatgtcaaagaccgccactcggtggtgcaccggcgtcagcgccggagcgccggccagcgacccgccagggcccgccgccagccgcaccttgaacccggcgttgaccacctccagcagcgtcgactcagcatcgcccttgaaccacctggagaggtgggagcgatggcgggagggggagggatcttggagtgggcggggcgggctgcattctctaggagggtagtggggtgaattcacagcactggaagacccacacataggcgggaggatggcagcctgaagatgaacatactcaaagaggtaggagaaatcgatgtgcatgcgttgccagaccagtagaacaagtggctccgcacctcctacacaaattcaacacaacagtcccaacaggaggacatcgccacccatgacaagcctccctgcaggcagacacaaccattcactcacagctcgccgctgtgcaagagccggccgagggttttggcggtgaaggcatcgcccactcgctgcagctctgggcctgacaaccggggctgggctgccacaaactcgtcgtcggggagctggctcatgtccctgtccccggccaggtctgcggcagggagggcacagacgggcacccggggttgggagggtggaggaagaggggagcatgggggtatccttgcaagggcaggcagtgcggggttcggacagcgggcaggcttccgggaggccaaccctgaaaatcccgacggtctagccaggcgaccagcccggccttctcaccctcgaccagcgcccccaggatgttcccgacatcaatgatgccggcgtactcccccgtcgccgcatcgatgacgggtgcgccgaggatgttgtacgccgccagttcctgggagggcggcgacgatcatgggtttactccgagagctgcttgctggaccccatggcagtactgaaaggaccatgtatacacgtcctacgcatcccctccaaggcaagtccctggcacacccctcccctctacttgctcaccctgagcgcctggcccacggtcgtctgtgtcgtgaattgcaccaggtgcgggggcttctgacgccccttcagggggcccgctaaaccgttcaggttcttgatgaaggttgtcagggtctgctgctccagcaaattccgtgcgttgaagaagggatgaggcgcgtacaccatggcgagggaggggaccgggtgtcccggtgctcctcctgagccggactcccgtttgaacaaggcctcagcactctctggcgagtagcgttcgcatgacgaaagcgacatatgtgacagggcagagcgataggggacgcagggggagtggatcgggacaggcatggagcgggcggggagatccaccgtaacccgggagccgacgtggcgttcgtgtgtcatctgagcgccacagcggctggcgcgctcaatagggatgtagccacgattgtgcccaacgagatcgatgccagctttatactttgcccctttgaggaagaacaaaaaccatgctggatcgcgtggattgcagcgtctgtctggggttttcgtttcgggatttgcatgtcgcaggnnnnnnnnnnagaggaagaacaaaaacaatgttggatcgcgtggattgcagcgtctgtctggagttttcgtttcgggatttgcatgtcgcaggcttgtcgaaggcgagtcgtcatcatcgcgtcgatgagctcccaaactttgaatttgcacggcttttattctctttattactgtcgagtcctggtctggtacacctcgtcggtggaagcaggctgcataatctctgcgcacaatccttgaccaagccatggtggcccaacatgaagacggcacctaataaacacatcgacacaaaattacaatatgcatctcgggattctctccgattcggaggcgcgagacctgacgatcgcaagcatgtccaggagtcacgtgacggagggtggttccggctccgtgaccctcatcgacatctgccaaacaaaacccaagacgctgcgtagcggaactggaactcattgatcgtaggaatgaaggatcagaagaatcacatgaagacttcaggaggttccccaagagggccgggttccggaaaccaagatgcttcctcaccccggaggcagcacgatcgcaaggacggcacgggtcgcgggtgagttgcgccgttctgtgatgcacgtccccggtataagcaccccgtgtgtcgtccctcacccgtgacgtcccgctcacatcgcgttccgcagccacgaactggagaagaagcatggagggggtgcacacaactggggcaaggaggaagtcgagcaattgtgagtgatgaacggtcaatatttgttggtctgggtgcatacctttgggtcttttgattcacacagctaccctcatgatgtgctgctgcaggctcgctctggaggacgtccaggaggaactgaaccggaagcactagacagcaggggcacggtcggaggcctgcacccctggagtcaatctctcgagaggttcctgaatgttgcaggacacaagttgcccgagcagagtgagccttgactgggatagtgaatggacgcatgcagcttgcgcaggagcctgcaccaagacccggtccacttcaagactgctcgatctctggttttcctcattgttctctcaattgttcaatcgtagcaataatcgataaacagagaagcagaggttgcatacgccgtgacggggaagggcttgcctgggcaagacctgttgagagggcgcgnnnnnnnnnnttcattgttctcacaatttttcaattgtagcaataatcgatagatagaggaccagaagttgcatacgccgtgacagggaagggcatgcctgggcaagacctgttgagagggcgcgagatgtgaacgaaagccgaaaaacttaccgacaccacctcctctctacaaaatctttcataaacttagttgtaatttgaataaactcaagtagggggaatgagcttaatccactccctcctataaagcgtcgagtgcagtgttgagcaccaccttgctcggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcatgttggagtgggacgaggtgtttgaagggattggggttacaccttgctcgctcacagagcaggccacccgacaagggcagccctcattgataccttcaatccatgccnnnnnnnnnnataacttgaataaactcaagtaggggggatgagctttatccaccccctcctgtaaagcgtcgtgtgcagtgttgagcaccaccttgctcggaagacaccgtcgcacacggaccggcatggggaaaggagggaccaagttctgcggcgacgcggtgggagtgcggctcaagtccgtggggtacacattgaaggatgcgaagaaggtgagcagcctgtgcatgccacgcatgttggcgtgggacgaggtgttagaagggatcggggttgtaccttgctcgctcacagagcacgccactcgacaaggacagccctcattgataccttcaatccatgccacaggacatggaatccttccttcaaactgggcaccacccagaagttgagcgtctgaagacaaagcaggccaatgccgtggtgctgctgccagaggccagcaccgcccggccccatgtgtacatggatctgacgatcagcgggaagcctgcaggttggcatggacatactgtgggagttccaggccctggggtgctcctgaagaagatctgttgagcacgtttgacgggggatctatagctgtgcggtgttggccaggcgcagcacgttcatgaggagggtgcacagacggggccctggcacgcgttctctgagcacttatgaaggtatccctcgcccactcatggctgcatggtcannnnnnnnnnacgcagcactttcatgaggagggtgcacggatggggccctggcacgcattctctgaacacttatgaaggcatccctcgcccactcatggctgcatggtcaggatcactgacactgcacgacccgtccctcctctgcaatcaggccgcctggtcatcgagctgtttgaggacatagcgcctggccctgcggcgctgttccgcaataggtgtgcaggggcctccgcagactccttccaggggtcacacatctacaagctggtccgggagcaggcggcgtgggggggccaccgcccaaagtgaggccctgggagggtatgccctggccgcggctgctgcggtggtgcctcgtgcccgagccacaggctgcatggcacactgggatccaggaaagtgggaatctctaccgcgcacagctgtcctgcgccacccgccatgcgccacttcatccccacacacactaccctttgcgcaggcggaccaaggcgggcgtgcacattcgctcgcacccttccctgcgccactccgagaagggagcggtctccctcgcccgctcaggcgcagatttcctgtgggccttcaaccgagcgctgcacctggacgaaacgcacgctgtggtgggacgggtgacggaggccagcctgccgctgctggaccgcctgaatggcagcgccacgcagccggacgacagccccacctcgcgtgttgcggtcgcgcgctgcggcctcaccgacgcggcgggaagcgtggaactggccgggccggagccggagggggcccccacggacgagaccccggaggcggcccggacccnnnnnnnnnngctggccgggccggggccggagggggctcccgcggacgagaccccggaggcggcccggacccggctggcaagggaggccgaggcggcgcgtctgggcctcaggcaagccaggaagggtggtgtgcggaaaggagaggaggggggggattgtccatgcggcgaggagagtggcggcgtggcaggccgttggtgctttgtgagggggagcagtggcaatgttgtgtggaggtgggatagactttcatgcacaccacctcggggtaaatgacgctgcggccattccttacagaagccccgtgccccttatcaacccagggaagctttggccacgggactagaccgaaaacggaaggcgggggaggaggatggtcggccaaagggcgtcgcgccgggccggagggggatgatggaaagcttactgggcgggtctgacagcgacagtgcggccagcgactctgcctgagcctttcgaggctattgttattacaaatcaagagggtatgagcacgtgcagggattccagggatattataaaaagtgtatgtatgcgtggggttgtaggcgcagggagctggcactgcatgttgtgagtttgcgggtttgacatgtgtcccccacttcagcgggggggggggggggggggggggggggccaggtaggtatcaagagttaccggcgtgtggatcgccagcgtgccagcattgaatctgatatggcatcagcctatctgcagttgccccgaattgaccatcaggaagaggggagggccccctcacagcaatgctcccgtatcaccgcatcacgcnnnnnnnnnntcatctgcagttgccccgaagtgaccatcgggaagaggggaacggcccctcgcagcaatgctcccgtatcaccgcatcacgcctgcttgccctgcggcacgagctgctgctgcttggcgccaggcggcgcctctgcagccacatccaccccgccacttgccgccgcggccccggcgccggccccgcccgcgcccatggtcttaaagacgcccttggccgtgcgcttggcggcggccttggccacggtgcgcacgcccagcttgcgtaccgcgtacaccgcgttggccccgctccccgccgcgttcatgctgtgcaaggacaggcccgcggcgtcggcgccgtagcggtcgcccaccacgcccgcggcgccatcgcgggcggagagcagcacggcgcgccccgcgtcctccatgccctcccacacctgggaaaagccggcggcggcggcatgcgaggtctcgcgcagcacccccgcctcctcccccggcgccagcggcttgtctgcgcccagcgcccacagagcgccgcccgccaccttggcgccgacccatgccagcccgcccaccaccgcaccggcagcgcccgacgcccactcggcggcggcggcggtgcgctcgaagcggcgcttggtcgcctccgacacgtgcacgggcgcggcggtgggcgcggcggggcgcgccgcgtcggtgacgcgcttgatggcgccggtggcgtaggctgcgctgaccagcaggcccgaggccaggccagccgaggcgcggtgcacgccgcgcgcgagggcgctgttgtacgcggccccggccagggcagcctcaccgtgctgggcctccgggtccgctagcagggcctccgactccctgaagacaggtgtgtatgtgagtttgtgtgaggggtgtgtgtgggggggggagatcatgcagtgcaggatggtgacaatcctgcgaaacccagtcagacgagcacaggtgtggtcggaggggtgggctgtgcgactgcaccacacatgccagggacaggacatgcttgccatgagaggagtccctgcttctccctggaaacaagttccatcccaagaaggaacccagtacttcacagagcaacccacgtacttgacgacggcaatgttctccagcacggnnnnnnnnnntactggaggagtccctgcttctccctggagacaagttccatcccgagaaggaaaccatcacttcacagagcaacccacgcacttgacgacggcaatgttctccagcacggcctcgaagatacccacgtcctcctcgctggcagatgccagcagggtgagggagtagaatatccccgcctccgaggtgctgaacacccaggtgtactcccccgccttcagggccttgctggagggctttacctcccatgacacctttcccaccgcaagctggatgcagctggcgggtggcccctgctcggcggcatctcctgtgccaggactggagctaattaccagctcgccctcgctctggaggatgggagcctcactgcccctcacaatgtacagctcggcgtaagggaaactgatgagaacttccgacatgtggacagccgggtgcccctggtaaacaacaaggatccaggagcctcacacaaacagaacggtgcagttaattccgagaattcctggtcaatgagcctgtaaaggtggtcaatgcctcgcgcagcctgttgagggggactcggcttcccgagcacctggcatgcacctcgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggtgtttcgacattattttcgatcgtaaacgcgtctgtgcaatatatcnnnnnnnnnntaattcctggtcaatgagcctgtggacttggtcaatgcctcgcgcagcctgttgagggacactcggattcccgagcacctggcatgcacctcgccgtaccgattcgtggggacgaagcggggtatgcaccttccaaccagcttcagacagagcaagcaaccacgctccatgcaaccccgagccccgtagtggtgtatcaacattattctcgatcgtaaacgcgtctgtgcaatatatcggtgcaccagaactgctaggtatgccgtcgtccaagcatgtcgagggctccagcgactcgctgggccctggagagaagaagcataggagcggagtgaagaaattgatgagtaagctgggcctcagcaagtccaagggcggttcgcgcagcagcacccccaccccagggagtccagcctcctccagccctcgggttggccaggatcactcccgtgataacgccaggccggtgagtcgcaggttctcgccaaccccacccattagaaatcgatgacgggggcgtcgagcattagcccgcttgttcaccctcgattcattgtatatcaaacatgtgggttctgaggccacaactgtggaccactcaaaccgatctgtggtcctaaatatctccactcgatattnnnnnnnnnnccccacccccacccattaggaatcgatgacgggggcgtcgagcataagcccgcttgttcaccctcgattcattgtatgttaaacatgcgggttcagaggccacaactgtggaccactcaaaccaacctgtggtcctaaatatctccactcgatattcagggggatgccaccctgaccgaggccgccctgagggagcacgaggccagcctggccgcatccccccacctgggaccaggtactgccggtcagtgtcggcagcgtgctggaatggggccttgttacgacgggaggagggcgctgggatcggggggtgctgggcgggtagagtgtggtaggccagctcctgcatggaccagatgacatctaccttttctgttgtcaaattgtgcgatgctccgacattgctggctgccatgcttgccttgctcgattgggtgccgatgggcgattggaatgaaatgagctcgatctccacccccctccataacccatattccatctccccctacgtccctcgcaccgcagtcacgccctctgccagcgaggaggnnnnnnnnnngatcctgtgcgatgctccgacgtcgctggctgccatgcttgtcttgctccattgggtgccgatgggcgatttgaatgaaatgaggtcgatctcccacccccctccgtaacccatactccatctccccctgcgtccctcgccccgcagtcacgccctctgccagcgaggaggtgtttgccaaggaggccagccaccccaccaccgacagccaggcgttctcccacggcgccaccacctccgacatcaaaaccatcctcacaagcagcgccgagtccgggtccgccggccacccacccgcggaccccgcgcccatgccgtcgccgcagggccccttccccgcgccgtccccccgcgccgtccccgccgtccaccgcctagcggtgaccggcctggagagcgaggggccgccggccccactcatgggccctcgcccgccgtccccagacccggcctacgtgcgccaggcgcgggaggccgtgggtgcgccgcgcgccgccgcggagttgaccccggccgagctggaggaaggcatcgcccggctgcccgccggtccctttgccacgcagcaggaggccagcgtgcggcagccgggcgaggcgcaggcgtaccgcctgtcccgcgacgcgcctgagctggcggcgggcccctttgccgcgcagcaggatctgagcctcttctccgccgtggacggcgaccatgcggttggcgagggggccgagggcgggctggaggcggatgtcacgcaggcagcccggcaccgaatctccctggaccgacgcaccgagagccaggcggtgatagtggaggagctgcaggcaggcaaggtgcaggaggcgcagcctcggcggcgccgcggcagccgctcggcgcgccccgtcgcgggcgcgctcggcgcggtgcgcctcagcgccggctccggcagcctgagctcggtgagcgaggaccccgccgccgcgcgcagcctggacgggcccggcgccgccagcggcggcagtggcacctacaccgcggagaccagcctggggtcccacgccactgcacccagcctggcctccacaaacgcctccggcgccaccagcgccacgcccgccgctgcgatcggcgcgcccgccgccgccacaaccggcgccgtcgctggcgccgcgatggcctcgtccctgaagcccaaggatgatgtgcccgcgggcacacacatgtactcccagctgccccaggaggagggggggcccaccgcgccggcgccggagactctgctggctggcgggcgcgccgccagcgacaccttctacacctctggcgtccaggagctcgcgcctgcaggaggggcaagcggtgctgacgcaggaggcgctggcggtgccggcgtaggggagctgaagcctgtcgagggctcgggtgctgcttgcatcgcgggcgctgccggcgctgtcgccttgccggcgcaggagatcccccgcccgcgctcgcgcgaggaggagatcgcaggacccacgcagtacacccaggtggtcatgcctccggcgggcagccccccactgcgggaggaaagcgcggtcacggagccgctgctggccgacaacacccccccgggcgcagcggcggtgctgccctgcagcgggccccctcccccgggcgaggacacgattcgtggcgaccccggccccgccggcgagggcctggccgctctggaggtcggggccgccgccgcaaccgtggaggggccggccgccgtggccgccttcctggccgcctccccacgtgtagcggaggaagggcaggatggctttggaccggccactgtgatccatcccgacgagcagcgccagggcgccatgccggaggcttgggataataaggacatctctgcctttgtgagtggtggaagggactggaggaaggggtagggtggggtggggatgttctggacgagtgcttgtttcagtggtgcgagcagggaaggcatccttgccagagtcatgaggggccaggtgtcctcctctgagctccgcctgctgtgccctgcatggagcagcaaccatgcacttcggaacatttccaccaaaattcctcattcctccctctgtgccattctccatcccacaggcgggcagtgagcaagggacccagtcctccgccggcatcatgtccaccgacaaggacaccgcgagcccgccggcccccctgacgctgcccacgcttcccatgggagcgggatccctgggtaccgacggttcgctgacggggcaacaggccggcnnnnnnnnnnggctccgcctgctgtgacctgtgtggagcagcaaccatgcactgcggaacatttccaatagaatttctcattcctccctctgtgccattctccatcccacaggcgggcagtgagcaagggacccagtcctccaccggcatcatgtccaccggcaacgacaccgcgagcccaccagcccccttgacgctgcccacgcttcccacgggtgcgggatccctgggtaatgacggttcgctgacggggcaacaggccggcggcgtgccatgggacgtgcaggcgcgtgacttctttgatggtggcgtgcattgggccaggggccacccctaccatgccggcgccgggctgctcctcctctaccctgcctggctcnnnnnnnnnngcatctgtgtgctttaggcagcgctgaccctcccctgcagcacttgtctcttcccatagcattttttcgacggtcatcggaaagatcaannnnnnnnnncggcggtgtgcattgggccagaggccacccctaccacgccggcgcggggctgctcctcctctaccctgcctggctcattgcggcggcctcgctcaggacggtgctcaccgagttcacgcccgtgctggtcatgagcgcgctggtggccctggccgccaccgcgctgagctggtttgtgctggcaggtgagcgtgatttgaggaagctgggtggaaccctggttgaacccggcaagaacctggtgcacagacatgtgtgtgctttagccagtgctgacccttccctgcaccacttgtctcttcccataacattttttcgacggtcatcggaaagatcaacactacttgccacgttctggtccccccactcagtattccatcttcttgtgctccccaggcgagctgccccctctgtcggccttcatcccccgcggacccgcccctccaaaggaatccagcgacagcatgattgatcaaaataacgggcccctcactccaaactcgtcccaagcccagcccagcctggtggaaagtgcattgggcgaggcaggccccggcaaggagcaggcgggggacgtcatcgtggagaccgatgaaggcggggaggtcgagatcaagggcccctccaccctggagcgtgccaaggacgtggcctccaaccttgccagctcagcagcggccgccgtcacgcaggcggggcagtctgccgtggcagcggtgcagaacctcaccaactccagccctgcagatgcagcgtcggagcctacccaggtgcgagagtttttttggagatgaggtggcggtgcgggcacaagtgtgtatgcatgacctgccgtggaagttgcaggcgcctgggatgctgggctactgcaatgtgcaggnnnnnnnnnnggagatgaggtggcggcgcgtgcatgagtgtgtgtgcatgacctgccttggaagttgcacgcgactgggatgctgggctactgcaatgtgcaggaggcctgctactatccgcctgcagtcggctggaaagatcctccatcaagcaaggtgtccgtgtctcacctccaggcccctctcaaccgcctgcccctctcctcctcctccagggcgggacctccgtggtggacgccatcaccaatgcgcgtgaccaggcggtgatcaacctcaagcagaatgcccaggcgacggcgcggggcgaggaggagggctccggctatgcccccgactccgacgggcctgggcccgtcatcgagggcgtgcatcacgtgcagtagaccagcagctgaacgactccatctatttcatttgatcaggcccgcctgggaactgtcagtctcacggcgtcccagtgggcccctgtgcatgcatgcgggttgccatgcaaatgcgatttgctctggaacaaggttgcagtggaagcaaaggctcgaaggggatgagtaattcttctgaggaatgggctgggatccctgagggtgggtgaaagcactggcacaggggatggcatcatgcattnnnnnnnnnnggtctcacggcctcccagtgggtccctgtgcatgcatgcgggttgccatgcgagtgcgatttgctcttgaacaaggttgcagtgaaagcaaaggctcgggaggggatgagtgattcttctgagggatgggctgggatccctgagggtgggtcacaggcactggcacaggggatggcatcatgcattggggacaggagaggcacgaggctcgcgaggggttggctccaaattccaggcaaaaatgtccctgtgcattgcccagcatgttgcagctcggccactgcattccctccccacccagctggtgtgtggcctcattcgttatggctgcccaccatggtcagccatgcacccctcccgcatcatcacctctcagcgccggaannnnnnnnnnggccacgacggcagacgcgccgcgcagggcgcgccacgccacagcggcgcccagcgggcctggttgctgggnnnnnnnnnncggctcgcgaggggtcggctccatattccaggcaaaagtgtccccgtgcattgtccagcatgctgcagctcggcctctgcgctccctccccacccagctggtgtgtggcctccttcctcatggctgcccaccatggtcagccatgccccgctcccgcatcatcacctctcagcgccggaacaccagggtgttcttgccctcgaagggcagcgtggcggtgccgatggaggggtgcttggcgcacaggtactccacaaagtcctcgtgggaggtgacacgccgcccgtccggcagccggcggtgcgggaagtccgacgcgtacacgcagcacggcaccaccgccatgggcacgtccagcgccagtgcgaggtccacagcaaactcggtggcctggtcggggtgcatagccacgacggcggaggcgccgcgcagggcgcgccacgccgcagcggcgcccagcgggcctggttgctgggaatctcgatggcctgccagactggtggcacagcaaagggagtctgggctaggcgtggcgctgctcggcgcctcgcaactcaccaacgaggccaccagacgtccatccgcctccccatcgtctgccactgctggtgtctgaaagctctcctccacctcaatcgaggatgcggtgccctgcgtttcaaccgcaggctccccatcccccgcctcgtgggccgctgcagcgctctcgtggtctgatcgtagtcctctgtgcgtccagcgcaggtcttctgctgcctcgcacgccatggcataagcgcgctccnnnnnnnnnnattcaaccgcaggctccccaccccccgcctcgtgggccgccgcagcgctctcgtggtccgatcgcagtcccctgtgcgtccagcgcaggtcttccgccgcctcgcacgccatggcataagcgcgctcccagccggcaggcggctcctccaggcatgggagccgcggggtcgtctgctccgcggtctcctgggcctgcgccccgccgccttcgctgcgctgcgcctccctcgagacggcgtcgggcccgccgggccacgcgatgccaaggcaggcggccacggcgggcgtggccaccatccacaggtgcgccggcatgtcgcagggctgctctcgcgcgacgcgaccctgggccccttcggcggtcgcgctgttgtacggcgcaaacactgcattccagttgtagtacccccgctgtggcgtgggaccgggggtgaagatggtcatcacctcggaggacagggctgtgcacggcacggcgtgaccnnnnnnnnnntgaagatggtcatcgccgcggtggacagggctgtgcacggcacggcgtgacccaggctgccccaggccgcaccgctgccgcgccccacatgcagtgcgccccgtccagtcgaccagccccgcacctgcagccatttgacatggcgctcgagctgcaggggacggggctccagcgccgtgctggggatgccgttgaggttgaggaactcgaacgcgagctcacccttcccggcggcgacgtcgaggatgccggagccgcgtcgcaggcggtcctcccccacggcgtccagcagccacctgagagacgggcaggggggtatgtggagatgcacgtttgatgaagtggcaccgaagaggcgcatgcatgcctgcacggcaggatagggcagagaaggcgctaccactccccgagcagctccatactcgacctggagagatctctctccaccgccaccatcccctacctgcgtagggtgccagcccggaaccggttgcgcacacggttgcgcttgccggggccgcggttctccttgcaccggatgtcattggtggtgcggcgagcggccttgagggcggccctgcgcttggagagaatggggatagggtgaggccaggcaggcagttgatcacgtgatgcagctgcagagcactgtaaggcggggggggtctttgggaattcacgcccatgcatgagccttcccaaggcnnnnnnnnnnagtgaggccaggcaggcagttgatcatgtgatgccgcagcagagcactgtaaggcggggggatgaggggggtctttgggatttcacgcccatgcatgagccttcccaaggctagccctgccacaaggcacatgagcactattaaatcaggcatgggttgtatacccgagcttactgtcgggcggccactcgctgcaactcctccagtctctcggcggggtgcctgaagacacacctgtccttgtagaagcagatgcccatgcgctcccagtgtttacaaacctggtcaaggaggtgcatgcgtcatgtgtatggatgcattagggagattcatcattaccgttgagcgcagatgcagcacgtgaggtcgctcgacgaccaaagtgccccatccatgcgtaccggagcgctggccagcaatgcctccatnnnnnnnnnnaccgttgagcgcagatacagcacgtgaggttgctcgacgaccaaagtgccccatccatgcataccggagcgctggccagcaatgcctccatggatccagttcctcgcaatgcacaatccaagtgatggtatctggagtctccatgcacgctgtcgctggccggaaacatggactcgccctggaggatgggcgcgttgcaggtcgcacatggcgtctcgaacttggccaccaggtgcttgtgcgccacggccaacgccattatgatttcattccgagcttgatgttttgtacgatattgccagtggtacgtacatcccaatgccactcggctgggccatgcaattgacggagcgtcccgtgctctccgtttcagggcgcgaggtctgggcctgcagcggccactcggcaccgccagagtgaccctcaccactctcaccagcgacttgctgttgtgaggagcgcagacgttgcatggatttcgtactgcccgcctggcatgtaagttctgattacaaaacagctcaataggatgaaaactttcgtggcctcgggcagggcgctcatgctcaggtttgtctgaaagccacaatccctgggagcagcgccaggcccccccgggccagccgccccctgtgtcttacaggccctgctccttgtagtgacgctcgatgtcgtccacatcctcgcggctgnnnnnnnnnngtgctcaggcttgtctgaaagccagaatccctgggagcagcgccagccccccccgggccagccgccccctgtgcctcacagaccctgctccttgtagtggcgctcgatgtcgtccacatcctcgcggctgcccaggtacacgggcgcgcggtcgtggatgtcctccggctcgcgcagcagaaggcgctcgcagcgctcgtcgatggcgcgcccccccgcctgctcgatgaggtaggccatggggtagccctcgtacagcagcctcagcttgccctgtgagagcgtgggtggaggcggagggggggcgtgtgagcatgcgacagtgggctggggtgggggtcgcccccgccgctactccagggcagtttcgccgcccatgacacggctcagccgtccnnnnnnnnnntaggggtggcggtcgcccccggcgctcctccagggcaggttcgccgcccatgacacggctcagccgtccctggcgcagccgtcttaggggtgaacaggccctgcatgggcaacttccacaccactacatggtacaccctcctcccttccaaacaccagcaaggcacgccccaccacaccacatactttggtgttcttggcgtcggcggggtacaggaagacgccgccgtagaggaggnnnnnnnnnnctaggggtgaacaggccctgcatgggcagcttccacaccactgcatggtacaccctcctcccttccgaacaccagcacggcatgccccaccaccccacataccttggtgttcttggcgtcggcagggtacaggaagacgccgccgtagaggagggtgcggtgcacgtcggcgaccatggagccgacgtagcgcagggagtagggcttcccaccccccggcggccgcttcttctccgccacgtaggcgctggtggcggcgtcccacatcgccgcgttcccctcgttgatggagtagatggagccgcgcgggggcatgaccaggtcgcggtgtgtggccacgaactcgcccagggaggggtccagggtgaaccccgacacgccccgccccgtgctgagcatgaggtaggtcatggagccgtacatgcagtaccccgcggccaccatgtcgcgccccgggcgcagcacgtccgccaggctgccctcgctcccgggcgcgaccttgtagatgccgaagatggtgccgatggacacgccgcagtcgatgttggaggagccgtccagcgggtcgaacaccacgcagtactcgccgcgctgctcgggccggatgaagatgggctcctcctcctcctccgtcaccagcaccgcgcactgccccgtgcgcgccagcacgttcttgaacacctcgttggccaccaggtccagcttcttctggtcctcgccctgcacattgctggacccggccatgcccagcacgtcgttccctgccaggccagcctgcggattgtattcaaagaggggggttgactgatggagggggcacgtgggaccggggagcactggccaccagtgcccccagctgcccagcactgctgggggagtgccccgannnnnnnnnngaggggggcttactgatggagggggctcgtgggaccggggagcgctggccaccagtgcccccatctgcccagcactgctgggggagtgccccgagccaggccccgtcaaaccccaccgcccaccttgcgcacggccgaggcgacaaacttgcaccccacggtgatggcgttgaggaggacagtgagccggcccttggcattgggggcggtcaggtgctgctggctcagcacccaggccgatagggtgaaggggtccgtctgcgggggtgcggtttggagggatggtcatcatgcaggcccggtacggcgacgggcatgcatccttgatcgccaaacgcccagatcgccagcgcccgggtctctcacatgactctgggcatcctgcgtatcgcccatcgcgtcaggcgggtgaaccggggggagcgggggcaggcggggccgcgtcgagacgatcacacgagatctgcacttcaatgtctgggattccggtctagacgcaacggtttcgtggccaccatgccccaccgtgtgatggatgtcctcgtcacggagtagatgactcagcacccctcacggcatgtcggcaacgcttggacactggcccccgtgagagctctgcatgccctgctgaggatatgctatacgcactgaaacctttcaacgtatcctgggcgaaacaaccaggcatgggtcagggtgtctcctcgcatgcacgagggtgctgccagggtttgaatcacaaccaggggccgcagggagggatcaggcgtgggcgggggggcgcgacgtcccggacgccttggccccattctccctcgccttgacctcgggcgccacgacggccagctgcgcggccatcatccccctcagcgcaccccgcaccgcctccgagcgggagcgcagcagcgtgcacagcgcgggccaggcccgggtgtgctctgcgccccaggtgggctcgcccagccgcagccaggtgctcagcgcctccagcgtcagcgcctccctgggaagttgcagggtgtggggcacgtgacacgacgaccagctttggctcacggtttgtaggggcacgagcccagggtcgtcaaaccctgcaacggccggagagtgagctacatttgcccttggaactccacccttgcacggaccccccccaccctcacataaactaagaaatctcgcacgtgtaagtatcgggccaggcgacggtgccggccgccccgccgtcccgcgcctctgccttctccacccctgccgcggcgtcctccaggatccagaggcacgcctcggcggccatgacccggcaggtggccgccaggccgtccagcgccgcggcgccgccgcggcccaagcccggcgctttggtcatcaccctgcccaggcactggagcaggagcgcgccgccctccaccagctgccgcgcggggtgcatgccgacgttcgacgtggtgccgctgctttcgatgtcaccgaccccagcgccgtcgccaccgatgccgtcgccgactccagcgctgtagccgaccctgtcgccgtcgccgccctccccgtcaccttccgcccgacggcgcgcggcgcggacggaggcggccagcgcagagagcaggcgcagcgcgaccgccggcggcggccccgcgcgctccagcacctcgctcgccgcggcctg

SEQ ID NO: 40121 - DNA, 115 bp, Chlorella protothecoides
gggggggggggggggggggggggggtgttgaggaagcaccttgcggggagggtgaggagtgcatgacccgtgtcgggcatggagtgcaccacgcagcctgcgcctccaggaccag

SEQ ID NO: 40122 - DNA, 17039 bp, Chlorella protothecoides
  modified_base (1375)..(1384): a, c, t, g, unknown or other
  modified_base (1444)..(1573): a, c, t, g, unknown or other
  modified_base (1815)..(1824): a, c, t, g, unknown or other
  modified_base (2419)..(2428): a, c, t, g, unknown or other
  modified_base (2793)..(2802): a, c, t, g, unknown or other
  modified_base (2996)..(3005): a, c, t, g, unknown or other
  modified_base (3891)..(3900): a, c, t, g, unknown or other
  modified_base (4322)..(4331): a, c, t, g, unknown or other
  modified_base (4938)..(4947): a, c, t, g, unknown or other
  modified_base (5179)..(5188): a, c, t, g, unknown or other
  modified_base (5600)..(5609): a, c, t, g, unknown or other
  modified_base (6278)..(6287): a, c, t, g, unknown or other
  modified_base (6671)..(6680): a, c, t, g, unknown or other
  modified_base (6776)..(6785): a, c, t, g, unknown or other
  modified_base (7027)..(7036): a, c, t, g, unknown or other
  modified_base (7876)..(7885): a, c, t, g, unknown or other
  modified_base (7951)..(7960): a, c, t, g, unknown or other
  modified_base (8493)..(8502): a, c, t, g, unknown or other
  modified_base (9006)..(9015): a, c, t, g, unknown or other
  modified_base (9086)..(9095): a, c, t, g, unknown or other
  modified_base (9355)..(9364): a, c, t, g, unknown or other
  modified_base (12019)..(12028): a, c, t, g, unknown or other
  modified_base (12462)..(12471): a, c, t, g, unknown or other
  modified_base (12740)..(12749): a, c, t, g, unknown or other
  modified_base (13450)..(13459): a, c, t, g, unknown or other
  modified_base (14476)..(14485): a, c, t, g, unknown or other
  modified_base (15185)..(15194): a, c, t, g, unknown or other
  modified_base (15666)..(15675): a, c, t, g, unknown or other
  modified_base (15932)..(15941): a, c, t, g, unknown or other
  modified_base (16162)..(16171): a, c, t, g, unknown or other
  modified_base (16668)..(16677): a, c, t, g, unknown or other
tgctgcgccagcagcgccgggctggcgcgccccgccaggctcagctggctcagcgcctggagcaccgcgggcgacatcgcgccgggcgcggctgaccccacgcgctccggcccgccgtctggcccgcccaggccgggggagggcgaggcgccggcgccgcgcagcaggtgggccagctcagcgtgcccgcccagctcagagtagagggtggaggcgtccaggggcgggggaagtttcttgccggaagccacctgggcgcggtagaagcggtcgtagtcctcgtccagccggatgtcggtggactgcccccccaggccaccctgcacgatgcaggatggggggaggggttgcgcatgatgctgagatgcgcgtgggccaggccgccgctgggccgtgctggcggggcgccctcgtggggacagacccactcaatgcccaggcagggtggtaggcgtgcccctttctctagcacgcgggacaccagctgaaccctgacgtccataagaaatcgcccagcgacagtgtttgtcccagtgcatatcgtctcctagcccaaacacgcgcccagtacagaccaatacttgacggccccaccccttcagtcccatggctcagcgcaccaggtgcagagcccatcgatcgtccagctgtgggggcgccgatattgcgcgtggaatgtccagctcgtccagcagagtgcccacgctgtgcgtcatatcccgcctgcaacccggtggcatggggggatgtttggacgatggccgggtgcgcgaggaccgcgcagcatgctatcaggcccaatagttccatctgaatgctcatgcactcaccattctgggcttggggcggcccccgagtccacctgtccaccaaacatgctcctccggtgggggcgggcggagagctgcgctcctggggcgggcgccctgcaatcagtaagacaagcacatcgttctaggagatgtagtatgcaccaactaaagccactccttccccagagcaccccaggtcatgtgctggtgctctgtcgaggtggcaggggagtgtcaggggtgggcgcccagctacatccccagggtctaatgcggagcctcctcgttgcgcttgactcatgctgtttgaacagctgctgcggggtcccggaatgtaccgtaagcctaagaccttggatacaaccgacgtaacgttaccttcctatctacagacatgcatgcctggcctctatatctatacctcggcagggcatgggcatgaggggtatcaaacagcctgttacgtgcaaggactgggctgcagggcatctgaaggcggatacagcccatacattgtttactagtccctaaacgaagctcctcagggcaggcgccgcacccannnnnnnnnntggaatgtaccgtgagcctaagaccttgaatacaaccgacgtaacgttaccttcctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcccatacattctctactagtccctgaccgaagctcctcagggcaggcgccgcacccagatacccagaatatttccctgcgcatcgagaggatagggtgagaaatgatgtagtgttgtgatctgatcaggcaccggaatacggcattgtgagacacaagtcacactgcacaccttcatcagggcctggacgtggcgagggtctgcgccggccggcagctcccaggccagggagctctgcnnnnnnnnnnaagaggatagggtgagaaataatatagtgttgtgacctgagcaggcaccggaatacggcattgtgagacacaagccaccctgcacaccttcatcagggcctggacatggcgagggtctgcgccagccggcagctcccaggccagggagctctgctggccctttccgccatcctttcctatagttggggcaagcaagagacccagtgaggaaacaaatactactgaaaggctggcacactgcttcgtcccactgtcagatgccccaaggaccactccatgcactcgggtttgcacctcacctcccaccctggtgtccgccgtcacacgcagggtctttccaaccaggtccacatgcatcttggcgccacgggggacctgcagcctgtactgccagccgccggggtgtgcctgggcctgggggagccactcctccctgccacgcggcgcctcctggccctggggcgaggcatgggcgaagccacccgcagcccctgggcccacgttagcaggaaccccagtgctggagtgggccggctcctgtgcagggcgggcaaagcggggcttgtcctgacccgtcagccgccatgagcggagnnnnnnnnnntccacccgcagcccctgggcccacgctagcaggaaccccagtgctggggtgggccggctcctgtgcagggcgggcgaagcggggctggtcctgacccgtcagccgccatgagcggagctgggagggcgtggcggtgggctggctggtgtagagggacaggcgaacggggacagccatgcacggcctggcatagcgtgggggtgtatctcccaggctcttgacaggaggttgagccgtggccttggtgtcctgggacggcacggaggtcggtgagggggggaaaggttacgcaacaccaccctactgccatccgctcccgaagcagagcttccggcagatcgaaaccctaatcctctgtgtggcgnnnnnnnnnngaaggttacgcgacaccaccctgctgccatccgctcacgaagcagagcttccgacagatcgaaaccctaatcctctgtgtggcggagatacgttccgctggaacagtagcgcaacgagtctctcttcacatgcaccggctcacggctcgatatttgctgctagaagtccttgactcgatggttgtcatggaccnnnnnnnnnncgaacagtagcgcaacgagcctctctccacatgcaccagctcacggctcgatatttgttgctgtaagtccttgactcgatggttgtcatggaccgctgcgatatcgggcagccaggcgaagccctgtcctccaacccggggacctcaggctggaggtgtcgctggaccctcgtgaggcgctccttgacagcaacagacatgatggatccaatcttgacgccttgggctttggaagttgatacaaattgagacgcatggcgattttgtggttacttttcggtatggatccagtgccgtggcggaaacgtgctttggaatctcagcacgggacccttccgcaagatgtattggatccctcccaatgtgtaagactccgcagattcttgcgatcactgctcctgcatgacatatcaccaaatctgcaatgtcgcggggcaggaagtcacgatttgagcttgcgttgtaacctagttgtcgactggctcctcgagaacaaatccaagcaggggaccacacgctggatgaggcggagaccaggcatccaaggtcttcaacggacccaagctacacgtgtacgggatctgacaaacatctgccgtccccatgcgctcccaggcccgctgctctgtactgagcctcatgctgattggagctcgccatctcatctctaatggctctccccacctgtaggagtccttcaaggcactgggtgaccatgtcaaccagaccaagttggagctcatgcgaagccagatggtcgtgttcaaggagagtctcgagcagtttgcgctgaagtacaggtaggaaggctggcattgtgcggaatcagtacggttctgataccttggttgaaggtctgatgtgcgcatgagtggtccaacttacnnnnnnnnnngggaaggctggcattgtgcgggattcagtacgattctgataccttggttgattatctgatgtgcgcatgagtggtccaacttacttttgcctgaaagttcaagacctgctgctgcgccgctgcaggtcagatatacgccgggaccctgccttccgagaaagcttccatgccatgtgcgtcaccatcggcgtggacccactcgcgtccaacaagggcatctggaaccgcctcctcggctttggaggtgcgcagggctgcatgactgggttggggcccaccatgcgagggcgaggaatgctcctcgtcctctacatccatcctgggaggggtagcatccctgctgcgcatcccatcagcgcctgggattgtgctggtaggtgtgtgcacgcaaattcaccaaagcaccactcaccctatcctcnnnnnnnnnnggcctaggaccgtgctggtaggtgtgtgcacgcacattcaccaaagcaccactcaccctatcctccccacccgcgccccctagacttttactacgagctgggcgtgcagtgcgtcgagacctgcctggtcctccgatccagcgtgggggccctagtggagctcaacctcctgctgcgacacatacaggcaagggaccggagcggggccagatgccattcatgtcagtccagctcggcattgaccaccactggaaccctcaaggccccttgaacatgcctttctaatcctcccacctcaatttatcagaggcgaaggggctcggcggccgaagcggtgtccgccgatgatgtgctcaagtcgctggaaaagctgtcggtcctgggtggcggcttgggcgtggtgacggtcggcggcagccgctacgtcaggtctcagcccatggagctctccagggatgcggcagacgcgctcgactttgcgcaggtgggcctggggggtggcaaagtgggtgcagggtcacggcgaggagacgtcccttgtcacatattgcctgcgtgcggctccatttgctgatactgtgcccacaagatgggtgtattgcaggtnnnnnnnnnnggacgtcccttgtcacatgttgcctgcgtgcggatccatttgctgatgctgtgcccacaagatgggtgtattgcaggtgggcgtgcaccctgcttgatcacgcgctgccacagaccccccagatcctgacctgctgattgcaccccaccccaattcctggtgccgcagcgatcggggggcttcttctccgccccagacctatctgcttccttgggctgggcccccgctcgcnnnnnnnnnncagatcctgatctgctgattgcaccccacctcgattcctggtgccgtagcgatccgggggcttcttctccgccccagacctgtctgcttccttgggctgggcccccgctcgcaccgagttcacgctccagcaactcctgcgggatgggctgacctggctggacctgccccccgacgccggcgccccctgcctctactgggtgcctgccgtgggcatggagcaggcggccgcagcatacgctgccgcccacaggctcgcatgacgcagcgggcattgggaacggaggacgctgccaagttttgcatgctcgatctcctttgctgcctcatttgttgcctggtaaggcacccagcccgcccagctgcggtctatcatgttggaaagcacagcggcacgcagacattctctgcannnnnnnnnngtgctgcctcatttgttgcctggagaggcaccacagcccgcccagctgcggtctatcacgtttggaagcacagcggcacgcagacattctctgcaccatttgaatttgctcgcctgtctccatcgaaactggcaggggtacacattgttcacacacagtctgagctgtaagcctgagggcaatcagcagccagcgcgctggggcctgcatgcggagtccaaatgatgcacccatacctgtccgagacgagctcaatcgcggcccttcaccctcggaggctgttctcgccgatgaccacgcgaaagtcgtcaaagcccttggggtccagcatgcccgctgcgatgtaggcctgcctctcccggatggagtcgatgagatccttggagtcgtcggtcagctcgtcgtacgccgtcaccggctcatcggcgtgcaccgcctcgtgcaggagctcgtggtatgtgcgctcggcgccgccgcgcagcagcgccttccaccagccgggcgccgccttgggaagcaggatgtgcagctgggggtgtttgggtgttgagggaggaggggtaggagtgagggaaatattgagatggaggaggaggaggtgggaagaacacgatgaccaagccaaagtgttgatgatcgtgggaggcggtgaggccgggccataccagnnnnnnnnnnggggaagtattgagatggaggaggaggggttgtgaagaacacgatgaaaaagccaaagtgttgatgattgtgggaggcggtgaggccgggccataccagaaatcccccccaaacaaccacagccctgtcctccccttgcctcacctctgcatcctccaggcaccatgtggcgtcggtcgccttgacgcccgcccagagctccgcgtccagcagcttgccataccagcgcaagtcggccgccaggcgcagcggcgcaaagcgcacctggcgagcgaagagctgagcgtgagctgcttgtcaatgaggcaagcaagagactcgaagctgcacctgcaggcagacgagaagcagcagcactcaccctgacctcggccgcccgcgtgnnnnnnnnnntcccgagcacggcactgggacaggtgagacgcccaggtccgtctcgacgtcacaccatcaccaccactcacggagcgggctcgtcgtgtagcagcnnnnnnnnnnggaagctgcacctgcaggtggacaagaaccagctgcactcaccctgacctcggccgcccgcgtgccctgcgggaggctgatgaggcaggagacatctgtagaggtctgggtccacgagatcctgctgtcctccggcttcgccagccaggcctgggacaggatcgcggtgcgtgagacttcagggtaggattgcggaatgagcggccggcaggggcatcctggcatggcctcgagtggcatgnnnnnnnnnngtctgtagaggtctgggaccacgagaccctgctgtcctcgggcttcgccagccaggcctgggacaggatcgcggtgcgtgagaattgagggtaggattgtggaatgagcggccggcagggcatcctggcatggcctcgagtggcatggtcccctcccaagcacggcactgggacaggtaagacgcccaggtccgtctcaacgtcacaccatcaccgcaactcacggagcgggctcgtcgtgtagcagcatccaagggcgtggagtcgtagactgttctgaggtctggcaggcactcaggactgtgtgcgtcatcagcacaccgcgtctgggctgatgcctcggaatgggtgtcgccaggggactgtgcgtcgggtgttggcggcgccgtcgcctccagttcctggatcgtcacgctgctgtttttgtacgaggatgcctgccccaccggcctctcctcagccttcccgtcccttctcaggaagcccttgggcagggtcgggaaggcgagcggctgcgtgtccttccctgcggccggtggtgggaggacgagcgtgcgcacctcccgcggcactgcatcccagcccggcccgtgcggccattgccgcggcgcgagccgctgtgcgcgctgagctcggtcaaggcagccccggaccagggccagcactttggagaacgtgctgacgattgccgcgctgtcgggagcatcgcctcctcccgtctttgcttggcacgcgcgcagagcggtccacagcggcccccgctccgccgtcagcgccgccaggtcggccggggggcagtctcccacaaggaccgccagtcgccgagccgcctcgccgacnnnnnnnnnncgcggccactgccgcggcgcaagtcgctgtgtgcactgagctcggtcaaggcagccccggaccagnnnnnnnnnnccccccgctccgccgtcagcgccaccaggtcggccggggggcaatctcccacaatgaccgccagtcgccgagccgcctcgccgaccagccccgggtcgtccgccgcagccagcgcacaccccagcagggccgaggacgcgctttccaggacctcacgccgcgcggccttgctccgcgcgcacagcgcggcgcagagcctcgacgcgctctccacgacctcagggctggagtactccagcaggtcgcgcagcagcggcaccgcccccgccccagccagcgcctgggccgcctcgcggctcgtgcgcacgagcaggcccagcatgcccagcgcgctttccagcagtgtcggcccctcgggcagcccctcgctccccggcaggtccagagtcagcaggtagtcccctgggcagtgtgcagggtgggcgctgacgccgtcctcaggccggcatggcaggtggcgggagtcacccagcgccacatgctgaaccccttttcttaaccgataactggcagcgcatcccacctgcaggatnnnnnnnnnncgacgccgtcctcaggccggcacggcaggcggcgggagtcacccagcgtcacatgctgaaccccttttttaaacaaataactggcagcgcatcccacctgcaggattgtcggtgaagtccgccgcgtagcgccgcttctggtaggacccgggcgagccgtcgggccccgacaccctggtcattctctggggcgacgcggcgtgcaacgatttcacgacatccagcagacctgcgaggaggtgtgcggggggaggaaggggggttggaaaaccctgccacggggcgcgtgcccggcgtcaccgctgggtgaacgcctggcgagcgcatttggctgcacttacccctcagaaactacacgccccccccaaaaaagaaaaaactccactccaagtcctcgcaccgggcaccgccggcagctcggcacggaccagtccgcgatggccgaccaccgcgcgcagcgcgcgcagcgtggcgtgccgcacgcgcaccagccgcgggtcaaannnnnnnnnnctggctgcacttacccctcagaacttacatatccccctccaaaaagaaaaaactccactccaagtcctcgnnnnnnnnnntgccgcgcagctcccgcagcgcctcgcgctccgcggccggcaacgctacctcggccgccagctccgcggggctgcacgcctcttccgcctgcgcgaccgtggccgccgcagctgccgccaagtcccacaggcccaccagggtctgcagcgggtggccaccggtggccagcagcgcctcggcgctggcagccgccgcggcctcgacaaaggccagggcggccaggagggcgggggcccgcgcgccggcgacccaggcggcnnnnnnnnnncggccaccggtggccagcagcgcctcggcgccggcagccgccgcggcctcgacgaaggccagggcggccaggagggtgggggcccgcgcgccggcgacccaggcggcgtcctccagggccagcaccaccctcgccgccgcgctcctcgacccccgccccgccaggggggcggcgatcacctggccagccacccacggatcctttgccgccgaccaggccagcagctgcagggctgctgcgccgggctccgcctgaccgtccccagactggcagccgatgaccgcgaggcggtcgaagagggacagcggccacaggacgtgggcgccggccgcacaggcctcaagtgcggcggataccaggagggcgtgcgacggcaggagggcgaggaggtgggcctgcaggcgcggcactgcggccaggaggaaaggggcgcgggccaggcagtcccgcacgaagcccagaaccgccgccacatccacgtcctcgtcctcgccgccgtccaggtccgactccagcgccgcgacctgcccctgcaaatccgcctccatggcaccagtgggccccgccgaggccctggcgtgtgccagggcctccagccgggctgtcaacaggccaggtccgcgcccatctgggacaagaccccccagcctggcggcatgctctgccgcctctgtgtcgcgcccggccatcaggcacgccgcggcacagcggaaggcagccttctggacggcggctgggtcggtggccagggccagggacgcccgcgcatcttgcagactctcctcccactcccccagcttgtaccatgccagagcccggttgcagaggagggtctggcgcaggctgctcccatcttgcgaattttcaggagaacatcccagggattccaggccgcgcgtgaagaaagcagtggcctcctcgtatctctgcggggagggtcaacgttcaaacatgacgacgggagcaaacccgatcgagccgagcattgtccaacccctgtcatgttttcgttgatatcgagtacccacatgcaatttgaatgccgcgttgccatggagccggcaatcatctgcaatagggacgctggaggacggtgccctgtccaccatggtgccgtgtgcaccttcgcctactgttcggtatgcaaggatcaggcccaaagtaacctcatcgaagatttaatcacgctagtacactcctaagtataagtcggtacacatccacgtctttcaatgtgtcaagaacacctctctccgtgcaacctgtcccatgccccatgctgcgcatgacgggctctccttcgtccctggcaccccgtgatgtggtcacacgaagcacagcacgacagctcatgctcgcattcgtgcaagcatgagccttcattacgggagatacacgtcgcaacactcaaagcaatagaattcattttcatcctgccatcggccgaagtggacatcctggccccggggcatcgcgtacctgtttgctgattccagagtcacccgacgaccacgtctctttcgaaccacatgatgccgtgacatactcttaccacataatgaccgacatagaggactccccgccctctcaggaggaacagcagcgtcgctccgagaatgtccaggccctcctggatggaaggcgagtacacagggttggggaacctgcccgcgaaactcgatcaagtcatgcacgtgaataacgacaagatgcgcaggaagatgcataacctccttgaaattctttcgcattcctgcccgcagtttggaggttgcacgcggtgcgctgctgcccaagatcctcatcgtagctcagggggaggctgtgctgaagaagccattcaagtctccgcaccccggcgcccccgccaagtcaaatgtgagctggatacctgtgggtttcggactgcttcccctatgttggctcactcagatccattcgacccccccctaccttttacaaccccctttctgagcagtccttgcgacgtttcctttcaagccggaaacactttgtgccatggggccagggccagcccctccccaccccgctgcggcctctcccagactccagctcacccccagagcccagcccctcgccccctgccaaggtatgcctggctgtgggctggggctgactgtgcttgctccacgtggttgtcacatacatgcttctgtggcatcagcctcccaggcctcatgttgcctggttcagctatgtggaattcaggaccacaaatcctccttatccgccctttccccctcttaactatcgccagatcgagctgccgcctggcatagagcctttgattctgtggaccccgaccgaggggcaggagggcacccccgtggaagttgacccgatgctgactcgctggctccgaccccaccagcgtgagggcgtggccttcatgtttgagtgcgtcaccggcctcaggccctttgatggccaaggtggggcgggacgtgggcctgggtaaagccactcaggaatgctcgggtgtttgctgtgtgggaagaatggggaagaatgtaccctatttcccccccccacacgaagtcgctgtccatcctgcaagcaccctcccctcccgctcctgccaaggctgcatcctggccgacgatatggggctgggcaagacgctgcagggcattnnnnnnnnnngagcacccccccctcccgcccctgccaaggctgcatcctggccgacgacatggggctgggcaagacgctgcagggcattggcctgctgtggaccctgctgcatgcccgggcccccgccctggggggcacccccgtggctaagcgcgtcatcatctgctgccccaccagcctggtggccaactgggactcggagtgcagcaagtggctggacgggcgggtcaggacgctgcccctggccgagagctcgcgggaagatgtcgtcgcaggggtgaactccttcctccaccccaatcacatccaccaggtgaagaagggaggggcctgttgggagggggggtgatgaggagctgggccaaggacggatgggtgttgatgcactccatgctaactgggaccccagagatggtggagactcgccgccagcctgcttgccnnnnnnnnnnggaagggaggggccggttggggggggggttgatgaggagctgggccgaggacggatgggtgttgatgcactccatgcaaactgggaccccagaggtggtggagactcgccgccagcctgcttgccatgcatggcaggggacactgtgactggccactcccactgtcaagtgtacttctgaaaaaaacggctgtcatcacagtcgccgaagcgcatggccctgagatccaggggcccttatctgctgcccccatgaaccaaaccaccatnnnnnnnnnngagtgtactcctgaaaaggacggctgtcatcacagtcgccggagcgcatggccccgggatccaggggccccatctgctgcccccatgaaccaaaccaccattgtacctctctggccccccttgtatcttcttgacccacaggtgatgatcgtgtcgtacgagactttccggctgcatgcggagcgtttcagggaggcgggcacctgcgacctgctcatctgcgacgaggcgcaccgcctcaagaacgacgccaccctgaccaaccgggcgctgggtgccatggcctgccgccgccgcgtcctgctgtccggcacgccgctccagaacaagctggacgagttttacggtgagttcaccgcgtgcaggaccgggtgaggagggtgttgaggggttggacaagatcacagaacaggcgatgcacaaatgcggcaagaggtggcccaccgttcaggagacccggagacagccgcgctgctgtgcacgcccatggatcctcaccccaagcccttccctgccgaccctcagccatggtggacttctgcaaccctggggtgctgggaggtgctggcgcgttccggcgctattttgaggggcccatcctggcgggcagggagcctgacgccagcgacgctgaggtgatgatttgttcagagattgggttgggcagcttggcatgtcccggctgtgactggaatgggtgnnnnnnnnnngagagacagggttgggcagcgcggcatgtcccggctgtgactggaatgggtggggctttaggagcggttgctgtgcagccagcgagcctgtccatcgtccaggaaactgtcctctgcctttactgttcatcgcatcatcgagtaggcatgaacaactccaccacgccttgcctcaacctcctcccaacctcgcccgccaccctgcaccgtgcaggtggaggccggcgcctcacgcaccgccgagctttcctccatcgtcaaccacttcatcctgcgacgcaccaacacgctgctctccgcccacctcccacccaaggtggtggaggtggtgtgctgcagcatgacccccctccaggcctccctgtacacccatttcctcgactccaaggctgcggcagcgctcttcacctcccagcgtgccgccagggtcctcagcgccatcacctcactcaagaagctgctcagccaccccaagtgaggggtttggagtgctgtgggaaggggaagtggggtaggtgtgtgggagacatgggagcgctgagcagaggcatgcacccttcacaccagcaacagatgtgcatgttggagaggacgatgacagccgcctggcaacagcgcttccccacgtcgaccatgtacccacgcaggctcatttacgacacgctgcatgcgcccggggcaaaggggggcgacgccgatggctttgcgggggccggtgccttctttcccccgggcctgttcgatgacggacgaccggggcggggttccatgcccctgggttgggagcacctctctggtgagtgcatgactggggcatggggcgctgagacggccgtgggtgctcctggttggccagggcggcagagacgcgcgcgaggttgagctcactgccagagcattgagcttcctcaggggtggggcaatccagtgatgccgtgcagcactgcccatcttgtagcggcctgcccagcaacctgccggtgtgtaatcagctgactcctgcaaattaatcacccnnnnnnnnnncgatgccatgcagcactgcccatcttgtagtggcctgcccagcaacctgccggtgtgcaatcagctgactcctgcaaattaatcacccttgctatgcgtattctcagggaaattctccgtgctggcaaagctcctggatgtgctgcggcggctgacgaccgatcgtatcgtcgttgtctccaactatacacagaccctggatcttgtgggacaggtgagctgcccggctgtcagggtgtgttcctgtctgcttgattgctctgaacagcgattgaatgcaaggtgcagagcgtcgttgagcatggcaatgcgactgtggggtgcttgcgccctcggacgctgcacccctccttctacggccactattggaatgatcctgcccctcaccactgctctgccgagcagctgtgccgtgagcggggctaccccttcctgcgcctggatggttccacaaccatcaacaagcgacagaagctggtaaaggccttttgtgatcctactggtgagtggcatggtgatcgccatgcatctggggaggcccactgtctcctgccagtattttcgtcacaaaggctgaaatgcccgcagtagtgtcgacagcctgggtcctggtgggcgggcgctcagccaagcagtcatcgtcaatcactctcacgacgcacgacaacttccctgcctggcccctacttgtgacagaggnnnnnnnnnnggtcaatcactctcacaatgaacaacaactccctgcctggcccctacttgtgacagaggaccactttgtgttcctcctctcctccaaagctggcggatgtgggctgaacctcatcggcggcaatcgcctcgtcctgtgagtcggcgctgtgcacttggtgcagggagcagactctgcggatggcttgcttgagatgaccctcagccatgtcacggttcttggcttccttttcatagcacaccaccccctgctcctgcagttttgatcccagctggaatccagcagatgacaaacgtgagtggagttgggaggggttcggccgcaggtcaggacaggattgtcccaatatgcagccaggcacgattccctgtgcctgagctgggccaggctccataggatcaggcaaccgaccacacaaccccaacacatgtcgcttgcccgtgcagaggcggcggcccgcgtctggcgtgannnnnnnnnntttcggccgcaggtcaggagaggattgtcccaacatgcagccaggcacggttccctgtgcctgagctgggccaggctctatagcatcaggcaaccgaccacacaacccccacacatgtcgcttgcccatgcagaggcggcggcccgcgtctggcgtgacgggcaaaagaaaaaggcaagtccccgatggtattggggctcctttttgatctacgcggggcctctgtcctgcagggacctggcagctgcgtggcctgnnnnnnnnnngtggcattggggctcctttttgattttctacggagcctctgccctgcagggacctggcagctgcgtggcctgtctcagacttgcccgcaccccacaggcacccgaccccaacatctgcacccctggactctcgttcccccggacccacccgcaggtgtacgtgtaccgcttcctgaccacaggcaccatcgaggagaaggtgtaccagcgccagctgtccnnnnnnnnnntaggcccccaaccccaacatctgcacccctggactctcgtcccccggacccacccgcaggtttacgtgtaccgcttcctgaccacgggcaccattgaggagaaggtgtaccagcgccagctgtccaaggagggcctgcagcaggtggtggacacctcggccggcgccggggccggcggtggcggcggcggcaacctgatgagcatcgaggagctgcgggacctgttcacgcacgacgccgccacgttgtccagcacctacgacgccgtctgcgccaagaagaaggccggcacaggcggaggggtgagtgggggagcggaaggggtctggaggagtggggaccggagtgcgcaggcgagggtgggaggaccagggttgggagcctccccgccatcctccaggaccagccgtccctctccagcaccgcgctcaacccaacacccatccacacacacacagggcgcccgtcttgcagtgggcggcgcggcccaagccccnnnnnnnnnnaacccgccgtccctctccagcaccgcgctcgacccaacacccatccccccacacacagggcgcccatcttgcagtgggcggcgcggcccaagccccgcagcgcgccggcgccggacccgtggctcttcccccggactaccaccggtcccaggtgggccaccctcccgaggaggacctggggtcctgggcgcaccaccgcagcgtgcacagcgtgcccgaccccgcgctgcgcgaggccggtggcgagcacgtgtccttcgtcttcgcgctggatgtggcggggcgggacatcgggcccgaggccccgctggcccccgtggcgcggcgcccggggtcgggggccgcgccctggggcgggcggg

SEQ ID NO: 40123 - DNA, 72 bp, Chlorella protothecoides
ctcaacctcacccacccacccaccctggaccggcagggtgacgctggccaaggcgctggacgccagccgccg

SEQ ID NO: 40124 - DNA, 1613 bp, Chlorella protothecoides
ccgacgtgggcgtggcggtcgggtcgggcgcggcggtggccatcgacgccgccgacgtcgtgctcatgcgcgacgacctggccgacgtgttggccgcgctgcacctggcgcgcgcgacgcacgcccgcatccggctcaactacctctgggcgttgggctacaacgcgctggccgtgcctgtggctgccggcgcgctgtacccgcccctccgcttccagcttcccgcctgggtggccgggctggccatggccctctcctccgtctccgtcgtctgctcctccctgctcctgcgccgctgccgcccgccggtcgtgcaggggtgcggcggcgaggagggccgagcgtcggccgcgccaaccccttggtggcgctgccaaggcggccgcggcacgccccgcccgcgcccgcgcgccgaggtcggcctgtccaactccatcgcgggttccctgggccggatcggggcgagctgatagaggccgccccacttggttgagtcgatgccagggccaagtactggaccgcctctgcggtgcctactcaattgctttgccgagagatagactcccaggggaaggctccaggcaccaggcccgagaggaagctggccccccctcaccgccctggcatctgcaagtgcggacagcactacctctacctcctcgaccaccagcctgccaccaccctctcgtttagcctacgtgtacagacaaaatcatgtgggaacagcacaggggagaggtaccagagcagggctcatgggcccgttatttgccagggagggcagcctcacggcaggagccaatgcgacatggagagaaaagggggggacaggtcaacggctgcacgctcgtgctatgacttgggacagggtatcgggggggggacagagcctgcctgtctgcactggcccagtggactaccccgcgggcagcgcgtgcgtggggtgggaaaaggcgtgcggtcaatgggaggcaggcgcgcgccgggctccgtgcccacgtggcgatgacgtcgaacatgcgtggggtgtctgcgtcgcagcgcctcaggccgcctgctccagcccggagcccttgaacctgggcgcacgggaaagggagttggatgggggtttgggatggcgacgatgccgtcgcctgggctctgcccgggcatcgggggaataacagggcatggtggggggggggtcgccatgggagtccccaccccacccttgcgcgccctggaatggcccgccccgatcccaacaccttgtgccgcagctccctctcccggcgctcacccatgcaggaccgaggagctgaagaccgggaggtgctcccgcccctcacccgccggaacagaccaagccccctccgccggcgcggcctcggccacgcgccccgcggcggccatcgcccggctcagcgcctctacctcagagccccacccgcggcgctccccctcctccctaccgcgcttgacgggcgcgccgcggtgaggcggcgccacctgcgccagggcgcgctgccaggcgagggtgtccagcgagcgcgtcgtggccgccgcgccccgcgcctcgccccgcgcctcgcccgccagcagcgtggtcagcgccgccaccagctggcgca

SEQ ID NO: 40125 - DNA, 61 bp, Chlorella protothecoides
tcctgcatgcctggtcaccggattccggggaccctgctatgcctcgctctactcatcgccg

SEQ ID NO: 40126 - DNA, 61 bp, Chlorella protothecoides
gcctgtctcctccccagaccgcccaccttgctgcaggtaacaacggatggcacgagcaggg

SEQ ID NO: 40127 - DNA, 24214 bp, Chlorella protothecoides
  modified_base (356)..(365): a, c, t, g, unknown or other
  modified_base (726)..(735): a, c, t, g, unknown or other
  modified_base (818)..(827): a, c, t, g, unknown or other
  modified_base (1534)..(1543): a, c, t, g, unknown or other
  modified_base (5239)..(5248): a, c, t, g, unknown or other
  modified_base (6474)..(6517): a, c, t, g, unknown or other
  modified_base (6911)..(6920): a, c, t, g, unknown or other
  modified_base (7321)..(7330): a, c, t, g, unknown or other
  modified_base (8278)..(8287): a, c, t, g, unknown or other
  modified_base (8763)..(8772): a, c, t, g, unknown or other
  modified_base (9277)..(9286): a, c, t, g, unknown or other
  modified_base (9446)..(9455): a, c, t, g, unknown or other
  modified_base (10391)..(10400): a, c, t, g, unknown or other
  modified_base (10697)..(10706): a, c, t, g, unknown or other
  modified_base (11696)..(11705): a, c, t, g, unknown or other
  modified_base (12022)..(12031): a, c, t, g, unknown or other
  modified_base (12728)..(12737): a, c, t, g, unknown or other
  modified_base (12990)..(12999): a, c, t, g, unknown or other
  modified_base (13760)..(13769): a, c, t, g, unknown or other
  modified_base (14420)..(14429): a, c, t, g, unknown or other
  modified_base (15040)..(15049): a, c, t, g, unknown or other
  modified_base (15576)..(15585): a, c, t, g, unknown or other
  modified_base (15833)..(15872): a, c, t, g, unknown or other
  modified_base (16466)..(16475): a, c, t, g, unknown or other
  modified_base (17068)..(17077): a, c, t, g, unknown or other
  modified_base (17623)..(17632): a, c, t, g, unknown or other
  modified_base (18171)..(18180): a, c, t, g, unknown or other
  modified_base (20923)..(20932): a, c, t, g, unknown or other
  modified_base (21198)..(21207): a, c, t, g, unknown or other
  modified_base (21605)..(21614): a, c, t, g, unknown or other
  modified_base (22351)..(22360): a, c, t, g, unknown or other
  modified_base (22510)..(22519): a, c, t, g, unknown or other
  modified_base (22986)..(22995): a, c, t, g, unknown or other
ggccgcggcggccgccccggcggcgcgcgcgcggcgcgtgcggtttgaccccgggatgcccaccaggccctcgccctcgtcccgccagtggtggcggcgccgggcgcggtgcgcaaaggtgcgctcccgccggtgctgcagcgcgcggaagtacatgtactgcatgagcaggatggcatccatgcagatgaagtactgcgcggtgaacaccacagtgggcagctggtcgcccttgagcaggcagcccaggaggttgaaggtgtcgccctggtggtgggaggaggggggaggggtgcgaggcatggtgcaggggcaagcttgcactgccctggatgcaaattgtgcatggggagtgnnnnnnnnnnacggtgggaggaggggtgagggtgtgaggcatggtgcaggggcaagcttgcaccgccctggatgcaaattgtgcatggggagtgcacacatcgcggcaatgccatccctcgtcctacacggtccatactaccccacccttccccttgcgggctccatggaaacccctacccaccagcaaccactccgccaggaaccagggactcagcgcatcggcccgctggcgccgatagttggccacgagctggggtatttgtgccaccatccagaaggcgatgctggccaggcccagaccgaagcccagcatgtctcgcgacctgcacggcgcccgtaccgggtgtgggtcggtcccggtacaaaacnnnnnnnnnnagctataccttgaggagcgtaaatgcgtatgcaatggagggtgatcgggtgttgatcgctggcacactgtccaggagcccgcnnnnnnnnnnccccagcatgtcccgcgacctgcacggcaccagcaccgggtgtgggtcggtcccggtacaaaaccctcgctaacggtggcagtcaggccccacgtccctcaaaccctgcgcacgtgtaaatgcagtcatggaagtactgttctatcaagggattggcgccatgatgacaggccggtggcatgctcccggcctgaggaggcagccccgtgggtgaggcgccagggcagaggggaagcagggctgagtgcgctgcacgcaatgcgacgacagttgctataccttggggagcgtaaatgcgtatgcgatggagggtgatcgagtgctgatcgctggcacactgtccaggagcccgcggaggacatgtccgaccccgcggatccggtagaaatatgatcataatgggccaatgtcaacacatctcatagatggttctggcaaggattcccctcctctgcataccaaaaggttacgtagaaggtggctgaaatatccaagctgccttccatttttatgtaagcttgcaagactcgttctcgggtttctgtgcccaggatgatatctggaagcaaggtgtacgatgtgagaggggtggaattgggctttgttgtaagggtccgcgacatacgtacacaagaaatacgatatgggccgatagcaatgaagattcatataaggggggaggataaatagtagagccaggctgacannnnnnnnnntttacgtagaaggtgcctgatatgcccaagctgccttccatttttatgaaagcttgcaagacccgttctcgggtttctgtgcccagggtgatatctggaagcaaggtgtgagatgtgagaggggtggaattgggctcagatgtaagggtccgcgacatacgtgcacaagaaatactttatgggccgatagcaatgaagattcatacaaggagggaggataaatagtagagccaggctgacagagaacatcggcatcgtgggggaccacaaggcaggcggcagggataaacacaagcggcaaaggatctcaagtcaggcgcgcaggagcgcatgcaggaccaggaacactcctatgagagcagcgaggacaaagaggacgctgcctcccctgcctcgtgggcgttcctctggcatgcgctccaggaaccactccagggcgccgcactgtaccaggtctgtggagatgggcgcataccccagctccgtccgggccttgtcgatgctgaagtagtgggtcacccccaccttgagcacctcggcccggactaggagtggttcaaagtcccagacggggtgcaccacccgccagatcagctccgtcagccaggccaggcagtagaccacgaggaggggtaggcgcaggtggggcgtggggaagccgagccccaccaggaggggctcgaagaacctgaacatgttgatgggcgagccgtctggcagaggggatggggtggtgagtgggattcaggattgggagatggagtgctgagcagggtgctggaaattctgttgatgctctagatctcgaggagctcgtcgctttaatcatcacccctggccagcgcgcccagccatgcaaggtccacaaagacacccagaatcacccatgcttcccacctgagatgaagtaggcctgccccgccgcctcaccaccgttcgcatgggccagcgagcgcgccgcgaggacgtgcgcctccacgagattatccacctgagcgggggggatacacatttggcgcgctgggatgtggggaatctgggtctgacctttggaaaccgaacctctgtggatgcttcaccctcccccacaacagctcccatcccgcccctgaattctcctcatcctgacggcggctcacatgcaccatgtcggtgaggcttgagggcttgccaaaggtgcatttgtaccagccacgccgcgcgttctccaccgtgcggggcaggtgccgccgctcgcccgcgccatagatggccgccggccgaagtgcggtggtgtgcagccgccccctgcctgggtcgccgtcctttccaacatgccgcgcgccgttggccgccaggaccgcctgctctgccagggctttagtccgggagtaggcgtcgcagtgggcgtccagggggaaaaggggcagggactcgtcgccggccacgatctccaccccgccaaacaccgtgttgtaggtggaggtgtagaccaggctgggcacgccgcatgcgatgcaggccgccaccacgttgtccgtgcctgggtgaaaggtggggaggggattgggcgtgctcgacgtgggctatgcaagccactgttctatgtccaaacccagaggagtgcacccacttgacatggatcgccccgcacccatagcgccctccagcacagcaaccacacccatcccaacatcgcctcaccctgcacattcaccgcatggatgatggccgtgtgcagctgctcgcgcatgctcatgccatacgacgccgtgtggaagacgacgtctgccccctggaaaatgccctgcagaagcttggcgtccctcacgtcgcccaccaccgcctccacgcctgctgcaggctccacttgcacgtccagggccaccacatcgtatcccagagccgccaaacgcttcgccagtctgtgtgttagcagtactcccggcgctgtgatggtttggaggctgacacccctgtggacaccccttgccaacaaccgccttccgtcttgttcatcctcgagctcaccgattgccaaagtatcctccccctccggtaacaacggctttgccgctgcgaggggccatgctcagatcgtttcgaaaatcggcatgcgtcggtgcatccctagatcatattcagaactggcgatcggaaggaaaggcgcgcgaaagcgggaccgagtcccatcccgggagagccagatggacctccccatcgccgcgggcatcgcccctacaaaacagcacatcttctgggcacaggaagttgactgggatgcctggtggtgagaggtcacctccctccccggctcagcgcagggcctgaccctcggcgcgcggcactgcgattgccaccatgctcacggtccgatccgaggtcatagagtatgggtccctgcccacagctccttggatggtgcagttggattcagtgcaggcgctgcagcgaaggcttcgacacctgctccagctagcagaccagggtggcgatgacaggggtgaggcaactcaggcaggcgttcggcacgctcgatgactgatcacggaatgcatctcaatcacagcttgtatcgatgcaggattcctcacggtgcccgccctggccacggctttggacattaccaccacccagaccaaggcaaggagggggcatgagtgtccgggatctcggagctcctcccttaggcctactagtgttcctgacgcccagttccatcccgaccacccccatcccagatcctgaccgttctgttgtccggcctggtggagtctccggcctccctgtgccttgccccaggcaaagcggggcttggggtgtgtatcgttgcatgattgctgctgtgcgcgcccagtactgcagcatgagggtgggagaccttgagggactggttgcagcaatgcccccccacctcactcgtctccttcccccctattactcctgcacagactctgacgaggtggtggcggtggaggtcacctgcctcaccctctacctcgttgtggcctactacctgtgcaccgcctccaaggccgacacagccgacgtctggcccgccgatctcttctcctcccagcacgagccctccagccccatgcgactcatctcgcgggcctggggccgagaccaacgtgcgcatggttgggagaggggaggggaggcgcggcggcggagggcatgctcgtcgcggcagtgtggactgtgggcagaggcgatggcagcaagcactgggtgtgctgaccagccccgcacgctgttgcctggtccaactctgagcgatggcgaggccctacgctgatctgcggtggcctgtctgcatccgtacaggcagcaggaaccccaggggtcaaacctcacacccctacgatcctccccatacctccccagaaccccagcaccgagcgcacctgcccagcgtgcgccagcacctctccgagcacctggcaatccacgaggcgctggtgaagggcttccgcggcttcgtttgcgcccacctggccctcctgctggaagcggtgggcgtgaggggcctgcagggcgccaccccaggccccgacgccatggacagcgagggcggggagggggctgccgcaggccgcgtgtcggcggcgcagcttgaccgcctgggcttcctcattgcccagggccccccctcccaggaggtgtggggcctgggcgaggcgtcccccacccgcggctcgcccatggacatcnnnnnnnnnncgcccagggcgccccctcccaggaggtgtggggccggggcgaggcctcccccacccgcggctcgcccatggacatctgcgccacgcccaccctgttccagggtgggtttgtcttgctggcttgggtgctgtctggtggtgtgattgtggatggggggtgggaggtgggtgagcaagcgcggctcctgggtgcctcggcgccaggcgcagacctggactcgggaaccttgggtgccttgtgtcttccaatcgcagcccacgcctttgtggattcagtgggacttaggggcgcatgcagtgcatctcatccgcacagccctcccggtgccggtgttgtggacacccactggtccctgggtcgcatgcatgcgtaccagtacgctgcccgtccgtggcagtcaccttcctgcaactctccctctcccctcatacctccaccccaccctgcagacgcccccccccgcctgagttcgctgagccccttcttccacgacccctcccagcctgacccccccgccctggccgtggcggggtggctggccgagtccctgggcgccgaggacctgggccccggcgcggggtacggcgaccccggcggcgcggcgtcgcccccgcccccgccctcggccttcaaccagctggtctccctggcctccccctccgacctccagtccctgcacaaggccaccgtggtgcgtggcgaggatgatttccccggcggcgccgcgcgcgtgctggactgccacgactgcatcgtgtacgcgctggccccgctgcgccacgccctgatctcctgctgcaccgactgcctggtggtggtgggcgcggtgggctgcatgctgcgcgtggagcgctgcgagcgggtgcaggtggtggccgccgcgcgcgcggccacggtcaacacctgccacgactgcatcctgcacctgggcgtgaaccgcgagccgctgctggcgggcgacaaccgcttcgtccagctcgcgccctacaacgcagggtacgagcgcctggaggcccacgcagcgttggccggcgttgcgggcgggcgctcgctctgggactcgcccctggccatgctgccggagcaccgccgcgacggcggcggcgcgggcgcgggggcagggcacgcggccgcggcctcggacgccgccaccgccggctccctgcacagcgccagcagcggcggcagcagcgccagcagcggcagcagcggcagcaccccccccnnnnnnnnnnnnnnnnnnnnnnnnnnnnnnnnnnnnnnnnnnnncccagcagcgcggtgccgggtggggcggccacagtgtcgctcctgcccccggccaagctggtgcccttcgtggtgcccttccgcggcgcgggcgggccgctggcaggcgggccgcccctgcaacgagacgccaggtgtgtagagaaagaaagaagggaactgggggggggcgatatagtatggcatggcatgtttgagagggtgtatgttgcgtcgtgtgagatggagggtgtgggggtcggatgaggagcctggggtgcggcgggcccgagcatgtgcctctgtgagcacgctggcccatttgccacgccatgccctgctgccattaactttcacacccccctgcccccactgtcccaccctcttctcaggagcggcagcgacccgctgtcgnnnnnnnnnntggtgcggcgggccggcgcatgtgcctctgtgagcacgctggcccagttgccaggccatgccccgctggcattaactttcacacccccctgccgtcactgtcccacccccttctcaggagcggcagcgacccgctgtcggcattcctggactcgggcgagggcgggggctcgcagttcccggcctcccccttccccctcccgcagcagtactttgagacatgggaggccaagatggcggcagcgggggaggtgcgggctgccgtgaaggaggtgagcgcgggacgcaaatagggtgtgtggattacgagcaccttgtgccacgggagtgacatgggcgaacaactggacacacacaacggcggctggtgcgctgtcttcagggcccagcgtgtatcccagnnnnnnnnnnaggacaacgagcacctcgtgccacgggagtgacgtgggcgaacaactggacacacacgacggcggctcgtgggctgtcttcagggcccagcgtgtatcccaggcagtcgcataccgccgcaggggtcaaaggaggcaatcatcccttccctgctccccactcctctgtttcccttctgatcatcacaacaccctgccctaccatgcaggctgcgctggaggaggggcgacgacgcgaactcatggcggccattcaggccagcttcaaggactggctgcagtccacagggtccatgcggcacgtgtatgacatcgcacgcatggagcgggcggaggcagggacagggagcgggggaagggggtgagggagatctcgcctcccacccgggagcccgcgcgagatccgctggaacccatcatgcgaaacccttgacgctgtaaacgacatgcagcaacccccaagaaggtggttcaagttgtgataccgaaatcatacaagacgggcagaggtcacggctccaggctatcatataggtgctcctgttggtgccgggccgcagggcgttccctcctgtcactgggcgagcttcgagctaaacgcgccctttgagattcgacaaaccgcttgaagagatgggaaacgagcagaccaagcagcgaaagctgagccgcatgggctctaagctgggaagccagaacacctcccggaagcatacgcgcgtgccctccaaccccgagtccttgctcagccaggtttctgagaacctcgccaaggaggccagtcaggtccttcatgttcatctgaacgatgcctcgacccacctggccctcaagcgcacgagttcgggccacatccagctcaggctgcctgacgacctcaaggatgatgaggaggtgtgagggctgggagtggggggaaaaggccttcatctctggagacgaggcatgnnnnnnnnnnatgaggtctgggagtggagggaaaggccttcatctctggagacgaggcatggcagaccgggtcagagccggcccttccctcctgtgagcgacaggcagccatgacggagcaggaggtgcaggacctgaagctgctggaggacatcggactgggcctggagttctcaccgggcgacgcattcatcgggcagctggtactggatgtgcaggaggcctctggcctgaagccgtcaggtgggattacgtcagagggtaacattgcatgaggcgctggacatggaggagctggtgttgagcaggcatgcctgcatggtggtggtccccaggcttcaggcgcagagatacatgtggcatcttggtataggcaatgaatccgccctcctgtacacgcttgtgtcagttgttggctccttgctgcccccctgcaagaccccttttctcgcccacgtcctcagtcaccaacacctacgtcactgnnnnnnnnnnttggcatcttggtgtaggcaatgaatctgccatcctgtacacgcgtgtgtcagttgttggctacttgctgcacccctgcaagactcccttctctcgcccgcgtcctcagtcaccaacacctacgtcactgtggcggatgagagtgacaagtcggaggccaagttctgcagcacctgcgaggacacgcacgcctggtggagcgaggcacgcttccacttcatcgtgctgttcagcaacagcgtgctgaccctgaccctgaaggggcgtagtacggtgcttgggggaggaaagaccgtcttggggcgggtacgtgagggtgttgtaatcggatttttccgtgtgtgtgtgtggtggggggggggaaccagggaaggcaagctgggtgtccgctaatccacagtccttgaatgagaataggactgcttgtgctggtctacagagtgacactggtgttcgaaatgcaccccccactgcggcccggacagcctactttcagactggaggnnnnnnnnnncacactggtgttcgaaatgcacccccgctgtggcccggacagcctactttcagactggaggcagggtccccaccggaatcttcgctcctgccactgtgtattccattccccaagcagcgcaccatgcatacaaccctgcaatcccaccttatgccccttnnnnnnnnnnacgctcctgccgctgtgtattccgttccccaagcagcgcaccatgcaaacaaccctgcaatcccaccttatgcccctttgcaagcgatcttacctctcatgccgcctctcagaccaacctcccccccccttgacatacacgcaccctacccgcccgcaggcctacctccccgtggcctggctgcgccaggggtctcaggactttgagctggagctggagggctcccgccccggcaagtcgggcgggcggctcaaggtacacgctcgctacgcctggctgcgcggcacctctgacgacggtacctacaccaaggtgaaccgcctggtgctgcaccgcaccagccgcgtcgtgcgcagcgcggccatgacggccgcggtggagcacctcagccaggtcaaccactccctgctctcccacgacaacatctgggcggtgctggggccaggtcccggcgccggcggcgacgagggaaccccagcgccgcgcgagacagcctcttcgtcccccaccccggcgctggaaacccaagcctcagacgcggagtcgctgtccggggcgcaggcggcgctggcagcctcgctcccggccttgccccccgcctcgctcgccgcacggctggccagtgagctgacgcacgccggggatgaagggccgtccagcacctcccagcatgccgccacggcgctgctggacggtctgtccggcgcagccgccgacacgccggaggtggccgacctgaagcgcagcctgctcatggtcctctgccccgtgctggaacggctggaggggctggagcgcaagacacaggcgctgaccgccgcgctgcaggagcgcatgtgggagctgggtggcctggcggaggtgggggagggggaactggtggcccaggcgacgccggcggcgggtgggggtgacggggatgacgacgcaggtgcnnnnnnnnnncggcctggcggaggtgggggagggggagctggtggcccaggcgaagccggcggcggctgggggtgacggggatgacgacgcaggtgcgcagcgaagggggtggcggagggggcccgtgtctgtggatgttttgaggggttccaagtgtgcaccgctcgcagataggtatcgactcgctgcctcctctcccgccttttgtcctgtgatacggagttcggcctcctgagaagtcactctggtgatgcatcacagcacatcagtcctttttccgaccacatcgtcgctcctgaacagccnnnnnnnnnnttggtgatgcatcgcagcacatcagtcctcgttccgaccacatcgtcgctcctgaacagccccaaacatgtaccttcccccactgtctgcagtatccctccccacctccccccgtctgccgcagtccagcgcagctccaacagcctgggccggctgaaggcgcgggcggctaacccggtggagcccttcctctccggcaagttcgagtacggcatgggccggcccgccaagcgccgcaccgtcttcatgttcatgcggaaaggccactgggcggagcaccccgtcatggcccctgccttcctcggcacgcaccgcaccagcgggggcgggcgcctggggcctctgccggtgacgcagagcgtcgcctccacgccaggtgtggttggcgggggacgggcgacagtgggatggatgcgtaggatggccttgcacgtctcccagcgcacccctcacccccaacctccaaccaaaaattccaggccactatgaatttgtgggcctgctgcccgacgactactcctacgccaagggcagcatgttcatgctggagcccggcacgcgggcggtggtgttcgacctggacggcaccatcaccgtgggcgacggccaggtggtgacccagttcacgctggacgcgctgggcgccagcacggccctgaatgccaagctgagtcacaagtacgacctgcggccgcggcggcacgcgctgcacgcggtgcgagcctgggcggccaagggttaccagcccatctacctgagcgggcgccaggggtcgtactacaacctcaccctggcctggctgatcaagcaccgctacccgccggggcccatccacctgaccaggacccacctcccgacgctgcccgtctacttctccgtgggactcttcaaagtcaagtgggtttggggttctggtcagggggggaggagggggagattgtttgtggggcctcctcgggttcaaaggattgacagggtcgggaagcacgnnnnnnnnnngttcaaagtcaagtgggtttggggttcttgtcagggggggaggaggagggggagattgttcgtggggcctccctggattcaaaggattgacagggtcgggaagcacgtggaagtccccagtgctcggtctacgaggccacggggtgtatgctctgcacggagcggtggggggtgttgcgcagctccggatggggtcggcctggcaatgagagcgagccgcccaccgcccagtccctcctttcctccatgcgccaggtacatcgagggcctgcgggccaagggcatcgatgtgtacgcggcctacggcaacaccatgnnnnnnnnnnttagtgctcggtccacgaggccagggtgtgtatgctctgcacggagcggttgcgggtcctgcgcagctccggatgggatcggcctggcaatgagagcgagccgcccactgcccactccctgccttcctccctgcgccaggtacatcgagggcctgcgtgccaagggcattgatgtgtacgcggcctacggcaacaccatgaccgacataaaggcctacgaggccgcgggagtcgccaaggtcgggaaagcgcggggcgccatgccgggtcagacctgtgtttcaagggggtatgctggcgagagtgggacagcgtcaccacaaccggggtcctcccgctggaacgactggccaacaatgtgtccccaacattgcactgtgcctgcaccccgtggacgagacacccacaaggacactcacatgcgaacagtactgcagtccctcacccctgctccactccatctcctcctcttctacgcgtgcaggagaggacctacatcatcgggccctttgcggggaagaacggcacgaagaaggttgcaaactggaccgaccacctgcccgagatcatggcacaccccgacgcagaggtccccatcccctacaccgaactgctcatcactgagatgccgggatatgtcaagtaagtcgggccaaaagtgggggcaggagggttctttgcgtcggtctcgtatgtnnnnnnnnnncgagatgccgggatatgtcaagtaaggcgggccaaaaggggggggaggagggttctttgcgtcggtctcgtatgtggtgcagggatgttggcctgggcgacgcctcctctacgtccagccaggctcaaattgtgggagttcggcatgcacgcgggaggcattggctgaggtggcagtctttgccacaccggaagcagcaagatgggacccctcgcagcacaatgtactgcacgtccaacattgctttctcaannnnnnnnnnattgccacaccggcagcagcaagatgggaccccttgcagcagggtgtactgcacgtccaacattgctttctcaaatcctcttcaggaacaaaacggtggtggacaaggagggcaagacccacgacatccgcgtcgtcagctccctgcatcagcgcacggcgagcgaggagaagatcctggaagacagcgagcagtttgcacccagcgtcaccgccgagtgagtggagcgaaggggacttgtcagtcgatgcctgattgtggcagggtctcaaggacgctgttggcgacacagtgcttatgttccggggggtgctgcgtctgaggtggaccccataccttcctgcagctgtcaagaaacccccctcccccccttgaccctggcatctaggcctggagcgcgatcggacacgcccagcagcttcctggacgactctgaggacgatgacgaggctgcagtggcctcggcgacagaggccctgggcaatgtgacactccaaggccggccctgacgcgatagattacagtttctagtgtagtatgatattcttaactccacctcctcaaccagggcgactcagcgtggacttctgatctcctgtacctctcaacacccccacgttgtaaacatgtacacaggccctgttgtcgtgggcagcatgggacgcgctgccatttttggattgagattgtcagcagatgccgtcagataaacctccgagtagcagcactggcctacgtcccaaggccctcttctcacaccnnnnnnnnnntgccgcagtggcctccgcgacagtggccctgggcgatgtgacactccagggccggccctgacgcgatagattactgtttccagtgtagtatgatattcttaactccacctcctcaaccaggacgactcggggtggactacatctgatctcctgtacctcccaacacccccacgttgtaaacatgtacacaggccctgttgtcgtgggcagcatgggacgcgctgccatttttggatgagattttcagcagatgccgtcagataaatctccaagtagcagtactgcctacgtcccaaggccctcttctcacaccgcattcaggcgcgccgccagcgtgccctgcagcgccgccagctggcagccccagcgctcgagtgccgcgtgccgggcgtcatttgggtcggcgcgatccagggtcagaacaccctggacctggtctatggcgcccgcaaatttgccgtccaggagcatggacaccagcagggactccacctcgggcggtgggatgttcagctcctccccgatggccgacaggcggatgcgcgaataggactgcaccaggcgcgacaccgcctgggggggtgaagggaggggtgtttgcgtggcggaagggtgatggcgctggaagccggtcgtgatgcctgtggagtnnnnnnnnnnttgggaggggtgtttgcgtgtctggaagggtgatggtgctggaagccggtcgtgatgcctgtggagtgccgctggtggatgtttggaccacaaaggctgggtggcagccgcacgggcgacctcacccatccatcccctcgacgtccatccccacagatgcagtgcgcggcagtctgactcctggccccaagcacgccccccgccctccttccccccattccatactcgcctggatcctgacgttgcgcagcaggtcctccacgtactgcgcgatgaaggggtcggccatgatggccgcgcggtgggtgcgcaggatgcgctcaaactccgggatggcgctgctctggtacgcgtccaccagcgctgtcatggcggcgacctttggagagtgtgtgggggggagtctgggaggatgagcctttgtcggcagtgtgggcgtttgccagcggtatgggtgtctgtaagcatggcgcgaggccccatagagtccatcacatcgccaatcctgccccccaaaggcaaaaaccctgaccatcattgccccacctccggctcgttcttgtagggccgagcctcctgtgagtcaaaggggtccaccccgctctgcatcnnnnnnnnnngatagagtccatcatatcaccaattctgccccccaaaagcaaaaacccaggcgatcattgccccacctccggctcattcttgtagggccgagcctcctgggagtcaaaggggtccaccccgctctgcatcagcatggtggccagcaccaagtacttgaggcagcgcacgcgcgccgcggcccccgcctcgtcgtagctcttgaaggcctcgaagaagtcggtggccgccgcctcccaggcgcggtcggccatgtgcaccttgcccccgcactccttgatcacgcccaggatgcgcgggtgtgggacggcggagcggatgcgcagcgcacccgcatacagcgccttgagtgccttggtcccccgctgcgcagtgtgcacctggatcaaaagcgcgatgacctccagtgtctgggtgcccttcttgtggtcgtcgcccgcgccgccgtcctccgcggtgcacagcctgtgggtcgtgttttggggaaaagggggaggggagtggcggcgatgagattgtggttgggggnnnnnnnnnnagtgtttgggggaaaaggggaggggagagtggcggcgatgagattgtggttgggggaccaggggcaggccacgggtggaagcagtgcttgtaaagctcctcaccacatcctctgcctcctcactggagtctgcaagccaagcttgatcccagggacgtgatcgaccagagactcattcctccactctatggcaagaaagacaacacacacacataaaaatccaagagcgcccccccccccccccccannnnnnnnnnnnnnnnnnnnnnnnnnnnnnnnnnnnnnnnagtacttgtgcagtgcgttgaggatggtgagagcgcgctgcatctggccctccgccacccacagcgtggccagcttcatgttggtcttgaaccagaggcgatcgttggggtgggtgcgcaacgcctccagcgtggccgcgtagaaatcgcggagcagggccgcgtcggggctggctcccacgcagtccagcaccgagttaagcttcttttccgccgcggcgcgggagatggagggcaccacggcggcgtccaacaggcgacggtacgcggccagcatgtcctctgatgcgccgcggcgaaagtgcaccttcacgatctgcttcagggccttgaaggccctggtggatcagaggggagggaggattttggggcaagggtgaggggcccttccagagcgcgagacggcgggatgaccagcaagagcatatgatgaacatcttgcaccaggagatgccacatcacccgcaatgcagccagctactattttatgccggatccctttgcatggaccatggatgctgcaactccacagcacccacccctccaccccgcccaaccctgaggccacccagcgcaccacttctcgcggtcctnnnnnnnnnnggatgaacatcttgcaccaggacatgccacatcaaccgcaatgcagccagctactatcttatgccggatccctttgcatggaccatggatgccgtaactctacagcacccacccctccaccccacccaaccctgagccacccagcgcaccacttctcgcggtcctcgcactccatctccaggacctgttggaagccggccagcgcctcgtcgaggccgtcttccgtctccaggaggcccttgctgttgtagtactggttctccacatccacctgggcgggcggggggcgggtcaaggtgtgcacaggtttttggtgtttgcaggagggtgcaagatacacatccattccgggagcatatgccccagtcaagctcctccgctcacatcctgctcctccatttcatcctctgagtagtcgaagccatagtctgtgatgtgggtggagaggggcaagagggtcattgagccaaagccacaccaggcttgcatggagaaagtcccgctttccaagggtgctcagcacgcgcatgcaatgctcaggagagtggatactttctacaatgaccaaggcttcaccttccatgtcgctgtcnnnnnnnnnncggagaaagttgtgctttccaagggtgctcagcacgctcatgcaatgctcaggggagtggatactttctacaacgaccaaggcttcaccttccatgtcgctgtcgtctgcgatgggagaggatgggtgataatcagcacggaccaggagcagtcatgcgaggcacggaggccgaccgggtatggcacctccacgcaccatccatgcctactgtcgatttgcggtcgcttcagactagaatgtgtccatgaatctggggtccgaacctcctgcagaagatagcgtgccagggccccgggaccacctggatcagtcccggcaggctgaggagcaagccgcacctaaacctcaagggtacgagctctctctcctaattgatttgagaagattcaatcatcaccctctctggtgggatgcgctgcctgaagaggagagcatcgagatctgggtaaatcgcgcgcgctcccaacctcgacaggatcttccggcacattgagatgagcacacagagtttaccaccagcaagcaggatagtatcaagcattgnnnnnnnnnnctcccggcaggctgggaggcaagccgcacctcaacctcaagggtacaagctctctctcctgattgatttgagaagattcaatcattaccctctctggtgggatgcgctgtctgaagaggagagcatcgaaatctgggtaaatcgcgcgcgctcccaacctagacaggatcttccggcacattggaatgggcacacagagtttatcaccagcaagcaggatagtatcaagcattggtgtaacagtgccgcgcaggggacaggacagtgccactcagggcgctttgatgcctgaatcgcaggtaaacctgaagctcctgccctcgaatgccccgcctctaagaaacagcctccaggcctcatccttggtcttgatgtggctgcgatggcagtggggcacggcaggttgatgctacggcatccgggcccgctgcacatgactttggcgccggctgacaaggaattcaaggcccgcacacagagcctgggtcttctggctcaggccaagatccctggagccgagcacatccatcctgcaaacnnnnnnnnnntggtgcacatgacttttggcgccggctgacaagggattcgaagcccgcacacaaagcctgggtcttctggctcaggccaagattcctggagccgagcacatccatcctgcaaacctccaagcaactaggcaggaccccatgcccctcccttcccagcccctttttccctgtctgcacctcaggtcgctgttctgggccaggtagtattcgaagtcgaagcactccggcccgcgctggagcaggtacccgatcctctgctcccgaaacggggcggggttggccctgtacgcattggacagcacatccaggctcccagaggcctgggtgggtggggaacgggtgcgggggatagcaggtgtggggatacgtgaccatccagctgtgatcagagtcatggggtgcaaagtagtgcatcaagacactttcccagtccctaccattcgctcacctggtcggtgatgacccgcgacatgtacaccgccgactgggcaaacgaccagtcgttctgcagcacccgctccttgaccttgacaaacatcacctcataggggtccagcgactgcccatccatgtagtgctcgccatacggatttgctctggaagggggtgttgacaggagcgggaagaggtggaggcgtgtgaaaagttctctgtgtctctgatctgggaattgcccattaggtcaacccatttctgtaaggcctggcatgaagcatcctagacgatgctttccagaatgcaagatggtgtgcctggccctccgagaatatagcagctgaatgccttgcaaccggcagcagacaggccactgttatgcagacacgaaagccagtccagatggtgagctgaggcgctcagggccgcacaaggcccctcatgggcaatctgcattccgtcctgctcagtcctcaacaccaccaacccctccaccccagccccttgcgctcactgcgcgttgcaggcccaattggcgtggccctgccagtcgaccccctggtaccgcagcatgagcgagtcgaggttgtagccggccttcaggatggccagggagctccccagctcgccgtgccagataacatcccacatgctgtgccagcactggaagaccttggcatcctggagccagatccgcaggccgacctggtatgatggcaagagagggggtggggtggggaggagactcaggcaatggctggtcgtagtatacatttaggacagtccctcataaaaactctgagctttcacattgtaaattggaacctcagaggggcgcatgccctgcacactgcaggtcggcgagagcactgtctccttgggcaccctgcaacagggaaaccccagctttatcacacctggtcggtggccaagacataggactggacgtgggggttgacgcgccacttctccctcacccgcccgcctggcggggacccctcgcagctgatggtggggccgaccagtttgaccctcgcatcgatcctgccaatcagaacgtcctgccacttgatcatgtcctgcaggcggtcgagcagatgttggagtgacgaacagcactggcgcctgcatcaggccggcgagaaacgccaccatactgcacaccttggcgtagggcgggatgaagggccccctgacggagctgttcatgaagatgaagaaggagtagggccgggtgtccacccccgcgacgttgatcgcccatccgatggttccccagtcgtagcattcgttggcgtggtgcaggtagcgtgcgttcggcggcaggtctggcaagtctggcgtctgtgatgaaggggaggggtgggggtgagatggcgggatgggcaggaagggcccagacctctcctggaagtactgccctacgcaccctccccatccaccagctcaccgctttgtcggcatcggtctgcaccacgatcacgtagtcgcagcgatcgtctttggagatggcgaactggacgaaaaatctcaggtttgtgatgtactcagggtcggtgttggagaacacgtacatgaccaaggtgtcctttttcccaccggcccatgcattgcgaacggggttcttcgcatcgcttttagaatggaggatggcatagcgtacgacagagctgatcaagagaatggcagctacggccagcaggacgaggtggtgtagagagcgacgtcttttcggagtcctcgggacgatcggatccacggcatccataaaaggacttcccacgcgtgatgcagtaggagttgacctccgcgccaggttcatgtatcactctgcaccgcgtaggggcttgagatctggtgtggcactgtccagcctgtgctccgcgaaaccctgctcatcgcttcattgtgttcaaattgcaaaaagtaatcgcgctcgtccccagaagttatggtatggaacgacgtgagttgccgtgttgcagatgaagcgctctaccgggcgcgcaatctcttgtttccactgtccgcatgtttactaagcagagtaacaggcggaccctacggagccttctgttccgtgggcaaatgtgtgcagggcccatattgttttgcaatcagaacacttgacaagtctcaattccaagctcaggcagcactaagatcgtcgcaatgggatatgcaaacgatgcgcaacttccatctccatgagggtgttcctttggacctactccatgttaacaaacttgctcctagctggcatactagccgtgcatgttgtcattgatcatgaagagtctctccccgnnnnnnnnnntgtccatccccacgagggtgttcctttggaactgctccatgttaacaaacttgctcctaactggcatactagccgtgcatattgtcattgatcatgaagagtctctccccgcctccctgagggatactgaatgaacagcgtgcaggaatggcatgcacttcttgaccaaagagatgtgaggcatatacacaacatcacaaatctagtgcatcgcatgtgaatatacagcacaagatagttgagcatgtcccaggcatcactcgagnnnnnnnnnncgtgcatcacatgtgaatatacatcacaagctagttgagcatgtcccaggcatcactcgaggtgttggctgggatcccacgagagagctgtggaatgcgagtttggaatggagaacaaaagggatctccgatctcggggtttagtactctccgcgtgagcagttacccctcggagaggagcttgaaaactagtcacgggacttctaccgtccagtgtcgcactcattctgctaggtccaggaagggtgcttcgcggcaatttgctcgacgcgggctggggccgttattgccatggcttcgaagcaacagaagtatgcgaagctggaggtacgtcggggtcaccgaggggtgtttgtgagccgcattgatctttagatagcgtccagacgaaggaaatnnnnnnnnnngcagaagtatgcgaagttggaggtacgtcggggtcaccgagaggtgtttgtgagccgcattgatgtttggatagcgtccagacgaaggaaatacctccctccgacttcccccacaggcccacagcgggtacacgggactgtggaagaccgacctcagcaatgcctgcatcgcctcccccggatgtaaggcccaggtctgtcttgggtggctgaacgaacccctgcagaagccgacggcgtggcttgctcatcgtgccccactccgactcccaccacagtctgttgcacctctatcttctgctcctggtgtgtgtcgtaccacctgcgcaaacgggccctccacaatgacatgaccaggtggggtagccttggtcgtacggtctggctgcgagcagacacaggcacagggtcggttgcctcccttccgacctgtcgtgggtccgtgcttggggcaagttggaagcatgtctggcgtcgtggcgggtatttcacagcacagattcgattcccatccccttcaaggtacctgtgctgcaatggcgactggccctgctcgggacggtgcggcgagcagagctgccccgagttctgcctgtgcactgaggtcttcttctgcttcccacaggtggctgttgcttggcggtgtggggttccgggagcagtccccatggccggcccaggcacccgaatgcatgtgttcccagatcgccagcagccgtgtggcctgcaggcttgcnnnnnnnnnntgagcagacacaggcacagggtcagttgcctcccctccgacctgtcgtgggtccgtgctgggggcaggttgggagcatgtctggcgttgtggcgggtgtttcacagcacagatccgatccccatccccttcaaggtacctgtgctgcaannnnnnnnnnggaggtcttcttctgcttcccccaggtgactattgcttggcggtgtgggggtccgggagcagtccccatggccagcccaggcacctgaatgcatgggttcccagaccgccagcagccgtgtggcctgcaggcttgcgcacggtccctgctcgcatacctcacccgccccaacttcacgtttccgacacagagcgtggcatcgacgcgctggatgctgcaggacgagatgcgcctgcagaacacggagtgcgacaactgcatcatcggcaccatgtttgccgcccagtacctcgcctgcttgtgctgggtgagtctggggacgcaggcggcccaccttttggggaaaaggggggccattggctgcaggatgcgcggttcatgtcaggcgtgaggacaactcttcacgctgcatcggtccatggctgtgcctctgggtggttgcccggcgcctgcgcaggatccggccnnnnnnnnnnagtccatagctgtgcctctaggcggttgcccggcgcctgcgcaggatccggccctcagtactgcatattgtctgcctgatcaagcctccacatcaacccaaccctcagatcgcggcctgcatctccgggaacgacatcctcaacgacctggccatcctggccgacaacatcgccgacatcctgtggtgctcgtgagttttcttgttgcttttccttgttcataactgtttgggaaagagtccctacgttgcaacctgtgtcctgatcaggaccagggaggttggtctgaggtggcatcaggaatgcgagcgcccaggcctgccctgctgccattcacatgccgtgcccctgccgtcgtggagaccaaacttgcagggcccccccacctctgctcctcatttccccctccccgaccaacccccaaccccccggccacgtgcagcgtgtgcgcctgcatgcagacgcagcataaggtgcagatggacgagcgcgacaccaacccggcggtgggcatgccctacgccgcgccgctgccgcaggccatgggcgcgccgcccccggccccggcgtacaacacctactccccgcccgcgcagcagggctttggcgggtacccgcctgcccagcagtaccccccccagccccagtaccagcagtacccgccccaacagcaataccagcagtacccgcccaacccgcagtacccgcccaacccgcagtacccgcccccccagagctggaagcaataggccccggcaccccggatgcccgcgcccccgcatcccgaaattccaacaccctcgcatctggaggtccccacattcctcgaccccagatccccgtccccttgcacggcccgcgccctgcatgcttttcccgtggcccccccccctccttatgtatgcgcgccctgcacggctgtacaacgcgccaggcactcgagtcagggcatgccatcagatgctctctcatgtgctcagtcatgcgtgcagtcagcccagcacgccctgcatcaccagcaggccctcttgcgcggtgagggccagcagcgcgtcgccgtcgcccaccagcgcggccatgcccgcgcagggctcgcggtacagctccgcgctgtgccccgccgccgaggccagcgccacggtgccgtccagcgtggcgaaggccacgcgcggcgcggcgaagggcgcgaaggccgcgcccaccaccgcgccgcaccccg

SEQ ID NO: 40128 - DNA, 61 bp, Chlorella protothecoides
aacttgcacacacttgatggccacaggctccccgttcatgaggtggccagcaaacacctgg

SEQ ID NO: 40129 - DNA, 82 bp, Chlorella protothecoides
agaagctgccacactggcgttggaggtgacagccgacgttgggctctccttggctggcgtgggtacagcagtgttcaagcta

SEQ ID NO: 40130 - DNA, 78 bp, Chlorella protothecoides
tgctccctcctagcatctccaacactctcctggtgcgggggttccacatgaccgggccctttccccactttccacctg

SEQ ID NO: 40131 - DNA, 37146 bp, Chlorella protothecoides
  modified_base (1388)..(1419): a, c, t, g, unknown or other
  modified_base (3597)..(3606): a, c, t, g, unknown or other
  modified_base (4606)..(4615): a, c, t, g, unknown or other
  modified_base (5939)..(5948): a, c, t, g, unknown or other
  modified_base (6395)..(6404): a, c, t, g, unknown or other
  modified_base (7357)..(7366): a, c, t, g, unknown or other
  modified_base (7821)..(7830): a, c, t, g, unknown or other
  modified_base (8750)..(8759): a, c, t, g, unknown or other
  modified_base (9551)..(9560): a, c, t, g, unknown or other
  modified_base (10911)..(10920): a, c, t, g, unknown or other
  modified_base (12556)..(12565): a, c, t, g, unknown or other
  modified_base (13079)..(13088): a, c, t, g, unknown or other
  modified_base (13430)..(13439): a, c, t, g, unknown or other
  modified_base (13898)..(13907): a, c, t, g, unknown or other
  modified_base (14286)..(14295): a, c, t, g, unknown or other
  modified_base (14461)..(14470): a, c, t, g, unknown or other
  modified_base (14869)..(14878): a, c, t, g, unknown or other
  modified_base (15652)..(15661): a, c, t, g, unknown or other
  modified_base (17982)..(17991): a, c, t, g, unknown or other
  modified_base (18890)..(18899): a, c, t, g, unknown or other
  modified_base (18955)..(19042): a, c, t, g, unknown or other
  modified_base (19149)..(19158): a, c, t, g, unknown or other
  modified_base (20249)..(20258): a, c, t, g, unknown or other
  modified_base (20787)..(20796): a, c, t, g, unknown or other
  modified_base (20883)..(20892): a, c, t, g, unknown or other
  modified_base (21067)..(21076): a, c, t, g, unknown or other
  modified_base (21261)..(21270): a, c, t, g, unknown or other
  modified_base (21799)..(21808): a, c, t, g, unknown or other
  modified_base (23854)..(23863): a, c, t, g, unknown or other
  modified_base (24436)..(24445): a, c, t, g, unknown or other
  modified_base (24851)..(24860): a, c, t, g, unknown or other
  modified_base (26370)..(26379): a, c, t, g, unknown or other
  modified_base (26751)..(26760): a, c, t, g, unknown or other
  modified_base (27172)..(27181): a, c, t, g, unknown or other
  modified_base (27872)..(27881): a, c, t, g, unknown or other
  modified_base (28167)..(28176): a, c, t, g, unknown or other
  modified_base (28926)..(28935): a, c, t, g, unknown or other
  modified_base (29215)..(29224): a, c, t, g, unknown or other
  modified_base (30387)..(30396): a, c, t, g, unknown or other
  modified_base (32139)..(32148): a, c, t, g, unknown or other
  modified_base (32544)..(32553): a, c, t, g, unknown or other
  modified_base (33309)..(33318): a, c, t, g, unknown or other
  modified_base (34390)..(34399): a, c, t, g, unknown or other
  modified_base (34822)..(34831): a, c, t, g, unknown or other
  modified_base (34888)..(34897): a, c, t, g, unknown or other
  modified_base (35591)..(35600): a, c, t, g, unknown or other
  modified_base (35857)..(35866): a, c, t, g, unknown or other
  modified_base (36016)..(36025): a, c, t, g, unknown or other
  modified_base (36585)..(36594): a, c, t, g, unknown or other
  modified_base (36676)..(36685): a, c, t, g, unknown or other
ctcgcgcggcgttgaagcccagcgtcacccgcgcctccgcgcccagcccgtccagccgcccctcggccgccgccgccagcgcggcctccatgctggccgcggcgcgcggcgcctgccccgcccgcagctgcagcaccgccgtgttgttcagcaggcgcgcagagggagcagggtggggcgacggggatgagggcgtggccgatggggccctgtcagcccccgcctgcacctcgtccccggcgttggcaggcccccacagtgcgaccgcgtgctggtacgccgccagggaacccccggggtcgagcggtgccagcacatcgcccagcatctcccacaggtcggcgcgctcgcccaatcgcttcagcgcggccttgaagtgggggatgcccgccgcatcgggtccgagccgcagccgcgggtacagcttccccagcacctttgggaatggggcgatttggaggtggagatggcaggaacggaatccagtgggcgcaaaaggactccgtacatatatcactttccagatggaagttctccttcataagaaaagggcggtcttgtcgccttcacaacactctcccccgccttcttgatgaataatgcgaaagcctgcaccctattgagcagcatggatccatatgacatgccatacccaacctctccacgcacctgcaatgcgtcggtccaggccggcacgacagtcagagccccctccagcaccgaggcggcatttgtcagctccccgcgtagcagcgacagctggcccaggcccagcgcgggtagcggtgcgcgcgggtccaacgtcgcggcctgggagtagaggcggaaggcctcgccattgcggccctgcgcatgcagcgcgcgcgccagcaccgttgtgcactccagccgcagcggctccgagtcagaagcatccagcgcggctttggccagcttggcggcctggcgaggggaagaggagggaggaaaggatgggggagggtgtgcagacagcgacagattcgacatcgatactccatgcctgtcaggtcaggagccaacagctgcatgctgacaagatatgaccgagtcccgcaactctgcaccagccctcaccccatccgcaaagccctgctgcaggctgaagtaggccaagaggacaagggtgtaggggttctcggggtcctgctcaaaggccctgaccaggagccgggagccgtcccgcatgtcctgtggtgagtaatgtgcagagtgttggaggatccagatgatgctcgccagtgcctctcagacgcactgcgccccgccatcacccgcgacagcagcggcagctctttccattcggcctgcccttgccacatccagatccctgctgcgtggccgcccccccccccccccccccccccccnnnnnnnnnnnnnnnnnnnnnnnnnnnnnnnnccccaaatcacacacctcgctcgtctgactggcactgagcttgagcacggccaggcccaggagggcctgggtgcaggaggggtccaggtccagtgctcgctggtatgccgcgcccgcctgtaccacatcccccaggcggaagaggcaggccgccaggcccagccgcacctcggcagggcagccagggtgcctccgcagcgcctccttgtacctgtgcagggttgatgcatggggagggtggcagcttgactgggatgttgggcgatgctgaggaaaggtaggcctgaagggccataggccgacgccagtgtgaacagagcagcagcaaccacacagctcaatggagtgggacactgactaagctgcagacctccccttgaccaaagcacacacacacacctatccagtgcctccttgtagttcccttccccaaactccagagccgccagggccagagtgggggcaatggtcggtcgccctcccagcaggtgcttgctggcctggacaaattgctggcgagctgcgacacgattgttgtcctgcaatagtgatgcacattgtggtccagggagggctcagtgtgaggaaaaggggtcctggatcagtgcaatacctggtgctgccgtgggatccagttcagatcagtgctgcgccccaatcagcttctcatggctctccctgacaatgggcagccgatcccgcacgccgtccacagattggagcctgcaggccacaaaggattgcctgacacaaacaaaaactgctgaacccgcacggcagtccccccccttcaccttgtccagggctagctgtcccatgcacagcaggggcagtgcgtcgtccagggccctgttacgtgcattcaacaggagagtgctggcctcgtcgaatgctgcacgtgcaatgctgcggttgttacgaccccggtgggagtgccaggcggccagggcacagtgggcttgtagcacggggaaggtgacgggctccggggcagagcccgtagcctgggccaccagaccctgcagcaccgcctggtacacatcggtgttgccgtgcagaagaaatgccttggctacatccacccatgtgtcctgggaggccctttcccggtgcagcagggagatcacatcgctgggggatgcagaggaggggatggacagacccccacctccgcgcagggccagcacaacccccatttcctcgtactatctcatgctgggcatctacccccgtctgatggtgtagcggtagattaggtcccttgcgcgagcgatcggcacttccacctgcgccatgccatgcccgcaagcagcagcgacttcgcgcgcgaaagccggtgatgccggtggagagacagcgcctcgccatgcagcctcagaattagacagtgtgttcatcaagattcgaggcaggggcacacttgtacatgataccgtgaatatattcattaccaacttcatttgattcataaaggagttccttgctacgatgggcatgctgctggccggcaaccctatcgcctcgggccggtgttcggtaccgcttcgcacagccccttcacccgttctgggacacacaagggcaatttttactccttttgtttgtaagtatgcacgtgtggtgtgttccatgcttcgaaagggatattcttgcggtgagtttcagactcatgcgccaccgccccgccatgccactgttacaggtacctccgcgcccaggacgttgcgcaccaggaaacaccgcgcacgccatgcattcgttacgaaagcttcggccagcgtggcagaaggtgagacctaggggggcgttgtgggaggcctgcctgaagcaggtcatgtgtgcggtggtgcccgctctgcatggggaggtgtgctgtggtggcagcagtttcatctggagcacttcttgcggcctcgacaatctcacacacctcttccgcccacgccctttctctgcgccagccccacccccgagctccgcaccatccgccgagctgggtcccagggagggcatcaggaatatcgccatcattgcccacgttgatcacggtacggcagcgcttggaggtgatgcacttgctaggtgtcaaacactttgtgcagccattacattcaaagttttgggcgcggcacggtatgggcccgcgccccactgctcatccagtcacgagctctgctnnnnnnnnnntaaagttttgggtgctgcacggtatgggcctgcgcccactgctcatccagtcacgagctctgctcacccctgtccttcccctcctcttatctatttcaggcaaaaccacgctggtggatgctatgcttaagcaggccaaggtcttccgcaccaaccaggcggtggagatccggatcatggacagcaatgacctagagcgggaacgtggcatcaccatcctctccaagaacaccgccgtccgatacaaggtccgagattgtagatgagaatggctccgtgtgtggtgggtgactgagggagtcttttgaatggctggcaagcagactggcctggaaggactggcctaacaagccctgcaagggacagtcatgctgtggccccatgcacaatctcatacctagaccccccccaccttcatccatctggcaacaaggctccctctgtatgtcactgcaccctcctttccctgcactcccaccaaatctgcttctgtatcagaccctttcccccctttctcttagtttcctcatggccccgaatccctcttgccaccccccatccccttaatatacacatgcgcgcagggtgtcaagatcaacatcatcgacacacccggtcacgccgactttggcggggaggtggagcgcgtgctcaacatggcagacggcgtgctgctgctggtggacgcggtggagggccccatgccccagacccgctttgtgctgaagaaggcgctggcgctgaacaagaaggtgctggtggtcgtgaacaaggtggaccgccccgcggcgcgccccgactgggtggtggaggccacctttgacctcttcgtcgacctgggcgccaacgatgagcagtgcggtgagccatgggtgactgttccattgtggaaggatcgctgcgtgaggggaggggtggcgggcgaaggtggcaagtctgctggaggttctggtgcatgcacggagcggtacgcagaccgaggatggcaatcgccagcgcnnnnnnnnnntgtggcaggtctgctggaggttctggtgaatgcacggagcgtcacgcagaccgaggatggcaatcgccagcgcctccctctgaccggcatgctgctgcaccgactactctcaagccttgcctccctacccggctcggccattgtgtacatattgcctgggagtaccgtgctccagaccttgactcccgtttccaccttcccacgcagacttccccgtcgtgtttgcgtcgggcatgggcggcgtggccggcaccgacccaaacgccctggctgaggacctgggcccgctgttcgagtccatcctgaacgaggtggacccgccccaggtggtccagcaggggcccctccagctcctggtcacaaacctggactatgacgagcacaaggggcgcatcgccatcggtcgcgtgcagagcggggccatctccaagggcgcgcccgtggtcttcctcaagccaggcgaggaaggaggtttggggttgtgcatgtgtggaagggtgggccgggggaagggtcggtgttggatgttgtgaggtgcagcatggcgtccaggttcaggatggtcctgtggcagtctcgatgggagtgcagtccccaagcctccaaaggctgggcgctgctgcaggatatcgccatcctttgaccaaccaccctccaccgctcgactgcccaccacgtcttgtacgctcactcgtccctctcacctcatccaccgacacacaggctctccccccaccagcgccaaggtgaccgagctgtttgtgtacgacaactttgcgcgcacccctgtggacacggtggaggcgggcgacatctgcgccttcacgggtctgtcggcggtgtccatcggggacacagtgtgccagccggacgcactggtgccactgcccaccatcgaggtggaggagcccaccgtgcgcatgaccttttcggtcaatgcctcgccctttgcggggcatgagggcaagtttgtgaccagccgcaacctgaaggaccggctggagcgggagctggagaggaacctggcgctgcgcgtcgagccgggaaccggcgctgagtccttcgaggtgtcgggtcgcgggtgagccgggctgctggctggcggtgtctctttgtatcttggggcatggaatgttgatgccctgggtgcatgactgtcacaccagtgcgtttggttggtggggaaggagctcccacacagcatggtggcggcgcgccccctccccgcaccagtctttgaccaccctctcgccggcttcccccagtcaagcctcccctcccccactccaactctcctccagggccctgcacctgggcatcctgnnnnnnnnnnatgcgtttggtcggtgggggaggagcttccacacggcatggtggcggcgcttccccctcccgcaccagtctttgaccaccctctcgccgacttccccgagtcaagcctcccctcccccaatccaactatcctccagggccctgcacctgggcatcctgatggagaacatgcgccgtgaggggttcgagttcgcggtgggcccgcccaaggtgatcacgcgcaccgaccccgccaccggcgcgcggctggagcccgtggaggaggccatcgtggaggtggccgccgaccacgtgggcggcgtggtggacctgatggcggggcggcgcgcggttatgctgggcatggcggcggggtcggccggcaccacgcgcatcacctaccgcctgcccacgcgcggcttgctgggcctgcgctccgccatgctcaccgccaccaagggcaccgccnnnnnnnnnntcgcatcacgtaccgcctgcccacgcgcggcttgttgggcctgcgctctgccatgctcaccgccaccaagggcaccgccgtgctgtccaccatcctgtcggggtacgagccctgggcgggcgacatcagcacgcgcgagaacgggtcgctgaccgcgcacgagaccgggcaggtcaccgcctacgccgtggagtccgtgcagcagcggggccggctgtttgcgcgcccgggcgacgcggtgtacgaggatcaggtggtgggcatccaccagcgggcgggggacctgaaggtcaacgtgtgcaggaagaaggcgctgaccaacatgcgcgcctcgggcaaggacaacaccgccgtgctgaccgagaccatccccgtgaccctggactatgcactggaggtgaggctagtgtgcgagccggttggtacggggtgctgctcgtgggctgtgcccgagaccagagctagaatttggggctggtggttccaatctgtagtttggggcctctgggtgtgggagaggggtagggatctgaaattcatgcgcaagaaccccgcgccagctgcccgggacacttcctgataccatctcttcatgcccatgcctttctcaccacaccttatttcacagtatgtcggcgaggacgagctggtggaggtcacgcccaaaaacatccgcattcgcaagaaccctaacatcaagcccaagaagaagtgatgggaaaggagcagggtcccttttgtgtttcaagagtgcggtatgatcgtcggctgttttgagtctccttgcaggcaaaccgcacgatgcgtgcatgtctcattgccagtgacatgcacactgaatgtttcgagcatccatctgtaattgtagcagagtgccgctgaagatggtagaaggcaaaacagcgccgccgcagatgatgtttctgaggcttcactcaagcagtatccctgcnnnnnnnnnngctgaatgtttggagcatccatctgtaattatagcagtgcgccgcagaagatagtagaaggcaagacagcgccgccacagatgatgtctctgaggcttcactcaagcagtatccctgccacattaaactgagtgataaaacacaaaagaaatgtcagaagtgggattcgaacccacgcccttccggatacggacctgaaccgcacgccttagaccgctcggccatcctgacggtggtgttggctcctgacctggtgtgacccaggggggtgacttggccagcatgaattttgcacgagccattcctcgcagagaggaagatgccgcttcaggcctgtgattcagcaacaagagctgctaaattgattaagatagacacacggtggtttatctcttctcactgcttatttgttttgtaagttatggttggtggcagcgtcgtggctaccaaatttnnnnnnnnnngtgacttggccaggatgaattttgcacgagccattgctcgccgagaggaaggtgccacttcaggcctgtgattcagcaacaggagctgataaattgattaagaaagacacacagtggtttatctcttctcgctgcttggttattttgtaagttatagttggtggcagcgtcgtggctaccaaattttcttagggcgcgagatgtagcatcacggagagaagtacacccatgcacaccagtgagccagcaaatactggatgcaatgcaaatcaccatgatgaacagaatttaatctcgaatctcacatgcaattgagggtgctgtcgtggtataggatagcagtagtggccaagcgccggtacttttcgcaacgctcgccttcggcactgattgggacgctcaggataccctcagtcctgcattcaagagcagcaaaacgggcagacgcctgctcaggcatcgtcaggatgacatctgaggccgcgaaagaaatcgaggtgcccatcagccttgacaaatcgctgttcgacgaggagatttcagtgctggccctgcaggtgcccaaacagcggtgccatgaatacatgaagtctctttccaagtaaggagggcataaatgctggtatatgcattgcatgcagtctcgcatgtgagctcaaggtgtggtatcacctgctctgacaggcttgcagataagtgattccctcgcaactctcacacagatacttgctgaacaaaccacgactacaaaacgtcaaggacgctgcttcttcacctgactctaagctgctactcctttcaactgactatacacttgacggtgataagatagggctgctgtgaaggttcagacctgaagggcacaatgtcagccatgatgcgcccgcatggcagggcaggatgggacactctcgtgcctnnnnnnnnnnaataagatagggctgctgtgaaagttcagacctgaagggcacaatgacagccatgatgcggccgcaaggcagggcaggatgggacactctcgtgcctggaaggagatggcggtgggtcttagttattcattttaaaaggaacttgtctccaacgatccccattgccagatctacctgaaccagtgttggctttgaaagagaaggaggatctgactctggtgcccaccacagtacacgtggactactcctactggccagcccctcatgtactcaaggtgagcctgtgagaggaatggagcacattcagtgcaatcactccagtactgagccaccgctgctgcctctcctgattccaatcgtattttcgatggctttctggccttaaacagacaacatctcaggctatgaagttgctaagggcattctgacagaagtaaatattgacttttcccacacgcgcttgtagcgtctgctgccagagggcatggaggtgccgtctgcctttgagaccataggacacattgcgcacctgaacctaagggaggacgcccttccatggaaacatatcattggccaggtaaggctgcaagggcattgtcggtgaaagggcgcacagcttttgtacaggagctcagaggtggtttgcaggttgataaatgaatggtgtctgctggcagcaatgccaacgctttacatagagagctactacagccctcgaacagaggcttgcaccgaccatgaagtaaccaccaaagccctgcccttaccacctgcccgccaggtgctcttggnnnnnnnnnntggcccttgaacggaggcttgcaccgaccatgaagtagccaccaaagccctggccttaccacctgcccgccaggtgctcttggagaagaatgtgaagctgcgcaccatcgtgaacaagctgggcagcatagacaacgagtacagggtgtttgacatggaggttatcgctggtgaagaagacacagtcaccgaggtgcagcagcaaggacaccgattccagctggatttccgcaaggtgctgtggcggaagatgtggggtggctgcaggtggggacagtaaaggggctcacgcttgtgttccgtgtagatgccctgttggatgcggcagacctgtggtgctttggagaatgggtggatgaccctgcccatgaatgctctccatgtacgagggaggttgaatgattgtagcccaaggcgcccggcagccatttgcctgggtcatgtttgtcctctgcaaacagtataacccccccccccccatcctcacaggtgtattggaactcgagattggagcgggaacacacccggctggtgaccacctttgcgccggggcaggtcatactggacgtcatggccggcatcgggccctttgcggtgcctgctgctgcgcggggctgcacggtgcgctgtcagcggggaattggatgccaggaggaagctgggggaaatgcgcttgtctcaagggggaggaccatgccggcgtgccatgtgcagcgtggcatggaagagagatgtttcacagtacctgtacatgcatttgagaccacaaagtgagtgatgggcccccccatctgtttcactggattcccataatcttccacacaggtgtacgccaacgacctcaacccagacagccataccttcctgtgcaagaacatccagcgcaaccgcgtgactgagcgggcgtttgccttcaacatggacggcgcggccttcattcgcgaggcggccgccgggcggctggcgccggcggcgctcccgcccctaagcgcggccaaacggcccgtgccgtctacggcagtgcaggagagcaagccgacgcagcgcctccctttccaccacgtgatcatgaacctgccggccagcgccgtggagttttgcagcgcattccgatcggcctttcctgaggagctttgggaggccggctccctgccaaaggtgcacgtctatgcttttgcgaaaggcgtggattgtgaaccaggtgaccgaggcattgcaggttatgaggaggatggatagtttgtttcatggtgcattcagaatgactttgaccgcggacgtcgagcgatgcccaggctaagaattgtggctgcggggtcctgacttggggtatgcctcactgtcgctggcnnnnnnnnnntgcggacgttgagcgatgctcaggctaagaattgtggctgcggtgtcttgacttggggtatgcctcactgtcgctggcgtgttcccgggtatcctcaaagcctgcaggctttccccctattcttctcggtacccaaatgacccctgcccctcccaccccctacagagctcactgcgcgcttggaagcggcgctgggcggccccctagactgccccgccgccttccacaaggtgcgtgatgttgcgcccaacaagcacatgttttgcatcagcttcaccccaccgaccgtgctggccctcggggctgccgagggccatgcgcgtgatgaggctgccagtgccaagcgcctgaaggcatcctgagaatgcttggtgttcttgcaagccggttctcgcatttgtgaatggaagacgaagtgcagtcgccgcacatggctgtgcgctggccctcaccgcaacgttacactaacaaccagagtgacatgctgccctaccgaactgggagtatcgctctctcagcgtggcatcgacaaagagcaccagatttccccatcgcgagccagatctcatccctgaccctcaaagcgcccaggaggccagctccgccgcggcgtcggggccgtccaggaagggcttgcgcacctggcgcaccatcgcctcgccccagtacgggtcctcgcttgccacgtcggcgttgaggtctgccagatggcgcgccacgtcgcgacctgcggccagctccgccagcgcggcgccgatgcgccgacgctggagcgcgggcgccagcgcggcgacctcggccgccaggcagctgccgtggaaggcgttgcccgtggggaagaggtacacctggggcacggcgccacccgaggggcctgccgacagcggcggcgggccctgcagcgagcgcccgcagcgcgcgcagcgctcggcgccgtccagcaccccgaccctgacctccagggcgcccagcgacttcctgcgctcaagggtggaggggatggagtgatgagcaccctgaggaatccattcttctcgaggcaaaggagcagaagccggctccagggcaatgcttagcctcaggcccaaggggcacgctacaccagcccctctccacgacccgcctgatggcatgggcggtctcactggacaccgccatctcccgcttcaggtcctcgatctcctggttgtaggcctccagcgccctgaagaatgggtggaggaggtgtggcgacttggtgaagcagaggcagccccatatcagcatgcactccacccccccttgcctgcccctcccagactcacgtgcacaggacgtccttgaaggcatcgatctccacaaagtcggggaagaggggcagcacgtcctcgatgcgcagcaggccccccgactcctccagcagcgaggtcaccagcgcgatcccctgtgcctgtcacatatgcattgcaggcgagcggtgacgcctgactgtctggctgcagataatataacccgtcactgcaggcagccaacaggatagtgtcccctgcattctctgccccccacagcctcaggtgacaccctgtccctcccccaaactccctcctaatctcaacccccccctttccacccatccattcacctggtccttgggatnnnnnnnnnntccaaactccctcctaatctcaaaccccccttcccacccatccattcacctggtccttgggatcccccgaggcctggatcaggtgccccgcaatgtccagccacagccggcggctcagccccgcgtcgccccctgcccgaccagccacccgcaccgccaggtctcgatccagcgtcagtgccagccgcaccgcgtcgtcgtgcaagcccaggtcctggtacagcgccaccgcggcgtggtcgcggccgcgctcccgcgccagtcgcagcgccaggaccgggtcgaacagcgggcgccccaggggcgatcgtgccgtccgcaggtactccatcagctgctcttctctgcagaaggggaagggagagggggggagaggaggaggattggagttgcatggcgctagagtgtgtgtgtgcgcatgtgtgagggggtccagtctgtcattcctctggaggatgggggtctgcacccgacgctgtcctcttccgctacaataagagcatcagggacggtnnnnnnnnnnagagaggaggaggattggggttgcatggcgctagagtatgtgtgtgtgcatgtgtgagggggtccagtctgtcgttcctctggaggatgggggtctgcacccaacgctgtccttttccgctacaataagagcatcagggacggtcacagtgccatggactttgcaaccatcaagcccccctatccccacctcttgcaagcccacccaagcaggcatctccattgccccccccccctctaatcatcataaaacctcacccgccgtccagcgcggagtaaaggtccagggcgaggtcgtgcagggcctgggcaccggcgccggcgtccagcgcggcgcgtacgnnnnnnnnnngaggtccagggcgaggtcgtgcagggcctgtacgccggcgccggcgtccagcgcggcgcgtacgaaggaaagcgcggcggcacgcgacgtcgcatcggcgcgcgccccggagctcagcgccagcagcgccgggagtaggcgctcggggtccaggggcgggttggccgcgacccaggcgcgcacgctttcctcgggcgccagggccgccagggcgggggcgaacttgtaggccagctcggggctgactgccgggctgcgcaggacctccagtgcgcgggtgacctggtgtgggggacaggagggggtacgtcatggtaggcagcgctgatgagggggcatggcgagcctcggcgctcggcagcctgcgcgctgcccatgcagcccttgtccccactcactccaccccccccgcgtgtgaatggaagtgagccctcttgctgcatgctcctctcagtacannnnnnnnnnttgcagcccttgtccccactcgctccacccccctgcgtgtgaatggaagtgtgccctcttgctgcatgctcctctcagtacacacagaaactgcagactcgcctgccctcgctgcaccagcagctccagcacagtctcgtggtcgccgcgggaggcggcaaacacctctaagaggcccggctggccgtaacccgagaggagggaggtggtggtcccggcatccagcaccctgacgtgctttcttaagaaggcggcgagctccgcctcgacctgagtgggtgggagtgggtgtcagagtgtctgatgccgaggccatttgtgttgatcggctatgcattgagctgagcgaagggcctggtgcgatcaggagcaacatcgnnnnnnnnnnggtgtctggtgccgtggccatttgtgtttatccgccatgcattgagctgagcaaagggcctggtgcgatcaggagcaacatcggtcaccacaaacagtcccagattgcgaccccgggctcccatggcgctcttttcacctcctcccactgcacgcgcctgctcgannnnnnnnnnatcccagactgcgacccccgggctcccacggcgctctttccacctcctcccactgcacgcgcctgctcgagctcgctggcgccgccggcgccagcgccctcgccggtgtcctcgctggcgcccagcgcggcgcggttctgcttgtccagcaacagctccagcagccaggtggcgaccatggtggcctgcacctggtcatccctgcccagcgtctccaagcgcacctggtgacgtaggacagggaagacttttgactttgacccttgccagtgggctctcagaagtcaggcaggtacgtgttcgagcacacccaggctcggaccccaaggctgccgtaggtctgagccctggacgccatccgcatcaacacttgcctggaggaagcgctggagggcgccnnnnnnnnnnttcagaagacaggcaggtacgtgtttgagcacacccaggctcgggccccaaggctgccgagggtctgagccctcgacgccatccgcagcaagacttgcctggaggaagcgctggagggcgccaggctgcgcggcatccatgaagcgcagggccaggtcctcgaaactgggctcggtcagcgtcacctggagggccacgcggcaagagatgtacgaggggagcatggtgggtgggctcttgaagacaccatcaaatcccttcatgttctgcattcaggatttgagcggcggtgccccaagattgtcaggccccatgcacgagcaattcgccccccacccccacccccgacaaactcaccttgccaaacagcgtgcctgcggcctcccagtcaccgccctccactgccgcctcgccctgcgccaggaacacggcggagcgctgcgcggcggtggagcagtgcagcagcgcggcgccgaactcgccggcgtccaggaaggtgcgccacatgtcgcggtcctccgaccccgcgtccagctcgaacaggtcgtcccccgcccagaggcagacccgcccgccgcgctgcgtgtcgggcaccaggcccagcggcagctccgccacgtcgcgcagtggggcggcatacctggcgcgacgatggaggggtggggaggagggacgggcccatgtgattcaagaaagggagacatgcaccaccgaaagagctttggaggcctcactgccctccggcggggaggcgcggtggagccaggcagggcnnnnnnnnnncggagctttggaggcctcactaccctgctgcggggaggcgcggtggagccaggcagggcggatgccaaccaccatgtgacatcaagggtcttgagcccgaccgccgcatggacattcctcccccttcctccccgcggcacctgctcagcaccaggtcttggacgcgccgctttgacacgcggttgaccagggtcagggcggcggcgctgagcagggcaaagtggaagcgggtggccgccagggacagggccgccctgcccccgggccacacgacgtccagggggagcagatggtgcctggtgagcgcggcgctcgggtcggaggcgaggccgggggcgtccggctgcagcgtcgcctggaagatgccgtcggggcagagcaccgcgataccctgggagaaggcgggtgtggagggtatgcaaggtcattgatgggaagtgaagcagcacattattgcaagggggtcacagggcgaggcgcacagggcgagcatgtctttcctccacccaatggcagcatccgccaccccccaaagcacttacgctgggctgcgagagcagggcaccctcgggcccggcattggagcgcgaggctgcagcagggtcgggctcgccaaagaggagcgtcatctgggtggggccaggcgcgctgggcagctccaggcccgtcggtgagccgatggtgtctggcgggaggggtgtgacggcaagaatgagggctggagtaggtcttgtgaccacagttgacaagtgttgttgcctgtatgatgccaggccccactgcctcttcacatcagtacccggggatcctgagtgctcaccgatcgccgctgagtcctcttgccctctcccaacaaccatcttccggcccccctccttccacaccatggcctcaccgctgaagcagtcctgcaggctgccctccccgtgaaagcagtggatgtgcgagggggtcagggccagcacgagcagcttcccagtggctggcgagacagtctgttccacgctgtgcacgctttggccctgcaggctgtgcaggggctgcacccgctccttcctcgggtctgccaggtccaggctgaccagggtcccggagtcagtgcccagcaagacggggctgggtggaaaggacagcacatgtaggggttgggttgcagcatgtttggataccgcacactgtggcaggcagcagcacgctgcctggtttgaggccgtcctttcctgagaccaccgtgaatgaacgtgcatgcgatgtgtgcttgctaggtctccccaagacccaccgcgttgtgtgcgagggctgcaagctcggccaccaggcgacggcggtgagggccatgcccttcatcttggacaagatgcgtgcctttttccaggccgagtccacatacagcgtctcgggcgctcccgtggccgcgctggctgccaccaggcagtgactgcccaagggatccagccacacctgtcggcagaccgcgtccccagggcgctgcagatcgatctcgacacaagaggcctggccgccgtcggagagatcggcccggagcaggaagttgcgcgaggtggccaccaccagggtgtctcctgacagtgccacggccaccggcgtgccccggccactgcgtcgtggtcgtgaggggcatggattagcatacatatcgttcaaagggatctaaatttgggattcatcatgacttgaggccaggcgatgtacgtggctttcacccggcctgcatggagatgtcagggcctggcccgtcgagtcactcaccgtgacatgaagtcgcgaaggagcgccagatcgaagatatccggctcatcctcggcgtttgggtttgccacatcatccgagacgatgttgttccagtcctccaggagatccatggccggtgggagcaccttgagatcacttcttagagcaccctctacccatccctctggctcagccacgtggcctaagcttccattggaagaaatttatgcatttacttggccaggtgattggtggtaagcccccataggcacacatactccggccgtgccgtctcggcgtggcagcctgctgagcgtgcgaggctgcccacatgagcacggagacggacgcacaagcacaagaggtcccgctggtccataaccgcatgcattgaatactcaaagtatcagcatggcgtcttctgtggcaccggtggattcgtcgatctgcgccagtgccagaagtacgccggcgagaagatggtcgaggtgtttcatagcaaggcctaagcccatcaggcatgtagaggaagaggggaatggactcaggcttctgcatccttcacatgnnnnnnnnnncgcgcaagcccatcaggcatgtagaggaagagggggatggactcaggcttctgcatccttcacatgccgctgatggctcacagatcgcatccttgctgcaaccccagacatgccaggagggtcttgggcagagccagagcggtggccgatcccgtgcaacccacacccgaggatcagaaaaccattgacgatatcaacgagatcttcggtgggtggaatgacagtctgttggctttgggtgcaaggcccagggcgtccatccccattcctgtgcatggcagggcatccccactgcagatcgtgtggggggtgtcatgtgaccagcaccgcgcactggccccaggggttgaggatcacgtcgaggcattcgccggacctggaggcctccccttcatcaggctgagccacgcctgtgggtcgtctgtggaggtacgatgcctggggtcggcagtctcccaggcgcttcagccaggctgatctcgtcaggttggatgcgtagaagccccccaccctgtcctcggcagagttctgacggaattcgagtcaggtcggggcgcaaccccagagccgtacttgaacacacactcgcacaccctcccaccctccacccagatatccctgtttgggggccagatcaccagcttccggcaagcttccggggacgaggtgctatacatccgccccgacgctgtgtttgaccgctccaagccaatcgcggggggcatccccctctgcttcccccagtttggccccggcgccatccagcagcacggctttgctcgcaacgtagactggagcgtgagcgacagctccgccgaccccaaccccgatgaccgcgagccagaggtccagctgcttttgagagataacgagttcacacgctccatctggtgtgtggnnnnnnnnnngcccgacgctgtgtttgaccgctcaaagccaatcgcggggggcatccccctctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaagggtggtgacggaggtgctttcaaaaatacgcactggggtagaacgccacgcgcaggaaaagtcaccccctttgtcgtacatcgcatcaccaaacaggccgnnnnnnnnnnctgaagggtggtgaaggaggtgctttcaaacatatgcactggggtagaacgccacgagcaggaaaagtcaacccccttgtcgtacatcgcatcaccaaacaggccgcatgagttccaggccgccctcaccgtcaaccttcatggcgagcggctgcggctggacttccgggtgatcaacccctcctctgggggcacttttgacttcaccgcggccctgcactcctacatcgaggtggtggatgtcgagcgcagcgccgttgtggggctccaaggcctggcgagttggcggttgggagggggtggagtgggggttgtagtggagggagggccacggcggtactgttgtgaggatgctgctcgcgctttgggagacgtggtccatgacgcaatctccattgaccgacgatccttgatgtatcgccgagattgctgaccccgtgcaatgttggcccccatctcaaactcctcgccttccaccccctcctccaccacagaagtacctggacaaggtggtcagcgccacctctcctccagagtgcgaggaggagggtgaggcggtcttgatccaggggccagtggaccgcgtctacctagacgcgggcgaatacgccgagctgcacgtcggcaacggcgccgcggtggccctgtccagccacggctggcgtgacgccgtggtctggaacccctggaccgccatgcccgacgcctaccgccgctttgtgtgcgtggagaacgcggtggcggccgtgcccatccgcctcgacccggggtccggctggcgcgcccgtctggagctgtacgtcaaggacctgtgatcactgctcgtttgcggggatggcggtggtctctgtgctgagaattaaaggaggaggaaggatgggcgctatctgagccatgttctggcggctcgcctctcctacagcggagggctgcccctttgcggagcttgtagcctacggactgcgccagctgtgtctcagcagcacctattttggagcgctgccgagggctgatgcctgcatgacaactcacctccatcagagcctgtgccctgcccatcgcatgctcctcacccagggccccttttgcannnnnnnnnnctgtttgctgggacggcggtggtctctgtgctgagaatgaaaggaggaggaaggatgggcgctatctgagccatgttctggcggctcgcctctcctacagcggagggctgcccctttgtggagcttgtagcctacgaactgcgccggctgtgtctcagcggtacccattttggagcgcggcctagggctgatgcctgcacgacaatccacctccatcagagcctgtgccctgcccattgcatgctcctcacccagggccccttttgcattcaattgtctgggtgtcaactttgcgaaagcatgcacaggggttttggatgatagggaatgcatgggcgggggcaccttctctcgacaggcacgatgagggagggaagtcttgagccgtgggtcgatgtgagccagtagcctacgggcacaaacgcttttggggggggaggggaggaggggaccaagctgatcaacccgcactaagccagggctcaggaggaggccttgggttggaggtgaagcaggcgcaggaagtccnnnnnnnnnnaatgagggtgggaagtcctgagtcgtggggcgatgtgagccagtggcctacgggcacaaacgcagggggggggggggggggggggannnnnnnnnnctgatcaacccgcactaagtcagggctcaggaggaggcctttggttggaggtgaagcaggcgcaggaagtccacccagagcatggagcccaggaaggtgttgcccgtacgcactgcaaaggacagcgcggcgcacacggcgggcttgccgtggaacaaggtctcgatgccgcgcnnnnnnnnnnatacgcgccggccatggtctgcggtggggtgtgggtgggcgggtgaaggggatgggtgtgtcggggagtaggatgggtaaaggggtccacaagcgagtcgtataaggcatgggttggcggattctaccacccaggcctgaggccatctacgccagcagccaccctcctgtggcgctcatcagccnnnnnnnnnngtacgcgccggccatggtctgcggtggggtttgggtgggcgggtgaaggggatgtgtcagggagtaggatgggtaaaggggtccacaagcgagtcggataaggcatggtttgacgggttctaccacccaggcctgaggccgtccatgccggcagccaccctcctgtggcgctcatcagcccgacatgtagaactagttccccctcccccccaggacaaagaggtccctcccgggggtcgcaccagcacgtcctggggcgcattgagcggcacaaaggtgggatccagcgaggtgcgcagcgccaccatgccgttggtcacgcccacgccaagcagggaggcaaagaagcccacggcggccagcttggagccgttgcgaaccaccgcgccgccgcgctggagcagggagaagcgcgggttgcccggctgcacgcgctggaaggcgttctccgggcagccggagaagaggcgcgacagcgcgcctgtggcctgtggggccgcaccgctgtatgaagagaaggggggggggnnnnnnnnnntgcgccggtggcctgcggggccgcaccgctatatcaagagaggagggggggggggagggaatttgaagtacgggtgtgaggcggtgtgctacacagggaggaagttgttgagcctgcgcagatgggtgtgttgaggtgaatgccacgagcggtgccccaaacagtgcttgtcagctgatcaacagggagtcctccgagttggtgcaccagcaaggtgtgcaggcacaccgcgctggtatgatacctccagctagggcgctccatgcaattgtgtcagctggactgggccggagattcacctcctccgatgtgtcatcggacgcgcacacgatctgctcaaacccacttcttctactacactctgggatcctcatgactaccccacctccttcccaccaaaaccagaaaggaagacatcccatcacagccacgcacgtgaggttgtaggcgggcgccggcagccagaccagcatgaagtcagcgatgagggccatgatgacgttggccagcacaaagtcgagctgggactggaactcgtcaccgcgcttggtgtactccgcggtcagcttcatggtcaggccgatgccgagctcgatgcccaccttgaagaggaagttggggtcagccagcaggcgggcgcgggcgccggggaaggacaggagccaggacaggaaggggttcttcagcatgtccaggtaccgcgccaggacctcctgggagatgcggccggcacggatggcggccgcgatctctgcaggagaagggggggtccagtgttgagtatggggtatcaagggtgtgggaatagggatggatcaatttgtggcgttcatgaggctgagcaacagctgcaaggatcctgagctaggtctgagcaaaagtcagggtctcaatcaagctcctgatccaggccatgtgagggcctccaagagggaggccttctcgttgatcaggtcagcatccctgtgcgcgcaccttcggggaaccggtcggtggcagccttgcctgccaggagcagggctgcagtgatggaggagtccctcccctcacccccctgcccatccccaccaccgcccccaccaccgctgccgccatcgccgcccgggggctgagacccgaagctggtcgtggatccggattgggcttgtggggccagccgacagggtgtgcctcggcggatcaggcatggcaggcgggggacggccagggggcacggcttcgggccagagcgaccagttgtggtggcatggaggggtgcgcggcctccgaggctggcggacagcgccagggtcatggctgcgctgtggctaggacgggggtgcaagggtttgacgagtcggcactcagcggcgcgctgttcgtgggatggagcgagctgtgcagtgtcgaaatgtcaagctaacgaggctgcacagatgccccatgccgcgcacatgcgggcgggttcaaatgagcatcgcgatgctgggatgtcccacgtgacagcacaaccaccactttcatgagctgcaggaaatctcatgggcatgatggaatagtcgatgaatgtcccggaagaatttccacgatggcccctgaaaagcgctcaagtgttcccatgaacacgtctgtagcgctcagcctccttttgtgcatgatggggcccagtcaggatggaccgtactcccaacctcaattgagccactgtgcatctggtgcaacatgaacctgctgctgaaggaatggccaccacttttctcacgataccatcgaggggtgcttgagactctgctgacagctatgtcagagcaatgtctgcctccttgccagaactgtcatgctggggccctgggaagcctcacaggagagaattacacctgcacatatatgttaagacagaaatttgtgcaggaaaagataaaatctactgtttcgccgcgactggtggtccctctttccagaagagaaccctctctaacgttacggacttttctgcaaaaccactggcttgagacatccgaaagcatctcaactggtcgagaaatcattgttgctgtacctgctgtnnnnnnnnnncctaacgtaacggacttttctgcaaaaccaatggcttgagacatccgaaagcatctcaagccatcgagaaatcattgttgctgtacctgctgtcggctatgagcagtcgtgcccacctgacggggcagaaaggtgcgcagcgtactcacatggtttgcccggattcgatggaggagattccgtcgtgcaggtgcctcgtggtcgattcatccacacaaatagatgcgtcaagtttctttctatccccgtggagttgagtaagtcaagcatccgaccccctccaggtcccacacgtacctgctaatccggacgaacgtcaagtactgacctccggtacgatgcccggagggaccgtcgatcccgctctgcttcctcttagcaatcgccagagctgcgtactggccagcagtatccccgacctgcagctgggaaaggtgcgcacgtgcaacatactcagagcaagggggtggggtggggggtacctgctgagactgtttgctcttcccagttccagcggtgcagggctatgtccaccccattccccaaaacctgcactcacaggacctcggaatnnnnnnnnnnctttgctcttccagttccagcggtgcagggctgtccaccccattcaccaaaacctgcactcacaggacctcggaatccccggcctcagttccctgcagctgaaactggcgcgtgcgccctatgccgcgcgctccgtggagtacaccgagagggccatcacactctggcagttggagggccgggcccccattcccgtggaggttcagatggagatcacccaggcgccctcgctctttgccctcccggtcatgcagaagaggccctgggagaccccattccaggcacgggggcagtgcagggtgctgggctggtgccaagggaatggggccagggcaccaccgagccgctgctcaccccctccatccccaccttgatggcagacagcaaattgtttcccttgggtccnnnnnnnnnngcagtgcagggtgctgggctggggccagggggatggggccagggcaccactgagccgctgctcaccccctccatacccacattgacggcagacagcaaattgtttcccttgggtccatgctcttcttacttttgacctgccacatccagcatgcacagattgctgccgtgccatgtgagccctgtcactctgcccagggtccgcgcgtgccctgcgggccccaaatcacataaccccaaaccgtcccactctcggtgcacctgcagattcgcatgtcgtggcgctgcagcattcccctccgcttccctgcgagcgtgaccccttgcgccctggacgaggcggcgatgagttcacccgaggactggacccccagtcttgagggcgcgccgactgggctgtcgctggtcggctccagcgcaaaggagcgggagatactgctgacggcggccccggtgaggctgggcaggcgggggtgtgggaggggtgccgacacctgcgagttgtctggaccaccaggggtgtcgctggacccaagctggctggtaggccattgaggtgggctccgcctgagccaagttcgtgctggcgatccagcattcagatacatccatgcttcccctcagtcggccacttccccttccctccctctcctttcaggacaagacaacctttgagaatgtggcaatgttcacttttcccaaactggcctttggggctccatctcaggtgttgtttcctgtttgggctgactgggatgtggtgtcaagggggagctggcggtgttgctctggtgactggtggacacccaatggccccttcctctggcaatgctggggtgaaccgcaccactctgacagcaggcattgagtgcatgcacttggaggccccagttcgagatgctgtcgatccccgcgcgcctctgttgccccctgccctgcccacacccctgcctcctccaccggggtcaccgcagatgcggcctcgctggatggcattcgtggggcgcctgttcacccccgattcgtacctcgtcgctatcctgaaagtccccactgtggtcatgtccaggaacgccgaccagcagagcaaggtgtgctaggaggggggaggctgcgcagcgactggcagagcccggaggtccctgccgttcattccgctcttcggcatgctgcaggcccagtccctgctgtggggcaaggtgatgcctctgagcagcaccagccttgactacacccctttcatcgaccatgtcaaggggtacgtggagctgacggcgtgtcggtgtgcatgggacagtgcatgggttgggacctggggttggtattcagcgcgaagactctacggccatgtatttctactacccaagctcggtgactggcctggagtgatgcacctgccttgcctccgcagctccctggcaggccggcgccatgtcagcaccagcgcaccccaacttgcttccccttccctcacaattatttcccatcccgcgcagccgcttcacgcaccnnnnnnnnnncgctcccccttccctcacaagtacttcccatcccgcgcagccgcttcacgcacctcggcattctccgccagctcacgcccgccgactttgagttcctggcagccaaggcaggctttgtcaaggtggatggcagcattcgccgcaagcccagcagcagcgagttctcgaccttcaacatctggctggatgggtgaggggatgatgggaggccgcatagtgatgatgtccagggaatcggggcatgagcagctcgaccccggccaagtcctggcctgacacagattcctggacgaaccacatcccttcgccctgggagccctgatctgcactgggccccttcgaaatcccccgcccccgtcgctccctgcaacnnnnnnnnnntgccgcatagtgatgacgtttagggaatcggggcatgagcagcctgaccccggccaagtcctggcctgacaaagattcctggacgaaccacatccgttcgccctgggagccctgatctgcactggcccccttcaaaatcccccgcccccgtcgctccctgcaacagccatttgcagaccatacaccactgccgggcccatttcgagcgcctggatcccctcatcctggcaggctttgcgtgcactcgcgaagccgcgaggaaggccatctgggaccagcctccggtgaggggagccatgtccgcctgcaggattgcacagacagggccagggctctcggcctgtgtcggccgtacatggtacgggttggcagccctgcgggtggcagcctgatacccatgtgccacacctcnnnnnnnnnnttgtcggccgtgcatggtacgggttggcagccctgcagatggcagcctgatacccatgtgccacacctctgcgctccacagggggctttcctgctccgctttggcagcaagggcggtcagctggtgatgaccctgaagagcttctctggcagcgtcgatcatgtcctcctgaatcacttccgcctccaagcggaggggctggaggtgagccccgctgcaagtccgcttgagacagggaaacggtgctacggcattacacactgtgcgcccatgaactggctgcccctgaggctccactggccaggctgggactgctcgcgcactgcaagtccatgcatgccagaggcttccttctctgccccgctcccagagctgcaggatcctccacttccacccaaacaccctttgctctcccctgccgggccctgcagaacaccgtgcaagcctacccagaggcgcggctgctcctggacaccagcaccgggtatctacacaatctgaaccatgccctgcaatggcactatatcaaccaggatggcggcgaggtccccggccccaaaaggtaccgtgcacatgttcttggggggggtacgtggaagggggtttgccagcatgttgggcttctccttacaatttgcctgacggcactcacgcacctgggccctggcaaggccgcaaattatagcgcggnnnnnnnnnntcaggatggcggcgatgtccccggccccaaaaggtaccgtgcgaatgttttctgggggggtgcgtggaagggggttggccgccatatcgggcttctccctacaatttgcccgacggcacttacgcacctggtgccctggcaaggccgcaaattatagcgcgggccggcaagcacgtcgcggctaacaacccatcccctcctcctgctcttaccccccttcccccgtttgtggtgctgtgccccaccatccgctgccccccctcgccccgtctgcgcaggcgcaagnnnnnnnnnncactgtggtgctgtgccccaccatccgctggcccccctcgccccgtctgcgcaggcgcaaggactactgctccagcccgaccgagtgctcctcccgcaaccagtgcccctgcgaaggctccggcagcttcccatcgcttgctggcttccccctggggcctgggctccctcatgggcccgtggacatcctgctggcccccccgggaccaggggaggggcattcggcgccgccctccctcgggcgggtcccaggcgccgatgcccacacgctgtacaacccgctcatcgatgggtctttcctcctgccctcaggcatgctgccccacccaggcagcgccgacttcctgcacctcggcgggggccaggacggccctggcgcctggaactaggcgtggagggcgccgctggcggtgcggagtcgtcggctcgcccgacgccccgaggcaccccagccttccgggactttcccttcccccggcccgcatttccaacctgacaaccctgtcgcactccaacccttgcactcgaacccagcgatgggcccgcccgtcgcgcatgggtcgcgccgtttcctcctcctttttagggggccgtctgcccttgacccaaccccacgacagcgcttgatgattctcgtcctttgctctgacccctccatgcacggcttcgccactttcctccccttggctgtgtggcccgtttcccagctgcctccgaccgtcccaataacgctccctccctgcaactgccnnnnnnnnnncgttctcgtcctttgctctgacccctccgtgcacggcttcgccactcccctccccttggctgtatggcccgtttcccagctgcctccgactttcccaataacgctccctccctgcaactgccagccattgccctgacgatgtacacactccacgcgcactcacacacgaatgcccggcggggccgagggtgcgagggcacagtggcacggcagcgcggccggcggtgcacatgtgagccgccggcccgcccccctcagatctcaccctcctcggcggcgnnnnnnnnnnacacacacgagcgcccggcggggccgagctgcgagggcacagaggcgcggcagcgcggccggcggtgcacgtgtgagccgccggcccatccccctcagatctcaccctcctcggcggcgccatgctgcgctgacccgacgggtctcctgtcccggccccgcccctcgtcgtagtcccttgctggccggcggtcccggctgcggctccggccctccgcatcccgcgccccctcctccctccttcgccgtccggtctcgtcgcggggccccctgccgtcgccgtgccgcagcggccgcgcctccctcgaccggtcgcggtagcggcgatcccgctcgtcgcggcccccccgctcccagctgcggtccctgcgccgcgccccattggacgcctcccgctctcggctggagtggctccagtcccgcggcttggcgggggcctcgtcggggccggcgccgcgcagggcacgcaggcgctcgctgcgggcgcgctgctcctccagcaggcgggcgtgcacctcgtgcagcttcttccaagcactgcaggcgagagggaggagggtgtaaaggtgagagcatgctctgggccggagggcttggagcggaggaggcaggagcgggtgggggaaaccattgtcctggcatcgaggcatgggaccccaccccttgcccccccctcgtctgcattttcaagcaacaggcacagcctttgccgcgcctcacgtccaagcacatgcacagtgatgggcctggccctgcatcccctccccagccatccccaagtaatcacaaagcccacagcgccgggctcacttgaagtttcttccctggtgatggtccctgagccgcgtctcatcgttgttgattatgagccccgagacggggcacacctcctgatgcaggttcttgagggcgttgttcccggctcgcgcctcggctgctgcctctaatgccgcgcgctgggcctgcagtagaagcagggagcagacacttttgaaggaaagttggccggccctcccactctgatttgggacgtcgcttgctggcaaatgacatcagcgccgtcatttcccccccgatccgcgtatgtccatgccctgggggatgtcggtcctggcaccttgggagttcactggaaatcccccagcccacaccagcgacaccagnnnnnnnnnnactgtcggtcctgacaacttgggagttcactgaaaatcccccagcccacaccagcgacaccagggcagctccacttcctcttcagaaacacgcaccttgagcttctcagcttcgttggtggcctccatcgcgccgtccacctccccctcctcccccagtctctccgcacgagccaccagctccttcatctgggccgtcatggcgtccagcttggcctggtcctcatgcaggagcagggggttctccacggcacgcaggcgcacggtgttgctgtcgatgcgcttccgaaggtcggtcaggagcttctccaaccagcgcaggagctccgcctcgtagcccaggcgctccttggtgcggtcgtcctccgcctcgtactgtgccctgcatccatcgtcgtggatgccggggcaatcgccacagtcgttcttcgtgcgtctgaattcctcatagggacagaatcccgacaagtagaacttgcacacgtctttatcggtgtggtgccgcttcctgggcctgcacagtgtggacggatgtgggtcgccgggccctcaagggtaggacgccctgcacgatggtcacctcatccctcgcttcttacttgtacttggctttctcagtggcgcctagattcctgtcctcccccatcagctgatccagcatggcacgcatctcgtccatggcgacagaggggcaggcgccccgccctcacagcctgttcggctcaagggctctgatcgcgtcacccactccagaagatgacggtaagtgacgaatgatagtgggcacagggatgctgatgaagatctgtgatgagacgcacatggcagagacaccggagcactccaggacgggggccatgctgcgtgagctgcgaggacgagcggagggcccttatgatcggtcatacctcctgccctacggcgtgtactgatccgaaaattcggagattggccatcgtagatactactttgttcgggaaaagtgtacaatggaccgacggtccctccgcgagaggaaggtgtcggagaggttcgccgtcctcgacaaggccgaccagcgccaggtgaacttgtatgataatcatagggcgcactaatgctattgagatactgtcacgggctgcatcgccatcatcgcattgctccgttactgtgcaggctgtgaacgctcggctggaggcccttgaagaggatgatgcccaggagaacgccctggcacccggctcggacgacgaggactttaccgttagagaggactcagatgggggtgagctggatcaatgcgccgggccagcaactgtccttttgatcctttacccctgtcacgggagcagtggagagcctcgccacccaccatgcgcagagtcaatcccggccgccggcgggagctcaaagaagaggaagctgaagacagggagcatgcggaagacgcgaggcatggtggcggagcgggctcggggccccaagctcttccgggactggctagaggaggtgggtgttttggcagggaatgtaggcccccgtgcatggcgcaggcattttcccacagcggcttcgcccatctcgggcgtggagcgccgagctgccatggtcctcatgtcgagcgcaagtgccatgggatggcatatgactgcgcgggcatcgggcgcgcagtcctgctcgcccggcgagtctcacatccgaggccctgcgcgcaggagatcaccgctcccccccacccacccacccaccccgcaggccgacnnnnnnnnnntggcccacgatcctggacccaactacctgacagctgcgatgggcccgccgcgcagccgctccacccgccacagctgcacggtgtgcggcgacgcctccaagtactcctgcacccgctgcggctcgcgcttctgcagccgtcgctgcaacgctacgcacgtggagacgcgctgcctgaagttcacgctctgacgctctgcttttggggggcgactgtgattctacagccagcccgccgtgcagacaggtcgggtttgaggccaaagtggaggaaaggcaggcgtcccgtgcacagtgcttcaagcctgacattggtggagcgacccagccaagcacacgggctgccccgcctgcccccgtcccccgcccccagccacgccttccaccccccttcgcnnnnnnnnnngggtggagcgacccagtcaagcacacgggccgccccgcctgcccccgtcccccgccccccagccacgccttccaccccccttcgcttcatcgcatgctgtgccaggtggcagagcgcgcgcggtgcagggccgcccgcaccgccgcctccacgtcctcgaccaccagacgggccgggtggcgctcactgttccctgggccgcggaagacgccggtgcgcaccaggacgctggtccagggtgggccggcggcgttggcccctgccacgtcggcctcgggattgtcccccaccgcccagatggcgccaaaggcgcggtctccccagcccagcgccgcggcctgggcgtgcagcgaggcggcggccaggtcgtagggcggcgcgtggggcttgccgaagcgggtgacgcgcggcaggggcgcgcccgtcacctccgtgtgcagcgcctgcaggcaggccgcaaaggcgccgccgccgaggcggggcgcggcgtgcgccccggcccactccacatccgggttggagaagacgacgtgcacgggatcggggtcgcaggtccctgcgcccggcggaggccgggtgacggggcgggcaccgggcaccgcccgccccagcacgacgtccagcgaagtctgcagcgcgcagtaccagtcggaagggtcgttgagcaccagcactgcgcggatgggctgggcggagccatccccggccgaggggcctggggaaggggtgggacgggcggcggcggcggcggcggcnnnnnnnnnnctcacctccaacagccacctcggcaaagggcacggaggcggggtccgcacgcaccagctcctcgacggtcacgcagcggcgcaggccgtagccggcagccagactgtggaggtcgccccgccccaccagcagcatgcggtggtcggccagggagggcgcaagcgccttgagcggggtgtggctctgcaccacctgcccctcgcccacccgcacgcccagctgggcggacaggcgccgggcacgctcctcctccagccagccgccggagttggtcaggaagacgatggggtagcgcgggaagccggaggcgtcgtgcagcagcgccagggccctggtgtgttgggggcggggtgaaggtggttggtttcctttgtggggtcccaccttggtgtccagggatgctcgtggtgatcatcagcaagatatggcaagggggttgtgtggtgtgcaattgtggtgtgcaagaccttggcagtaagcttagaggacccatcagtcatcaacgtgctcaacagagaatgtggggaaaccccgtcccgcaaagtagccaccactcgctcgcctcttggccgctggcaggacctggccgccacgcatcaaaacgccatcgatgtcaaacgcaaaggccgccggaccgggtgtgtgctcatatatgtccgtcgcgaggccccgggccccgatccgggagaccaggccggtcagagcccatcctcgggcgagcgtccgacaagcggctgccattaaaactgcatcgtatgcttttgctcgtgatcgagctcctgtaacatgcagctgtcgtggagatgcgcagtaatatagtatccttaatgtgcgcgcagcatgccattactcatggtaaggttcatgtgcagcaaggagttcccggtcaggtgttgacgattctcgattcacctggggcatggcaaccccttctattataaaataatacaagcattttgctccagcgcaaatcatcccatcgtcccttgcaagtgtatgtcacggctaacccgattcctgcactgcgaaaatgtggcactaaggtctcatgcaaacgcatgtgttaaagagnnnnnnnnnnctcacagctaccccgattcctgcactgcgaaagtgtgtcactcaggtctcatgcaaacgcatgtgttaaagagcaaattctacgctgatcggcagttatttctccattctgcgagggcccttcccatgctaggccagcatccagcaggatgcgtctcacctgccccaagtaagctgagctcgcacccgtgttgtgggggaccctctccggagctttccatcctttccacctgcattcgtgttctacgacgcctggcacagtgcttgaaactcaagccccgcaccgtatttggggtcttgttctataacatttctacgttaggtcatatacagcagtccacgttgtagagtctaatccgcccccacaacattgtggtatcggaaacaagttccaatcttggtccccgggggtctgagccctccnnnnnnnnnnacctacgccgcacagtgcttgaaactcaagcccctcaccgtattcggggtcttgttnnnnnnnnnnattttggtatcggaaacaagttcaaatcttggtccccgggggtctgagccctcctcacaagatcgtgagaacgcgccagcgagagtacgcgaccaacacggtcatgccggaagacgccaaccccggcgcctgccgcgacgcccgcagctaaccagccacccacctcggtgcccgcggtgaccccgacgccgggttggcgtcttccggcatgcccgtgttggtcgagtactctcgatggcgcgttttcacgatcttgtgaggagggcttggagccccgaggacgagatctcaactcgttttccgaaaccataatgttgtgggggcgggttagaccccacaatttggcgatttaaaaatcggctccgcgcgcgctccaaaacacgtatcttcccgccaaggcagcaacgacactgcttttcccggcgcgtttgggtcccatctcgccagaaatccagacactggaacttcttcgtacactcaaacctggaccgcaagattatcgcggcccatcagctggactggaggccagtggggcaatcatcgtgccccttccagaagaagtcgacgcccaagggcccgcacggtcagcagtaggcccggcatgctctgacaccactgcgcgaaatgtcgaccttagcgcagccgctgtttgagcccgaggacgtgtggccaggcgtgctcatggacgacgatnnnnnnnnnntcgcacggtcagcagtaggcctggcatgctctgacaccactgcgcaaaatgtcgaccttggtgcagccgctgtttgagcccgaggatgtgtggccaggcgtgctcatggacgacgatgtgctggagtctttccaggcaagccggttgcacctggtggtgctggaggatgtcagagtgatgacatgcgtcactaccggctcgatgcgactcacggtcccaagatactcctgtcccaaacttatcctgggacttgtcgnnnnnnnnnnggtaccggctcgatgcgactcatggtcccaaggtacacctgtcccaaacttatcctgggacttgtcgcctcgtaacttgtcgcctctcgacacctcagtcgcaggccagtccttcagcttcagcggtccagtttcccctgacccaccaannnnnnnnnnccatttgcaggcgagtccctcagcctcagcggtccagtttcccctgacccaccaagccctggatgacctggaccagtttgagatcaaccgccccccatcccctggccaagtcctggagctcctgtccgatggagtggggacctcgccctggggtctggaagctggcgccgtcgccgaccccgggaagccagatgaggcactcggggacctcgtccccatggcgcgcccgatccacacccccacccgctccgccgacggctctgcccaccaccagaccagcagcggagaggatgcgagcaatatgtcgcggtatcagcagtccagccccgccagccaacaagatggcgctgcggcggccgacgaggacgaggccaagcgggcggtgagcgggggccgcatggtgccggggatgggctggcgggggaaaggtcgtggtgcacgcagggctcactgctgacctgctgcatgcctccttgtcaaattcgaggtgatggtttccaatgagggtgtcggattctgggacatgcttatggcctcccccgcctcatgaaggatccacnnnnnnnnnntgacggctccgcccaccaccagaccagcagtggagaggatgccagcaatacgtcgcggtatcagcagtccagccccgccagnnnnnnnnnngcgaggtgatggtttccggcgagggtgtcggattctgggacatgcccatggcctcccccgcctcatgaaggatccactcacacccctcacccagatccgcatggcacgcaaccgcgagaatgcgcacctgtctcgacagaggaagaaagcgcagctggagggcctggagcagacgtgctctgcgctgaccaagcaggtccgcgccctctccacctttgtgggccagctgacggcggagaacgagctcctgcggcgacacttggcggccgcctgcacggcggcagggcgccccctcccggacctcccgcgtgcacccggcccgcaactggtcctactcccgcccccggcgccgggcgcggcgcccgtcgtggcgctcagcctcgcccagcccctcagcggtgctaccgtgcccctggctgcagctccagcgtgcccggcgcaggggtcggcaccagagggcg

SEQ ID NO: 40132 - DNA, 76 bp, Chlorella protothecoides
ggcggtgtgggacgacgcggcggccgacccggggtgtgcaccggattgccgcctggccaccacgctgatcgaggtc

SEQ ID NO: 40133 - DNA, 75 bp, Chlorella protothecoides
gaactcctgtcactataaggctttgggttgctgtcgtttatgtaatgccgtcgaagccgatattttcagaagccg

SEQ ID NO: 40134 - DNA, 66 bp, Chlorella protothecoides
agcgatcgatcgacaagtttgcaatacagtttgaatttgtattgagttcagtacgctacacacggg

SEQ ID NO: 40135 - DNA, 169 bp, Chlorella protothecoides
aatagtgggagagggagggggtggcccttggtccttgggtttctcagagccaggggtgcaaggcacatccctcatcccgccgctcatctgcatggcctggtgcgagcagacccgtagctgagattataactgccgccctgtccgcaacaccactgtgcaggcaagtgga

SEQ ID NO: 40136 - DNA, 69 bp, Chlorella protothecoides
agaggccgggcggtgtggctgacgactcttgcgatacatggacccaagcagttccgggtcgtctgccgg

SEQ ID NO: 40137 - DNA, 77 bp, Chlorella protothecoides
tccccctcctccacccagtccccctcctccgcctagcccccctccttcacccagtccccctccatcaccaccaccac

SEQ ID NO: 40138 - DNA, 129 bp, Chlorella protothecoides
ctggttgttccgcacctcgatggctgcaggagcaggcgtggggcggggtggcggggtctccgggtcggggaacgggcgcgcccgcgccaccagcaggcgtgcggaagcctggcagagcgccgggacatg

SEQ ID NO: 40139 - DNA, 79 bp, Chlorella protothecoides
ctggagatgatgggggagtctgattcctgcgacatactggccatgaaagctcccggcacctgggtcgcggatcaggccc

SEQ ID NO: 40140 - DNA, 98 bp, Chlorella protothecoides
acccctgcaacatcttcctgcacatgccagaaggcgcaaacagtatcctgccggtgcccgaagccagttccaggctcccttgaggcctgagggcaggc

SEQ ID NO: 40141 - DNA, 224 bp, Chlorella protothecoides
ggcctgccaccgcttctggggacgccaaacctcgggagagcacaacgtgtgacgccatggtgccgtatattgcccaggggccagtccagcggtggacaagggacgcgcatcagggtttaggaaccctgattccctatcacgtgtggtttggtggagttacgctctaggagacccagttcggccaacccgggactatactaatcgcccagtcaggtgccactcga

SEQ ID NO: 40142 - DNA, 61 bp, Chlorella protothecoides
agcagcccctgaaacacaattcctgtcccagcacacaatgtattggcgggtaggtgggagg

SEQ ID NO: 40143 - DNA, 442 bp, Chlorella protothecoides
  modified_base (88)..(330): a, c, t, g, unknown or other
acacgggacggaagggcggaggacatgtgtctgcttgcctggcagtacagaagacgcgtgtccagcgggcgggaattgcaccaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggggtgccgggagcccacgttcatcagtacttgctgtatctcttggccatggcctcgatcttgggtctgacggccccaaaggtacgctccttctcggtggtcccctgc

SEQ ID NO: 40144 - DNA, 67 bp, Chlorella protothecoides
tgttgagagtacggctcttgcgcgcgctaatctggtttcccttgtgagtgttcccagccactcaaat

SEQ ID NO: 40145 - DNA, 61 bp, Chlorella protothecoides
accccaccactgacacaccatctgggaacccggaacagaagtggtgtcctggaggtggtca

SEQ ID NO: 40146 - DNA, 61 bp, Chlorella protothecoides
catgaagaagggtggggcaacccaggcaggcaggagctccgcacactgggcctctgggctc

SEQ ID NO: 40147 - DNA, 75 bp, Chlorella protothecoides
ctcgccggcgtgcatggcctggggggttgggcggaggggggtgggatgcttgaactgggaccttgttcagggctt

SEQ ID NO: 40148 - DNA, 4887 bp, Chlorella protothecoides
  modified_base (2212)..(2221): a, c, t, g, unknown or other
  modified_base (2654)..(2678): a, c, t, g, unknown or other
  modified_base (3122)..(3131): a, c, t, g, unknown or other
  modified_base (3299)..(3308): a, c, t, g, unknown or other
  modified_base (3851)..(3860): a, c, t, g, unknown or other
  modified_base (3994)..(4003): a, c, t, g, unknown or other
  modified_base (4257)..(4403): a, c, t, g, unknown or other
ggtgtccacgccgcccggcttggcgtggggcccccgctgcgagagggccgggtgcgcccgcggtgtggggggctgcaccccgtccgccgtgccctccgacgccggcccctgccgctgctgccgtcgccgccgcgcggggtccacctgcgcctccgggtccagccccagatcgccatcgctccgagccgccgccccgccgaccagcccggcgccatggcagccggggaccgggccggaggaggcgtgcaccacggccgcgtcgcagaggagggtgagaaggaagcctacgccgcagaggaagggggccagggggaagtccatggccggcatctgctccagcgcgtcgcccaggaggtggcagaagccggcactcaccatgactgcgggatgggggtgggaagggggggtgggaggttcaggctcgcgtcccggaacgagatgtgagtgtgtgaggagttggagcgaggggggtgcatggtggacgagggggtggaaaccacggcacgctccatggctcattgcactgcaggcactcggtcagcaacacctgcaaacgcccccctgccccttcggctgctcatcaagcctccacggctcaccccccgcgctgagcatgttgcccaggacatagcccaggctgcgcccggaaccgcctctttgcttatcgcgggaggaaagcagcacgggcaggtaggcacctgcacagttgcaggagggtgaagggggtcctcaaacgagacgcagggggatgctcatcaacgctggttcggcaggcactggacacagtctgtgcaccccgcgcgtgctcttgctcgggcgaggggccagatgtcagtttcagcgcgcccacctatcaatgcggttattgccagggtgaaggctgccaaggcattgaactctagcctgcccagcattgccctcgccacgcccctgtgagctcgcagggaagcgaggaagaaggtgtgattgagccatgcggcgagggcgtcgacgagcagggacaggctgcgattactgagctgagcataacccactgctgacctggtgggtgcgcgaaggcacgcgtgccgctgctggagtggaccagacacagggtatttccctttctcacgggctgggttgtgaccggcttggtgttctatcaattaaaggcgagggtggtttgttaatatgcaccgtgcgtgtgcgcggagcgtgctggccccagaacaccccatgccagcattctgggtgatgattcgggaagtttactccacaatgtgaataccaaagcgcgagctcgacttggagcaaggcaagtcgaggcagctcgcgcgccagagggcccactgaggtcccacccacgcgtgaggatgccacgattgggtcccgcgatccgcgagcgcacccggcacctcacaggcaacacagggtgtcacaggacccagacgcgttggaaacctccacaggggcatcttttgctcaagactgtagattacaccattaaataaagccacatcatgagcctggccctccttcgccgcggggtgggcgcgtcccggtccctggtgagcactccgatgggaagatgttgggatgttcgggtgtgatggcgattgattatggtgcctaatgaccctaattctctcgaaatactgcaggttggtccctcttgggcttgtcgggctcaggtgagccgggctgggtgtccggagggacccgtaagcggcacccgtcagcatgtcagctcactgaccccctcctgagcccattttcactgccaatctcctgtaggcgagcatcagcaaccaagctgactatgagcgattcgctaaggaccccgagcacgccggtgccactgtgagccttatggattggtgggtatggggttgccatgagatctgccagccagcctccccacagccttccagaggcaccgcccccactcagttctcccccgccgccttgcagtggcccaaggtgctgaacgcccccctgtcggaggtcgaccctgagctctatgacatcattgagcatgagaagaaccgacagtggaaggtgggctctagaagggtagcaaggggttctccaggccccatgctgatacaaccgttgcctaaatcattgcaacttcacccagggaagagatctggggtctgcatgcgcctagagtgctcgtgtacctccacgccaagtctgacacatcttcactccaacctctccattcatcctnnnnnnnnnntcccaggccccatgctgatacggccgttgcctaaatcattgcaaattcacccagggaagggatctggggtctgcatgcgactagactgcttgtgtacctccacgccaagtctgacgcatcttcactccaacctctccattcatccttgcacatcagggtctggagctcatcccctctgagaactttgtgtccaagtcggtgatggatgctgtggggtccatcatgaccaacaagtacagcgagggctaccccggcgcgcggtactacggcggcaacgagttcattgaccaggctgagtccctgtgccaggtgcgaggggatgatagggttggtgggtatctttatgtgtgtaactgagtgctggggcagcaggtgtggtgtctcttttgccctgatctagctcttctgggcagatgggctggagatgggctgnnnnnnnnnnnnnnnnnnnnnnnnnccccccttccatcacgctcatgcctccaaccctatcgcagaagcgtgccctggccgccttccgccttgaccccgcggagtggggcgtgaacgtgcagtccctgtcgggctcgccagccaatttccaggcaggttcctgttctgtggccgggagggcaggcactgtgctgggcctggcccggcaggcatgggtccagtgtgggccgagccgccgcatgcaccggcccttgcactcgccaagactcttcctctggctgacgccgtgcattctcaaccttcacgcaggtgtacacggcgctgctgaagccacacgaccgcatcctgtctctggacctcccccatggtgagagacaggccattgggatcggtcaacgtcccttgtcagtatgctgggagggtcatgtctcacaggggatctgcaagcatgccctcctgcaggccatgnnnnnnnnnngggccattgggatcggtcaacgttccttgtcagtgtgctgggagggtcatgtctcacagggaatctgcaagcatgccctcctgcaggccatgtttcttgtccatgctgcccgtggcagtggatgccagtagcacaaccaacccccaccatgatgccacaggcggtcannnnnnnnnnttgcctgtggcagtggatgccaatagcacaatcaacccccaccatgatgccacaggcggtcacctgtcgcatggctaccagaccgacaccaagaagatctcggcggtttccatcttctttgaggtgtgctgtgcagggcagcggtggggtgcaggagatgtgtgctggggcgaggcctgggagccatacacttcccgcctgggctgttgcaggacgcctccgccggggtgactgttggtcgtgtgagatggaccggcgccccatgctgtccgcccttggcccctttgcctgcagaccatgccctaccgtctgagcgaggagacggggctcatcgactacgacgccctggagcgcacagccgagctgtacaggtgcggcgcaggttgtgggggctggtgtcgtcgcatggcagcccccgtgcctgacgcccatgcgcagtcgtgccaggcccctgggcgctgggcttgtgagcctggagtgtgtatggtgtgatgcagcatgccacggcatggggtccccatgctgcccacaccctcctcccannnnnnnnnngcacttcccgcctgggctgctgcaggacgcctccgccagggtgactgttggtcgtgtgagatggaccagcgccccatgctttcctcccttggcccctttgcccgcagaccatgccctaccgtctgagcgaggannnnnnnnnnctgcgcagtcgtgccaggcccttgcgcgctcggcttgcgagtctggagtgtgtatggtgtgatgtagcgtgccacggcatgtggtccccatgctgcccacaccctcctcccaacctgatgcgcgccaggcccaagctgatcgtggcgggggcctcggcctacacgcgccactatgactacccgcgcatgcgccagatcgcggaccgccacaagtccatcctgctggccgacatggcccacatctcgggcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggcaggacaagaaggggaacgacatcaagtacgacctggagggccccatcaacttctcggtgttcccggggctccagggcgggccgcacaaccacaccatctcggggctggcggtggcgctgaagcaggcggcggggcccgagttccgcgcctaccaggagcaggtgctggccaactgccaggccctggccaaggggctgctggacgccggggtcaacctggtgtcgggagggaccgagaaccacctggtgctggccgacctgcgcccccgcggcgtggacgggtcgcgcgtcgagcgcgtgctggagctggcgcacatcgcggccaacaagaacacggtgccgggggacgtgtcggccatggtcccggggggcctgcgcatgggcaccccggccctcaccagccgcggcttcgtggagtccgacttcgccaaggtcgcggccttcgtcaataggtgctgaagagagggaggaggggggg

SEQ ID NO: 40149 - DNA, 64 bp, Chlorella protothecoides
ccggcatgcgagcatcgatctccatccccccaaactcaatgcagggcactgcacactccctcgt

SEQ ID NO: 40150 - DNA, 61 bp, Chlorella protothecoides
gagtttgggttttggtgggttgagttttgggccatgtgcatgccatgtcaccaagagagcc

SEQ ID NO: 40151 - DNA, 61 bp, Chlorella protothecoides
cgctcggctctccacctccgccttgacggattctgtagggaacacggaggttgcatcccta

SEQ ID NO: 40152 - DNA, 61 bp, Chlorella protothecoides
gtgcggcgtggcggctgtgctgctcgcgaaagagcctcccctctccctgtagcgtgctgcg

SEQ ID NO: 40153 - DNA, 61 bp, Chlorella protothecoides
gccgtcatcatcatcatcggcagcaccaggggggaccttggaaaaaaggaagactacttag

SEQ ID NO: 40154 - DNA, 73 bp, Chlorella protothecoides
cagcttgccgcccagggcggtgaagcgcgcagggtcgcgcagatactccaccatctcctccagctcgcccttg

SEQ ID NO: 40155 - DNA, 61 bp, Chlorella protothecoides
actggggttcaaggagaaccacaagaccctccaggatgcagggtttgaggtttacgggctc

SEQ ID NO: 40156 - DNA, 89 bp, Chlorella protothecoides
gctgtgcaagcagcgcttccggcacctcacggtgagcggatacttgtttgtgtgtgtgttgcggggggggggggggggggggggggggg

SEQ ID NO: 40157 - DNA, 61 bp, Chlorella protothecoides
gcacgacatgtaccctcgctcgcctgctggtcgggggcgcgccgttttctggcgccttggg

SEQ ID NO: 40158 - DNA, 93 bp, Chlorella protothecoides
acctgcccatctgcagtcattcaatgccctctttgcaggagtctctgcaagaaacaggtgctacaggcaccagtgcaccacagggggccgagg

SEQ ID NO: 40159 - DNA, 68 bp, Chlorella protothecoides
cgcccgacgcagaggacgatcagaatatggcatgccctctgcggtcagctcagccatgcccccccccc

SEQ ID NO: 40160 - DNA, 10703 bp, Chlorella protothecoides
  modified_base (240)..(249): a, c, t, g, unknown or other
  modified_base (330)..(339): a, c, t, g, unknown or other
  modified_base (575)..(584): a, c, t, g, unknown or other
  modified_base (936)..(945): a, c, t, g, unknown or other
  modified_base (2932)..(2941): a, c, t, g, unknown or other
  modified_base (3520)..(3529): a, c, t, g, unknown or other
  modified_base (3960)..(3969): a, c, t, g, unknown or other
  modified_base (4022)..(4031): a, c, t, g, unknown or other
  modified_base (4763)..(4772): a, c, t, g, unknown or other
  modified_base (5601)..(5610): a, c, t, g, unknown or other
  modified_base (6370)..(6379): a, c, t, g, unknown or other
  modified_base (6988)..(7151): a, c, t, g, unknown or other
  modified_base (7280)..(7289): a, c, t, g, unknown or other
  modified_base (7962)..(7971): a, c, t, g, unknown or other
  modified_base (8181)..(8190): a, c, t, g, unknown or other
  modified_base (8594)..(8603): a, c, t, g, unknown or other
  modified_base (8810)..(8819): a, c, t, g, unknown or other
  modified_base (9373)..(9507): a, c, t, g, unknown or other
  modified_base (9601)..(9610): a, c, t, g, unknown or other
  modified_base (10225)..(10234): a, c, t, g, unknown or other
gcggcctcctcggccgccgcccgtgcggcctctcgccgcgccatcaccgacgccaggcgggcgctgcgtacctggggcgcctcgggcgcctgccaagggcgctcgcgtgggtcgacgacctggaggcagaccgcgccagagctgcccaggatctgccacaggcggcaggtgccatcgaaggaggccgacagcagcaggtcttgcgggatggggggggggggggggggggacggggggggnnnnnnnnnnatgagttctagtcgcggtgaggacaagatgtccagggccaacgatgcggtttgcggcgcatggttgtttggaccagggtgnnnnnnnnnngttctggtcgcggtgaggacaagatgttcatggccaacgatgcggttgcggcgcatggttgtttggaccagggtgaggggcctcgcgcggaacccccccagccccctcacgaatggagcacgcgcccataaaaacccagcctggcgtggccccacgccagcccctttgccaccctaccgttgtgggtcggggaccagcgcaccaccgagatgggcctggtgtgttcgctgaggcgnnnnnnnnnntatcctaccgttgtgggtcggggaccagcgcacgatcgagatgggcctggtgtgttcgctgaggcgtgccacccacgcccccagacttgcagcctgggtccagtgagttgagggaggagagggctctgtggagctacagtactaatgcaggggtggcacgaggctgccgcggcagcgtcacgccatctcgcctgcctgctcacgaggccgattgcatgcgggtccagcctccctgtgccgccacgtggcggcttgggcgtgcaggtgtcggcggcttcggttccgcctgcagggtccgaccatattctgcaccacacccccgactgccacgcccaagacacacccctcaccnnnnnnnnnnagtggcggctcgggcgcgcaggtgtcggcggcttcggttccacatgcaggggtccgaccatgttccgcgccacacccctgactgccacgcccaagacacacccctcaccctgactcttccccccctttccacgtcatcccacctgcaggctccatacaacgacggtgctgtccatggagccggaggccagcagcgtgtcgtcccgagagaccgccaggtctgtgatctcgcccgtgtgccccctgcaactggcctggaggaggcaggtggtggtgctccacagtttaacgaggcagtcgtcggcgccggaggccaggacccgtcccccggcgtcaaaggcggtgcagtagaccgcgctctggtgcccgcgcagcgtcttgaagcggcggaaggcccagggcgtgaggcacgaggcctccgccgcgcgtgggtcctgcgccgcgcggcactcgcccgtctcccgcgccagcaggcgcagccccagggtcgggtcgcgctcgccacgggcccactgccgccgccggcggtggtccaggaggtggaaggcggcggcccgtggtggcgcgggtgacggcaggcccggtggcagcaggctcagcggcggccggtcgaggagcgacgtgatgccggagctggtcagggcgggcacgcgcatgcggctgaggccgtgcagcgtggacagcgcgtgggtcaggaactcggcagggaggtgggcatgccggcggcccagctcctcaaggctgggggtgtgccggttccctgcggcgagcgggggccgcatggagggaggggtggacgaggggtcgtacgacaggcacggatgctttttctgtagtgtgcagacggtgcccaccctgaagggcgatgcccgggggatgacaggtggggtgtcagctctactccccactgcctggcacaggcaggctaccccttctcgactgccctgtcctcccacacctcaccctggaagtcgaagcgaacggggaggaggttacgctccgcagcctcgcgcgcaagctgctccccaatgtggggcaggggaccgtgcaggagggcgtgcacgaggatgtacatgacctccctctcgtcgacctcggcttcagcatccagctcggcggaggacgtgctcccagagcccattccaaccatgggggcatccctgtcatttacgcccaaagagctcgcacagcgaagctggggtgccaggcgttcggagggcaccacattgacgggattccgttgccccgagctcatgctggggttcaaacgtggaccaacatggcgagacgatccatctgatatccggtaccccctatagacacttgctgctcatctgccctgatattaaatagcacgcgacgtgctgcgtggacgcgtgagatcggtattgcggagttagagttcgttccggctttccactctggctccacaactcttcagtcggaggccccaggctgcgatccaggcgcataattggcaatcagtaggacacatgcatagttaggtcgcggccatgcagagcttcagcctcgtcaaggccaaaagggtgccgcgcaccttgctgcagtgcgaggactccgatgaggagccgcagccaagcacagggcctgaaacaattgtaagagtgacaaataattttcgcagatgtgtgttgccaactcgttcgatctcctaagggtgtccctggaccgacctccgccccggcgacctctgacgtggctctcctcctgccacgtctgcagggagcagcagtcgatcatctggcattggggaatgaagcagccgagaaggaagagtactccctggccttgcggcactgggaggagggtctgcgagagggcagtgatgccccacacattctccatgagcagatgtctcaggtaggattcaagctcggaggtcattgacggagtttcgagcatatctgcagcagtggctttgctgggtgaaaccggtggagatctggctcgattctggcacgcctctnnnnnnnnnncgaaggagttccgagcatatctgcagcagtagctttgctgggtggagccggaggagatctggctcgattctggcacgcctcttggttcccagagccgggctttgggccacggccaattccgtccggcaccctccatatcccaggttctgatagagctggacagacctcttcaagctgcaaagcaagctaaactggccgtcgaggccgccccgaaatgggccgaggcgcacctcaccctgggcagggcccggctttgcctccgggactggcccttggctcgcggatccttcgcgcaggctctgcacttccagccagatcatgccatggccaagatggagctcgaagagcttgatgcattcattgcacggcaagaaacccgattacggccagggccccttcccccgtaaagtgcagtctgcgtgctgtgcgctacggatacagagagccgtagggccaggcaggatgtaccaggccacgcaattattcctgtgtaaatgatgatcaatgttggacatgtactcagttgcgctgggcatgccgtccattgccgatgggcgaagagcccagcagggttccagnnnnnnnnnntcaattactcctgtatcaaggatgatcaatgttggacatgtattcagttgcgctgggcatgccgtccattggcgatgggcgaagagcccagcagggttccagcttgtggttttggatgtggcatggaaaagcggtgcacagcagcaatgaagatacgcttgtacatagctttatttcccagccatggctccattagatcaagtacgagcgaatttaaatcacggaagccataccaggaagtgatccgaggcggtggccgagaagcgcgcaagcgcaaagccaaatgccccactccgtgctccctgacaggaagccagggtgttcctgactccctgccgcccgtccaaccttcccaaaacatcatcgcattgcaacaaccaataatcatatcgattttcggagtgggattggcgcctcatgccggtcctcgnnnnnnnnnngtaaatcatgtaagccatatcgggaagtgatccgaggcggtggccgagaagcnnnnnnnnnnatccaaccttcccaaaacatcaccgaattgcaataatcaataatcatatcgatttgcgaagtgggattggcgcctcatgccggtcctcgagctgggctggctctaggactcccctttcgagcccccggctcctcccccacgcctgatgcatgcccagcgcgccgccgcgccctgacccaccccgccccgcaccatgcatccgggggccatgtacgagaccctggtcgaccagccccccggcccggtggtgcggagccccctggcaccccccctccgcctcctgctccgggctttcaatatccttctggcaggggcctccctggccctactcctcctggtcctgctaatcatcctgctcccgcgacacagcctgcccgcgccaggccccctgccagagggccatgctgcctcgagaccgggcctcctgggcgctcaggcggcgctccgctcctggccggcctgggccgggactgggcttgccttgctgggcctgaccactgcgatggccgggctggcggggctggaccaggacaagcggcgctccctttccacccacgtggccatgctcgtggcgctggtgctcctccatgccggcgccctgatcctgctcttcgtcgctaccgactggcgaggcaggctgccgggtgagtggtgtggtggggagtagagaggagctggaggggtgtttggggggatcaatggaggggcagaggatggtgttggtgtcactgnnnnnnnnnngggtgtggtggggggtagagaggagctggaggggtgttttgggggatcaaatgaggggcagaggatggtgttggtgtcactggaggggtgcagcaggcctgcgctctccttgcatgtacccagacatgacatcttgcgggtgctggctgattcaaccccaccaccaccaccaccaccccatcccaccctgcagaggacccagcaggcctctggccagtggtgctgcggtacaccgcccaacatgcgactcgtgtcaagtattgcctcatcgccagcatgctggctcatgtcgtggccgcgctctgcggcagcgccttgctgtccatctaccaggtggggagcaggctggtcgggtggcagggccagatgcagatgctcgtgaatgggtgaaaggagaggacgtggtcatcccctgtcaggtgctagcgatgcggtgacttgagtacatatgcgaggctttgctgcacccacccgatgtcatcaagaagacagcacggtccacggcaccgttcacatcctgatgcagacggcgtacgaagcgtggctggacgacaacgaggaggccgccacgcgtacaaggaagctgctggcctccagaatgcagcggatgacagcaggtaccgtggatggggccatgagctgcaggtttggtgatcgtgttcagccccgcgctgacgtgtgtgggcatggcaggcagccctgcggcatgcagtgcggactgccagtcaagcagagtctgtttgaggcatggactacagtgcagctgcctataatcgtctttgggccatgtgcttggtgaagatcccatcgtccttgcatcaggggctgnnnnnnnnnngctgtttgaggcatggactaccttgcagctgcctataaccgtctttgggccatgtgcttggtaaagatcccatcgtccttgcatcaggggctgtcagtcgcttgcagggcacacctccccctctgcatcaggggctgtcagtcgcttgcagggcacacctccccctctgcaccatgactgatgcacatgcccacatgcacctctccctccgatcgcagggggcgcaggtacaccgtgggcgcggcacctcagctccaagtatgctatcgacagctgcgcctgggagatgtccgaggatgcagccaggaggctgtccctgctggctctatcctgtccgcggttgggaggggaggagggagctgtgtgatcagcaatccctgggattgcatggtggattgcaggcgatttacccaacgatgagaatgcacactgtatcccaccactgttgagggctttaacactggcttgtgcatcggctctgggtgttggtattccagtggatccttacaactctgttgtcatgtgcatgcgcccagcggcttgcaccacaccctctttatctgcctttgaaattgtaaacaacgaataagctctctgatcagggtcttgcaggagaggtttaccgtgggcagggatgtctccttagcgtgattgctcttggaggatgatatatgatccacatggcgatctcgttggcataggctggcgagggctctcaagccaatgcaatttcaactttggttcctaaacacatgctgcnnnnnnnnnnaaggtttaccgtgggcagggatgtctccctagcgtgtttgctcttggaggatgatatatgatccacatggcggtctctttggcatagcctggcgagggctctcaagccaaagcactttcaactttggttcctaaacacatgctgccatggctcatcataatgaacaggccatcgtggccccgtgccttttgcaaatgtgtgagccaattccaggggctttcaccacagccagtggatggtgcagcatgtagctgatccagcacataacatagtcgtcagcaagggtttggagcctcaaggccaatccaggaggcgcaggagtgtgatgctgcgcttatctacttgtctctgccttgccatgagtggctgcagatggtatgtaaaaggatgggactataccatgctgcgacaggcagccaggaggaagggtgcggacatcatgcagctcaccttgccgggccgggttggcaccggcttgtccgcaccaacactgcgatgagtgactgctcctgctcaatacaaagcagggcaacgtctgctcgcaccaggcgatgttcctcaccagggcttgtcagataatgctgccatggtggtgcacaagcttccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggacttcagaaaaaaatttgaagatgtggctcgagagcccagcaacatcccttgcccaacttcctgagcgcacccattgagaagcacgaaaaccgatcaccaggaacccacgagcgcagcctacgnnnnnnnnnnccgctgccttccctctggaagatgttggtggcgagcacacgccccgtgcgagaccctgccttggtagcctccaggcaggtgacccagccaatgctgtggagagtgggaatggggtggcgaggtatggccaagaggacttcagaaagaattttgaaggtgtggctcgagagcccagcaacattccttgcccaactttctatgcgcacccattgagaagcacgaaaaccaatcaccaggaacccacgagcgcagcctacgtgtcggtggcagcggccctgacgttgtggatggtgatgtccagggctcccccctccagaatcagctgccagctggacaggacctggtccctgcccgcgatgcagccggccgcggggtggatgacctgcacgctctccgacttgccccacaccgcctccatcgccggcaggtcggcgtctccaaacgccttgtagaaggctgcgttggcttgcaggacgccgctcaggttcccttcccgctgctccctgcaatgaggagggtggtatgcgggcgacttaacccctttgcaaggaggagtcctgcatgcgagcgagtgggtgaactcctcgcaatccccaccatggccctcaccgcagtttatccctgaggactgcggcctgttcatagtcctctctgaggatggcggcatccaatnnnnnnnnnngactcctcgccatccccatcatggtcctcaccgcagcttatccctgaggactgcggcctgtccgtagtcctctctgaggatggcggcatccaattcacgctccagggggcccaggccgccaccctcctggtggagggccctgaggggggcggacaggcatggcgcagggtgggaggggtttgcacccgagcattgacatgatcggcatgnnnnnnnnnnaccgccaccctcctgatggagggccctgaggggggtgggcaggtatggcgcagggtgggagggggttgcacccgagcattgacatgatcggcatggattgtcggccgaaaccaacaatgtgatctctccattgcaccggattccatgctgccacaggtctaaagcatcctcatttcctggacccatcctcacctgggcaccaaccgcactcgccgagtcgggacgcatggcctgaatgcacatggccgacagactgcccatcgatgcgtgtttaagctggtgaatgagggtgcatcaccagatgcattgggtcgcaagcctctcatcctcagctccatttcgatgacgcttcagtcacgcagaagagataccggtgatggaccggaacgggcgcaccgggcagnnnnnnnnnncgacgcttccgtcacgcagaagagatgccagtgatggaccggaacgggcgcaccgggcagctcaggctacctaatctccagccaacatgcattattaatgcatttgccccctgcataagacgccgagctcgacttttcgttgcgcaggggtggtgcgccctgccgaattggattctgcgcccggagccatcggaccttgcgcgcccnnnnnnnnnnacgacctttcgttgcgcagggtggtgcgccctgccgagttggattccgcgcccggagccatcggaccttgcgcgccccctcgacaccctgaaagcgcgccaggccatcatgcagtcgacccattatgtctttctgatcttcgcatcatccttgaagctcagcgggtgtgattcttccggtccgcacgccttgcacgggaccccaacggctcgcccccaagaatgtcggagtcgtcgctcactgcccccttgcatgaactcctgcgcacgactcggctctccagtctcttgaaagatcgggaggtggtgtcactggatgccgattgcaccgtcgacgaggcgctgcgcactctgtcggagcaccgcctgctcgcggcccccctcaggctggatgaggcgaccgccaagtctgagagcctgacgggctccccgacccccaccgtcttcctggacatccgcgacatcctttccagtttcatgcatggtgtgtggagtgagatggctgcctgcagggtcgagggtgttggtgggggacgagtgtgggttgaggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactggaaaagcatgctctggacgaccccgccttgtcaccccccacgccacctccccgacctcagcctcccctcgccgagtcatttgacccnnnnnnnnnncgtggagtgagatggctgcctgcagggccgaggttggtggtgggggacgagtgtgggttgaggcggccaaagggacacgccacgcgccctgcggcaagctgcgctgcagggcgccctgcttcgttggttcataccttttcccctgcttggtagcagcattcccgctcttcacttccttcactggaaaagcatgccctggacgaccccgccttgtcacccctcatgccacctccccgacttcagcctcccctcgccgagtcatttgacccctttctaatgatactctccttgcagatctgggcgacgagctgctgcgggagactccggccatgctgacgcgcatgcgccggctggaggagcgggggctggccttcgccgagcagcccgtgcggcgcctgcacaccatcggcggcgacggcctgctcctggacgcggccaccgccccggatctgaccctggacgccgccctgcgcgaggggttcctcaagggcgaggtctccggtgcgcgcgcgctggacgccggcgcggcgcccctgcccggcgccgcgcagcccccagcgcgctccgtcacgcatcgcctagggctggcggactcgcggggtcgggtggtgggcnnnnnnnnnncggacgccggcgcggcgcccccgcctggcgccgcgcagcccccggcgcgctccgtcacgcatcgcctaggactggcggactcgcggggtcgggtggtgggcattctgagccagacggacgtggtgcggtggctggcgggcgcgctgcgtgacctccccgcgctggccggcgccagcgttgcctcgctgggcctgggggcgcggcgcgtggagggcgtgggcgccgagaccccggcactggatgcgctggccgccatgcgcgccgcgcgcgtctcggcgctggcggtgctgggcgaggacggcgcgctcatcggcaacttctccgtctccgacctgcgctccatcctggcagagcactttgggtcgctggcgctgccggtgggcgagttcttggcacgagagcatgggacagagtatcgcggctatgccgcgcaggcggaggtgggggtgcggggttgggggtgggggtt

SEQ ID NO: 40161 - DNA, 78 bp, Chlorella protothecoides
cacaacccctccccaccaccctccccctttctctctctctctctctctctcacacacacacacacacacacacacaca

SEQ ID NO: 40162 - DNA, 80 bp, Chlorella protothecoides
ggagctggtggcagccatcacgctgcagtccacggcagacatcgcggcgctgctggccgccgcgcgcgcttgtgtggctg

SEQ ID NO: 40163 - DNA, 63 bp, Chlorella protothecoides
gtcccaggtcctcgtggcctcaccaagagctattgtcacttcaccctgtactcatcccccccc

SEQ ID NO: 40164 - DNA, 61 bp, Chlorella protothecoides
gccaccacccttgagctgccaagtgtgttgggcgttggcaccctcaatattgattcatgat

SEQ ID NO: 40165 - DNA, 98 bp, Chlorella protothecoides
gcgcggcatgcccgcgaactcgccggtgccattgccgttaatcctgccgtcgtcgtccagcacgttggcaaactccaggccatgccgcttgccggtgg

SEQ ID NO: 40166 - DNA, 61 bp, Chlorella protothecoides
ggtgtgccaggtcagcatgctggagggggcgcccaccgaattccagcacctgcgggctgac

SEQ ID NO: 40167 - DNA, 136 bp, Chlorella protothecoides
ctggatgggaggatggatgaggcatcttgagctgtgatgtttgaccaggtgagattcagccggcggtgaaaagctgggggcggcagacatgcgtcattcattctggcaaggagggatcctgaccagcaggagaggt

SEQ ID NO: 40168 - DNA, 61 bp, Chlorella protothecoides
cgccgcgccggagtcaaaggaccaggcgcgcgacagcgccttcaggaaggctgcgttggcc

SEQ ID NO: 40169 - DNA, 61 bp, Chlorella protothecoides
gtccacacccaacccaactgcctcccccaagcctctgcctgccccaccactgctccatgat

SEQ ID NO: 40170 - DNA, 159 bp, Chlorella protothecoides
ccccctttctttttagggtgtcccacagagggtcggggggcgcgtgggtgggcggatgatgagggcctggtttgcgaccatcgaaaactttgctgtccgtccgcttcgtcgcatgcctgagaacagtttgcacagggcgctggccccctcccttccctg

SEQ ID NO: 40171 - DNA, 78 bp, Chlorella protothecoides
atgcgggagcacgcctctgcccagcccagcctgggtgagagggaggttggggggaaggggtggagaagaggaagcaga

SEQ ID NO: 40172 - DNA, 70 bp, Chlorella protothecoides
ccccagcccctgcttaccacaccgcattcccccccctctcccccccactccagctctacctgccgcgctc

SEQ ID NO: 40173 - DNA, 73 bp, Chlorella protothecoides
gtgaccgaactgctctccatcaatttcacagctcagacttctcctcatccctttgaaccaacacttctccagt

SEQ ID NO: 40174 - DNA, 117 bp, Chlorella protothecoides
tgtgctcctcacagatcctggagtgaaaggggtgggggggtaggggagaggggttgggaagggacagagcagagagtggagggcacgagacttgagcatgccatgctgggtcgggcg

SEQ ID NO: 40175 - DNA, 61 bp, Chlorella protothecoides
cccgggaggggatgctgtgggcaggggaggggggatccatgcgcggccccgcacctggagc

SEQ ID NO: 40176 - DNA, 61 bp, Chlorella protothecoides
cgtgtcgatgttaggaagcgctggcggggggatgtcgtcctcaccatctcgccctctggcc

SEQ ID NO: 40177 - DNA, 6963 bp, Chlorella protothecoides
  modified_base (755)..(764): a, c, t, g, unknown or other
  modified_base (1125)..(1134): a, c, t, g, unknown or other
  modified_base (1727)..(1845): a, c, t, g, unknown or other
  modified_base (1897)..(1906): a, c, t, g, unknown or other
  modified_base (2009)..(2018): a, c, t, g, unknown or other
  modified_base (2913)..(2922): a, c, t, g, unknown or other
  modified_base (6900)..(6909): a, c, t, g, unknown or other
ttcgaggtgaccgccccagcgcctggcaaaatgtcggtatgctgtggtctcttgcacccacagcccatccatattaaggagcacgctgcagcgtatgacccctctgttgtgccctgcatgaagatagccagtattcaacaggtcctgaaagcttgcctcatggaatctcagaggtgggtgcaaaaatcaggccggtcatgggtgtggtcaggttgttggtcaagcaacatgagattcgttgtggtccaattcgagaaaaccagttgcgcgataaggagtgagaattggctgggagcaggggggcagccggtgctcgaggcactaccgagaggaagttcagtacaggctgtgagagggagctcaggcatgggcgaggatatgtggggatgaggacgggaagtcaaggagcctggcgctgggcatcggcagcagggaggggcatggaggcccagaccgcgcagcggcccaatagccgccggccccgccctggaggcaggctggggaaggagtccggctggcggcgcttgggctgggggagaggaggccggcctggagagggttcagcgggtagatcgcgaggacaggcgcaggcgcagggaacggccagccgggtagtgggacggagcgtctggcgcgagggacggcggtggtcgcgcggccccacacgacggtggtgtggcgcttgtcgccgcccagcagcacagcgcgctcgttggtgaagtggcgctcggccagcgcctgccgcttggtagcannnnnnnnnnacgcttgtcgccgcccagcagcacaacgcgctcattggtgaagtgacgctcggccagcgcctgccgcttggtagcagcgttgaagcatctggcggtggggtggggtccggccgtgccgggcactgcaagctcggaaaggagggtgcaccgtgcggcgatgaactcggctgctgcggggacgtcggcggcgacggggacaggggcatgcagggtggtgatcgaagcggcgaccttgggagaggcggcgacagaggggcagggggcgacgctgccatcaggcgcgtgcaccgtcgtgatgcgcctggcgtcgacgccagccccggacgccgtggcgtcctcagcgacggcgacggcgcgctcnnnnnnnnnncgccatcaggcgcgtgcaccgccgtgatgcgcctggcgtcgacgccagcgccggacgccgcggcgtcctcagcgacggcgacggcgcgctcctcccacgccttccaggcggcccccagcttcgcccccaacgagaactctcgctctacaccggcggcctccgcctcctggggcgtcgccatgtctgcctcctccagcctctccgccaccagcgcctcatctgcctccatacggtcagccatgaagaaggcagggaggagcaggtcgccgtcgtccaagtggaagctctcggcggcctcctcggcctcctcgaccaggtcgtaggccagtgcctgcaggcggtccacctccgcctgggccagctcggccttctcctgcatggccagcgcggcggcctcggagtccagcgccgccttcagctgttcggggctggcctggcggagggagcgctccaggtcggccagacggcgcatcacgtcggccatgacggggcggtctgcggggtcggggcgcaggcagtcgatcaccaggcggcgcaggccgggagccaggaggccgaagcgggacagcctggggtagaacgtgccagcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccattataggtggaggtggggagcaaagcttcaggaggaacctggcaaannnnnnnnnnttataggtggaggtggggggcaaagctttagggggagcctggcaaagcaaccggcacccagacatggcacaacaacacatgggaccctctttcattcctaaannnnnnnnnntggtgtgggggagggggttacgcgcgctaagcgggtgcgggaggagcggccgaggagggccgggggatggatctgggcttgtcagccaatataagtggaggtgaggagcaaagcttcaggaggaacctggcaaagcaaccggcacccaggcatggcacaccaacacatgggaccctctgtcattcctaaacctaagcgcacccatctcgaagcaggtctgggtccagccgctctttatgtgtgggccctgcagctccagcagcatgcagccaaaggcgtacacgtcgccagctcggggattgcgcgccagggtgcacatatcctcggggccggtgtggctgagggtgcgcctgtgtgcgattttgtggggggagaggggggttgggaaacgtgtcaggctgggcgaggggcctcacgcgtcatcatccccagccacactcacacccactctgagctcatcgatacacccccctccccaagagacaaccccaactgtgcgccgtcacaaacatgcatccaggccaggcgctggacgtctggggcaggccgccgtccggctccagcttggccacgccgtcaattcgcccgccactccctccacattcaccaccgccctcctctcccgcattacatgattgctcgaatgcgcctgtggtggccgcagggctatgcggttcagtcctatacccgcacatctgcaccaaaaagggcgtccccacagccgtctgcatcacaacacctccaacaggtgtctcagtgtgcgcaggggactttagagtgtcgtccgctggcacatgcactggtttcctattatcccatcctgctcatttgctttgagaagtcatttacaaccacgacatactgggctatgtgccaccaaccccccagccctccnnnnnnnnnngagggcaggggcaagtttttggcggcagacaagattggtctaggtgttgggcaagggggaggagagcgggaggatgctgcatcgggcggaagacgagcagtgttggtgttgtgctcaggacaccaggtgctcccagcgcttattttccaggtgatgcccccatcccaaccaggcatgcggacactcaccccctcagcgtgcaacgcatcgatgcgctcggcgaggaggcggcaggtggagaccatggtgacatcgtcaggcttggtcttgccgctgtgggcgaagagtgttgttttgggggtgagaatgcgtcataggacggcgagcgtgtgcgagagtgcgtgggcgcctggcagcctggaggggcgggccggctgggagtgccatgcagctaggcaactgtgatgcacagcatgattaaatcagtcaccaggccttgcccgcacacacatgaccatctacccctgcccacccaccaccaccccacctcgaacaaaaccctcacctgaagaaggtgcccatgtcgctgtcgcagggctcggtgagcacgcctactgccctctccccggacagaaccaggcccagcagggggacggtgccggcggcggcgcacacgcggtgcccatgcacctcgcaggcgacggccgcctcgatctcctccggcgtcttcttgcccacgcgcagcttcagggcgccgaagcgcgggattccatcgggcccccatggcagctgcaccttcaccacatggccgaaggcgcctgcgcccagctctcccacctctgggagctgtgttggagggatggaaatggggggataggtgtcgcgaggccgggtgaaggtgagggtgtggagggaacagggttggcaagcccggggactagaagagggccagggagattacaggacagtgcaacccaggaatagccaaactcacgtcgctgagctgaaaggttgggagcaccctcttgaggtggttgaggtagaggtcaggcttctcgaggttgagttcgctgaaggtgcctgtgtggaaggagggccagggaaggggggggggtgtaaggtgcagggggagcagatgtctgtgcaggccgcgttgaggtgcgggtggtcgtagtgaattgaagcaccgttgcgaagaagggacgagatccaggtgtgccgggcatcccaccctacccagaccttttctcaccttgcttgggggtaggctgcacggccaccaccatctccatatgggaggacttctcagactccagctctgcggaggcagggcaggcaccctccacatccacctgggcgccagcctcggagccgtcgctgatgggaccgttcagggccgcctcctctgatggtgtatcgggctcaaggtcgatctggacgaaggcgtcctcctgtgggtcgaggtaggcatcgtctttaggctggactggggtggagttccggatgatggcgcgcttggactccacagactcgaaggaggggggcaaatcggagatctcggatgctcggggcatcttgtccgagtgggactttttgggcttgggctggagaccgcggcggaggccgatgttggccgcgggcatgccgacagagctgctcctgatggctcgcacagcgtcagggcggttgcgacctggtgcggggacctatgggagacaccagagcggtctaaattggaggctggaggactggagggggcgatgaagacagcctaaagcagggtctcaacggtcacctgaccgacagttggacgactacatatgaactgtaggaccctcccaagcaggctactgaacttcttggttctggatttctgcggataagacagaggaatgattctgaaatgattgtcaggggagaaaggtgcctgtgcgtggatttgtgccaaacttagaaacctgcgtcactcacggggaaacccaatccgcacagggagggctggctgaccgacattgttcaagtgctgggcttgagaggggagtattattatcaagggggtcgaagaggaaaggttatggggcgtcacaagcgcccgcaggcgcttttgttcgttgcagctcgacgccagggtgccctgaaacagctcccagggacaaaggtgtcccatccgaacctcccggccctgggactctggagggtgcggacccggcagggcacggaggggaaacagttggggtctgtgtgtcaaatagacaacccttacggagatgcaagtggtggttgatgcctgttgaggtaactgtgagatcggaccaaaccactcgaccatcgtgactgagacccaagcctcttccacccatttcgtgcgacgggccgccgtgcccacggattgaggggaatgtaccatgatgtgttcaggatgttaacccacgagtgagactgccggtctcggatgtctgtgtccgtcgggagttcgcatatgtagctctctcatagcaggagaatggcacaatgcgtgataaggatcccacaggcccccatgctgtattccacccagagggttacagctctttggatgctgcgctctcctagtacggctagcggcgggttgtgggaggtgtgtctgatccgtgtgcatctgggccggtgttgggcttgtgcgctagggtgtcgctcactacgtgcatctttgccacggctagggatccgcaccagcggccgccgggtcgaaagcctttcctctcgcacctagaggaatgggctctcaccttttccgcaaccatccttggctgctgttcaacatatctccccctggtggtgcccgaagatgagacagcagaacttgtgccaggcatgacagatcgcagcagtagccctggcatgacagatcgcagcagcagcctaggtttgaagccttacttacaagatgcaaaacaatcaccccactgcggcacatcgattgctgcccagcggcggcccgctgattgggagtctgggcggctgactgtcctaatttgctggcaacggcgcccgggcctcgctcaccaaatgaggattcccaggacagtgagaggcgtcgctgcttgccattggcaacggggcacgatgggaattgcgcaggcgacggcagggtcgggcctcccgtgcctgccgcctggcgccacactccacggcgaacacatgccactccgttggtcacccagcaggtctttagacgcccggttcctctcacctctccttgtaccaaatatgcatgtgtggtcacccagcaggccctgcagtagttgcgtgcgcccctctgagacctgttggcccccgcttctcgtggtgcaacctcgcgtgggaatgcatgcctgaacatgcatcaatcaccacacaagctggcgtgcagcgtccgcgcgtgggctgcgcatgggctccagagtgaggatgaggagtcctcgacggtgttgccctccgcgccttgcagctctgtcctgctgcgccgccgcctgcagacctcgagttggctgcatcaccgtctccagccggcgtcgccgaccccactccagccggcgtcgccaggccgtcagccaccagccctcggtcctgggtgctcaggggtcgccccgcatcgcccgccccagcgcgaccagatccacgtccatggtcaggaggaggggtgaggtctcgcgcagcgccacctcgtcggcccgcccgcgcaagcgcgccacggcgtcgccggcctccacccccgcccgcacgctgcagcagaccgacaggtccaggccctcgcgggagaagagggcgtacaggcgctccatgcgcgccgtgtaggccgccagagcgccctcctgcacgccctgctgcgggtgggatgggagggtggggggaaaggggatgtgggggtctgggtggagggggacagccaggtcctgggatggctgggggccgccggcacgcggcaccccaaaagcccatgcagaggcgtcagcagaaggggcgcccaccttgaagctggcgaggaaagcgcgtcccacggcgtgcacgagccgcacnnnnnnnnnncctgctcatctgcactacattgacgaatcaggctaccttctacaatgctgtctg

SEQ ID NO: 40178 - DNA, 80 bp, Chlorella protothecoides
tgacaccaacgcaatctgcactcggcatcagtaagctacaattgggcgcgttggccgggccatgatcatgcgacaacctc

SEQ ID NO: 40179 - DNA, 1965 bp, Chlorella protothecoides
  modified_base (757)..(766): a, c, t, g, unknown or other
  modified_base (1180)..(1189): a, c, t, g, unknown or other
  modified_base (1342)..(1351): a, c, t, g, unknown or other
  modified_base (1514)..(1523): a, c, t, g, unknown or other
agggcgggccgccccagccgccgccgccgccgccgctgcggaagctgcaggagccgaggctgggcgccggggacacgccgtcgctgccgccggccaggtgccggccggagaaaggcggggcgtgcagctccaccgacgcgccgcccatgctggcccgggcgcgcacgccgttgctgttcagggtccacagctgcaagtctgcgatggggggcgggggtttggggagggaaagctcgatcggctggacagtggcgagcggtcgagagcggactcagtccccgatcacacgcgcaggcagggagcgggcggggcggccagcttgggcgaggaagggtgggctcccagggcccatcggcggaccccaatccgcggctgctctgcatcgaaaggcaacacggctcgaatgaaagaccccgtcccccacacaccatcgaccagggcatcgacgctgtcggccgcggcgtcgcgcccggcactctgcgccggcggcaacagggaggccagcgagcggctgcttcccaacggcccgcgccgccccgcagaccccaggctcgtgatggtgctgtctgtgggcgaccctgcaaagcatgtgtggtcaagagggtatcagggtggggaggagttcaggtcacccctgcacactttgctgggtggatctagcaaaactgacacaggtgcatgtgcagtgagccaagccggggatctctccaagcagtcacagggcatgtgcgtgggaactctcctcgtcaactccccnnnnnnnnnntgtggatccagcagaaatgacacaggtgcctgtgcagcgtgcccagccggggatccctccgagcagtcacggggtaagtgcgtgggaactctcctcgtcaactccccatcctccctccagccccccctccagccagtgcgcaccgagcgagacgacgcgagaggcggagacgcccacgtccgacacctggcgccgaccgccgggtcccggggctagcttggggatgcccaggacctggctggcggagggcgagggacccagaccccggcgctgcgccacagcggcgcccggccccctggcggaagacgcgaaggagctgctgcgtcgcagcgcgctcgcacctgcagtggacgcagagggaggagctgaggggagcgctgtcggggggggatggaggccgccgaggctgagttnnnnnnnnnntctgcaggggatgcagagggagaagctgagggggagcgctgttgggggggatggaggccgccgaggctgagtttgagggtgaaaggtaccaggaaagtttctgggcacacaggagcagggccgtggggagcgtcggcacgacaggggatgcannnnnnnnnntgtaccaggaatgttcctgggcacacaggagcagggcagtggggagcgtcggcacgacaggggatgcagtcgaccgtccacgctcgcgccacgacgccaagggtgtcccttctgcgcgcatgccattcggcaaacacaggcggctgcgcggcgcatgcagccnnnnnnnnnncccgcgctcatgccattcgatgaacacaggcggctgcgcggcgcatgcagccccaccggctttcccagaaccggtatccttctactcgaaccccccccctgggtctttcctctccccctccgccgacccaccctccgagggcgggctgctggtggtggaggacatggagggcctgaacaggctgagcccgccggccctggcccccgcgctggcggccccgctccgcaggctggacagcatggcctcggggacgtggagcaggcccgggcgcttgggtgcgcgcggcgcgccgccgtcgttcttctggccgcccccctgccccggctccagcagtgcgagcagggccttggcggccgtctcgcccgcctcgcgcggctcggggtcgaagcgccgcgcgtcgtgcggcagcaccaccgcgcaggtggccccgagccgcgcgagg

SEQ ID NO: 40180 - DNA, 61 bp, Chlorella protothecoides
tgcaggcggcaaggagcgtcgatgccaacgtggccttgaccagcgctctgctgcgtgccgg

SEQ ID NO: 40181 - DNA, 70 bp, Chlorella protothecoides
ttagaacactcgcacccagcatgagcaaataaggtattatgccttccatgcatacctaggacgctgtttg

SEQ ID NO: 40182 - DNA, 535 bp, Chlorella protothecoides
  modified_base (164)..(398): a, c, t, g, unknown or other
acatggggccatgccaggagggcactgggatctgccgtgctgagcctttggcacatcccctgatgggtatcacggggagccccgtatatcgcatccacatcccctccctccattccacacctgagcagtccaacctcctccacctcggcttcctgcgctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatccccagtcagtgcgcttcacctgcaggacggggtccagcatgtctgaccccggcgtgaagtcgaccaggggctgggccgccgccgtggccgccgctgccgccgccttgttgaccaggctctgcacaggggggg

SEQ ID NO: 40183 - DNA, 5514 bp, Chlorella protothecoides
  modified_base (640)..(649): a, c, t, g, unknown or other
  modified_base (2074)..(2228): a, c, t, g, unknown or other
  modified_base (3583)..(3592): a, c, t, g, unknown or other
  modified_base (3964)..(3973): a, c, t, g, unknown or other
  modified_base (4479)..(4488): a, c, t, g, unknown or other
acgccggaggcggcgtcggcggccgccgcgtcggcccccgtcaggtactccagcagctgggaggggtggcagtcggcgcgcacctggacgtaggcgctggcgggaacggggtccagcgccgggccagagccaccggcgtgcaccagcaggccaaaggagaaggcgcggccgcgcagcgcggcctcgaagcgggggcgggcgcggagcacggcgccggcccacagcacaaaggcctggtggctgtgcatgtcgttgctgtagcacgccacgcagcgcacgcccaggagggaggccaggggggcctccaggtccctgggtggggggaggagggggaagcgaaggttggggaagggggcccgggcagggggggtggggacagtttgcgggaccggtgacatctcagcaagcaccctacttgttgcctggagcttgggagacagatgaagactcatgcacaagatgccgcggaggagcgcaggtgcctccaagactcgtgatgctgagccaccctttcgcctgcaacacctcggactcccagcgcgcgcccgcccgccgtccctttccatcattgttaatctggtgcacatcctctttccctccctttccttcacccctcctcgcccactcaccaggccctgcnnnnnnnnnngcactgttaatctggtgtacatcccctttccctccctttcctttacccctcctcgcccactcaccaggccctgcgccgccagaagtgcgccacgcgggccagaaggcgggcgcggcccatgtccagggccgccagggcctggagggtggaggcgctgtcctccgccacaaggtgcaccaccccgtcgtcgctgatgtggcactcccgagcgcggttgccagcagtgccggggaccccgggcgacagcctgcggggtggaagtggtgtacggggggaagtcgtcgtcatcacagcattatagccatggctgggatcgctacttcccaaggcaatacgggagtcccacatcagaaaccagcaaggcatcacacctcaggtgcaggccctggaagcggtctgggttgtctgacgagagcagggacaggctgccctccaacagccggagggcgaccaggtttcggcgctgctcggagcactggagggggtactcattggacagctgtgtgtgagagtacaggaggaagaatgggtgagatgtagagtgctgcaagccgtcacggggaagagggctcagggctggaagtatgtatgattcttttcattccccaagaactgagattcaagagctggtggttagggcaggggcttcgacagatgtctccaaccggacaaaggccctgcgagccacccttcttggcccctcccaacacccaccccgccccagcccacctgcagatgaccgaggtcgtacgcgcgctcaatggcggtgcggagctcctgggacgccgcggccagggctgcgtgctctcccgccagccgcgcggcgtcggacagagactccctcaaccaggccgcgaggctggcggcgggggcaaacagctcgcccgtcccgcgggccgcggcctcgtccgccagtccaaaggcggagagcaggggcagcaggtcgccgtccccgggcaggctggccgtgatcagcgccagcccagcctgtgcgtcccccgtccggacataaaactccagctgggcgggggtgggcgatgcgcccacagccagctggtccgcataggcattcaaggcctggggtggagtggtgttgaggggtgaggcgagagaggctggggaagggaaggccgatccttgatgcgccatccgcagggtggggaggccagggggcagctcacagccatcgacggccatgcgcacctggagggagtcggagttcactttcatctcgaagggatgcgccagaaacaggtcggggtgcacacgtttaatgacttgtcgcaggagctgctggtgggagggttccatggtgcccatcgcgccagggcagggccgctagggctgtatcgcgaggggcgaaaggcaggctcgctcccaggccctctgccacgtcacgcagggatgtaggagtaatgactcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccggacgcacagcactggaagatcgctcgcatccacgagagggctgccagccccattcccatcaccattacagtccgaccttccattctgcaagtgggctgcctggctctgagggactcgtgtactggtgggccaggggtgactccgacaccggcttcagagtatagagcctgcccagatcccgccgcgtatcgcagcgccttcctaaccggagtaattaagggcacgccagaggatatctagtgacttcccagaccctgctcagcgtccccgggaccccagtcgacaccaagatctcgctcgccccgaggcagtcggcatgaaggaggcccagtatgagggggcggacgccgtgcgcaaggaccatgtccttgtggccgtccgcttccgtcccatgaggtcagcgagcagggtggcgggttgggggggggaggagggcggcaggggaccccagtgggggctgtctccacacctcctcccagcactgtcagcaatgggagctgccttgttgcaccgtggtgccgagccgtctctcgatgcctgcaggtcatgatcctttgatcatcctcatccaaaaccatccaaccatccccacctcactctcggctcccccccaaacttctccagtgaccgcgagtaccagcgtggcgaccgcgaggtgtgggagtgcgagggtcaggcggtgggcatcgccgaccaggacacgggcatgcaggtcaagttcatgtacgaccacgtcttcggcggcgccgccagcaacgccgacgtgtacggcgcggtggcctcgcccatcgtggcctccgccctggatggcatcaacggcaccatctttgcctacggcgtgaccagctccggcaagacgcacacgatgatggggtccggggtggccccgggaatggtcccgcaggccatcgcccaggtgtttgccaccgtggcccgtgccggcgctcgcaccgagttcacgctgcgcctgtccatgatggagatctacaacgaggtgctgaacgacctgctggatccggcgcggagcaacctgaaactgcgcgaggacccgcgccgcggcgtgggcgtggagggcatcaccgaggagaacctggtgtcggcggagcacgccatccaggtcatcgcgcgcgggaacgagaaccgcaaggtgaggaactttggcgtgctacctccaaagtactgggaggtgcctggcaggaggggtgatggtgggtggcgagggaggggagggagattaaggggccgcgggggtgaacgaggggtgcagcgcagcgctccaggacagggtgaaggtgtggagcgcagcagggcgcgctttcctgggcatgcaaatcgggtcctggtccacnnnnnnnnnntgctccaaagtactgggaggtgcctggcaggcggggcgatggtgggtggcgagggaggggagggagatcaaggggccgcggggggtgagcgaggggtgcagcgcagcgcctcagggcagggtgagggtgtggagcgcagcagggcgcgcttccctgggcatgcaaatcgggtcctggtccacctcgggcacccaccagcgtatgtcttcatgcatggcagcgccggtccgcgcatatgcgcctctcgcctcacctgtgtctgcctcgtggccgccgcgcactcctgcctcgaccccactcccctccccaccacccccggactcacccagaccgccgccacggccttcaacgagggctcctcccgctcccacnnnnnnnnnnacgcatacgcctctcgcctcatctgtgtctgcctcatggccgccgcgcactcctgcctcgacctcactcccctcctcaccacaccctgactcactcagaccgccgccacagccttcaacgagggctcctcccgctcccacaccatcatccgcctgtccatcgaggcccgggaccgaccgggcgccaacgcagacccctccttccgcggccgccgcaccttctccctgctgaacctgatcgacctggccggctccgagtcggcgaaggctgagatccacagcaagcagcgcatggagggctccttcatcaacaagtcgctgctgacgctgggcaccgtcatccacaagctggcggaggggaacgccgcccacatcccctaccgcgactccaagctcacgcggctcctccagtccagtctgacgggtgggttggtggagcagtgggtgtgtttggggggtggcatggtttcggggggtgaggacaagagttcatgaggggagggaggnnnnnnnnnnagtgggtggagcagtgggtgtgtttgggggggcggcatggtttcgggggatgaggacaagagttcatgaggggagggaggtttcccatgaagtggatgtgggcgcccagcagggagcaggattgcaaaatccggcagggctgtgacctggatgcagaccgggcgtccttggactcaggcgccttgcgcagcgtgcgcagtgaggcgtgcatttcggcactcctgccccatggtcaacaacacgctcccagccacccatgcactccacaccacgccctcgcaggctccggcgccagggtggcggtggtgtgcacggtcacgcccgcctccacgcaggcagaggagacgcacaacacgctcaagttcgcgtcgcgcgccaagaagatcgccatcgccgccaagcgcaacgagatcatggaccagagcaccctcatctcgcgctaccaggaggaaatcaccaccctccgctcccagctggacatcgtcatgcgagaacgtgggtggtgctctgtctttgttttggggggagtggtctcaaggggggacgatacagggaaccgaggggggggggagctgcggcctacgatgtcagcctcccagcccctggccgcctctgcacttgatccgccgtgcgcacctgcgtgcctccatgtccctctgtggcacagtgcatgcccatggccgccaaggcccggcatgatgcaggcccaatgtcaccctaccacacacatgcacgagccaagcccccgccacccttccccgtcaccccacccccctccggcccttgacccaggcggcggcctgcccctgcatgacccgctgcaccccgagatccgcaccctccaggagcggctggaggaggagcgcatggcgctggcggcgcgcgacgccgacctggacacgctgcggcggcggctgggcggcctggcgcgatgcgtgctggacggcgcggcggctgccacgcagctgcaggcccggctctccgacccgcgcgccgacggctggcacgctgagctggcggcggggc

SEQ ID NO: 40184 - DNA, 67 bp, Chlorella protothecoides
gccgacatgaccatcgggtacagtggcgctgagctggccaacctgctgaacgaggcggccatcctga

SEQ ID NO: 40185 - DNA, 161 bp, Chlorella protothecoides
gccgtccacagagccctctccccgagggcactgcgtcgcgccacggggctgtcccacggggcaggggcaggcgccgtgcggggctgcacacagcccccctccgccccttccccagccccgctccagtggcgtcactggaagatccagtccgggagggtggc

SEQ ID NO: 40186 - DNA, 80 bp, Chlorella protothecoides
ccctggcagtggaagggcagggtgcatgcataagcccactcaagaaaagtcacagctgccaggcggctccctgctccggg

SEQ ID NO: 40187 - DNA, 76 bp, Chlorella protothecoides
gctcccaaccccttaagctcccaaccccttcagctcccaaccccttaagctcccaaccccacctgaacggccttca

SEQ ID NO: 40188 - DNA, 61 bp, Chlorella protothecoides
tcctgggtgagatggctggcggggcaggggggaacggaagggggcccgtatcgtgggcgtg

SEQ ID NO: 40189 - DNA, 501 bp, Chlorella protothecoides
  modified_base (93)..(133): a, c, t, g, unknown or other
ccccagccgccgctggcctgcgaggccgcgctgctgagccacggcgtggaggcgctggcccgcgcgtgcgtcgcggcgcggctggggggcccnnnnnnnnnnnnnnnnnnnnnnnnnnnnnnnnnnnnnnnnnctccagcgccgggtccgccgccgagctgtttggctcgctggaggccgcgctgggggcctgctctccgggagacgagcccgtcggtgcacgagggtgcggccgccccgccgcggcgcgcgccgtcctccttctcgacttcctctttgcgctggagcgggaggcccacgcggcggcgcgtggggacgagctctaccccgcccccgcccgcgcgttcttcgcgtccaacatcggggagctccgcggccggtttgcgcgcctgcgggcccccgccctcgccgccgccgaggccctgcgcctggacgcgcacgtcgtctaccacgcgcagcagggcctggcggacctcgcgggccgcgcccggcgcgcggcgc

SEQ ID NO: 40190 - DNA, 80 bp, Chlorella protothecoides
ggaagaagactgatcatccaccttgagtcacgcatgtaaaggtttccgcgtgacaaaactcgatctcaggtttcgatgag

SEQ ID NO: 40191 - DNA, 68 bp, Chlorella protothecoides
gatctactccatgtgtacagcttcatcaacgggcattactgccccccccccccccccccccccccccc

SEQ ID NO: 40192 - DNA, 61 bp, Chlorella protothecoides
caccatggccatccactcctgacccattcagagaggcatcatgctcctttgagcagcgcca

SEQ ID NO: 40193 - DNA, 5095 bp, Chlorella protothecoides
  modified_base (197)..(277): a, c, t, g, unknown or other
  modified_base (600)..(635): a, c, t, g, unknown or other
  modified_base (2272)..(2310): a, c, t, g, unknown or other
ctggacgcggcagcggccgcgatcgccgacgccaagagcgcggcggcggcggcctgccccaccatgccccgcgcggagaaggaggcgctgtgcgacgcgctgggcacgctgtcccagcccggattcgaggccgcgctgggactggtgctgcaccgctgcccgggcctgcagcccgccgacggcatcggttttgaccnnnnnnnnnnnnnnnnnnnnnnnnnnnnnnnnnnnnnnnnnnnnnnnnnnnnnnnnnnnnnnnnnnnnnnnnnnnnnnnnngcgctgacgctgcgccagctggccagcttcgtgcgcgcggcgggacggggggcgggcgagggtgcgaccccggtgtggcccgacgtcggcatcggggcgggggtgccgcccaggaaggcgcggcacggcggcgcgggcgccggggctgccctgccagggacgccgggcggcgaggctgccgccccagcagcgaccggcgccggagccgccgcgccggctgatgcggcggcacgggatggccaggcccctgccacatcgtgtgagccggcgacgactggcgtttctactgatgtggcggggggggggggggggggcgggggggnnnnnnnnnnnnnnnnnnnnnnnnnnnnnnnnnnnnccgccagagccggagggtgcggcggccccgttgcccgaagaatgcgctttggcggggccgatgctgcagaacggtgctgctgacaagtccaacggtgtaccctctggagaggcaggtccaagagctgaggggcagtctctgccccccacagagaaacagagattgggtgccccccagcgagaaagctcttcatgacggcctatcgatgctcatggtgcacccaatttcatcctgcctagctgcgtctggatcgacctccaggccctgtaatcactcctttactcagagacagcattcggcattacagtgaattaacatgtgatgctacatgtgttgcatgaggaaagcgagcgcggatgtgccggtggaaatattggcgcgcacggaaaccacagctggcacgggaacacctgagtatgacacgctcagagcatctgcgcgacatgtatcgcagctttctcagctggaattttacatccgaagcatgtcatgacatacgtcagggacccattgtcagctggtgctcgaattcaggcctcaactcgaaccacttcccccggccctgtggtacaccgtaaccccatcgcatggcagccatcaagctgaacagctcgcgccagaggtctggcgccgctggcatcctcctgctggccctcttggccatactcgtcgtggtcttcagaccttgggatgcaggtgaagaccaggcaccttggcgccctccaccaccccccatgcggtggagactgagccccgccagtctgcgcaaagtatccatttgacagcctggtcccgacatcgacactcttgccgcctccccccatccaggatcagcccagcatgtccccataggtgccgctgcagccctgcagctggtccatgaggcgcgggtatgcggctcccccgccaccgaccagtatgccaacgtgcaggagtcctgcctgctcgcctcccccgtcgcgcgctggtggcgcgaggcgcgcgccgagctggggccggcggcgctgacggcgtccatgcgcgtgcacatcgagcggcgcgccgactacgacggcatggccgtgcgctggggcatcggccacacgcagcccagcgtggaggcgtgcgcccacgcctgcctcacccacgagcccgtgccgcagtcgggtgtgtgctggtggtgatgtggattttgttcggggggaaagattgaggaggagaggctcctcaaatgtccggggcgggggctctgcaaagcgtgcacgagcggccatgacgactgcgcagcgctgcgcaccatactccgcactgatgatgccactgccgtgacacacctcctgcgctttttcgcattcccagggcacctggatgagctgccctgcaacgcgtttgtgtggtgtgcggcggagggtgggtgctgggagcccgacatccacaagcactccttcggcgactgctggctcaagttcacggaggggccggccgcgccggaggtcaacatgcgcggcgagctgtcgcagcgccagcggagccagcaccccgacgcgccgaccgaggtgcagtggcacgcgggcgcggtgctgccgcggggcgtcgagctgcgcaatgggagctggagcccccgctacgagtggtgacacccccccccccccccctcnnnnnnnnnnnnnnnnnnnnnnnnnnnnnnnnnnnnnnntctcggttgggctagagtgtatgccaaggagctgtggaggggtccgtgcagggttgcgggggatccgccttctgcttctcagagcacgccacctgctgggtgtccagtttcagccgcacgcctctgccaccactcgccctgcccagcgctgtatcgtgatgcccaacccccacctcccacgttgtctgctcggagcaatgcgcgtctgacagccagcgggccccgcagcaagcctgcccagggcctggcgcttgcaggatgcttccatgcatgagcgtgccggggcggcgtccactgcaaccccgctaaccaggaggccgtcagccctgcgcataccgccgagtccactccgctgccgtcttgtcatgagcttccctatccgtctgcaactgcttggctatgctggccaccagcgggtcacctgaggcagggttgtgggttcaaaatttgtgaaggggatgcctccatctggtatatcccagtgcctctcaggaaagggtgcacacgggggaatgggcacacggtgccacctgaacctccttcaaagcattctccacccggcatacacgtactggggttgggatctgtgagcagggagcagatggagagcaggaccttggacaccgtcagcgcggggctccactgttccttcaggatatccaggcagatctgcccgttgctattgatgttgcagtggtagatgcgggtgcggaaggtgacctgcgcgtaggatgggtacatggcggctgggtgaaggcccgccgcacggggtacaattcaggactcttgcaagcatgattccacacaacaacaggctggatgcgggccggggcgccatgcaacccaccattacagcacaccttggggggacgaaaggggtagtcggcggggaagtggatgtctaggaagtacaggccgccgctgtatggagaccctgtggatgaagttgggcgtcgacttgctggtgatgccaccccatgtctgggcgcctgaggagctgagcagccggtgtcaaatctccagtcctgatactataatcacagaaatcgtctgcgcctgccgccccgtccgggctgccatacctgagggacccatgatggtggacacccactcatacaggttgtcgcccttgggcccggcggagcaattgcagggggggtccagactgatctccgccagctccttctggatcctcttggcgctggcgctcagtttcgacatcggcacagggaggtgtgtgccgtgagcttgtgcgggtggaccgggttgcacggtagtgtcgaccgtgatcctgacgcactgtcgtcgctccagttcgcagcaacgtcgagagaatcaatggcagtttaaatctcggacggatgataagttcatgagcgtggagcgatgccctggtcctgatccaagcgttacacatcaccgttttcatctgctgtcgacacctgcaggaaccgaagcctcccgccaaagaggcatcatcttgatggtgagaacggcagcaccccgaccgcccctcaatcttcacaccgagtcggcatatatgtagatttgagcgtcaacccagcctgcgatatgcagcattacaactctctgtctccctggacccctgcagcgtcgggccagcctcttcacaagcccctctcggcggaagccctgtgcgccggacgagcaaagattcgccacaaaccgtccgaaaatattaggcgcaacatctctttttgcatttggtgggcacagaaaagactccgaatgcagtcccggaagtgatctcgagccgggtggtggcactccagcacttgcggtgacggaggcatctgtggtggatgtttggaaaaccgacaatggattatagattacattgccttggtgcttccgctgggatgctcgtcttcggttgcgtgccagaccacggtgttgggttgtctctgcaacttgactggatagttgatcaggcttctgctgcagatactgcctgttgaaatgtgtctcgaaatcacccaccaacgatatcctaacgtaactccttggaacgaaacgtgcgtgatgatcccgggtgatgtgaccgcgtttgtgatgactcagcatcgcatcgcgcgcctcacgcctcaggaatgtcgaacctacccaccccgaacctgctaggcctttcatgccacccccgggtgccgcagtttcatcaggccttgggatcctggatttcgcttgcattcgtcatgcagggcttactcaccgtcagtaagcccccctcagggtctggcttccaggctcggggctccgggccgtcgtccgcccggggcccgggcaacctgtaccgacccaccaacccccagggtgccggagttcagaagacgagcacacccccaccccccatccgcgtgcgggcatcggcagcgcatgtggatgcccatggcgcggcgtcctaccacaccccggcccacaggtgggtagcccggagagtggctggtcgaaatctcggcatgccgccatggaccgggcattccagcggcttccatttgctgaatatagtgaaataagtcagtggcatgtgttgctggctgagcgaaggcatgccctgtcaccccacagggacgagggctaccaagggcctcgttctctgtctgtgaacgactccccattccagtttaagttcctgctccccgacgccgtgacgggggctgctgttgggaggaacgggtccacagtgaacgccataaagcagcagacgggcaccttcatgcaggtgtgtgggagtcgggtgtgttagggggggggggggggggggggg

SEQ ID NO: 40194 - DNA, 405 bp, Chlorella protothecoides
agcagcagcagctggcggcggcggcgcaccagcaccagcagctgcagctgatggcggcggcgcagggcggcggcgcactgcccttccccgcgccgggcagcgccaacgccatggtcgccgcggcggtggcggaggtggcggtggccgcgcagcaccagcagtttgccacagaccagctgcacgccgcggcggcggtgcagcacgcgcaggcgcaccagtaccaggccgcgcaggcggcggcggtggcgcagcaccagcacgctgcggcgcagcaccagttcgcgcaggcgcaggcgcagtacgcggcggcggcggtgcagcagcagcagcacgccgcctacgccgcacaggccgcgcactccttctcggccgcgccgggggccggcgggaacgggggcggcaacg

SEQ ID NO: 40195 - DNA, 61 bp, Chlorella protothecoides
gaaaaagatcagggcttcctgtggaccccaacccccgccactgctctcctctcacctgtga

SEQ ID NO: 40196 - DNA, 106 bp, Chlorella protothecoides
gtggctctgtgtggctgcccctcggcagtcctttccggccaatatggaggaaacccctccttgacgacagagtctggcagtgcaaaaccccggcacccttgcagat

SEQ ID NO: 40197 - DNA, 66 bp, Chlorella protothecoides
cccagcgcccctccccctcccctgtatgcatcccctccgcacacccatgtgactccttccctctcc

SEQ ID NO: 40198 - DNA, 14139 bp, Chlorella protothecoides
  modified_base (3016)..(3025): a, c, t, g, unknown or other
  modified_base (3940)..(3949): a, c, t, g, unknown or other
  modified_base (4419)..(4428): a, c, t, g, unknown or other
  modified_base (5120)..(5129): a, c, t, g, unknown or other
  modified_base (6490)..(6499): a, c, t, g, unknown or other
  modified_base (6988)..(6997): a, c, t, g, unknown or other
  modified_base (7974)..(7983): a, c, t, g, unknown or other
  modified_base (8785)..(8794): a, c, t, g, unknown or other
  modified_base (9443)..(9452): a, c, t, g, unknown or other
  modified_base (10116)..(10125): a, c, t, g, unknown or other
  modified_base (13219)..(13283): a, c, t, g, unknown or other
cgctgggcgccgccccggcagcgccggttcagccgccgcacgtccaggcgcagcaagcaggctcggcgctggggtcacagccggcgcaggcacaggcgacggcggccccgccacagatgcccgctgcgtctcgggccggcccgccagggtccactgcgggtgcgcccgcggagccggggcccagcgcgggaaccccagcggcgcagccggcggcaggcccggcctcccaagcgccctccaacccggcgctggaaaagcagcgggcgctggcggccttggcggcgcgcatcaagcagtcggcgaggcggtgacagcgggcggcagaccgacgcgccgtgcatgaagcgcgtggggttagcccatgatgcctgcaccgctgtgccaacccatgtgcaacgtgccgttgaatgcggtgacagatctgaagtcagcagacctacatttacaggttggctccattggacagagcaggatatcattctagccaaagcgaagagatggagcagcggtgacagtcgagcaagtgaagtttggaaggggtatgtgagggtacatgtcaatgtcaagtcgatgcggttcaccccaatggggcggtctctgatcgctatgcaatcctgatcccacgcggctcaggcacgggccagtgtctgggctgtgaggcctcctgccggcctgccctcttgagccggccagagcgcgagaggggagaacgatgagccacgtgccgcgtcactcgatctcctcaatgtgggcaaggcggtgggggttggaaggcaggctggtctccccggagctgtgccgccgggcggaaggggacagcccctgcgccacgccggggggcaggaaccccggctccggcatgacaaagccggcagggccgtcctcgacggggccctccttgcccccctcctctccgaacccgtcctccaggaagaactcagcaatggcctccatggccgcgcagactccgcggtgttcttccagttcgtagcccttgccgatgagcttgggcgcgtccagccgccagagcaccttgcgcgcggtcggaacgcgcaccaggcagagcagggcctcgctcagcgcctcgcgcgcctcgccgtccgcctcgccctccgcttcgccgcccgagatcacgtccagcatggtggtgagggcctgcgtggtaaagggggatgccatgatgacatcgtgggtgtttgctgcagtacggtctggcatggcacaacatgtggaggccaaaaccaatgatgctcgagtgatgccacagtcaaaccccccacacaactcaccgcctcctctgccaggatgtcctcgagcgtgccgtcctcctcggccgcgaagaagcagttcttgatggcgcgcgcggaaccgcggcgccgcagttcgctcttggaccgcagctggctgctgagggcggtgagcaggccccgccccggctgcagcagcagctgtcgcccggctgccaggcgagtgacgttgggcaggatggttgccacgtgctcgtaggtgtcctcagagccgaccacctgcgcgagcatcaatgttggcccggtccattaggggcaaatgcgctggcagccacaccacacaagatcatcgcacaataacgtcattcccgcttccctctccacaaccccatctccataacaaccactcacaggctgcaggaacagcttgaggagcgtggcggtgtgcaggccctccacgctgctctggccgagctggagcagggcctcgctcccatcctcgctggcagtcaggttggccagcagggagatgagcaggcccgggtgggcgcacgcgttctcacggaggtagtccatggcccgagccggggcgtggagcgccagcagcgccgactgcacgccgggctcctgggccaggttcacgagggccgtcagggcgggccgggaggcttccgtggtgtcggcgatgaggcgcaaaaggggtggcagtagggtgtccgcacgattggaaagcgtggacatgccttccggggagcccgtcaggccctccaccagctccgcggcatgcgtccgaacctgggagaggccagtgagggacttggtgcaggccgggggcaggacaggaatcctcgagtcgacctacgcgccgaagcggatcgcgatgggggcatcagatattcagattgataagccgatcaacccaccggtgcgcgcttgtcgctgaggaactctatgagctcctggagctcgtcggcatgctggccggcctgtaccatcgcaaggggtcgagcacaacccagtcctggtacacaagacggtatggtagcattcctaccgatcgaagcttgttgacgcgtctttgcagcagtccgagacccgcccagggttgctctcgcccatgtgccagcctggatcgaggtggccctcgcgcagaaccacatcgcgccctgacattcttacggataacacaccaccccgcttttgtggtgtcgtcgctgcatcgcgccagaaccgccaccctctcagcatggaaaggatgctggcatcgacctctactagcaggggggggaccatgcggtccttccagcccttcgtggcgtccagcccagccgtgcctcgccctcgggcgttcggccactgcctcccccaaccgcggccccgcagtctggtgtccagggccctggacttcgagcagctcaccctggaggatctgactcaggaggatcccccactcgcgcccccgcccccgccagccccccgttcggggcggaagatgtcccgtcgattcgctgctgagacggccaaggtcccgggcaagcacgtggccctcaaacccagcgaggccctggagctggtgaaggccaccgcctccaccaagttcagggagacggtggagctgcacgcgcggctgaacatcgaccccaagtacaccaaccagcagctgcgtgccacggtctccctccccaagggcacaggtgaggggctgggagccttttggggggggtgaggtgggggggcaaaagggagagggcacactcgaaggggagggnnnnnnnnnnacctttttgggggggtggggtgggggggcgaaagggagagggcacactcgaaggggagggggaggggtgaaagggcatgctgccgcatggagtccaaggaagagcggctgacctcgcagtgctgggtgcatgggcggacagcgcctggctgcttcagccggcttccagtatagggtctcaatgcggttgcagccctcgcacctccgctactagccacgcagccacgaccccaacacatccctccccccatcgactcccgccccctctgccccgccgcccaggcaaggagctgcgggtggccgtcatctgccagggcgacaacgagaaggtggcccgggaggcgggggccgaccacgtcggctccgccgacctgatcgccgagatcgcggggggcatgatggactttgacaagctggtggccacccccgacatgatgccgcgcctggccaagctggggcgccagctgggcccgcggggcctcatgcccaatcccaaggcgggcacggtggtcaccgacgtggcgacggcggtccgcgagttcaagggcggcaaggtggagtaccgcgcggacaaggccggcaacgtgcacgtcggcatcggcaaggccgacttcgacccggcggcgctgctggagaacctcaaggcggtgcaggagtccatcgacgccaaccgcccgccaggggccaagggcatctactggaagacgctcactctctgctccagcatggggcccgccgtgcgcgtcaaccacgccgcgctgcgggagatcaagctgcagtgagggggagggcggggttcacgccccgctcaagtctgccctcctttccacacacccttgcttcccacgtggccccctgagggcagcagtctttgtttaaaaagggggggcggcgcacgcagcgtctcggggcaagnnnnnnnnnnaggggggcggggttcgcgcctcgctcgagtctgccctccttcccgcacacccttgcttcccacgtgcccccttgagggcagcagtctttgttgaaaaaggcggggcggcgcacgcagcgtctcggggcaagggaggcgaaaaaaggaaagggaaggggggtgggcagtgcagggtgggtgggctacctgcaacgggcgtcagggtcgggtgggggggatcggcagcaaggggccgcacgcttgctcgcatggtgctgggcgagagcgtgtccaaggagatgtaggggcatgggcggaggtgggcgggcagtgaggggactgtgtgtcgcctctggcgctgtgcctcctggcccaggcgcgtctgggcgcatttttgagctcagcatggtgttgaagggggtgcggccgctcctggatccctggtctcccccggtgccacgtcggggagcttgctgccgaggatgacacannnnnnnnnnaggcgcatctgggcgcacttttgagctctgcatggtgttggaggggaggtggccgctcctggatccctggtctcccccccgtgccatgtcggggagcttgctgccgaggatgacacagggtcggcctcggccgcagctgggggccacgcgccgggcgagcgcgccgcactcagcctccacgcccacagctgctgcgcgtcacttgcgccgccttggcgactccagccggatggtgtcccaggcgggggcggcggcgggctcggccccgccctcctcgtcgctgtccagcgcaaaggggttctccttctcctgcgacaggaacttgctcttgcccaggcggggcggggagtcgaagtcgtggctgtcgcccgaggggtccggccccagcgcgcccgaggcgccgggcgccgcgccgtccagcgccgcggcctcccccatggatgcagtggcgcgccccggggccgcggcggcgcccgccgcggcggccacggggtcgacccaggtgtccgaccgccccatctccacgtccgggagcagactggggtccttgactgcgctgctctcgtgacccacagcgacaaaggtgcgcgcgcgcacggtcttggccttgaccccgggggccgcactgccatcagagtagagcacgtagttgtggtaggcgggcgcgaactggtgcaccgtgtccgtcaccnnnnnnnnnngccccgggggccgaactgccgtcagagtagagcacgtagttgtggtaggcaggcgcgaactggtgcaccgtgtccgtcaccatgtccctggagggaggggtggggtggggtggggggggtgttggaggaggagctggcacatgcacggcatcccaggccggatggagcgaaccgaggctggaggggcaaggagggctgcggctgcagcatgggttgcagtcacatctcaaatccggtgcaggcagccaatgcgctcgtctgcacacccgcagcgatgatcgtcaaaggcatgtccccagagagtaatatctctggaacatgccgaggatatgcggtgctggcgccgcagctccccttttccccgtcctctcccaaaccttcaaagcacacattccaacaaccccacctgatgctgatggcgtgcgtcacattgccccctgacagtccgccccccgccacgacgtagggggcgtaggggaaggcgaagagcatgcagatggccgcgggcagcatctccatgcacagcaggaagttctggatgttcacgccctcctccgcgctcttcaccagccccgccgcactgcagatggcgatgaagaagccctgcaagatagcgtgggatgaaggggcagcgtgcgcacagtgggtctggtggatggatgaaggaccaggtcccacgtgtgctggagggaagtgtgtatttgtgggttgatcctcagggtaggagcatcgacctgccccctcatgcttgcagcactagttcagcccaccgcttcttccccccttcccccccaaccacccggcagccgcagcgtaacccgcctgccagaaggagaggaagatgaccgacttgatgaggatgaacttgaggaggggcctgaagggcaccagcagctcgtgcgtgcccaggtagaagaggaggagggcgtagagcgcgatggagtaggtcaggttgtagatcaccgtgatgtagatgtagccctggtccgccgcccagctcccctccttgtaatttcccgtggcgtacaggaccaccaccagcaccgccaggatgggcttgattatgacgaattggagcgcaccctgcttggtccagcgcacgaagcgcccgttcaccggcagcggcggcaggcagcaggtccaggtccaccagctggggcgcagcatgtagcccgccatcttggtctccaccgcgccgggaccaccgacgtaggccaggcacagcgacataaagttgtagatcaccagagcctcgtagctgttgttgtttggggagggggaggggggaagtgcttggtgggcgacgcagggaggtatgacgggactaagggaaggggatccagtcacggaaagaagggagnnnnnnnnnngaaattgtagatcaccagagcctcgtagctgttattgtttggggaggggtaggggggaagtgcttggtgggcgacgcagtgagtaatgacgggactaagagaaggggatccagtcacggaaagaagggaggggtgggagaatatgggatcctctcaccaggaacaactttcccacgagcaccatacactccctgtacatgctgcaggtggggtaggagggtcccaccctggcacccttctgcgcaccagtcacgagcggctgccaggtaaacggcgctgccaggggctattagggaaggccaggaggccatggcgtagacagggaccaggaagatgatgcgcacgatgtagcgctgaggaggtgggtagagtgatggagctcgtgagcggggccgggtgacacacacgcactgggattgatcaggggacgctcccacacttcccaggtgcccacctgaaagactggctccgagtaatgtcggaggtgtnnnnnnnnnnccttccccggtacccacctggaagactggctccgagtaatgtcggaggtgttgaattatctgcgagaatggtacaagggatggatccgtggctcaagacgctgccaccgacctcgatccgtggagcgacccggggctgacagcctagtccatacccactcgatctcacctggcccagagatatcaagatggctgagagggcgaagcatcctgccaggatgtgggcccactgagtgtcgagcagcatgcttggtggggtctgtcagccacctccaacccgcttggccggttcaaagaggtcagggtggcaacacacgcgacatgctcgatcccagcaggactctgattttcacagctagactcgggcgaccctgggatcccaccgctacggctgtggcccgtgacgtgatgcttgacaacagagacccacgcgccgaaactcggagcgcactttttctcatccggcgtgagccgaacgacccgctaacagatgagggcacctgatccaggtcttgctcccctcctgccagcgccagaatcccttacacaaaacataggatccctagactacattcaaagcacaccatgctttgtctacagcgtccccccttgcagtgtgccgctgctcggcacggtttcgcacccaccagggttcccggccttggacatcgaggctgccccgccctcccacacttgattgcaagcaaaccaaagccatgccacatccgtcctgtgctcggcgctgggccatgcgtgcgcatccaggcccaggcagcagcggccagccctgcgcctgccaagcccccgggtgcgcatcgatgtgggcgtggacaggcgctggcattgcattggacatgtaatcgagcgcgccttctgagagtatgatgcgccaagtgttgatcacacatggccatggtttggggacgtgatgcgagtttccagggaaccccaatggtgacccgctgaggagcatgcatnnnnnnnnnnccgagcgcgcttctgagagtatgatgcgccaagtggtgatcacacatggccatggttcggggacgtgatgcgagtttccagggaaacccaatggtgacccgctgaggagcatgcatcaccatccctgcttccccccctttcacagccaagaaggcgaagcaggcggacctgaagaagctggccatctgcgtcggcctgggcgccgccatctgggccatccccgcccccgccggcgtgggcttgccggcctggcgcctgctgggcatcttcctgggcaccattgccgggatcatcacgcagcccctccccctcggcgcggtggccatgatgggcctgggcgccgcccagctcacgggcatcctcaccttccaggccgccttcagcgcctttgccaacgagatcccctggctcatcgccatcgccttctggctgtcgggcggcttcatccgctccggcctgggcgcgcgcatcgcctactccatcgtgtcggtgttcggcaagaccacgctgggcctgacttactcactgaccctggccgaggccctgctggcgccggccatcccctccgtggcggctcgcgccgggggtctcttcctgcccctggccaaggcgctgtgcctggcatgcggtgcgtggcatggtggttttagtgagcgggagagcagggttgatgaagcgtgagagatctcacttggaccgtgagcttgattaacagtatggtccatcagcatgggatcccaaccatctcactccccactccccacccttttaccccaaacttacagggtctgaccccgccaannnnnnnnnnataccatctcactccccactccccacccacttgccccaaacttacagggtctgaccccgccaacggcaccgagggcaagatggggagctacctgatgatgacgtgcttcctttccaccaccatctccagcgccatgttcatcacggccatggcggccaaccctctcgccgtcaacctggcggcggagacgttgggatacaccatctcctggggtgagctggggagaagggctgcgttgtgctgggatggaaggaggagcagggcggcgggctctcgagaaccatcacatgtcctgccatgaagcgccggctctggacagttcccaaagccgcgccggccctgcgggccccgctggagctgcatgggagcactggtactccatgcaccttgaatctcacctcccccctcacccttgcccacccatgcacgtcctcgcaggaacctgggcgctatcggccctcgcccctggcctcgtgtgtctgctgctcacccccgccctcatgtacgttctgtaccctccccaggtcaaggacacgcctgacgcccccgccaaggtgtgcagggaaggctcatggggtggggggcacaccagactacggcttgattctcaaacgggtccctttgaatgagtttctgggaccctgtggcnnnnnnnnnncccaggtcaaggacacgcccgacgcccccgccaaggtgtgcagggcaggctcatggggtgggggccacaccagacaacggcttgattctcaaacaggttcctttgaatgagtttctgggaccctgtggcaggagcgctgaagttcgctcatgcttccagtctcctccagccacaagacttcttacgcaagccctggacctgccctggaacccagcacacacccttcacgtccccttctcaaccctccaacccccttttccacacacacacacacatgctcaggccaaggaggagctcaagcgcctgggcccaatgagccgcgacgagaagatcacggcctttgcgctgggcctgacggtgtgcctgtggattggcgggcagtccctggggatcaacgccgtggcggccgccctcgccggcctctccatcctgctcgtcaccagtgagtcttgttttgtgggaggggaaacagctgctggcagcgaggatgccgggatccactcttggtttccccatcacccatgcgcatgctggttatatcaacaaacgcaggcggggaggccgccccctgacactccgcacacctgcttgtactcaagagtgctcctcccatgcacccgcccatccccatccccctcaagatgtggtgacctgggagcagtgnnnnnnnnnngtatcaacaaacgcaggcggggaggccgccctctgacactccgcacacctgctcgtactcaagagtgcccctcccatgcaccacccatccccacctccctcaagatgtggtgacctgggagcagtgcctgtctgacaaccaggcctgggacacgctcacctggtttgcggcgctcatcgccatggctgcctacctcaacaagtacggcttcatctcctggttctccgacaaggtggggccggggatttctgggtgtgggcccagcgtactatgccgggcgcaggaggggttgagacccctcgcctgcgttgcctcaccatgttcccccctaccccccgtcttccggactaggtggtgggcatggtgggtggcctgggcctgagctggcaggccgcctttggcgtggtcaccgccctctacttctactcgcactacttcttcgccagcggcgccgcgcacatcggcgcgatgtacactgcctttgtctcggtgtccatcgcctgcgggacgcctgggatcgtggccgccctggccctgggtgagtgtggtcgacggctgggaatgggtgccaggagacgttgccccctgtgctggcaggcatcccatggttggaatgcgtctgaggcaggcatgtacatgcggaccagtatgcccgtcagtcgcacctttcccaccttcctcaccaacaccgccctttcttccccccctatcgtcgcatcgcaggccagctgtccaacgtgatgggctgcctgaccacgtacggcatcggctccgccccgccctattacggcacgggttatgtaccccaggccaagtggtaccagtttggcttcatattctccgtcatctaccttgtcgtctgggtcggcgtgggaagtgagtgctggggagggagggcacggtgtgaaagttggacgtggtactggaaagtgatgctgagacgggggaagtgcaagaaggtgtcccaggcacctctcacctgagccacactgcgcggtacagctacatccatcaatgccgccctcccctccgcaggcgcttggtggaaggtgctgggcctgtactgagccacgagctccagcttgtccgagtccagggccgctcgacccgccaccgagaagatcttgacgccgcgcggtctgcgttgcccgcgtgccctggctgttgcacgttgtgtaataacccttcacacccatcatgttgccaggaacagcagcatgggtcgcagggcagaggcggacagcaatctctcgttttctcatggcagccagtttgactacaatcccctcctccagatctcttctcaagaccagggactgttacacctaaagtagcagcagactacacagaaggggcacgccaccgcgtggcctgggccaggtttgggcaccgtgtcgttgccgagacccagccacgggtcgacgccgcggagggcatgcgccgctcacgcgcatcgcctgcgctcacgcctcctgcacgaacttcacgcccttgtcgatggaggcctggagctccggcaccagggacttcagccccgcgcgctcatagtcgttgagctcccccagaccataaacctcctccacgccggcgcggcccaggcggaccttggacgcaaagaagggcaggtcggtgacagtggactccacatacgcacactccacgacatcggagtcgccgttaaggccgcgcaggcatgcatcggccatgagcgcgccagcgtaagccatggacagcgtcgcggagcccttccccgccttggcctggaccacctcggtgccgccctcctgcgtgcgcttggtcagcgcgtcgatgtcggcgggggacagatccacgttgggcgtgggcacagtctgggagaagagggggaggatggtgatgcccgcgtgcccgcccaccacgggcacgtccaccttgcccacgtcgacgcccgccttctcggcgtagaaggtcttggcgcggaccacgtccagcgtggtcacgcccagcaccttgcgcttgtcgtacacgcccgcggccttcagcacctccgcagcgatggggacggtggagttgacggggttggagatgatgttcaggatggcgccgggggcgtggcgcgccgccgcctccaccagggcgcggacgatgccggcgttgatcttgaacaggtcgtcgcgggtcatgccgggcttgcgcggcacgccggcggggatgacgatcacgtccgcgcccttcagcgcctcgcccagctggtcctcgcctgcgtaccccttcacgcgacccttggagttgatgtgcgagatgtcggccgccacgccgggcgtgcccgcaatatcgtacagcgccagctccgtcacgtaggggttcagctgtttggagggaagaaggggcggcatgggtcaagcacggcagggagggctggctgcaccagggtcggtgtcaacaggccacagcacatggtggcagctaagacacccaccacacagcaacacaaagggaatacattgaaccaggacggttgcaaccccagaccacacattcagccagtcactcccagattattccagcgcacaatccatgctcgagccccaccttgaggaggagggacagaggctgcccgatgccacctgcggattacgtgaggggtgcgtgcggggtgagggccggccgtggtcggggatctggggtgtggagcatcgcacatgcatccaatggtctaagaagcgagaagagatcaaccctagcagggcaggagcaaggagcacgtggagtgcgtggggcatctccgcaatcacatagggagtgggagcacggggacgtaccagcggcgccgagcacggcgaccttgcgatcgggaaaggaggcagaggcatagccacgggtggccgatgcccgcaggagatccctgcttgcgcggaacaggctgttcatgctgcaagtcaatacagaccctgctgttgaagcgcgcccggcgaggaccgtaagtgccctctcaaaatatcccgcaaaatcgaattggaatgagcagagggtgaatacatggcccacggcagggcttgtagtcgcgccaacccgtgctcgtcgggggagggagcgtggtcggtgctcccacccnnnnnnnnnnnnnnnnnnnnnnnnnnnnnnnnnnnnnnnnnnnnnnnnnnnnnnnnnnnnnnnnnatgcggctcacgtggctccagctcagggtgcgcgcaatgctgggactcgtttgccctcccctctgcgtcgtttcgaatcgtggaacgaatgcgtttacataatttggattagctgtatccacagtacagtgcaggaagcagtacttctgcgcgactttgacccccttgcacgctgtaagggatgcaggcgcgccaatagcctttcccacccggcgctcgcctcgcacctcccggcatggcgccccccaccacaccccgggagaggaggaaacgaaagtccaatgcctccgagtccagtgctgccgtcacgccccatgcatacgtttccctgcacaagtcccgactggcggactggcgccccagccccatctctcacctggcagccagccgggacggcagcctgggcgtggccgtgcgggaggacggggacgtggagttctatgacctcaacggcccccacctcattcacgtaggcgtacacttttgggggtttcccatgcatccaaaacagcggtgccgctggtgccccaccccgtctcgagccgtgtgcctgcctcagccatcgcgcctcccaccttcctcccacctcccctccctcacgtcctgcacagtgcatccccggcgaggcggcctcggccctgacctgctcggccatagtggagaccggcgaggctcgccaggacccccgcgtcttcgtctccggcttctccggcatgatctccgaagtagacggcgcctccgccctcccgctggccaccgacgactcctacggcggcgcggtctgggcgctggcccccgccccgccccgccccgccgccgagggcctcgcgcgcctggcggccgcctgcgaggacgg

SEQ ID NO: 40199 - DNA, 77 bp, Chlorella protothecoides
tggaggtgggcaggagtcgcggtgtgtgtgggggggggagatgatgcaaggtgggctgcggcatggctggcgttggc

SEQ ID NO: 40200 - DNA, 61 bp, Chlorella protothecoides
gtccgaggcgggccagggattccagagcgggtggatgtgcctggcatgagcagggcggcac

SEQ ID NO: 40201 - DNA, 75 bp, Chlorella protothecoides
cgtgtcgtctctctcctgaagtatcgtctcttcggattaaagttttacaaatccacttgcggcttttgtatttgt

SEQ ID NO: 40202 - DNA, 2322 bp, Chlorella protothecoides
  modified_base (98)..(107): a, c, t, g, unknown or other
  modified_base (1178)..(1187): a, c, t, g, unknown or other
  modified_base (2225)..(2234): a, c, t, g, unknown or other
gtaggagttcacgcggttgtactgtggacgtgggggtgggtcagggtttgcgcggatctgtggcataaagttgcctgaaggtacttgcgatccctctnnnnnnnnnngcactggtccacgacgagagcagtgacagctggcaagcccgaacagctgtcgtctgtgcacttcacggagacgcagcgtccgcaggatgcgctgccatcaaaggtggcggccggcagggaggcatagttttgtgcaaagtaggagttcacgcggttgtactgtggacgcgggggtgggtcagggtttgcgtggatctgtggcatgaagttgcctgaaggtacttgcgatccctctcgagacaggcctttcgaattcgaacgcagcaagcagcttgcacccttcctgcggcacaatgcacatctccgagggtcctacctggcagttgaacccacggagcggttggccagactgggcaatggcccctgagccggactcgaccttgccgttgaatgcaaatgctgtcgcagcgaggagcagcaacgctatgaaaagccgcattgtgcttgtctgtctgcagaggggggaaatggtcgtcatgggatccggtcgcggctggccccctcgatgtaatgaccgggcctcggcgtcgagctacattccgatcgcagcgcgtgcgaccccctcctgcctgcctcgatacccccgcaagtaccggatgcgatgttcagagaggtgtctgtggtctggtcgccctgatcgggtggacgtgcctgttgccgggattgtttgctcccgtcgccgacttggttggtatggttcgtcaatgagtctgtgagaatcgcatggggcggtggagtgctcgtcgtgtgagatttgcgatgcggacgctgcttaatggaccagctgctggtccaaaattttgtacatgcgcgatcgcagtcccaaacccgtgggttcggcccaggccgggacagctgttccagcgcccgactcgcgcgacccggacatggacgctcgacggcccccggggagtgatcgcaccgcccatgagcttgcgcgccctgaaatcaggcttcattacatgtctttcgaccgcgtgaccagccgcccgtctcgcgtgccatgcaatgaacccctgcgcctctcccgggacccaggcactcctgcccggcggctgcctggacccctgnnnnnnnnnnggaccgcgtgaccagccgccggtctcgcgtgccactgaatgaacccctgcgcctctcccgggacctaggtactcctgcccggcggctgcctggacccctggctcggatgcacggccccggctctcctttacacaaagatggggacgggagggcgtaatgcacatggagagacactagaaaaacacggtgtatgggggtcggatctcggcggggctcacgtttgagcacgccgttgttacccctccattttgtttgggcttggttttgggtcggggggcaccgagcgggcgccccgacgcagagccggcgcggcgcgccccacgtcagggtccagggttatgctccgcacgcaggggaggggtgtgctacggggacccactccccacggtccccctccccacacacgacgctccgggcctcatgcccccgcctcggcggcgcccgcgctggccgccgcggcgtcggcgttgcgggcgatgtgctccgccagcgcggcgtgcaggcgcggggccatgcgctgcatggccaccgcatacccggcgcgcgacccgccgggcgcggccaccagcgcggcgtggtgtgcgaggcagaacaggacgcagcgcttggccaggtcgggcgcgttgaagccctcggccagctcgaaggcggccgacacgttgtccggggtcaggccctccgcgatggcggcctcgcacaagcgcttcagcgtgtccaacatgtactggtcggacacggccagcagctcctgcgcggcctccggcggcaccgccaccgagccgcagtagatgcagcgcatggtggcctcccacacctcccaccggatgttggggatggggatgaccgaggcgtcggtctcgcggtagtgcccgtcgaacatggagcggaagatgtcggagcaggcctgcagcgcgatgcggtgcgcgtagaagggccggccctccacctggaaggtcacgtccgactccacgtggctgttcacgtactgggggcccaggtaaacgcgctgtagggggtgggttgttgcggggggtgggnnnnnnnnnncggctgttcacgtactgggggcccaggtacacgcgctgtagggggtgggttgttgcgagggggtgggagggatgtgggggggtgtggg

SEQ ID NO: 40203 - DNA, 79 bp, Chlorella protothecoides
cctgggcgagggtccagggccggaggaggatggttcggaggcggagcacgaggcggaggacgaatcgggggcggacgac

SEQ ID NO: 40204 - DNA, 63 bp, Chlorella protothecoides
tgagggtccgtggcgtcgtctccaggccttccacgggcccacgcacgagcggcgcgtgcagcg

SEQ ID NO: 40205 - DNA, 8245 bp, Chlorella protothecoides
  modified_base (103)..(112): a, c, t, g, unknown or other
  modified_base (2105)..(2114): a, c, t, g, unknown or other
  modified_base (2687)..(2696): a, c, t, g, unknown or other
  modified_base (5784)..(5852): a, c, t, g, unknown or other
  modified_base (6762)..(6771): a, c, t, g, unknown or other
  modified_base (7503)..(7512): a, c, t, g, unknown or other
gctggacgacgacgaccgcttcaaggcctgtccggcgctggagctgacggggaacaacggcacgcacttccacctgaccggcgtgcgcgacctggcggcgccnnnnnnnnnncccggggctggagctgacggggaacaacggcacgcgcttccgcctgaccggcgtgcgcgacctggcggcgcccgccgcccgcgtggcgtgtgactcagcgctgctgccgcccgacggcctgggcgaggccgtggatggaggtatggcggtgcagcccctcaccccggcccagctgtccaaccaggccgccctctactcccgccgctccatcgccaggtgggctagaggttggggggagggtgtgcgacggagagtttctcggtggcctgctgttgtgtcgggtatggagccctgttgccacggacatctgtttccggaggcatggcgctcaaagtacatcccatcgtgaaggcccatacgccccccccctcccctgttctccgccccttaaatccacaggtactacgagggctgggcggcgagcgacgatgcgctcttgccctgcaggacccggaacgtgtgcctgcgcctgggcgcggaggggggcaccccggggtcgctacccccggaccccaagtgctcggggacgatgcggcgcgagatggacgaggccgacctgtacaccgaggtgcgtgtctgcggtcaatggggctggaggagggaggagggagggtgttgaccctgttctgcagctgcagggtggtgagcagtccagtcaacccagcccgccaacaccacctcctcacctactccacagctgtgctatgcccaccgaatggtggacgtggagggcgcgctgggcttgctgagcaggaaggatgccgcagcagccgcgcagaagctggtgcccctgcgccccgccctggacgcggccgccaaggtcacagcgggcattcgagacggctgcgcgttccggtgggtttccctgctggacctgtttggacagggccccgttgcgtgagggaatgctgcgccgttgctggatgaagtttgtgtccctggttgctgctgcaacgtgtcgtaacagagacatgtggtctagggaatcagcggtaggctggcttgttcgaaacagttgccgggatcccccaggatcggtctcggcacagcatgcagggcagcacatgttttgtcaaacggtattgctgaaaatacatgcattaccagtacccacactgtgaacgcattccctgacaaagtcgagcgtctctgaatcgggattaaatatcgcccttgggtcgtttcaggcgacattccccaaagtgagctacaggttgtcgacctccccgggtggacccggggtcccgcgcgaccagccatggctgtggtcctcggcatcgagggctcggccaacaagattggcgtgggcatcgtacgggaggatggcaccatcctgagcaacccgcgacacacgtgggtctggtgtggagggcaaggaaggtgtcggcagcagcttgcctgcgcaccatgaggaccagtacagcggctgtgcgttggcccgctccacacaatgtcagaatccatgatcaacccccctatgcctcccgcgccgcaggtacatctccccccccggccacggcttcctgccccgggaaacagccctgcaccaccaggagtgggccctgcccctggtccagcgcgccctcaaggaggcgggtgtcacgccccgcgacatcaccgccatcgccttcaccaagggccccggcatgggtggccccctggtgtcctgcgccgtggtcgcccgcatgctggcccagctctggcgggtcccactgctgcccgtcaaccactgcgtgggccacatcgaaatgggccgcctggtcacgggcgcccgcgaccccgtggtcctctacgtctccggggggaacacccaggtgggtgttcgggtgtctgcgggtaacctgtgagtgtgccctggtctgcatgcccgacacgcgcgctgcggcccccattccgcccgttgctatcctctgccgctcaggctcctcttccgtgagcccctgctgcctttccctatggcttttcatgaccacaccccaaaccctcccttccnnnnnnnnnncgccctggcctgcatgctcgacacgtgcgctgcggcccccattgcgaccgttgctatcctctgccgctcaggcccctcttctgtgagcccctgctgcctttccctatgactcttcatgaccacaccccaaaccctcccttccctcccctcaggtgatcgcgtatgcggaccagcggtaccgcatctttggcgagacggtggacatggcggtggggaactgcctggaccgcttcgcccgtgtgctgggcctgtccaacgaccccgcgcccgggtacaacatcgagcagctggccaagcagggccggcgcctggtggagctgccctacgtggtcaagggcatggacgtgtccttcagcggcatcctgtccttcgtggaaactgcggcgcgcacgctgctagacaaggtgtgggagggtgtgggagtggggcgggtggggactggggcgttgaatctgggggcagcaggggacggccaggcgatggcctgcttctgggggggtatcagcgggtcggaattccgccccgccgagcatgaagtgcactacccgcaccctgtgcttggcacctttgacnnnnnnnnnngacgctgctcgacaaggtggggcagggtgtgggggtgggacgggtggggactggggcgttgagtctgggggaagcaggggacagccaggcgatggcctgctcctggggggggtatcagcgggtccgaattccgccccgccgagcatgaagtgcattacccgcaccctgtgcttggcacctttgacttcccacgccttgaaagcgctctgcatgcctcccccgccccggaacctcatgtccgaccaccagacctgtcatcctcaagggcgctcccctatggtcccccactcagccccttccctcccaccgacacagggcgaggccacgcccgccgacctgtgcttctccctccaggaaaccatcttcgcgatgctggtggaaatcacggagcgggccatggcccactgcgccaccgccgacgcgctggtggtgggcggggtgggctgcaacctgcgcctgcaggccatgctggccaccatgtgcgaggagcggggcgggcggctgtatgccaccgacgaccgctactgcatcgacaacggggccatgatcgcgtggccaggcgtgctggcgctgcgcggcgggcagacttgcgccgtggcggagtcggcctgcacccagcgcttccgcaccgacgaggtgcacgtcgcgtggagggagtagggcaagagagggcctttgcgctgcttgggtgctctatgctcagctcagatcgtacatgtcgtgtatacattctttacatacatgcgccataccggacgcgggagagggagtacgtgtggggtgcagtgcgggacaaacaagcctagccgagggtttggagcgacaacggggagcgagcgggaatgaaggaaagagtagacgagtggcggctttcgagccgtgggggatcaaagctgagcagagaggtttgcagagcggcgagcgtctccacaccccaggtggaaaagcaggggaggacttggagcagccccagcgcgccccatgttcttcttaagggaggcccggcagcgaagtccgggtgccgcaaagcgtccaatccacctcccaacttctcctggtgggtcaacctcctgggtcaagcctccgtcactccttgccctccagcagcgcggcgagctgcgccgcctcggtggcgtccagggccttgcgcgggaacttgacgtcgtacttgagcaccaggctgccgcgcttgcccggctcccgcgccttgggcatgccctcgttggggatgaccttctgcgaccccggcagaaccacggtgtcgcggggccggacccgcagaacgcggttgtccagggtgggcacgtccaggctgtcggggtggagcgcctgcaccagcgacagcgtcacggggtagtgcagatcgtcgccgtggcggctgaaccgcgcatgtggcagctgcttgatgacgaacaccaggtcctggcgcggggcgccggggcgggagtcgcccttgccctcaaaggtgactttcgtcccctccttccacccgggcttcagcttgatctccagcgtctcctccaccttgctcgttttgcctgccgcgtcggtcacgttacgcgtgaccttgagcttcttggtggcgccgttgaacagctgcgggaggggtgggttgggaatgaatgttgtgtcgatccagtcgtgaggcggggcggtggtggtgaggtggacagaaaggacgcaggaggcaagggcagagggcagccacccagcaccggcgagtgcaatgtaaaggatgttgctcgacctgactgtcaaccaacccatacccagaccaaacaccacagccttcatcgtgcccacctcttccaaggtgcacgacagctgcacctcaatcttctgtggcctgggggcagggccctcgcccatgtcgtcacccatgccttggaacccgcggctgctcctcctaccaaagagctcagggcccagacggccgccctgcgagcctgcacggtgggagcgcaaatgaaaggaggagtgaaacgcatgcattatgtcagggcaacacatccaagccccgccgcatgctgctggcatccattcaaaaagtgcgtcacccctgccatacagcggtatacctcaaaatgcacttcgtggggacccaagaacgatccacacgccgccctcaccctctctttgagggcgcttccttgactctgcaaaaataccttggaaggagggtacgcggcgagctcctccgcccagtccacccccgccgaacatgccgcccaggtctccgcccatgaactcctcgaagatgcgtcgggccgtatcctcggagaacccggcgggggtagactggaatcgaacgcccatccctgggaagccgccagcagggacgccgccagggaagccgccgggcataccgcccggtcctgcggccccctccgtgccgggagggggcatgccctgcagtccctcctcgccatatgtgtcaaatatttgccgcttctgagggtcagacagcgtgtcgtacgcctcgctgacctccttgaacttctcggatgctgctgcctgatcaaatggggcgcagggcaggatccatgatcggagcgtgcgctgacatggcatgaacatccagagtcgcagcagtggccgggaagcagggaccctgctaggcaccggctgacattcccaagactcccacccacctgcttatctccagggttcttatccgggtgccatttcatggccagcttcctgcgtcatgttcgagaatagggtggagcggtggtgaggaccaggggcgtcaacaagagaggcactgctgtcccagcccggcactctcaacggtcccgtacctgtaagccttcttcaattcatcatccttggcgtccttgctgacgcccagaatcttataaaagtcacgccccatggcgtgcaatgctctctgccgcggaggttgggtctagtaccggaagcgagaaggaagcaccgttcacgattgcctgtttatgccaggtgacagatatactggaagacgttgcaatactttcatatcacataaaatggatgcctctgcagaggggcctggtcagtacttggcagatcgctcttttcctcgagaaccatcgcgaggttcatgtcnnnnnnnnnnnnnnnnnnnnnnnnnnnnnnnnnnnnnnnnnnnnnnnnnnnnnnnnnnnnnnnnnnnnnatgcaaagcgataaggccacggcattccgagtcgaggtcggagcttgcacaccaggcattgccccggtgatcgatgatctcccgtacctttggatgttgactggcagtccgtgctatggtttgtgattcttgactgtgcagaggaggtcgccctcttgtccgcgcccatgctggggggcgcagggtcgtcgacaccgtccggcatggtcgaggagccgtggaggtgggaggatgtactggcagggggggatgcacaatcaagagcgcatggcgagagattatcgtcacaccaggccccgctccctgtctcgcagtaaggaggaggacaagatttttgaggacgccctggcgcacgtctgggatcgggtcgatcgatgtgagcgctgcgccacccaactcgctcggcgggatgtgcagtctgtgaggcagcggctggagcagctggaggtgcgtggtgtttcctttgttggggttgagcgacgccgcccaggcgtgggaatattctgtcggtgatgggcccgccctgctttgtgcgggtgaggagcaggcaagacctgaccgcaacattgcatgccctcacaaattgcaatcgtgaacgcagctcaactttctttgttacacctcgctgtctgctccttcccaccgttcagagagatgtcatgagcgtcgaggaggggagggtcctgctccccaactatgctgtgcctggggagtccctctccgtggtgcgtctgctgttcttgtgtgcaatcaatgttccctgccgtggtgcctcgctttgtcggactccggaagcccttcagtggctctcaacactgcgactgcgcagcatgcaatccgttctcttgctgatccaatgtaaaggaacctgccccccccgccaatccaggcgcacctgcagaagaaggtnnnnnnnnnngtgcaatccgttctcttgctgatccaaggtcaaaaaacctgcccccccccttgccaatccaggcgcacctgcagaagaaggtcaagtcccaggagacggagcggcgtaagggcatcccctggacggaggaggagcaccgcctcttcctcatgggcctggccaagtacggcaagggcgactggcgcagcatctcccgcaactttgtcatcacgcgcacgcccacccaggtggccagccacgcgcaaaagtacttcatccggctcaacagccagtcgcgcaaggacaagcggcgcgccagcatccacgacatcacctcccccgcgccgccggagccgtccctgctggcctacggcatgggccaccacatggccgccccgggcatgggcatgatgcacgtgaccccggggggcgtggctgctggcgtccccgtcatgcacccaggggccctggctcaccaccgggccatgctccagcagcgcatggggtcgtgaggggtgggccccggcgccgtggggcgcacggatgtgtgatgcctggcgtggcctgctgacgctggtcctgggtgtccccccccgccaagactcaggcaggcaggcccatgcatggcggtgcaggaaaactccacccctggccctgagcatctccgtaacgacggccgtgagtttcctgccctgcaccctcccagccctcaatcccctttcccctcccttcaagcttcattctttgggcagnnnnnnnnnngcccccccgccaagactggggcaggcaggcccatgcatggcggtgcagcaaaactccactcctggccctgagcatctgcataacgacggccgtgaggttcctgccctgcaccctcccggccctcaatcccctttccctcccttcaagcttcattctttgggcagccagtgcttccccccgcgcccccacccccgagaagacttcatgtgcacaggggcgtggcggggtgggctgcccctccccactcgctgtgactctccacctgccctgacgtagacgccgagaagatgcatgttcatcgacttttaaaatccaagtttgaggagggggtgtaggacgcactacagagcgccctcgcagtgtcaaggagtggcaaagaccaaagggggttgggacgagcgggacggactgaatctgcagagcatacgagcaagggtgaggcagcgggacgggaggggatggtgtagcatctgacggggagggacctatcactggatcagacatgcactctcgcttcacccacaggagggggcctggcgccgggtcgctccctggccaaaagcctctctctactgccacgcggccgcttccgcactgccaccgagcggcgcaaggggttgatgaagggaaggactgggctcgtactccgcggcagtcgtgccgcgctgagaggcccttcccagggtcccgtgcaaggggtgcgggggggggaagggggattttttgggggggg

SEQ ID NO: 40206 - DNA, 125 bp, Chlorella protothecoides
agatacaattacactggctccatgcgctgacggggccggcagtccagcctcaaacaattccatccattggaacgtcaggcaggcgtcagatggcctcaaagaggccttggagaagctgctgaacg

SEQ ID NO: 40207 - DNA, 110 bp, Chlorella protothecoides
atggacctcgaaagatatggaagcagaggggaaatgaggagcccatcaggctgcaccaggccttgccagagacaccctttggcctgaaaggtacctttgctggcaggcag

SEQ ID NO: 40208 - DNA, 20880 bp, Chlorella protothecoides
  modified_base (1164)..(1173): a, c, t, g, unknown or other
  modified_base (1327)..(1501): a, c, t, g, unknown or other
  modified_base (1787)..(1796): a, c, t, g, unknown or other
  modified_base (2897)..(2937): a, c, t, g, unknown or other
  modified_base (3439)..(3448): a, c, t, g, unknown or other
  modified_base (3678)..(3885): a, c, t, g, unknown or other
  modified_base (3959)..(3968): a, c, t, g, unknown or other
  modified_base (4042)..(4051): a, c, t, g, unknown or other
  modified_base (4462)..(4471): a, c, t, g, unknown or other
  modified_base (6445)..(6454): a, c, t, g, unknown or other
  modified_base (6865)..(6874): a, c, t, g, unknown or other
  modified_base (6957)..(6966): a, c, t, g, unknown or other
  modified_base (8159)..(8168): a, c, t, g, unknown or other
  modified_base (8694)..(8703): a, c, t, g, unknown or other
  modified_base (9124)..(9133): a, c, t, g, unknown or other
  modified_base (9621)..(9630): a, c, t, g, unknown or other
  modified_base (9791)..(9876): a, c, t, g, unknown or other
  modified_base (9943)..(9952): a, c, t, g, unknown or other
  modified_base (10581)..(10590): a, c, t, g, unknown or other
  modified_base (11517)..(11526): a, c, t, g, unknown or other
  modified_base (11869)..(11878): a, c, t, g, unknown or other
  modified_base (12235)..(12244): a, c, t, g, unknown or other
  modified_base (13306)..(13315): a, c, t, g, unknown or other
  modified_base (14789)..(14798): a, c, t, g, unknown or other
  modified_base (15050)..(15097): a, c, t, g, unknown or other
  modified_base (17381)..(17390): a, c, t, g, unknown or other
  modified_base (18954)..(19125): a, c, t, g, unknown or other
  modified_base (19213)..(19222): a, c, t, g, unknown or other
  modified_base (19307)..(19316): a, c, t, g, unknown or other
  modified_base (19532)..(19541): a, c, t, g, unknown or other
  modified_base (19840)..(19849): a, c, t, g, unknown or other
ccgcccgccgacgccgccgcggcgcggaccacctccttgcgcagcacgccgaccacctcctccacgctgcgcggcgtgaccaggtccagtgccaggtccagggccttgcgccgcacgtccaggtcgggcgccgccagcgcgcgcagcacgcccatcagcgcctcgcgcatcacctccgggtgccgcgccgccagctcctccagccggtccagcacgatcaggcgcacgttgttgtccgactggctggccagcagcgaggtgaaggtggccgcagcgccgcgcaccgcggccggcgcggagctcaggcccaccagggtcaccgccgcctcgtacacaaccgccgtgctgcgcgcctggagcagggccaggaccaccttgaggaagcgggggcgctgggcggggtcgtcgccgcagacgcggcgcgtcaggtccagcgccgcgatctggagcacgtcgccccactccgccacgcggtccgcgttgctcagcaggtacgccacggcccggtcgcgcgcgtggttgaccaacaggtggaaggcgttgcgccgcgtggacaggtccgcctcgcccgccagcaggcgctccaccacctcgggcgcgtcgggggccagcagctcgccgcgcggcagcttccagatggcatccagggccagcaccgcgttcttgcgcacatacgagtgccggtgctccaggttggccagcactgcgattttggttttgacattagggaggcgcttggaaaggaagggggggggtgctgatgagggagggcggcactggaggggcggaataggggaggattgcacccgtctcatggaagacatgcagcatgcctgttggatcacaacaacaatacaccccatcctgtcccggagatcacctgagtgcaccaggggctccagcagctcctcctcgcggatgcgggtgagaaagcgcagcgtcaccccccgtatgaactcgttggggtgctgcaggctgttcctcaggttctggcagatcaggatcatttcgggcaggagcttgccgttggcgtccgtcttctcgatggtttcctggggggcggggggaatcgaggggtgccatggagttgagctctatgagttgtaccggaaggcccgtggcagcccgcctgcctggctgcccgcttccagtgctccagcaacnnnnnnnnnnttgctgatgagggagggcggcacaggaggggcggactgcggggggattgcaccctcctcccgggagacatgcagcatgactgttggattacaccaacaatacacaccatcctgtcccggcgagcacctgagtgcaccaggggctccagcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaggggaaacgaggggtgccatggagttgagctgtatgagtggtaccggaaggcccgtggcagcccgcctgtctggctgcccgcttccagtgctccagcaacaagctcagcaacaagctcagcaacatacaatcacgacagcacgagcacagcctccaaaccaatggctgcaaacacccataaagcccccaccccactcaccaggtagaggaggagcagcttctggacctggtggttctcggatggcagcacgtagcgcacgatggtgatgaacagggctggcnnnnnnnnnntcaatggctgcaaacacccataaagccccacccccactcacaaggtagaggaggaggagcttctggacttggtggttctcggatggcagcacatagcgcacgatggtgatgaacagggctggcagctgctcccccgccagcagggcggcgatggccttctccatggcctccaccttggcctcatcgttgctggactccagggcctctcgtatctcgttgccgctggcctgggccctgtcggaggacaccaggaaggtggacacccgctcgtgggcggcctcccgtgcagccatttcgagcaggctatgctagatgttcagacaggcgcggcgagcagggctggtacgccaggctcgggcgcgccagctggacacgctgccgtgcccaacttgatctgacctccggcccgaccactcggcgggaggagggatggctcggaggcaggcttgaaaggacaacagcaacgagatgatcggtgcgcatgcatcgagtgctggggccctcgggtgcgggacttggcccccgcacgggacaacaccccccgcaaacagttctatgccaggtggaaagagaggacaccctaccggattgcaccaggccggggtgaaacaccaccacccctgccatgcaccgcgtcgaaagcttcccagtcttgttgcccaggtaccatatattgaaccacgggagtgcagcgatgagcgcctccgtgctcgtcccccatggtcaggcccgggtgcctgtgggtgtcgggcactcccccgcccctcgatcccccttgctcctccagcgcgccagggccatgggcccatgcttcgtgccaaacgtcacccataaatccagctgctctcctcgcatgtcgagctgcatcatcacccgagctgtggctgaggagcaggaggtcgcctcggctgcccccaccccccccgcaccccagcagaaaatccggattaagctgaagtcatactgggtggacctgctgcaggtggccgtggatgccatcctggatgtcgccaagaccaccggcgccacggtgtctggtcctgtccccctgcccacaaggtgcgacctgctgggttggggggggggggggggggggggggnnnnnnnnnnnnnnnnnnnnnnnnnnnnnnnnnnnnnnnnncagcagcagcagcttgtactgggctcctgtacgcatggctgcggtaaagctagatgcgatccttcagcttccaccaccatccccatgttgctcttcatcgcttgacctcttatcacatcagttgatgcccctccttctcttcgtgcaggatacggaagtggaccgtgctcagctccccgcacgtgaacaaggatgcacgggagcagttcgagcagcgcacccactcccgcctcctcgacgtcaagaacctgtctgccgagactgtggacaagctcatgcagctggagatccccgcgggcgtgaacatcgacgtcaagctctgatgtgtgccgtgcaagggtaacagactccacagcggttgcctcaggcagtggtgacaaagatacaaggaggtacggggttgtgagcatgggctcgagtcaggggggggggtactgagaagcgctcattccgtcatcctagtgtacagttttgcggggggggggggggggggggggggggnnnnnnnnnntggttgcctcaggcagtggtgtcaaagatacaaggaagtaaggggttgtgagcatgggctccattcaggggaagggggactgaggagcgctcatcccgtcatcctagtgtacaattttgcgcgggggggtggggtgtgtgtgtgtgcaaggatgggatccgaaaggtgtgcctcaaagggtaccgagactcctcctctccctagccggctctccgcttgcgcttgtcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtatttagctgcagagtagatggcgcggcatggcagagtgcgagtcatgcactgcacaggcactccgaaannnnnnnnnntgctttttgggggcagggacggtgatcgttggctcctcctccagctcgtcctcatcctcggctgccccaggctnnnnnnnnnngcgtgcctatcgctgccttcctcttccggccccccgcatcagctccacccctccgcttcgccggcccagcggctccagccctccgcttttggggggcagggacggtgatcgtcggctcctcctcctgctcgtcctcatcctcggctgccccaggctcctgtgcggtgaccaggttggagtattttgttgcagagtagatggcgcagcatggcagagtacgagtcatgcactgcacaggcactccgaaacctcgcagggcggattccatggctggacggcgcaggcacaagcagccctctctgaagccaacagcatgtctaagcatgtctcgagtactgcatgcattccgcaccacccaacactgtgacgcaaaccaacatacctgtatgctctggaggacggcctcccagnnnnnnnnnntagcagccctctctgaagccaatagcatgtctaagcatgtctcgggtactgcatgcattccgcactacccaacacagtgacgcaaatcgacacacctgtatgctctggaggacggcctcccagctcagcccgccctcgccataccctgcctccgcgtcgtcgtcagacgccgcgggggcctcgccttcggcccccgcggccgcctcctccccattgtcctcctcttcctcctcgctgccgtcagaggcgtcgccctccgagtcatcgccgctcaggtcctggccgccctcccccgcgtcctcgggggagaagaaggcatggcgcacggggatggcccccgcccgttgcgcctggatctcctcggccgcggccgccgtcagcgcgcgcgccgcagccgctgccttgattgggtccccgtcggggacggcggcggcgtcctcctccgtcacaccgcccacgactagcgcgtcctcctcctcctcctcctcctccgccgccgccagcgccgcggcggcgtcgccctccaccccgtcccgctcgtccacgtggtctgggggcagggagaagaaggggatccgcccgcgctgccagtccaggagcaccatcttggccacagtgttcaggtcgggctcgccacccttgttcagcttccccgcggcgcgcgccagctgtgacaggaagtcctccgcgtcctcccaggcctccagcttgtaggcacggcgcagatactgcggcttcacccgcgccagcacctcgcccacgtggtcggcggcctcctccaggctctccacgcgcaccacgcccttgaggatggcatccgactcggtgtccgtggtgccgttgtacacgacgccggggcagtcgatgaggaagatcttcttggtcagcgtgatgtactgccagaccttggtctcgccggggacgggggccaccttgcacacctttttggagcgcagcgtgttgatcaccgaggacttgcccacgttggggtagcccaccaggcccaccgagatgtactgcttgtcgctgcgcaggcgggacagctggcgcagcaggcccagcaggctgcccttgccaaagggattggtcaccgaggcgtggaaggccagcgtggggaactccttggacagcgtgtgcagccagcgcttggtgacccaggcggggacctgtggggaggagagggggggaggggatgtcagtgggtccatggaatgggggttgccactgagacgcgaggattaggtgggtggcagactgcatacaccagactaaggtcatggtatgagagcagaacgtcacccgcaatgcagccgaggggggcgatgcggtggaagcggtgcactgctcaaattccccccctgccacaccctgatcgggcacacataaacttcaggcaccccggtaacaaggcctcaggactgtaaggatatgctttcatcgtcactgttcatcagatggtacggacaagcaagtgtgttcctcatcggccatgggagatacgtgagagagctgctttgccccacccatcccaacatccccaggccctccatccgctcgctcaccaggtcacacttgttgagcagcaggatcatgtgcttgtgccgcgcattcttcttcaggtgctgctccaggaagcggcagcgtgtgcccagtgggtcccgtgcatcgatcccctgccgcagtgttcgagcaagtatcgatcaggagggaggctcgcaggccagcatctcgcccatgggcgctcagacggcgcatgcgctcacagcatgcgccgcccccccagtgtgtgggcctcagacacgaaacaaatgccttcatcgtcactgaaaatcagatggtacggacaagcaagggtgatcatcgccggccacagcactgagaagggaggggggtgggatgcagctcgacgccaggggaaaccccagcacagccccacagcacagcccagacctggatgacgacgtctgaggagtnnnnnnnnnncagaagggaggggggagggatgcagctcgaagccaggggaaaccctggcacagccccacagcacgtcccagacctggatgacgacgtctgaggagtcgaggaccttgtacagctcgccccagatgcgcttggactggcccttgaagaagacggactcctgggctgcaggccggatgtcggcaaaggggtcagagggaccaacagcgtcggccttgctcgtgaaactgggcggagaaggttgggtatcgagtcaacgagtgggctggaaatgggtggagggtgctgcagccggggtggcgacccctgtcaccagtcagcgcaagggggcttggtggcgtatcggtgcttggcctgtccagcccgttcccaggaaacagaggccaaccgcccagccacaagtgtacactcacnnnnnnnnnntggccggatgtcggcaaaggggtcggagggacccacagcgtcggccttgcttgtgaaactgggcggagaaggttgggtatcgnnnnnnnnnncctccacagtctcggcgcggtccaacagaccctggtagctctctgccgagagctttggcttcttccgccgctgcttcttcccaaaggtgtcggcaaagggctgagtcgccaccagcccattacgggcagccctgcctgcggtgcgtacagaggtgtcatccttgcagtgtgtgctggttgttgagcagcggagtggattctcaggtgagtacccagatctgttggatgctggggttcattcacaaggcatccgtcaatcgtcaacccaactcccgaggaaagaaggcaagaggagcagccccagagtgtcgccccagggcacgctggtgtccacgaaaacacaacccaccggcaaaatttgtggaagggtcgctgaggagcgaaagtgggagcttcttctccttgacgaggacggtgaaggggtcggccaccttggccgccatttcctcacggaacacctcgagctgcttctggccaatgacacgcgtattgccaaaccagcggcggtctggctggatgcgggtgctgggcagctccttgctttgcagctcctgcatcgagcagccggcgagaggtggatggggtagggagcgagtggccaacgcacaccctcctcccatacacggtatgctgagagcttgcagctgtgtccacacatgcagtctcgtggcatctggcgcatccaacccccttcctcatgtgcaactcacgtgcgagatgatttttccatccttgttgcggttcggccgtgtcttgtacatggccagacggcgcacctgcgcgcaaggggcagcaaggcgccatgctcgagtctaagaagaccacaaaacaagcatgccacgagcactctccctggtgcatgcaggctcggcggaccccctcaccgtgctggcgctccgcatgccgtccttgctgacggagttggcgcggttcttgtcattggagtgtttggggttggacttgggggtccccgccttgttgcttcccttggccattgcgtgcgcaaaggcacgagggcctgctaaggactaggagcacgagtgaggggtggccctccccgaacgagagctatgagggacagagacgcggcatgcaatgcaggtacttgaatacctagctatgagtttgacgaggagagagttcagctgatgctgaacgtaaacattgtgtacgcatgcccaggcgcgcactcnnnnnnnnnnagtacttggataattagctatgagtttgacgagaagtgagttcagctgatgctgaacgtaatcattgtgtacgcatgcccaggcgcgcactccccagcgagccgcccgcgcgggtgtgaccgccggcggcaaacaaaaattcaggacggtagaatctcaggatccgttccaggacactgaccgacactatgcatctagcattcaatcaaagattcccatgcacatcctaagaaaagacaaaatgatcactcggcagtcgcctccactttcatgacagatgctcagatctgcttgttacaccgtctcttcctcctcctccatgcgaccccaccctccaaggccgctgcccccgctgcccagtacacgcaacttgcatgctgaccagagagcgctgcggttgccatggcgagggcctgcaggtggcccagcagcgctgtctgctgcagcggcagccggcccgccacacaggcacgcagtcccagcaacgccagcgccgctgagctggcgtccaggggcgtcgcggccnnnnnnnnnngcacaggctcgcagtcccagcaaggtcagcgctgctgagctggcgtccaggggcgtcgcggcccggttgccgcccaggccccagcccgccagctgcgccgcgggggccagcgccgaggccgccaggtgcgccaggcgctgcggctccgaggttccacatgccgcccagccgaggcccaggaccgggggcaggctgcggtggaccaggcagctgccagcgatgagggcccagaccaggggcggcgccgcggctggatggcgagcgggtcctggcgcccgtgcagcatcagcattctcgacctctccgccgcctcgtttggcctgaacgagtgccagccccatcgcctcgctcgctgccccaacaagcatgcccctgtgcttgcaagcctgtacgaggatgctggccatgccctgggcgaggnnnnnnnnnnatgccagccccatcgccttgctcgctgccccaacaaagatgcccctgtgcttgcaagcctgcacgaggatgctggccatgccctgggcgaggaaaagcagccccacagcctccaaccaggatccagactgggagctgattgccaggagcgctgccagggtcagagggtgagggcccatctccgtacccgcacccggcaccgtgcaggccatcagcagggcagggagggcagcagctcgggcatgcaggcgcgccgccagccacgccagcacgtcccactccagcctgggtgcgagggatcgtgggaatctcgagtcagaagcaggatgctctgccaagagatggtccacaatgcacttgctgtaccgcctccagcccctactcctgctccttgcatgcatgatgcgagtaccacaagcgcacccagcacgccctgcgcggtgtccgccacaccagcttcgcatgcgcggacctgagctccaaacggcnnnnnnnnnnactcggccaaaggatggtccacaatgcacttgctgtcacgcctccagccgctactcctgctccttgcatgcatgatgtgggtatcacaagcgcacccagcacgcccagcgcggtgtccgccacaccagcctcgcatgcgcggacctgagctccaaacggcnnnnnnnnnnnnnnnnnnnnnnnnnnnnnnnnnnnnnnnnnnnnnnnnnnnnnnnnnnnnnnnnnnnnnnnnnnnnnnnnnnnnnnaggccgccacaggcggcccgctcctctccctcctgcgtcccccatggggagtctccatccggcactnnnnnnnnnngggccgccgcaggcggcctgctcctctccctcctgagtcccccatggggagtctccatccggcacttgccttcccaggacccgccagggaagaatgcccgggccgaatgccgagggaaggcgggctaccaggccgtggctgggcatgacaagggcatgcatgaaagggtggccaggcggcagggccaaggtagaccctggacgcagcacgagctcgggcaggaccagtctgctcgcttcacaccccgcagccgccgccgagggagggcggaggcacagctggcaagccagctgccagggaacaaaggttgatctagaccggttgccgtgggcatggagcgttacctcttccccgctgttcacatcaaggctgaggaggtgcgtggcgtttgccagccagtccacgcccgccatgatctcttgccatggcctgatgatgggggcggcaggcatgcacaaaggtgagaacgagtgcgcgcatgagtactcaagagctgtgggatcgcaccagtatctgggtgtcaaggagcatcaattgacagagatcccttcctttttttcagaacaatgccctcctcccctacaatccatcaaagcccgtcgcctgctgacctggcgctgctccggtcnnnnnnnnnnggtcaaggagcatcaattgacagggatcccttcctttttctcagagcaatgccctcctcccctgctatccatcaaagcctgtcgcctgctgacctggcgctgctccggtctgtctggccccgccagggtggcagagggaaggctcccttctccaggtccacaggcctgccaccgaccgtgacggcccaggtcccctgcccgcccagcgccggcagcaggagcagatgccgcacgcgctgctgccctggagcgggccatgtcttcctgcttgatgccacatgcccggcagcctcccaggcccccgagggacgctgcctgcccaggtgtgtgcagtcatgcggcgccacggcctgctccgtcgcagcggtcagccccagaaaggtggccgtcatcgtgggcatgaggcgccgctggagcacagctcggacacacgctgagtcggcgcagtgcagggcgtcgacgatgccgccggccagccggcagaccagctggttgcaggaaaggatggactgcggtggcggggtggggctgggtctcaggctggctgctccaggctggcctgggtggttgtctggggtgaccagaccatgccatttgtgcagtgtcctcgagcggaaagttactggcgctgggacatgggcactgcaacctacagggcctcaggcacagcaaggcttccccccgtgcgctcagagacctcaaccccacgctcgcggaccttgtgactgccgccggtccagaccccgggcacgtcctgcatcagcacacgaggtgggcccgccccctgcgaccccggattcagccccagcgtatcggggatcagcccgtcgcccctcccaggcacgatgcccaggctcggcacgtggccgagccccaggccgccgccgcgcaggaggctccccgtccccggcgagggcaggagggccnnnnnnnnnnacccagcgtatcggggatgagcccgtcgcccttcccaggcacgacgcccaggctcggcacgtggccgagacccgggccgccgccgcgcaggagtctccccgtccccggcgagggcaggagggccgggaaggcgcgcgttcctgggtcggcgaggcggaggaaggccctgatgctgggtaggagggggtcctggtcggaggccatgcggctcagcagggcctgcgccgtcagcacgcccatgctataccccaccagcaccacgccgcccgaggggctggggttgcggggctggaggtactgcaggcagtcgtacaggtactgagactgtggcaccagcagcgannnnnnnnnntgttgtggggctggatgtactgcaggcagtcgtgcaggtactgagactgtggcaccagcagcgagtggtccagggccgaggcctctcggccaaagtcgggcgccagccaccgcacgggcagctccccgccgcccgcccgccagcgcttcactagctccctgccggtctgagaggccagggaccgcatctgctccggggtgcccaggtgcccatgcacgaagatcacggtgtggagtatgctgccattgtatcccaatcgggctgggaacaggcagggatggggaattcctggagagcttattccattagcataccaacagtgtttcagagagtgtgaggccatgagaaccccccgcnnnnnnnnnncctgggaacaggcagggatgaggaactcctggagagcttattccattagcaaatcaacagcgttttagagagggtgaggccatgagaaccccccgcacaccatcttctgggctcagaattaaacactcccccaccttgtgcctcctcagtggggttgtccacgtatctgatcaggcggtacccccgctgctggcccacattcgaaggaagcaaaatttcttcataggcctgccataggtacgttgtttcacatgccgatggggcgagcgcatccctcgcagtgtgcagggcgaagatggccagtatcgcccaccagcccacccaccaggcccgtcggagcccaaggcacgccctcgacatgactgagaccctagcattcgatacacgtcggagggttttgatctggggaaccaacatgctccagcatccctgtgtcggcaggggtgctcagatcacactgggcctggcacagcggggttccgtcattttcgaaaggtcgcgccctgggaggaaactgccgagccgcaggcgcataagcttccctgcttagctggaccccgcaacgtttcgaattcgttccaaacaccccgttgacccccaccgcaagggcatctgctcacaaacctacgccactcagcatcggttgggtctccctgccatgaccagccacggtccgggcacgctgccggagattcccagcaacagcgccgccctgggggaggaggacgagccccccactttctcccctcgctccctggcggtgcagcggggcatcctggccgaggccgtgggtgctctgggtagtcaagactttgcggcggcgctgagcgcccagggggacagcgtcagtgacgacagtgactgggaatatgagctggagaatttcgaccaggttcgtggtcctgggctcctcgcactaaacatagcgcatgcaggtgggagggtcgcacccagtgcatgcgcaccgcccccctgctgcctgcatgtggctcgccaccggactgcatgcccctggctggggtctggcaagcccagcctcagggcctcaccctgcgctccttnnnnnnnnnntctgggctcctcgtactaaacatagcgcatgcaggtgggagggttgcacccagtgcctgcgcaccgcccccctgctggctgtatgagactcgccatggggctgcatgcccagggctggggtctggcaaggccagcctcagggcctcaccctgcgctcctttcacctccgcagatcaacatcaagcacctgatcagggcggagctgaaggacacggtgcgcaagatgatcgcaaagcagaagagccccgcccggacgctgatgcgcgacaagctcatcttcgtggtctgcaccgtcgacctctacctctccgcatactggcttggatgctagtgagtgcctggggtctataggggtgttggacggtctcatgccctgtccatgccagtcgactgcattggggcaaggggttgatattgagattggctggggcacctggagcgggatttgttaccctaacccgatgcccaacccacctccacatcatgcagtccccagtccttctaccagctgtacactgtgaaggcagccgtcctcttctgcatacgctgggtggtgtaccgctataagcgctggcactacttcctctttgacctctgctatgcagcccaggtggtcctcctcatacagctctggctcttccccaccagcatcgcatggatcaaggtgagagcatggatggcagccagggccatgatggattggggatggagtgcggcttgtgggtaacagaggggctctcgtggcccgagcaccgcaggccccatggcagcccactcgattcgcacctggctgctgcgtatcccagtccctaagctccctcccgcaccctctcctcctggatccgacaggtcacgtttgcactaaatctggggcccctcgtgtggagcatcgtggccttccgcaacagtctggtgccacactccctcgacaagatgacgtcgcacttcctgtgagcattgccatctgagtttcctggtcgtgagactgagtgacccggggtagcttcgtggagttcctgtcctccctacccttggcagcaggagttggcgcttcagcagccccgttgattccttgcccacaccaccaagcgcaggcactggttcccggcctgcgtcagctatgcggcacgctggcaccccccctcccaggtggtggattacctggcctcttccgcggaggcccgcagggcctgggagtccaccagcctgcgtgagctattcttcctccccctggtcccctacctcatctgggcggtcctctactacctcaaggtgccttggagggtgtgagaggcaaccatgtactccagctgctgcggtggttgcctgggatgctgtctgaaggcacccctgatctcttgtgtactatcagggcaggaagcaggttttcaacctctcggtgggcaagtggcctcactgattcccatcccagcaccagcaaatgagtacgtccttccaccccgtcctcgcatcnnnnnnnnnntccatcccagcgtcagcaaacgagtacgtccttccaccccgtcctcgcatctccttggtgcaggtgtttgtcatcagctccagcaggatagagcagcggggctacgaaaccctgttcaagtgagggccgggatgttttgcacccgctgggatctcatggccgtcggtgcttgcagcggagcgggccggggcttcctccccacgatgcaggccaggctcctgggtcaaggggggagtcaccccgccatgcaannnnnnnnnnnnnnnnnnnnnnnnnnnnnnnnnnnnnnnnnnnnnnnngaatcccgcaatgcctcgcgcccgcaggtttgcgacctccaaccgccgcagcctttttggcgcggtggtgctgcgctttcctcacgcgctgcagcccgccgtgtacatggctatgcacgtgggcctctgcgccgcgaccctggtgctgacctccgtctggtggcggtaccagctggcctgcgaggccttcctggtgatccagttcaccgcctcggcctggagcggtgaggcccggggctgtctagaggggtcctgacgagctgtcgtgcgacactgtgccctgccgcttgactgggcaaggaaggtgctcgcatccccacccgcacactcccacccaacccaggagcgacgttctacttcgacgtgttctcgaggaagtacattgccgggctgggcgccagctcaaagggcagcgggggcgatctgaaaactggggcggcccggcagcacgacgcagacgggcacccggcgcaaccgccaatgtagcattgcccaggatgagtgaatggcaagggaaccttcccaaagcgtcctggcctcccctgtaccaacactggaagctctccacccggaactgcacctcctcgcacttttgttgctctctccaagcataaaccccttctgacacttgggaaatcgaatttggaaatggaagttgggagagtgccagtcagtcatgggggaggggccggcaaacctcatttcacatttgggcggacctagaccctggtactgagcaccacagcttcgaacaccgggataccgggcggagttaaaccctgctgcgccgggagaggatcttagaacgtgcccgacagctagtgaaacctgggtaacatagtgttgacgacaagttcccagaacgcggcccatcacggactcgaggagctgcgcacgcgagtacacctcggggtgttatggtgagccccggagcttgccttgctcacaacatgtatgggcatgcgtgaggccctctcatggcacgccctcgcctcgtgtgcagcccaaggacgcaaaggccgatatcctcacgaagggcaccaagatcaagcccaagaaggatcctcgcaccccgaagaagccgtctggcgcatgtgagcatggtattcaagactgtgtagctggcctcacagatccaggcctctcttccccatcgcgtacgagaagcaccgcaaatcccggcaacgcagacatacactactgcaaggacaagcgtgagctcctcaaacaggagcaccccagcctcagcctgggagatatgggaagggagatggggaagcggtggcaagaggagaccatggaggtcaagaaggtcggtgtgcgtcgtgctttccgccatgggtgggggattgagtttgcttctcagggacgattgtcagtgttgggctggagaggaaagctcccgattaaggtaacgcacgctgcatgcaccaaaagtgattgtgggctgtacaatgacgcccatggcttgcacatgacgcaattccttggagccatgtctgaacaaatcacagcctctctaagcacatgcactccttggctgcagccctactttgacatggcggcgcgagacaaggcgaggtatgaacgggagctggcggcttacaaccagtctctcagcacatagagcaccgctgttgctcctttcacgggtgctcccgccacagaaaacactcgctccacggtccttcagctgaacttgtattccagatccacgtgtttgcactcaaagcacaggtattgatgctctggcctggtataatggactcacccagcagccgctcccctcccatgatcctccttcccaacgtgagcccaggttgttgcaccagaaatgtacaagctgagatgacaagcaggcaggcctctttggggagggcaaggatccttggctcatcgcagctctactttcagctggttctcaatgtcgctgcggttgaggaagagggatttcccttctgagtatcctctatcgtgtgccacaaagctcaggcgttcagcaccacgatcttcaacagccctcgaccgactcccaaacactcatcctcctcaccggcggacggtccactggagctcattgatctcctcatccgtgaggctgcgctgcatggagcggtatgcaatgcggtagcagtggctcgtcttgccctggggtgtcaggaggtcgagggaatggggtttgtggatgtccatgctcaaggcgtcactgcagcccagtcgcgtctcgcagcgcccgcccaggagtggattgatacctcaagcgaccacgcgtggctggcatgcnnnnnnnnnngtgtcaggaggtcgagggaatggggtgtgtggatgtccatgctcaaatcgccaccgcagcccagtcgggtctcgcagtacccatccacgagtggattgacacctcaagcgaccacgcgtggctggcatgctcccagggacagctgtgctcctgaaacgcagcccccagcgaactcaaccacccaccgtctttgggtgtgtgaagctgtcgatgagcttcacctcctccacgaggtcccccgccacggcacgcaccacctcgcacaggttgttctcggtgaagctgtcgctcagccagaatgccacgtccttgaagcagggcgggtacttgctgtagggcttgaacctgggcgtgcggggcgcgagggagggggggggtgagggagagaggctgtccaggcgattcgtgcgcttgcctcgctgcaccacccactttgtcttcatgctgccggccttgaactgggacaggaagcgcgagtcctccgtccagaacagccggatgtctgggatgtcaaacaggaccatggccagacgctccagaccaaggctgcaaaggaaagcaggaagagctggctcggtactgtgggtggagcaggggtcccagcatgcctcgctgcttgggatgccgagcgtacccacaacagccgatgggggggccttctttgccaggccaagcagatgatgccctgtgggtcctgacactgcaaccccatgcaacaagttgccaccgcttcagcacagatgccgtcctgttcctcctgcactcccggaatgaccaaggcgctcacccgaatgcccaggccttgcggcctgcaaaacctccgtcatccacgatggactgctgggtgacgccgcaccccagcacctccagccactcccccttgaacagaatctccagctcgaaagagggctcggtgaaggggaagtaggcatccacccaccgcatctccacagaacctgcacaaacaaggggccggggggggatttgcagccaccggtgggcatgggggaatgtctcagagagcaggagccgtgactggcgtgcaggccttccagagttcaggactggtcaggcatgcctatcaggagggcctattgccctctgctctcaaccctcctccatgacaaacaatctgtcccacccttgctctcaccaaagaggtgctgggcaaggccctccagggtctgcttgagctgcgtctctgcatactgggtagggtccatggagccccagtcctctggacccagcactcgcagcccctccatctggtggaacaccgggtagtgcgtcgagtcgatgctgtctcgcctgcagcagtgcacgtgtgggggtgagtggcacggctgccacggaacgggacggggtgggagctccacctggtgtgagccctagatggccgaggattgacaagaccacgcttcacagcctacttgatcacgccaaatttgaatgccaggctgaggttttgcacccaggagccttcagttctccagcgggagaggcactgtcccggattccggcccctctcccactgtcccgccttcctgtgcacccactcccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaccaagacatcatcaaagttctggcgattggaagggggggggggacgggggcgattggtatgcatgatcggagagcgtgtgccnnnnnnnnnngggcaccaagacatcatcaaagttctggccgatggaagggggggagcgggggcaattggtatgcatgatcggagagcgtgtgccnnnnnnnnnncgtcccggattccggccccttcccccccccgtcccgccttcctgtgcacccactcccaagccctttgccacccaccggtacacatcgccggtgatgaggaaggcgggctccccgcgcttcagcagctccagctggtgtgcagaggtgtggcagcgcagcacggtggcatcactcacgtagtaggtgtcgttggggttgcgggagacgtggtcggcnnnnnnnnnnaggagcctggccctgtcgcaaggtgggaggaggagccagccagcagccacggcctggtacaggagggtgcccccccatgtccagcccgtgaggcaggagccacgcaccgccttgaccgtgaccacggggtacaggtcatcaaaggtcttcagggcggggtccgccttctggaggtactcgtagatggaagtcttgatgatgccgagcgggtgggatggccgtctggggaaaaacagagtgagggtgtggggaggggtgagggtgagcagaacagatcggcatgaccaccaactccgtgnnnnnnnnnntgccttctggaggtactcgtagatggaggtcttgatgatgccgagcgggtgggagggccgtctggggaacaacagggtgagggtgtggggaggggtgagggtgagcggaacagatcggcatgaccaccaactccgtgaacagcacgaggtcgctctgttcacagtccttcactacatctgtgaacaccattgatgggcagcaagtaacagggcacttagaccccaggaagctcactggtggagattgacgcccaacttctcatagatgctctcggggacgttgttggagggatggtctgtgagtatctctgcattggaggaggggctcgtggcaagccctcagcctcacagggcaggtttggggaggcttgactacacaccagcgcatctcagggccagcagaatgagcatggtactgtactcgtggcctgcgtggcgcaggcagggactcaccagagcgcggagggcgagcacacccccgctccgcgggtgtgctaacactgggttctgcagcggctgctgaggcgcagatgggccctgcacccgtcacgaatcctgcaggacaaggaaagctatccaggttaccctctataggaggctacagaatgggcggcaagacaggatcacttacctcgcgaggggaggtgacgaggcgtgggtgccgaagggaggaactggccactcctgatcgcgcaggacgcccagggcgctgatactgcgctggggagtggcgcggatgatggagcagacgtattttggaagcctgtacccctcaaacatgcgcacgcactgctcacccactcgcaagctcctggtgagtgctgcgacagtgccataccggaaggtacaacaccccgccatgctatcggcagagctttacaaatattaatatcaatacaatttcaaaaacgatgtttactcccaaattttccaggtttgcatgcatggaccgagtcgctggaatattgcttggtggtcaccctcccgaaactctatccggggagtaccgttctttcaccacattatcgccc

SEQ ID NO: 40209 - DNA, 72 bp, Chlorella protothecoides
agcccacgcctgaagtcgttgataggggtgcgtctgggggaccctggggtggcgatcactctgggcctggag

SEQ ID NO: 40210 - DNA, 127 bp, Chlorella protothecoides
tacaggagtgtcggcgcctcgcccgccaccagggctgcctcccacacctgacagggattggggatgtggctggcaaggtttgaggcctcaataataccctacaagcgcatcccagcatcaggcactg

SEQ ID NO: 40211 - DNA, 76 bp, Chlorella protothecoides
ttcaacagcgctccccgattgaagagatacatgtcggcctgtttgtgggttttgcgagggctgcgattgatgcaca

SEQ ID NO: 40212 - DNA, 136 bp, Chlorella protothecoides
gggcggagcccttcacggacgacagccagctggcgctcctggacgccctcgaccttgcgccagggtctgttggagtcgtggagggtggcgacggggcgtgggacccgggccttcgcggaggcacagccccctccga

SEQ ID NO: 40213 - DNA, 10804 bp, Chlorella protothecoides
  modified_base (195)..(204): a, c, t, g, unknown or other
  modified_base (536)..(545): a, c, t, g, unknown or other
  modified_base (1591)..(1600): a, c, t, g, unknown or other
  modified_base (1967)..(1976): a, c, t, g, unknown or other
  modified_base (2368)..(2377): a, c, t, g, unknown or other
  modified_base (2672)..(2681): a, c, t, g, unknown or other
  modified_base (2880)..(2889): a, c, t, g, unknown or other
  modified_base (3063)..(3072): a, c, t, g, unknown or other
  modified_base (3146)..(3155): a, c, t, g, unknown or other
  modified_base (5002)..(5011): a, c, t, g, unknown or other
  modified_base (5268)..(5277): a, c, t, g, unknown or other
  modified_base (5729)..(5738): a, c, t, g, unknown or other
  modified_base (6384)..(6414): a, c, t, g, unknown or other
  modified_base (6594)..(6603): a, c, t, g, unknown or other
  modified_base (6952)..(6961): a, c, t, g, unknown or other
  modified_base (7268)..(7277): a, c, t, g, unknown or other
  modified_base (7944)..(7953): a, c, t, g, unknown or other
  modified_base (8301)..(8310): a, c, t, g, unknown or other
  modified_base (9365)..(9414): a, c, t, g, unknown or other
cagccgcgcagccgccgctgccggccctgatgggggcgcagccgccgccgccagcgcagccgccgccgcctgcctccccgccgcccgcggcaggcaaggggcccgagaccagcgcggcggagccctcgttcttcgacgccttcctggcgggggccgccacaccgcgcgggcctccggaatttctgcgccgcgccnnnnnnnnnnggcgcggccgagccctcattcttcgacgcgttcctggcgggggccgccacaccacgcgggcctccggaatttctgcgccgcgcctttgacaggcggacacccctccttcgcagaggttgggctggtggtggctggcatgggggcctgccgcagctgggcaaataagggggggggttctgtgcttggagtctggctggactgcccctgatgatggaagatccgcgcatggggcggctgtggcacacggactcccttttaggaatattccctcgccaggggtcgtcactgggtgacatgagtgatccatcccctcaaagcccactcccacccannnnnnnnnnccaggaatattccctcgccaggggtcttcactgggtgacatgagtaatccatcccctcaaagcccactcccacccacccaccctgtctcgacttgccgccctccttgcagactttgagcggatgcaggacgagtaccgggaacgatataacatggcacccctgcgccgaaaggcgcgcaccgtccagctgccagaccgcgctcggagccgcagtcgggagaggacagggggcgaccgttcaagccgaggtgccttgccaccctggcaggtctccccgcccccccgtcgggccttcagccccaaggggaggagggagcgggagcgatcgctgccacgtgaagacagcaggagggagcgggagaggtcgcgagaggcgactgggcgggagcgcaggcaggaggctgacgtgcgtcctgagcgggagcgcaggcaggaggctgacgtgcgtcctgatctggcgcgcccggagtctgagcgtcgccgcagcaccagccggcgagctcgctcgcggtccacctcccgaacccacagggtgcgtctgcctgggctggtgttcttgggggtctccttcgaattgcacagtgcctcactcatgcccgccgcagtatggccgcagctgggcctgccctgccctggcctgggccctctcaagcctgggctaggatgttgatggaaggtgcagcccgcatgttgtttcagagccactcgcctcacacctcgatcgcccactgccacccctcccacaggccgccgaggggagaggtgaagtgcctctccggccgtcatcgcctggccgccacagaaacgacagggacagcgaggggtcgaggcgcaaggccagggacgaggaggatgtcgtgcggcggcgggcgaagatcgatgggactgagtcgtcacggcgcgatgccagggacctggccgaccagactccgcgtcggaggaccaaggacgaggacgccaggacgtctcgacacagcacgagagaggtgaaggccgagtcctcgcagcgcaaagacccggagacgtcaaccaaggggccggacccnnnnnnnnnnaaggacgtcccgacacagcacgagagaggtgaaggccgattcctcacagcgcaaaggcccggagacgtcaaccaaggggccggacccctcgctgccctcggcggaggcggcgcccccccagctgcccccgctgccctcaccggtccatggcgcagaggctgagagtctgggagcgggccgcaacagggtctcggagaggagtggacggcgcgaagcgggcaggctgcgcagggccaacgacgaagggcgggagcagccgagaggggacggcggcgacgacctgggttggggcgagtttgttgtgcggcgccccgaggacgcgagcgaggtcaggatggagccgtctggggagaaaaggcggaaggannnnnnnnnntgaagggcgggagcagccgagaggggacggtggcgacgacctgggttggggcgagtttgtcgtgcggcgcccagaggacgcgagcgaggtcaggagggagccgtctggggagaaaaggcggaaggagggtgggccgagggcggtggtggaggaggagtctcggaccaagaggcgccgcagcgacgaggacgtggaacgtggtcgggaccggggatcgcgtgagcatatgccgcccgagcctgctgcgcctgtccgcagagagcgccagcccatcgtgtggcagccggaggagcgacgggatgctcgtgaggatgcaggagcggcgaacgcccccgccgcgaccgagagggagggggcacccagcgggaggagccgtcatgaggagccttcannnnnnnnnntccgtgaggatgcaggagcggcggacgccccagccgcgaccgagagggagggggcaccaagcgggaggagccgtcacgaggagccgtcacgaggggctgagagggcggagcaggaccccacggtgcataaggcggccccggcccctgagccccgtgagatcaacccccggccgcactcgtcaagggagcggtgagcctgttgatcaggatacattgttgagatgctggcatgggcctctggccgctcaggctgggaattgacgccgccagctccggggaagcactttgaacctcnnnnnnnnnntgtcgttcggtccgcctgggtgaactccgccctgcaactcatcaccgtgacaccccctcctcccgcaacacatgctgcaggaaggagcattccaagaaggagaagagccacaagcatcggcacaggagggatgatgggaagcgcagccgggacaggcctgagcggcggaggagcagcagccgccaggcctgagtggctnnnnnnnnnngttcatagttgagatgctagcatgggcctctggccgctcaggctggggaattgacggcgccagctccggggaagcactttgaacctcggatggcgtcgttcagtccacctgggtgaactccgccctgcacctcatcaccgtggcaccccctcctcccgcaacacatgctgcagnnnnnnnnnncttcgtgtgcttcctgtgaggttggttgccgccctgccaaggtgctcacgcatgtacctcctgatggtgaaccnnnnnnnnnntttcgtatgcttcctgtgaggtttgttgtcgccctgccaaggcgctcacgcatgtacctcctgatggtgaacctgtggcagagtcagtgcaagtgcttgctcgcgatgcgtttggcagaagggtccttgtaaggccgagcctatgtctatcagatgtgctcttgggtttagagggttcaggtgctccttgagtgtgcccagcagcactcaacttggttgagaaacagtgcaaggtcatttcaggttctagcattccttggcagtgtgccagggacagtgaatgcctggtgccatcaaagatcccccatggaaagctgactaaccagcaagtccactctgcattctgccgtcgcgtggtccgcgcatgcccaacctggctgctggtcacgccattttgcgcgccctctgattcagcaatcaacagcatggctggcacgactcccgccatgtcagtccccggagctcacgcccatggtgaagagctgggcctgggcagccgacgatgccagcacgtcctctgtgctttcttgccccacccgcatggccgccacctgcagcgtgatgtccaggctcctgtgcttggccttgttgcgattgaagctgagccggccgcacacgctctgaccggtggcagcgtccagcaccagcgcttccctgggtggaaggagaggagggagggagtcggccctgcgaggtccacgaggtaggatgccaggttcccgctttgccaagtaatgcattgtccagcctggggagtgggcagcgacatatgcccctccctcatgttctctccatgtctccctgcccatggcacctgagcaccaggacggtctgggcccagtgcgtcggctgcccggtgggggaggtgtccagcactacaggtcggtccttgcagaagcgcaaggagaaggcggtgtcaaaccacacgacaatggcgtggcaggcgcctgtggggagtgcggggccagggttctctcagtgggcaccgatcttccttctgccagtctcaaggtacccagatggcacttggcgcggatcccacacgggaagggaagccggcacctgcccatcccatccactccccccgcgtcccagctgcagtccccgatgccaatgcccgtccctagaccctcccaaaatcatagcccaggagggcgggcactgcccatgcaacccctgcgcacccgcggacccaggtcggggacgcagctggaaggtggcgctgaagtcctgatccgcgcacgacatggtcgccaggtcaaaggtgtgcaggttctgaggctcagtcaccaggtcctccgccctcaccagcctcactagggcctccctctcggctgggcagggagtgggcagggggatgcacgtcgtcaatggctgtacggcacaacccgcgcatgccagagtggctcggttgcagcacactgcgccccatcatggtttacaagccatgagggaggtccccgagccagcaccccaatgccactttcccaccggcttccgatccgaccccacctgcagcctgcagcgtccccttcaccggggccatgctgaagccatagacttcgtcccagaaggaaagccctccggccgccggaccgcccccggccacatagatcgaggcctggtcgggcaggatggcgccgccggggacgaggaagcgatcgcgggccgccaggaccgagtccagcatggactcgaacaggagggcatagcctgtgaaacaggtgtgggtttggggcggactctgggcacagaattcaaaaacaccatcggcaggattgcatgtgcagcaaacattagccagggggatccaacgccctttgtcccagcatggggtcaaagtacannnnnnnnnngacaggtgtgggtgttgggcggactctaggcacagaatgccaaaacaccattggcaggattgcgcatgcagcaaacattggccagggggattcaacaccctttgtcccagcatggggtcaaagtacatcggctctccactcctgggtttcactcgaccaggcgcagtgtgaaacaagctgcatgctgcccaaccccgcccagactgtgcctccaccccaaggtagaccctcacccatccattcgctgacgaggacannnnnnnnnngaaactgcatgctgcccagccccgcccagactgcgccccccccaaggtaggccctcacccatccattcgctgacgaggacatcgaccttgctgccggggacatccagctcctccacggcctcaaccctgccagaaacaatgctgacccggtcgcccagcccgttggccaatatattctggcgggccacctctgcaattcgagcactcccatccactcctgagtaggtgtggggggggttacttaagatgtagactggcaggcctcctccttttgaggaactggcagggctttgatgaggatttgggtgagtgggaggtgccttatgtggtggacttctccccagcattaccagaagaagcaagtttctggctgaaacaagaagagctcccccttcctgcccacagctccaacagcccccgccacacaagctcaaaggcccctcacctacgannnnnnnnnngcacattctggcgggccacctctgcaattcgagaactcccatccactcctgaataggtgtaggggggtttagttaggatgtaaactggcaggcctcctcctttggaggaactggcagagctctgatgaggatttgggtgggtgggaggtgccccatttggtggacttctccccagcattgccaggagaagcatgtttctggctgaaacaagacgagctcccccttcctggccacagctccaacagcccccgacacacaagctcaaaggcccctcacctacgaccctagaggctcctgcacgggcggcaaacatggagaggatgcccgttccgcaaccgacgtccagcacgcgagcgccttgcatgagctgtgggttctgctcgagcgcggcctggtaggcttccgtacgggcctgcagccgattgagggcggggattgaagaggctttgaagctgccaagagattggaggtcgtcttacattgtttggtgagggtcaagggcactctggagagccacactccaaacggcaggctaggcagcgcgtgcctgtctcgatctccgccaggcccaagtcatcgcagcgcccaccctaccttatcactcagcatgtcgcgatggatgtcaaagaagctgtaggactcgaannnnnnnnnnnnnnnnnnnnnnnnnnnnnnnggaaggcacagaggtggagggctcgtcgaggagtgcggcctgcagggccagcacggccgcccgcatggccaccgcattttcttcctgggcttggcaggcgttggcgccgcagccgctggcttctgcaggggaagcgctccaggcaccctcctcgtcccagtcatggctcagcattccatnnnnnnnnnntgcttgggaggcgttggcgccagagccgctggcttctgcgggggaagagctccaggcacccgcctcgtcccagtcatggctcagcattccatcgccagccagcgtgggcaggaagaaagcttcgtctgcccagggacgtgtggccagagtgggaagcactgcttcagcaccctccctcgcacaacttctgatgtagtttatgagctgcagggtgccatacgtatccagattctcctgcaagatcggactttgtgtgcgtctcatgcgcggtggcctgggtgctaggtagagggcaagagtgctagccactggcccccatacaaatgcgctacacacccctcgcacctgnnnnnnnnnngggtagagtgcaagtgtgctagccactggcccctttacaaatgcgctacacacccctcgcacctgcttcctgaagaggctcaggtcgaatccgtggacctctgagtcgtgctcgatgacctcctccaccgtgggcagccaggtgtccgagaacaagctcttcacaggtccctcctccgactcctcccagtcgctccactcctcaggcccatcactcgcttctgagacgctcattgctatgtttaagccctattatgttcgcttataatgatgcttgggacatgcatgcatgcgtaatcgggaactgnnnnnnnnnngttatttccgcttataatgatgctttggacatgcatgcatgcgtaatcgggaactggccgcgactctcgggaaagtcgtcaggcgcgcgcgaattgtggccggtcgcgcccagcttgaacgcatcggggaaccagaacaccgcacccacgaatgatcttcgtgtctagccgcgcgaagcccttgtacgtgatgaagaaatgggaagaatatgcgccgactctcgattcgggctctgtgcttgcctgtaactcgggcagatcacttggcactggagcgcgacgaccacaatgagtgcgcccgatccaacactatcgaatctcaccttgaagtccttgaaagaccccagcttcgataccgatgagatctttcagacggccctgggccaatggaatggggagactggccgaccccttcctgtcgaggccctgcagtcgatacacagtcatcttgcagggtgaggtcctctcctgtgccggatcgacgagcaagaatggatcatgcttgcatccctgcccgtattccgagtgtatccactctggaacgctcagagtctgtgttcaagaggcttgagagtccgtctgatctctagcccaccccattctctctatgagcccagagtgcagaggcggctgggagagattcagaaggcagcgaacacagtctgcnnnnnnnnnntcgtctaatctctagcccaccccatactctctgtgaggccagagtgcagaggcggctgggggagattcagaaggcagcgaacacagtctgcgagcgcttggaacaagataccagtgagaggcaggggctgctacttgcgtcgctgcagacggtggagcgtggtcactcggaagcccagggcctgttccgggacgtggaggccaagactgccaccctgactcaggcagccacccggcacggaaatcgattgaaggtgcgtgtgcatgtgtggtgcagtcatggctctgcagcatacgcagagcctgcagcggcagcatgaagtatcagatgacatgtggagctggcgcnnnnnnnnnntggaaatcgattgaaggtgcgtgtgcatgtgcggtgcagtcatggctctgcaacatacgcagagcctgcagcggcagcaggaagtatcagatgacatgtggagctggcgcaggcagccctgagatgcatgcgctgatcacgatgcagcgagcccccttccactcccgcagacggcgctcctggagaagcagcgcgcgtcggctgcaatccgccagctcaaccacctgctcacctttgctcacgcgcctagcctgtctgccctgccagccctcttccatgacgatgcacgagccggggaggcggcggtgaggctgagggtggaggggggggctgagggctgtagctgcagtgatagtccacagaggagaagggactcaagactacacctggtcattcattcagatgccctcacaccttctccgctcttctcctgtgtctctggcaggccacagcaactgccctgctggcagtgtcccgggaggtcgtggaggccatgcgcagctcccacaccctcaagcagagcgccccagtgtgtggaatgggcattgggcctcatgctgatggcattcatggcatccctgcgtgcttgcacggggcggatgacccagcttcttgactctgtacacagctccttgcacttccacccacggcgtcatccctcttccctacgattcagcttggcagcatcaatgctgcattggtgaggctggaggagtactgcaatgccctggacaatcgggtggtgtccaggtttgacgccgccctggcccgatctgacttccccgccatggcggcctgcgcacggtgaggggctatgggggtggactatgggtgtagcagtccctcgagggagtcgcactggattttgagtgtgtcacacgcgctgagtttcgtaactcgcaaacctcctctgcccaaacaccagcttcccactctgtccccacactctatctgagctcagcatcatggcggccggggctgggaagaagggcgacccctcggggtcgggcgagaggctgctcatccagcgatacatctccacccgccccatcttnnnnnnnnnnnnnnnnnnnnnnnnnnnnnnnnnnnnnnnnnnnnnnnnnnggctgatgggccggggcccactcgacgccggaaacccaccgccgcctgggagtcctgggggcgcctccccgctgcgcagcctgaggctcctctacaagaccctgctccagaacatcatgaacgaggcggtggtagcagaacaggtcagcttgtgatgctgggtggggttggtgggtacctgcaagatgatgtggaccccatcaccggccactgctgtgttgtgcctgccaggctgcccacctgcagtcaccagggcacgactccccgacccaccccccttcaaacctcacacaggttttcacccagcccacggcggcactggctgccctggtcacgcgggtttttgagcagcgcgttcagtccgccgtcgaccaggcgctgagctggcggggagtgcccgatcccccctcagcctccgacctgcgcgcccaccttcgccagctggcggaggcggtgaccatgacccggggcctggccagcgacgcccaggttggcgtggtgtgtgatgaaaagcacggcaatgcggtctggggccaatgctgagggtggggacatgcgtacaaggctctggcaggcaagacatggaggggaatgtctcccacgcctgttgcgctgcaatccacaggatccccctcccatcgccagcgcatgcacccctccccaacaccgatgcaggaggtgatgggtggagagagcgccctgatgaacgagctggcggatgctgccacggcccagcacctggcaaattatgtggaggaggaactggagtggctagagacacgcttccgggaggaggaagaaagggcgccaggcaacccactctcgctgccgtccttcatggagctgctggccgctcacacggaggtcaggggctggcatgggtttctggtgtgtgagaggcgttgtttgatgcgtcgacctgcgattgctgcgactggggggcaacggtggcatgataggatgccgcagggcgcgagcccgctgccaacgccagcccgcattgtccactgcccttgcctgtctttgtatgcgatcctttcaacagcgtccagtggacgccagtccctgagggcagcaccatcacacctccttctccccatgccttccgaaaacatcgtcgtaaacccgggggccctccccaccttctttctgcaggcgctggagcgcacgacgacgctggggctgggcgccggcctgactgccacggtgcggaccctgcacggcaccgccgccgacctggccgccccagagggcccgccctgcctactgcggcaggcccgcgccctgctggccgccgggctggcggcctgcgccgggatgtgcgaggtgctgggcgcgctgggcacgctgggcgccgcgctggagctgctgctggcgcaccacggggcgc

SEQ ID NO: 40214 - DNA, 103 bp, Chlorella protothecoides
ggacgcgcccgcttggggtccggctgggagtcgatgggctccaccccgccatggcccgtcccgggggaggggtccagccggcgcggggaggtcatcgtcttcc

SEQ ID NO: 40215 - DNA, 61 bp, Chlorella protothecoides
gcgcagggaggagaccctggcccgctggacctcctcggagcgccctgcgctcaaggcgcag

SEQ ID NO: 40216 - DNA, 61 bp, Chlorella protothecoides
catgatggtggtctacccgctgcagacgggacgcatggactgccgcctgaccaggcaggtt

SEQ ID NO: 40217 - DNA, 61 bp, Chlorella protothecoides
ccacctgggcggggcggcggcgggggccgccttcaacgcgccccccccaccgccgccgctc

SEQ ID NO: 40218 - DNA, 76 bp, Chlorella protothecoides
tgtgcacctcccacggtagccgcaggtgccccgccttcccacctccttgccctacccctgaccaccacaggtggtc

SEQ ID NO: 40219 - DNA, 139 bp, Chlorella protothecoides
ctgccttgggcaaaggatgggaggagtgaggtggcacgtcgacggtgtggctggcgaggggggcaggtggtggctggggtaccatccaggcgcacatctcaccccctcaacccatgcctgcaggtcatatcggacctgc

SEQ ID NO: 40220 - DNA, 62 bp, Chlorella protothecoides
ccccctcaccaatccctcccctccgccacctgccccgccccagcacgctgctgtacgagtcc

SEQ ID NO: 40221 - DNA, 61 bp, Chlorella protothecoides
tgccgctcctgttgtgcttaaactggcagggtggcatgttggtccacctcccatgcaccag

SEQ ID NO: 40222 - DNA, 61 bp, Chlorella protothecoides
gcagcaggatgagtggcaggcactcccggggcttgtgtgggccggcgctgggcttgggagc

SEQ ID NO: 40223 - DNA, 2643 bp, Chlorella protothecoides
  modified_base (475)..(484): a, c, t, g, unknown or other
  modified_base (565)..(574): a, c, t, g, unknown or other
  modified_base (1205)..(1214): a, c, t, g, unknown or other
  modified_base (1433)..(1442): a, c, t, g, unknown or other
  modified_base (1891)..(1900): a, c, t, g, unknown or other
  modified_base (2279)..(2288): a, c, t, g, unknown or other
ggccgcgggcggcgcgggggcgctgcggccccgcgccgccgcggcctgcgacgtgctgcccgcgctgaggggcctgccggggacgcaggccgcgctgccccgctcctggaccaggctgtggcagggccagctgtacgcccaggagcaggcggcacctgcgacgtctgtggaggcggagtcggaaggtgacgaggacgccatcgaggacgcggggtgaggggaggtggcgacggagccatgcgccggcaacgggccctccggtggcggcttgcggtgcgtgggcggtcagcgatgccttgccggcgtgcagcagcgagctggcatgccacggaacttgcaaatcccaaacagttcaccagcgctcgaatcacattcattgtgggagatgtctgtggcagtccaccgtcgttgtgcacataccgaggggatggaatcgagtccaccacacccatcatgctgccaagttcatgggacnnnnnnnnnncccggtggcggcttgcggtgcgtgggcgatcagtgatgccttgccggcgcgcagcagcgagctggcatgccacggaacttnnnnnnnnnngccgaggtaatggaatcgagtccactacacccatcatgctgccaagttcatgggacatgtctcgccacgtcaccacaatgtatccgagaggagcagatcgtggcttccagggactcgcacgttcacatgccggcccaggcgatcacaggcgcagcacacaccggagtcacgatggtggactgagggagatgaccctgtacagcgatgccgaggcgcagcgggagggcctgctgtcccccagccggtttcggagccgggtcggggcctcgctccacctcctgcagcggctggggctgacgcggcgcctggaaggccacacaggtacatttgggtttctcagcatgtgtgcgataggtcccagaatcgcagcccacccttccctcccctcctcatgcggtaggctgcgtgaacacagtaaccttcacccctgatggggaaggactcctgtctggcagcgatgaccagctggtagggtgctgagcggctgtgtcagctctcgctctgtcccatgtgggcccttcatgcaccgtgctcagtgcataggccacagtacttgaccccaaccgccacctgaaccatggccccccggcgcccccccaccctagatcaagctgtgggactggcggcgcgnnnnnnnnnnctgaccccccggcgccccccctcctagatcaagctgtgggactggcggcgcggggtggaggtcctctcctacgacagtgggcacactgacaacgtcttccaggcccgtgccatccccggcaccgacaatcgcaccgtggtctcctcaggcgcagacggccaggtgcgactggggctggctggcgagggcggctcggtgcgcacgcgctgcgtggcgcgnnnnnnnnnnccgcaccgtggtctcctccggcgcagacggccaggtgcggctggggctggccggcgaggccggctcggtgcgcacgcgctgcgtggcgcgccacaatggccgcgcgcacaagctggcgctggtgccgggggcggcgggctgggtgctgtcctgcggcgaggacggccgagtgctgtccatggacgtgcagcggggagggccggcgatcgctctggttgaggtcaagtccccccaggcgagtgctctgattgtgttgtggttgtcaaaggggggaaagagggcggggggggtgtgtgaaaggggagtttgctgtctgccgtgcccgacaagactgcccaccaccccaatgtttgcattctgagtttccccatgcacacacatcactgtgggcgcccccccccccttccctcccacacacataacagggtcggcccctaccactgaacagnnnnnnnnnntcacatcactgtgggcggcccccccccttccctcccacacatataacagggtcggcccctaccactgaacagcgtggcctgcacccccctggcccccacccagtgtgtgctgggggccgcggacgaggtggtccgagtcttcgacctgcgcatggccggcaagcccctcaacgagctgcgccggggtcaactggtacgcgcgcctggcaggggtgccggctggagcggcacctgggtcgatggagggcaggcgttgcgcttgaattaccctgtttaggccacagggtcccagggctggccgtcgcatttctgcaaaggcttggcttcaacctcaccctgacgacccggctgcacccacccccatccccaaccgcacccnnnnnnnnnngatttctgcaaaggcttggattcaaactcaccctgacgaccagcctgcacccacccccatccccaaccgcacccagacacccaaccccccccttccctgtcaccccgcactgccagacgcacaccatggcgccgccccacctgagcgaccagccgcggcgccgggaggtgcacgtgacctgcgccgtgtacagccgccgcggcgaaatcctggccagctacaacgacgagaacgtctacctcttcgccccgacggcgggggccaggccgcccgcgcccgatgcgagctccgccaggcccgcacggcggcgcgcgcgcgggagcgaggagggcgaggcgccggtgcgcctcgcccc

SEQ ID NO: 40224 - DNA, 72 bp, Chlorella protothecoides
ggcggggccgtgggtgggttcacgggtttgtgaggggggtgacatgggacactgcgaccaccgaaacagcca

SEQ ID NO: 40225 - DNA, 69 bp, Chlorella protothecoides
agcaggtgcggctgtgcgcccgcgtcccaggccagcccctccttcccgaggggcatggccgggcatgga

SEQ ID NO: 40226 - DNA, 80 bp, Chlorella protothecoides
ggcacctgcactgttgaccgtcgtggggtggatgtgggctcctacacaccaaggagccgaacatgtgtggaatgatgcaa

SEQ ID NO: 40227 - DNA, 61 bp, Chlorella protothecoides
caccaaatgcagtgggacgaagtgcattcttaaaaaagcacttggctagcatcaggatgtt

SEQ ID NO: 40228 - DNA, 63 bp, Chlorella protothecoides
aaggcgctcatggaggcagcccatggttggatgctcccagcattgaagataggatccatgcac

SEQ ID NO: 40229 - DNA, 61 bp, Chlorella protothecoides
tgggggagcggccaccacatgagccctccttgatcccaacaaggactgcgcccccgaacgc

SEQ ID NO: 40230 - DNA, 82 bp, Chlorella protothecoides
cggcttggtcaggtcgcggaaggcgcctggcttgtccagatccagagcctccgacgcgtagtcggccagcacccagggaaag

SEQ ID NO: 40231 - DNA, 73 bp, Chlorella protothecoides
atgttgccgtgagcagctggtcaggtgcagaggagcgaatggtcgtatacgcagagcctggtcccctgaaaac

SEQ ID NO: 40232 - DNA, 61 bp, Chlorella protothecoides
gtggtggagggccgtgcgcctgcagagaaactggcggcggtgcaggcccggtacgccgccc

SEQ ID NO: 40233 - DNA, 68 bp, Chlorella protothecoides
tgcggccctggtcctgctctggttccagattgggtgggccaccttcatcggtcttgccatcctcctgg

SEQ ID NO: 40234 - DNA, 61 bp, Chlorella protothecoides
tcatcccgcgggagagctggccatgaaaccaccccgggggggggggggggggggggggggg

SEQ ID NO: 40235 - DNA, 61 bp, Chlorella protothecoides
tgtcgtcgccgccgccgtcgccgcgccacagccccagctcaggggccgtcagctccttggc

SEQ ID NO: 40236 - DNA, 74 bp, Chlorella protothecoides
aaaggacatcacctctgtgggtcgggggggagtgggggtggggcatggccctgggcgcatccttcaaagcgaaa

SEQ ID NO: 40237 - DNA, 118 bp, Chlorella protothecoides
catgccgggcaccgacacgctgatgctctgtggaacaagggggaatgtgagctgatgagggcaggtaaggggcagaagcgtggccaacgtgcatcagaactctttcctctgcaccttg

SEQ ID NO: 40238 - DNA, 73 bp, Chlorella protothecoides
atccaggtgcgcctgcggtctgtccgacaagggtcgccgataatggccctgcctagacccaccgccttcctac

SEQ ID NO: 40239 - DNA, 15520 bp, Chlorella protothecoides
  modified_base (1372)..(1381): a, c, t, g, unknown or other
  modified_base (2249)..(2258): a, c, t, g, unknown or other
  modified_base (4581)..(4590): a, c, t, g, unknown or other
  modified_base (5466)..(5475): a, c, t, g, unknown or other
  modified_base (6097)..(6106): a, c, t, g, unknown or other
  modified_base (6579)..(6588): a, c, t, g, unknown or other
  modified_base (7288)..(7297): a, c, t, g, unknown or other
  modified_base (8681)..(8690): a, c, t, g, unknown or other
  modified_base (9135)..(9144): a, c, t, g, unknown or other
  modified_base (9894)..(9903): a, c, t, g, unknown or other
  modified_base (10513)..(10522): a, c, t, g, unknown or other
  modified_base (10929)..(10938): a, c, t, g, unknown or other
  modified_base (11199)..(11208): a, c, t, g, unknown or other
  modified_base (12470)..(12479): a, c, t, g, unknown or other
  modified_base (13059)..(13068): a, c, t, g, unknown or other
ccccccacacccctggggctcaggtgctcgtgccagccaacgccctgccacccagcagcccacccacgtctgcctcggcatcggcatcggcaattgggactgccgggtaggcaaggacgacagccttgtcgttgcccttggttggcggaggtcaggggaggagtccatggaatggagaatccatgcagtcaccgctgtttaaccttcaagctgcctgcatgcctgttgtatcgttgtaatccatcccatccatccagagactgtcacggggacccggcacatggacgtacatgattgtatggcgtctggatttacagggcgcatgaattcaggtgacagctcgtgcggcttctgcagagctgggcacggaccctaccgttgacaggcaagatggagcctgaccaaggctacagtgatcacaactcgcatgggagtgggcaaaacataaggcccgatcctagagtgatggcaaggcttgaaggcaggcccttgcttgcgcaagtccaccagtgagacgcatgttgcagggggtgtttgcggcggcctccaggatccaaagacctgagcccaaggggcaccagggtgcttggccccccaggacaacccacaaggcacttggccaaaggtgcagaaagctgttgtatggtcagtgcggcatcctgggacctctgccaagcccggcattgccaccccactcagacgttggaggcatagagtcgctgggtgctcttctcgactgctcgttcctctcgcagccggtcaagctcctctagcgtggtaggcagggcccgctccctcaaactcctcccaaacggccagctgaacaagtgcgggccgggacagagggtcagtgggcttggcatgagcagcgtgtggaatcccccacatgaaggcacattggttttctttttctgataacattgtgcgatcttcggcacagcgaccctccaatccgatagtcatcggcccactgccctcctggcaagccagtcctcagcgtctagactgaactccctcctcacatgacgtatgtagccatcttgacgttcaggatggctgtgctcagtccgacaatcgtcagggcttggatcagggctgcgctcaggtgggccagcacgagtggccacccgaagagcagggcccacacaatgttgccggcgatggtgtaggggtgggccggattatccaggaaggacgctccctggttgatgagagggagagggatagtgacacggtttgcagaaacccatccagcagtgccagcacatgcgtcgcaaccaggaggagggggcaccgacgacacatattatggcccttgcagaggccgtcatggagagtgagcccatggcatcgctgctgtgttggtgtcatnnnnnnnnnngaccaggaggagggggcaccgatgacacatatcatggcccttgcagaggtcgtcatggagagtgatcccatggcatcgctgctgtgttggtgtcatgggcgtgccctccccattcgacctccctctgcgggcaaggttagctgtcagcaccgatcatagaatcaacacctgcccagccgtgccgcctgcggtgcacacctggactgagaagctcagggtcttgatgtatggctccagcgtgatgcctccatccagggcgaacaggctgatgcgcaggacttggagggcaaacggagcaaagacgatggtgagcagcatgcccacggcggccacgcagtacgcggcgcacagccagatcccgcccgtcacgatccagatggccctgcggaggggcagtatgggctgcgtgttgccccagaccatgacctggtcgatgcggcgacgcagctccatggccctggtgcggggacgcctcgcttgcggaggaggaatggttttggaccctcgccgcgtcgggtgggtgtgcagctctatgtcctgtcaggcttgcagtaaatttagctgtcagcgcggtgcggccctgggatcgctttccatgccgctgcacgccggtctccttttcgtcgaggtgcccagatcgcgggcgcgcgagttggggcgaagctgcacttcaagagcctgacatgcatgcatgcaggtgcccagccaacccatgtggattattcatgccaaccctggtgccatagtgtttttcaaaacatcattattggcccaaatagtaaggctgatccggtcacaggcaaaccgtgcatagtgttctctcccggttcaccatgtcggcgcggccgagccaacctcccgcatgctnnnnnnnnnnggtgcttttcaaaacatcattattggcccaaaaagtaaggctgctccggtcacaggcaaaccgtgcacagtgttctctcccggttcaccatgccggcgcggccgagccaacctcccgcatgctggccagcagattggccatctccaccgcggtggctgcagcctctgagcccttgttcccgaccttgcccccagcacggtccagcgcctgcaatgggttcaaagtgaatgtttgtgagggtgtggatgggggccagtggtcacggcctgctgatgaacatgagcacctttgacgactggagcacccacctggtccatggagtcgcaggtgaggacgttgaacaccacggggacgcccgtgtcaatggcggcattcaacactccgctggtcgtggcgcccaccacggcgtcgtagtgggcggtcgcgcccttgacctgcggggttgacaatacacaatgagcaccagcaggagatgggacgctggggtgcgatgctctgcaggtgggggccactccagtgtcctgcactggaacccaccaggccagaccctggcacagcatcaagacctcctgcacatcagacagcagcatacatgaaaatgcaaaagttgcagacccatgaccagacaaagggggtcagttgctgtgggtaacacagccgtaggcctttctgcacacgacagtcgagcccacctggctgggccagcatgcaccaatccctttcatccatggaccccctttggcctcaccacaactccgatggcgatgacggcatcgtactttccgctcttggccatggccttggcaaccactggcagttcgaagcttcctggaacccaggctacctgttgagatgagagggacgtgggttcaccaggtgggccgggcacactgcgcagtcctatagaagagcgccaccgttgggagagctgtacacaggcgttggggagcttgatgtttgtcctcccaccaagaactgatgccttggtcccctgcttcaatcccccagccatcgcggccagatccaccagagcttccccctcctcacatcgacatcattgtcgacgtccacccagtgacggctcagggtttcccgggctccagccagaagggggcgggtgaccagctcgttgaagcgtgccaccacgatgccgatcctcagtccgctgccatccaggctcccatagaatgtctcagacccctcctcgtcctcactgtcctccacgtcttctgggccggcactgacgccaggaccctgtacggcatcctccacacggggtgaggcattggagacctcgcccttgccggccttgcccctcgtgcggacactgctccgtgggagcaaggctgcgtgcacaaggagcgctcgtcgaattgtttgtattggcaccttaccagccaaaggcgcaataccacgacgtgtcgcatgaatcgactcccacgcccaaccctaaccccacctgccgatcgagacgatctgtgggccatgctgacggccagcattgtgctacgggtcgacgtacgggcttgggtgggtaccgacggggatctcagaaacgcctgggtacatgctacgctcaccatcctgactatcagctaagattaaggcagagcgagggtaaagataacctttcaatatgtccccttcatggttggtagctcttccgggtctgcccggtctgcacccggcgtagctggctgtgggatggggggatgaagggcgtcgggatgtgacgcgtcatgcatagcatacttttccagggccggcgtttcaaggcttggatccagctgctgttgcaactccccatgtatcgtggccacctccggcgtggcgtcgagtgtccgctgaggacactcgttttaacatgcactcgcgagcgtggcgtttggtgtgaggtacccccactacaggctcggcgtagagcacgtgtactgagccccattgcagcaccttactttcccccacccccccattcgataggctgcttatttcctgaccaggtcaaggccacggaccatttctgagaacgcaaacagggtagacagcctcgcaggccacatcggcacacccgcactcctgttacatttgcacctcctccaacagggtgcgattttcaattgtctgatgcagtacaccccaggggtacagatatgtcctcatgagatctcaggacaaagtccaaatcacctggcaaacatgaaggggatccccgcatctcctggcctgcctgcacttccttctgacaatgcacaggcatcaacaaagcgagggaatgggcatacgccccacgattctgatcgtgagcatccatagcagcagaagnnnnnnnnnnaaaggggatcctcgcatctcctggcctgcctgcacttgcttctgacaatgcacaggcatcaacagagcgagggaatgggcatacgccccacgagtctgatcgtgagcatccatagcagcagaagcctgtctcgagtacacgtttgcaggacattcgtggcccaaaaacaccctctttccatgacaaggtatttattatcccccggtaaccaccaatcggggtcgcttatcccctgccatgcgtcatccataaacttgcttggagggatccacaagtggtgcaaacatgtgtaggtttgccgggggcattgcatgcgcctcatgaggtagttcaacagggtagaggccgctggggcttattcatccggaagaaaccctggagagatctcacgtagcctgctccggcgtgagtaatcctctgctctagatcccatgatgtcgagcacgtcagtattggaaacgattatcgaaaattgattgcaccttgagtgaatctgtgccctggcccctgccagccatcgcacccgtcccaccggcccgttctcatgtcgtcgccagcccaacctagcaagccctggaccagtgtggatgagttggaggagcaagctgttccccatctcccagcctctatagccggatactaccttgggcactcggagaggggtgtgacggtgcgagacaacgtgactgcctttacccgctggcgcctgctgccccgctgtatggtggatgtgtcgaccgtgaacacctcctgcaccatactaggtgataatgaacagtgagaatttccgggtgtcaatggggcatcgcgatgttttccccgtttgcttctcatgtcggcatacgcgacaggtgtcgccgggatgggatcgctcannnnnnnnnntgataatttccccgtttgcttctcatgtcggcatacacgacaggtgtcgccgggatgggatcgctcatcctttacacagatggacaccccatcctacgacgccaccccagcccagggaccctcttcactccggcaccatggagcctgacatccccctgccttgctcccccaggatcgaacctgctcatgcctatcctgatcgcccccatggcgatgcagcggatgtgccacccggacggcgagctagcagtggcacgcgcggcggcaagcgtgggctctggcatgatcctgtccacgatgagcacggcccccctcgctgacgtggcagaggagctcccctcgtccacgcacgccctcaagtggttccaagtgtacgtgagtcgcggccttgggtgctgttgcaggacttcattgcttctgatgcttgatcttccccccataacgtggtgccgcaaaatgccaagggggttgcttggatccggtgtacgaatgtggatccctggacagaccggtgaggtctcctatggcaacagcagtagcctgtggaaaccacagaaaccctgcaccaccaaccttcctcaggtgctctctcggcgggatgtcacagcccacatggtgaagnnnnnnnnnngcattgcttctgatgctggatcttccccacataacgtggtgccgcaaaatgccaaggggtttgcttggatccggtgtacacatatggatccctggacagacccggtgaggtctcttagggcaatagcagtcgcctgtggaaaccacagaaattctgcaccaccaaccctcctcaggtgctctcgcggcgggatgtcacagcccacatggtgaaggaggcagaggcggccggatacaccgccattgttgtgaccgtcgatgcccccaggctaggtggggcatgggtcgcccctgtgaagtggaggcggtgcaccctctggagctcggtcctgtatgctacagtgtcaactagggatgcgcgttagggtgtgtgaattccctctatctgctctgcaccatcgagtggagtaccatgttgagagatgaggaagagggtgcgggcgttcttcccccgccacgcccattacctccccnnnnnnnnnngggaggcggtgcaccctctggagctctgtcctgtatgctacagtgtcaactaggggtgcgagttagggtgtgtgaattccctctatctgctctgcaccatcgagtgcagtaccatgttgagaggtgaggaagagggtgcgagcgttcttcccccgccacgcccatcacctcccccccccaaacccccaaacacacacacagggaagcgcgacatcgacgacaagctgcactttgacatcccgccccacctcagcctggccaacctcaaggcgctgcaggaggaggcggggcggccggccagcgggcacagccagggctccggcttcgcggcctacttcaccagcctcatcgacccctccttaacctgggactgcatcgcctggctgaagtcggtcactcgcctacccatcctggtcaaggtgggaaggggccccgtgggggggctggggagggagggcaggtgtgcagggcagaagcacaccggcagcgaactgcgtcgacgacaggacagcggagggcttgtcgagttccaggctctcgagcgtggcgcggagcggggtgtaacatgtctgtgtgcgtgcgactccctttccaggaggccacacttggtgcctacacctgtgatacagcccacaatgtctgaatccgcccgcacctgtcatcgcgtccgtaaaccaaacccggcatgcgctcaccagcnnnnnnnnnnggggaggcgggggagggagggcagatgtgcagcgcagaggcacaccggcagcgaactgcgtctacgagaggacagcggagggcttgtcgagttccaggctctcgagcgtggcgcggagcggggtgtaacatgtctgtgtgcgcgactcactttccaggaggccacacttggtgcctacatctgtgatacagcccacaatgtctgaacccgcccgcacctgtcaccgcgtctgtaaaccaaacccggcatgcgctcaccagctggtcgaccctgctcacccgtcatgcaagtgtgcccccttaccctccagggagtgctggccccggacgatgccagggccgccatccgggcggggtccgatggcatcgtcgtcagcaaccacggcggccgccagctggacggcacgccctcggcgctggacgtcctgccccacgtggcggccgccgtggcggggcgggtgcccattctgatggacggcggggtgcggagggggaccgatgtgctcaaggttgaaggggcggggttggtcgggggtgccccgaggggggggggactggggcatttgagggggccgacgcagccatgcgcctgggaacgagtgagatgtcggagacggccgtgcaccgaggcgcttccctgtgcaaaaatcctgtgttttatcacacacacacacaaagacaggcgcactaacacgcccccgccctccctccttccttcctctatcccaacgccccagtgcctcgcgctgggggccagcgccgtgctgattgggcggcccgtgctgtggggcttgaccctggggggggaggagggggtccgtgccgtcctgagcaccatgcgcgccgagctggagctcagcatggcgctgctgggggtggcgagcgtgcaggggctgaaccgcgactacctcgtcccgcccatgggcggggagctggtgctgccagcggcacgcatgtgaggtggcagtgtggtctcgaggaatgcgttcgtatcaaagagtgttggccgcgtcaaaggcttgaaggaatccatcattgcattcacttgttagttgtaatggggcaccggtgctgtttcaacacatcataccagtatccagttcccgttgcttgtgctgaattcgagtctgcatgtgtgagcctgttgttcaaggaactctcatccatggggtcaccggtgccgtgcatggcatctcatcgatgggtggtgcatgctggtgcccagggaacggctgcgaaagccacgtgcgatcgcccgtcccgccccggtcaccattcaagcgatcagaaggctccggccgggcaactgcacggcatttcgaatgctctggtactcgcgcatgagagctcacacaacacattacggagcatcctcacgacaggannnnnnnnnntggtcaccattcaagcgatcagaaggctctggccgggcaactgaatggcatttcgaatgctctagtactcgcgcatgagagctcacataacacattacggagcatcctcacgacaggagggaaggactgtggggcgcatgctgatctccacacatggccaacagcatgcatgttgccgatctcatgggagggatggtgccatccacgccagacctcgcgcgcgacattgtcgcctaggaagcagactagcaagccccatccatgcacagacgggcagcgatcctcccagctctgcaccaggtagcatggggaggatgggtgggggtacaagggcactgcacaggtttggttgtgagtgcgccatatgaccgtgcatgagtgcacgcctgcgagatcgacgcttcacaccgatgctcctcgtgcaacaccacgatctcccagagtnnnnnnnnnnaagtgcgccatatgaccgtgcatgagtgcatgcctgcgagatcgacgctgcacaccaatgttcctcgtgcaacaccacgatctcccagagtctgcagccgaaacggctgccagacaggcacgggtttggaggggagggccccaattctccagacgcctgctgctcgggggatccactgccactgccctggtaagcatctgaagtgcgcaagggctggacggtattcagaagctttgcccatgcgtggttttgcacagaactctgctgccatttgccgctcaagcggtgctccaggtctgcacacccatgcccttcccccttccccaggccctgggtgccaacttctcaggggtgaccagcgccatcctctccttcttccccgacaccgcgaggagcctgcgcctggacaccatctaccccatccagggtttccagcgctggcgagacgaggccgcggggttcgagctggtcttccccagcgcatggagcgcggacctctccgtccgccgcaggctggccgaggacgccagctggcagcgacccagccccggtctgccaccgctgggcctggcgccgaggtgaggagggtgggaggggggggcctatctctctgaggccctgccagggggtacatgccccgcatctgaggagaggtaccagcatctcatcctacgttgtctgctgtctgccggcatttgagaggcatgtgcctacgcccactcttccaccacacaggccctcccgcggccnnnnnnnnnntgcctatctctctgaggccctgctacggggtacatgccccgcatctggggagaggtaccagcatctcatcctgcattgtctgctgtctgccggcctttgaaaggcatgtgcctacgcccgctcttccaccacacaggccctcccgcggccctgtggtggcctttgggccgcggggtactactggtgaggagaacatctccgtcattgtctcccgggtggggcccggcagttcagactctgcgcagtcgctctttccagacgaggagggtgcccaggccttcctggacagagtcgtcgcccggccctcagccggtatgaccgccgccctacgcagcctgcgcaccaggtgtagatcgtggtgtgctttgctgcagaggctggcatgaggaacccttctcagaggagtgtggggagggtctccatgcacagtgagctttaagactcaccctggtgcccgcctggatgggcaagctgccctcggccatcattcctgcaccggcgccgctccaaccatccccaagtggtactcaacagtgccacccagccagcgcgacacctccaaactcccaatccttcaaccccccaaccctgccatcttgcaggacggatnnnnnnnnnnggtggtactcaacagtgctacccagccagcgcaacacctccagactcccaatccctcaacccccaaccctgccatcttgcaggacggatggcgctgggcgcgtgtacacaaccatggacttcctggtctcctcccccaggtggcagcgcgccaacctgtccacctatgtcatgagtggccagtccctgtacaccctgaactgccagtgctcggcccagaatgccagcgaccgggcacgcatgttccaggtggtcactgataactttgccgtggcgccgcgggcaccaggccagtgatgcaccgcagtaacgtgaatgccggcgctgtcaatttcattgtcctgggatgccatgtgcacacaccttgtgcactgccaactgttgagttgcaactgggcggtgtcaggnnnnnnnnnngatcctggcgctgtcaatttcattgtccagggatgccatgtgcacctaccttgtgcactgccgactgttgagttgcaactgggcggtgtcaggagtcctcaggagcgagggttgacgtgggagcaggccagtaccatgcaaagtgcatgtctggaggatgaggaagaaaatgagcaaggaggtgcacgctgcaaacaagaatgaacagtgatgacacttgtacaaaaaaggtggatggacgtcagggtctcaccatggcannnnnnnnnntagtgatgacacttgttcataaaacagtggatggacgtcagggtctcaccatggcatggccgtcactcgctgtcgctttcagacacgaggtactccaccactcgtcggttgttgatgcgctccaggggtggcagcccatcatcctcgctggagctgccatccaggcagccgggttcccgtgcctccctcttctcctgctccatggaggggttgtcaggcacagcaggtgaaccagctgcccgaaactcctctggcctgcatcaattcaggcaggaaaatgggatggtcgaccacactcagtggagcacacggagtattgtaccatgtcgcagccagccaacaacgtatttggtgagacgcttctctcacgagggcatgagccagctgagaacagcccgtctcagccactatgagtgctaattgatgcacatgcacactcaaagcaagaccagattcttcccacgcaccagacgcctgggatgcgctgtagctgcttcacgtgatcggcgtagaggaccttcacgatctgtccagacactgccgcatcgatggcctccacctcctcgacgatgaggaagttgccattcttgatccacagcttcttatggaaccgagccggaatgaggcacaaggtccgcctcccacatggaaactccacctgagtttgagtggtgtgtaacctcagtcccaacaaggaatacatgataccgaatgagaccctaaggccacctgtgaaatcgcatgcatgccaccaaattactttgctgaagtgagttcaaggtgcaacccgagtcacctcacctccatgatattgctgcctctgctacccactgccctaactatgctctcattctcagcaggtgctgtaacctcctcctgtagggaattctgtgtgatgtgtttccgtctactcatccctggcgacgacgccagggggctccaaccggcgagtgctctcgtgcggccagtccgctgaatttgtagccctctatgtacaatcacacgaaaacatatggatatcgccccttttcgtagataggatgttgaaactgcctcctgtgtgctctcctcgcgccctgggcgcacttcccgcgccggaatttgaacggaaaatctgtcgcccgggccaacccgttggtgggggacccccagattcgcgtggcacccccgccgggtcccaagtgcggcgagacggaccaggggccatgcagtaagatacagcattgagcttagggcaggatacggtcggcagacgtgccagnnnnnnnnnnaacggaccagggcccatgcagtaagatatagcattgagctaagggcaggatacggtcggcagacgtgccagattgcgaccagccatggcggagcgctggctggctatgcacgcctcgaccaactcccgcttcacccgagcctcgcaagacacacacgccagcctgcctccggaggcagaggaaccccaccgcacccccccctcggtgcgcagacccgtgggacgctcctcccacctggacggcatctccatggagatgtcccccggccggtcggagcgggcctttcgcacgggcaatgagcgcctgtacgaggcatacaacgacctgcacgccctggcccaggactttgagaaaccgtttgatgcccctgccatcctggtggtggggcatcagaccgatggcaaatcaggtgggtgctggaggggtatgggtgctgtgtccgaggtgatctgggtgcaggggtcaacggtgaatgccatcaagaatctgcttacaattggtagcatgcgccgggttctctgatttgagatctgcttggtctgggccgagatgccttgagtgcagcgcgtttctctccacnnnnnnnnnnaaatgccatcaaggatctgcttacaattggtagcatgcgccagtttctctgatttgagatcttcttggtctgggccaaatgccttgagtgcagcgcgtttctctccactttcctactgccaggcggacgactcgagccgctcccagcccacgactcatatttcccccccccccatcctgccctccacagccctggtggaggcgctgatgggcttccagttcaaccacgtgggcgggggcaccaagactcgacgtcccatcaccctgcacatgaagtacaactcggcttgcgtgcagccccactgctacctggtcaccgaggactttggggagcagggcgtgtcgctggaggagctccaggtgcggggagctggcgggtggacagggctttggggagtggaaagggtccatcctgcaataagcattttgtgctgtggagagaagtgtgagagctagctgtgacgaggcaacagtgactgcaaccacgttcagcatctgctgcttcagccatgtcgtccaagcaccgccactcgtcggttcactgccacgttgccatcttactccccctcccgccaggaccacatcgagaatgagaactcccggctggaccgggaggggcagttctggtccaaggagattgtggtcaagatcgagtacaagttctgccccaacctgacgatcatcgacaccccgggcctcatctccgccgcgccggggaagcgcaacagcaacctgcagacctccgcgcgccaggtggaggccatggtgcggctgaagatggagcagcgcgagtacatcatcctctgcctagaggacagcaacgactggagcaacgccaccacgcgccgcctggtcatgcaggcgggtgcctggaatgtgcattcgcgcggtttctttgtcctgagaggagggcagggggcgggtgcctttgggagggagtaggcaggtggaagggggcccagggtctgcatggggaccctttcctgctgtgtcctcccaagccctgcatgccacacagactgttctggtgatcactcggggacagcatggcaagggcaccttcaaacagccccgtgacaccacctgtccttcgcgcctcgccccaaatccctcacccctcctcttgtcccaccaggtggacccagcactgacgaggacggtggtggtgtccaccaagttggacacgcgcattcctcagttcgcgcgcgcgtcggacgtggagatgttcctgcgccccccctcccgcctgctggagccgaccatgctgggcgggtcccccttcttcacctcggtgccctcgggtcgggtgggcaacagcaaggacgccatcttccgctccaatgagcacttccgccaggccgtcgcggagcgcgaggccctggacgtggcaggtagaggggttttactgtttttttgttgtaaaggggtggtgagggggggggtccagagattgtgcatgtatgagttgttggggggaggaaactgtcgcgactccccttcacacccccgaatcacctcccctcccctcccccacccaccacccaaacgactccacacagagctggagtcgcggctggggcggcgcctgggccccggcgagcgttcccgcatcggcgtgggccagctgcgccgcttcgcggagcacctgctgcagcgccgctacctggagaacgtgcccaccatcgtgccggtgctggagcgggagtaccgctgcgcggcgcgcaagctggaggagacccaggcggagctgaacgacctgcaccccgagcgcttgaaggagaagggccgcgtcttccgcgagtccttcatcgccaagctggccctgctcctgcgcggcacggtggccgcgccaccggagcgcttcggcgagaccctggccgacgagcacgtgcgcggcggcgccttcctggaccccctgaccaacaaggccatcgccgtggaggggtcgctgcccaatgcccacatgcgcctgtttggcggcgcgcagtaccaccgtgccatggccgagttcagggcgggtgagctgatggtgctcgtggagtttcattcttgtggcgatgggtcatcgggtgcccatggaggatctgcatgccgcccttgggtgtctctcagggtcgttcaaccccaccccccacacccacacccacccacctgtcatccaccttcaaaaggcatcggagagatgacgtgccccgacatctcacgcgaggagatcgtcaacgcctgcggcatcgacgacttccacgacggcgtcaattacacgcgcaccgcctgcgtcatcgccgtgtccaaggcccgcgacctcttcgagcccttcctgcaccaggtgttttgttgtgggggtgggactgaggggcttaactgggggggggaatgggggacacccccttgacgtggactctcatgttctgtcccgcatcacccaacgttcaaccccccccctccccccccac

SEQ ID NO: 40240 - DNA, 153 bp, Chlorella protothecoides
ctggcagtgctggaggaggcccaggcaaacctgcagcccaccctgccgcggctgcactaccagttctccttgcacgacgttgccaaggtggggcgcgcatgggcgcagcacaggcctgcgcctggcatgctggggcccctttacatttgcgcc

SEQ ID NO: 40241 - DNA, 78 bp, Chlorella protothecoides
agtccacgtcgcacgcggcccgacaggagccttgaacgagggaggcaacgatgtggcagggatgtgccgcgcaagtgt

SEQ ID NO: 40242 - DNA, 67 bp, Chlorella protothecoides
caccaaactcttcgcttgtcactgggagttgctatagttcacggtcgatccggtcggtgcaaaagtg

SEQ ID NO: 40243 - DNA, 61 bp, Chlorella protothecoides
tgaaaggagcatgatataggggcaaaagagagcgaaatcatttttccgcccaacgagggaa

SEQ ID NO: 40244 - DNA, 4194 bp, Chlorella protothecoides
  modified_base (175)..(184): a, c, t, g, unknown or other
  modified_base (1386)..(1395): a, c, t, g, unknown or other
  modified_base (1690)..(1699): a, c, t, g, unknown or other
  modified_base (2484)..(2493): a, c, t, g, unknown or other
  modified_base (3340)..(3349): a, c, t, g, unknown or other
  modified_base (3634)..(3643): a, c, t, g, unknown or other
  modified_base (4093)..(4102): a, c, t, g, unknown or other
ccggcccccgcctcctcgtcctcccccgcccccgcctcctcgtcctccccgcttgccgcctcctctccgctcccctcctcatcctcctcctcgccctcctcatcctccccactgctgctgtcctcacggcgcaggtccgagaagaagatgcccatgtccaggcacacgccgtcgnnnnnnnnnncggtcgcggtcctggctgctgctcgccgccgcgctctcctcctcgctgctgctggcggccccggcccccgcctcctcgtcctccccgcttgcctcctcatcctcctcctcgctcccctcctcctcctcgccctcctcctcctccccgctgctgctgtcctcacggcgcaggtccgggaaaaagatgcccatgtccaggcacacgccgtcggacatggccgagcactcgcagttgagcgcggcgcggcccaccggcagccactccggcagcgcaaagttcaccgcttcggcaatgttgaaccccaggttgaagccggagtggtaggccgcggcgttcagcacgatgaactcgcccggctcctgtcgcgcctggacgaagggcacgcccgcggcgcgcaggaggcgcggcgagatcatgatgtccttgtgccgcacaaaggccgggcaggcggcgtgcagctcggggaagaggccgcgggccatgcggtcaaaggtgtggccgtcgcggggggacacgcagtaccagatcttggccgcgccggcgtggttgtagttgatggagtacaggtcgatgtcctccttgtgccagccgaagaaggacttccaggtgccaaagtaggccatgggcgaggtgacgccggggatctcgggcacgtcgtactgcgacagcaggcagcccaggcgccgcaggttccagccaaagtccaggcgctcgtcgaagaaggacacggccacgtctgcgccgtacaggggcgggttgatggtcacgctggaccagaaggagcgctccaggaagtcgtcgtcgcggtgccctgcggatgagcatggggcaagggtcgacaaagagcacaacgcagctgtccgagtgtgcaaaggggtggtacagcgcacccggcgcatcccagggcacaaatctgcaacagggtctccatgcccccgcacacgctcgatgctgctcatccccgcacctcgctcgggcgccttgtgactgggaccgctggccatcttctcaaagtcggaggccatcatcccctgcgcacggcagaggggctaagggcgtaagactatgatccgagagagtctccactctgctgcatcaagcaggcgcatggtccgtctccggatctgcaaaagctcgtcgcagtcaatgctccttctccctctcgagcccagtacctcacccgctgctcctccaagatacannnnnnnnnnacaggtgcatgctccgcctccggatctgcagaagctcgtcgcagtcgatgctgtttctccctctcgagcccggtacctcacccgctgctcctccaagatacatctgtacgccccactcttgccgaacacctgaacgcgtgtaccatgtgagggtgaaaaggacgctcagcaggtaggggtggaaagaccagataccaccctgtcattctatatgccacgcttcggggcttcccccatcatgcaaggcatccaattgacctaaatactccctcgagatgctgcaggcaccctcccnnnnnnnnnnctccccccatcatgcagggcatcctattgacccaaacactccctcgagatgctgcaggcaccctcccatgacgcatggtagcacggccccccgtacatgctgcttgatgggggtggcaatccgcacgttctccagatcgtacttcccccgcttatttggtttccaacgttttggtggaatgacctgcattcatggcatcagatcttggttagaaaaatggctcggcagggaccagccccggctccgggggtctcatcgctccagaccagtccagccggagatacttgccttgaaacatgcccattccgggtgcttcaggaactgttccctcacaaattcagcaaaaggtctctcgaattgctgtcgagtcggccgcagcgtggggcagaggtgaatgtccgagttcaccatcgtcccagccccttcctggtgtcgcagggactcctggtcagcctagccgtcctcgtagtgttcgacaccctgcatctggcccgagatcatgtaggagggtcggtatatgctgctcaaaagtccagatgaccttcatggacttggtggtgcaagttcgtcacgcaccccccttccagggtctacctaaaccctcgtgcgaacgaatgtttcgcgccatcaattaattcccgagattcagcttcactccacagctgctcctaatccctgtgatatactgtaaagttcatgtgcattactggtgaactccttgcacttataggctaggcatccccaaacagggatgtgtgtgggtagcccttgggcagctggctgcnnnnnnnnnnaacacactgtaaagttcatgtgcattactgataaactccttgcacttctaggctaggcatccccaaacagggatttgtgtgggtagcccttgggcagctggctgccagataaataaaactatgatacagtatcaagcacaaggagtgttcccggcatggtcaggctcacaagcccagcgttgcacccacccattcagcctgctaggccttgcggaggaccagcaaggaccggtggaaccccgaggctgcctcccctggctgcaggcgtcgcaccagccggaaccccagcgtgtcgcacaggaaggcaggaaaggcatctggccgcagctgcagctcgtccagcgggtggaactgcgccagcgacgcccgctcctcctcgctgcactttgcccgctgcatgcatgagaaaggaggaatggaaaggtgggctcggatggaccacccatcaagaacacaaaacagtgcttgcagggtgcaacaggaggcccccagcactgagggcagggaaggccacatcaacaccctgggcatgacagggcaggtcgccgcccgccaagcccacatgcctgctttttgagcttggatatggccgcctggtaggagctccagggctggggctccactatcagcaggccccccggggcaagcaccgtgtgaaactttataaacagggcctgcaggccctcatcccccctgttcagatgcacccatttggtgacactgcacatgggtttgtggaaagggggaagggggagtgattggcggggacggggggacaaaagggagggggaacgtggtgtggcatgaaggtgaccaggacccggcacaatcccacggggcagcaggnnnnnnnnnnggtgattggcggggacggggggacgaaagagagggggaatgtggtgtggcatgaaggtgaccgggacccggcacaatcccacggggcagcagggggaagggcaggggcccctgcaaagatgcaggccagcccgctgcaacaactcaccgaccaggcccagcgatgagtcatccccaggggcccccacccatcccaaccctcctcccgctcccacgcgatgttgcgcgcaccactcccactcccccccatcacgccccccacctcaggcacgtgatggtgtccagnnnnnnnnnncggggccctcaaccatcccaaccctcctcccgctcccacgcggtgttgtgcgcaccactcccactcccccccatcaccgcccccacctcaggcacgtgatggtgtccagcgaggccggctccaccacgctctccaggaagtcggcgtgcacgaaccaggtctgactaaggccctgcagcgcgtccctcgccgcgcgtcgctctccggcgtctgtcccgccggccctggcgacggcggcgcgctgcgtcgcgctggtacgcagcgcgcgaagcgtgctgcgggagcggcaagaggtcgggggtaggggtgccgaccggctcctggtgccgacgatgcccagaaagagaaccacgacctctgcacgcctctgcaacacggccaggctgcaagtctgttgctgccctgtccaccaaaactcccctaaaactcaccgccccccccacccccccnnnnnnnnnncctgcaacacggccaggctgcacgtctgttgctgccctgtccaccaaaactactctaaaactcacgcccacccccacccacccccacccccc

SEQ ID NO: 40245 - DNA, 107 bp, Chlorella protothecoides
gcaggtggagggcccccgcctgcgcaagcatgtccatcacctcggtctgtgatggaggagctgggggagtgagggttgggcatgcaccgtgacccgacagattcctg

SEQ ID NO: 40246 - DNA, 71 bp, Chlorella protothecoides
cggcctgtgcgtggcggccgaggcggcgcgtcggcatcgcatcgcgcgcttctacctggacccctccctgg

SEQ ID NO: 40247 - DNA, 70 bp, Chlorella protothecoides
tgcccccgactcgggctcggtgtagccgctgcccagagagcctgccactcccacttccgtggtcttctcc

SEQ ID NO: 40248 - DNA, 2473 bp, Chlorella protothecoides
  modified_base (285)..(294): a, c, t, g, unknown or other
  modified_base (359)..(368): a, c, t, g, unknown or other
  modified_base (898)..(907): a, c, t, g, unknown or other
  modified_base (1246)..(1255): a, c, t, g, unknown or other
  modified_base (1542)..(1551): a, c, t, g, unknown or other
  modified_base (2023)..(2032): a, c, t, g, unknown or other
  modified_base (2375)..(2384): a, c, t, g, unknown or other
ccacagaagcacatgtgatatcaaccaggacctccagcgggaatgcctggacctcgttgaccaacttcatccacttcatgtccatttgctggatcgtgcatcgattctctcagccgattctatttaatgctcttgccaccacccatcttttgagtggccatacccccgggtggccgtcacttgagcgtggtttcggcatccccggaagagtctcaagcaaacaagtctacctccaattgacccgaggtgctttcggactactcacttgatgttcctggattgctnnnnnnnnnntttgtcgatgataaccgcatttcattcttaaggaattaaagtgggagctgtcgaggagggccccnnnnnnnnnnacatttcattcttaagggaattaaagtgggagctgtcgaggagcgccccgattgcatgtgggtagatgtgcaggaggacaaggaggctggagcaagcagatcgagttgcctttaggtgcatgattcccctgttgcagcagaatgccatctggaattgcagtccagagacacacaatgaccccatcattatcttccatatcaattatcggatgtggtcgaatgtctccatttcgagacagggctcattgctgcatccaagtctagcaccaagaggggccgtaggaaggggtgagcaattgtcagacctgcaacttgcaaataaaacccgctactgacctggctccaccacagatggtttctgacatccatgaactggacagtctcactgtcctatctcatgtggacaaatacgagcacaccaacaccaccgctgagtccccagcaccgctccagccacaagaaggcgatctatgtaatattgaggcactccaggggctgacgaccaggatggttctccctgattgcaaggnnnnnnnnnntgccacaagaaggtgatctatgtaatattgagtcactccaggggctgccgaccaggatggttctccctgattgcaaggaagaagggagcatgcatggagcatgatgcaccgtagaaagccctggcggaagctatattgcttgtgatggctggttggggggctgagaccattcgccgtgagctgcatatcaagagcacagcatgccgcctattctcatctcgacgaggagggtggcaagaggtggaggactgggtcagcaagaagaggaaggccagggtgagcttttgcctgctctgtaccccgattcgtatcatcacctggaccagcagggatgtgtgnnnnnnnnnnacctgctctgcaccccgattattatcatcacctggaccagcagggatgtgtgcagcttgtgtgggggccagcattgctctcgaaagggcgaaggaagtgaggagtctgatatgctctcaaggccgatgggcgacagccagcatgatctatgtgtggcagctgcgttctaccgcccttgcactcgatgctctatctgatctatcgttatttgaaatggcagtctgcagcgtagagctcgttcgcatccccgattggccatgtaaaggggtcacgcaaatgggcaagannnnnnnnnncctgatctatcattatttgacatggcggtctgcagcgtagaactcgtttgcatccccgattggtcatgtaaaggggtcacgcaaatgggcaacaatgagtatcactcaacggtggggcccagtcaagcaatccaggaacatcaagtgagtagtccaaaagcagctcgggtcaattggaggtagacttgtttgagtgagactcttccggggatgccgaaaccacgcttaagtgacggccacccgggggtatagccactcgaatgatgggtgatggcaagagcaataaatagaatcggccgagagaatcgatgcgcgatcaagcaaatggacatgaagtgaatgaagttggtcaacgaggtccaggcattcccgctggaggtcctggttgatatcacatgtgcttctgtggtggggtcagctttcttgggggtggggacagcaacgccttcttgggaggaggcggggaggcctnnnnnnnnnncggggtcagctttcttgggggtggggatagcaatgccttaagggtggggcgggttacgccttcttgggaggaggcggggaggccttcttgggaggaggcggggaggccttcttgggaggaggcggagaggttttcttgggaggaggcggggacgccttcttgggaggaggcggggacgccttcttgggaggaggcggggaggccttcttgggaggaggcggggaggccttcttgggaggaggcggagaggttttcttgggaggaggcggggacgccttcttggggggaggaggaggggacttctttgggggaggaggaggggacttcaatggagggggaggannnnnnnnnntcttgggaggaggcggagaagatttctttggggggggaggaggggacttctttggaggtggaggaggggacttcgatggagggggagga

SEQ ID NO: 40249 - DNA, 61 bp, Chlorella protothecoides
tcctcctcctcccagccccgaggatgcctcaccgccgcccccctcccctaagaagaattct

SEQ ID NO: 40250 - DNA, 8686 bp, Chlorella protothecoides
  modified_base (618)..(627): a, c, t, g, unknown or other
  modified_base (991)..(1000): a, c, t, g, unknown or other
  modified_base (1289)..(1298): a, c, t, g, unknown or other
  modified_base (1368)..(1377): a, c, t, g, unknown or other
  modified_base (1607)..(1638): a, c, t, g, unknown or other
  modified_base (1832)..(1841): a, c, t, g, unknown or other
  modified_base (2247)..(2256): a, c, t, g, unknown or other
  modified_base (2325)..(2356): a, c, t, g, unknown or other
  modified_base (2412)..(2421): a, c, t, g, unknown or other
  modified_base (2588)..(2669): a, c, t, g, unknown or other
  modified_base (2796)..(2805): a, c, t, g, unknown or other
  modified_base (3154)..(3163): a, c, t, g, unknown or other
  modified_base (3727)..(3736): a, c, t, g, unknown or other
  modified_base (3806)..(3815): a, c, t, g, unknown or other
  modified_base (3974)..(3983): a, c, t, g, unknown or other
  modified_base (4327)..(4336): a, c, t, g, unknown or other
  modified_base (4669)..(4678): a, c, t, g, unknown or other
  modified_base (5963)..(6025): a, c, t, g, unknown or other
  modified_base (6242)..(6251): a, c, t, g, unknown or other
  modified_base (6371)..(6380): a, c, t, g, unknown or other
  modified_base (6500)..(6593): a, c, t, g, unknown or other
  modified_base (7065)..(7074): a, c, t, g, unknown or other
  modified_base (8039)..(8048): a, c, t, g, unknown or other
gcgcgacgcggagcgcaccgccgccgccgcgcgcgccgaggccgccgaggcccacgccgagctggacgcggcgcacaagcggctgcgcttcctggaggacgagttggaggaggcgtgctccgcgcaggtcatcgagactggtgagtgtgtggggtccgagggggaaaggcgtggggaggttgggaggggggaggaagtgtgggaaagggggcgaggccatttggctggagaaactcgcaggcatttcgtgcctggggttgacgattttggagtacctgcggtctctgtggcccgagctgccctgccaatcaagccacggtcaaactgaagcgtgttcaaccgattgcatcccctcacaggcgcccaggaggaggttgtggagctgcgtgccgagttggcccaggaaaggacggcgcactcccagaccaaggcccaggtgcgtaggggctgcgtagaaggggacttgaggggttcctggggtctcctggagaggctttcaacgtgtgtgagggcttgaagctccccgacgaggtagcgcaatgggggccagtcgtcagcgcgaccagctttgggccgccacagagacttggcctcacctgaagcaccctcccccccccnnnnnnnnnntctggagaggcttccaacttgtgtgagggcttgaagcccccgacaaggtagcgcaatgggggccagtcggcagctcgaccagctttgggccgccagagagacttggcctcacctgaagcaacaccccccccatcaaaccaccattgcagctggccgaggaggcggccgccacggccgccgcagtcgcagacgccgctgcgcagttggagcgtctgaacttggaaaacgcggagctgcaaaagcgcctcgctccgccggcagtggagtacaaagccctgcctgctacggctgacgagcgagtggcggaggaggcggccaacgatgcagtcattgggactggtcacgagcaggttgctgatgctgnnnnnnnnnngacgaagccctgcctgccacggctggcgagcgagtggcggaggaggcggaggatgatgcagtcaccaggactggtcacgagcaggttgctgatgctgactgggcggtgatcgaggaggcaaatgtgggcgagaacgcggttgagccgggggctgaggacgcagaggcggatgagccagccacagagacaaatgaggaggatgaagaggcggccgcaaagcggggcgacggctgtgctgctgactcaggcactgctggccgtgtggaggaggaggccaaggtcaccaagnnnnnnnnnncctgggccctgaatgggtatcccagacagctaaagaccattccattaaagacaagatgccacactggatnnnnnnnnnnggatgtgggcgaggacgcggttgaggcgggggctgaggacgcggaggcggatgagccagccacagagaaaaatgaggaggatgcagaggcggctgcaaagcagggcgacggctgtgctgctgacttaggcactgctggtcgtgtggaggaggaggccaaggtcaccaagcaaggagcttgaaccatttttcactaccagggctggagcgcacagagtttggggccgaggnnnnnnnnnnnnnnnnnnnnnnnnnnnnnnnngccattgacaccacactggtctgtgaccgtgcaccatatcaggcagtgttgaagaggtgggataggaaatgagagggccatacctccgagccttgcaggagcagcatgccttccgttctttccagcaacgatcattttgaaatccatgaacctctccgggtgaaggcatgcgcggctggattgcgcttcccaannnnnnnnnngctgggccctgaatgggtatcccagtcagccaaagacctttccattaaagacaagatgccacactggatgtggcccatttcccatattatgacctgttaccattgacaccacactggtctgtgaccgtccatgatatcaggcagtgtggaagaggtaggatagggaatgagagggccatacctctgtgccttgcaggagcagcatggcttccgttctttccagcaacgctcatttcaaaatccatgaacctttccgggtggaggcatgcgcggctggattgcgcttcccaacaccgcgtcgaggatgctagagcactgaaatgtcatgttaatcacatattcaacgtccctcccatccacccgggctctcatgggggatcgcggaggtatcatgcgtctggcaggnnnnnnnnnncattcatcgttccacccatctacccgggctctcatgggtgatcacggaggtatcatgcgtctggcaggnnnnnnnnnnnnnnnnnnnnnnnnnnnnnnnnacatgacctcgcacaacgatatggctgagcggtccatcattgcgcgtggagcatcnnnnnnnnnngcaagtctcatgacaatgggaagccatgctgtcatgaacgaaagcgacttggctgttaacaaccatttcgtggtgtctgggtgagtggcctgggcaaggcggcactgtcatgcatgaactcgcacaacgatctggttgagcggtccatcattgcgcgtggagcatcnnnnnnnnnnnnnnnnnnnnnnnnnnnnnnnnnnnnnnnnnnnnnnnnnnnnnnnnnnnnnnnnnnnnnnnnnnnnnnnnnntgcaggaaactcaccgctgacgtgatgccaggcactgatgcctgctatacgatggcgctgagcctgctgctcaccaacggcgaggtccaaaccacgagtcccaagccggtctgtctgaaacttggtnnnnnnnnnncctcgccaacggaaaggtccaaaccacaagtcccaagccggtctgtctgaaacttggtaaacttggcgcaagtgtatcctttaccgacatcatctctgtccagccctcagaccaaggcagtgacacccagcccctggccctcctggtcgacctggaaggtccaggtatagatggtccctcccagccatgcagctcacgccggcggttgctgccagtggacggctgggcagccctcgacgtgtccttggacgtcaggagcctgcacggggcgagcgatctgtctgggccttggagttgcgtggacgtcttcgagtatacgagagagctccagtgcagaccagcctggacnnnnnnnnnnggcctgcatggggcgagcgatctgtctggggcttggagttgcgtggacgtcttcgagtatatgagagagctccagtgcagaccagcctggacagaagccctcgcctatgcgactggagagcgctgcaacaagctcgagcgcccctcaagccccccagactccgcagatgagccagtcagcgcctgtctggccggatccaccccaggctgggctctaggcacccacctcttcaccctgctggccggcgcggcgctcgcatctataggcttcagggctcgatcaaccactgggtcttcaaaacaagtacagggacccagcagcccggcgcccacgcacacagcaatgacgtccagctgcagcaaggcagtcgtgcctccccctgcgtggtcagcctcgtgctcggaccgagcgtcggacttggcatccatggccgccgcgccgcacaggcccgccaccagtgcctggaccaggtgtgttgcccaggtgtgaagcctgcagcctggaacttgtttcctcttccagctgatgcatgcctcctgcctcgcttgcacgcaggacatcatnnnnnnnnnnacggaccgagcgccggacctggcatccatggccgccgccccgcacaggcccgccaccagtgcctggaccnnnnnnnnnngccctgacacccccgctgcacccaccccaaaaccccccgatgctgccccagggatgcaggcaggctgcggcggggcggccggggcaaggacaccgccggcacgccacgattaggcgctggcggcaggctggctgatggaacgatgcaccgcagcctggnnnnnnnnnnaccctgaccaccccgctgcacccaccccaaccccccctcatgctgccccagggatgcaggcaggctgcggcgtggcggccggggcaaggacacggccggcacgccacggtcaggcgctggcggcaaggtggctgatggaacgatgcaccgcagcctggacgctgaagagtgaccccagcatcggcgctggctcgccacggggcaggctcagcccctcccgctggccccatgcccttgccctgcgccagacccgtgcagggtcccctgccgggccactgctccccgcactcgaccggtgtaccgcgtcatgccccggtggaagcagtgaggtcaggtacaggggnnnnnnnnnnccccctgccgggccactgcttcccgccctcgaccggtgtaccgcgtcatgcctcggtggaagcagtgaggtcaggtacaggggtgcaggaggaagagcgcaagcatcagcggcatggggcaagcgaaacccccggaggtggcagcaaggcggctgatcaaggttggcagggcggtctggaggcctggggcgagcgtggccccaggcagcacagctgggcctaaagtcccctcatgcgccggcgcagtcccctgggggggcccaagggggcccagcagcgggcccccgcgtgtacttgacggacatgccgggcacgagggcgtgccgcctccgnnnnnnnnnngggcagcacagctgggcctgaagtcccctcctgcgccggcgcagtcccctgggggagcccaggggggcccagcagcgggccccccgcgcgtccttgtcgggcatgccgggcacgagggcgtgccgcctccggcgcacgtctgaccagacaccagctggacacctcactcgctcagagcacggcctcccagactgcaaaattggggcccgaatgcagcagcttccactccttctggcccacgtccaccttgtcggaggtgggggaccaatcccccggcccaatcttcatcgccaccttcttgtcgatgatggcggagtagaggtcgccgtacgccttgtggatcttgacctgccagcatggtttccaatgggggggcggggaggtgtgagggcgatgccgcggagacgacggcagtatcttacatgcagagaagcgcgtcgccctgggctgctgctttcccccggccaagaagggctgcacccccgcccaagctcccctaacttcggcagcccccctgccccacccagtcccaaccaacatcatcccctccacgcctctccacctcccttgccacccccccaccacacacacacacctccgacttgttgttgatgcggaagcgcttgcggatggcgatgagcttggtgatgtgctcccgcagctcgacgtcgtagtacatgtggtcgtagaacacgcagggcgtgccgcagtgggtcagcaggtaggcgtacccctgcgccgcgtgctcccaggggaagggccagtgctgcagcgtggaccccgtgtcgtggttctccaggaaggtgatggcgcgggagggccagatgcccagcacgccgggcggccgtccacgcgagtcgataaggcgccagtactcgcgccgcgtgacggcctcctgcaggatgcccttgagcgtgaagtcgaaggccgccgcggtcgccccggtggcgtcgcaccttgagaacaggaggggaggcgagcgggagtgagcgggagctgctgggacgggatgcggccgcaggtgtgggtgtcagaacgcagcaaccccgcaccctccagcacgccagcgcaccagtcgacggtgcgctggcggtgcgcgtcctggttgtagttgagcacgccatcggtgtaggagcaggtgtcccagtactccccaaacgccatctgagggaccgtggcgtccacatagtcccgaacgaagcgcccctcgtatccctgacgcacagtagtaatgtatgcaggggtgggtgggtcatggtggggcgtcggaacgagggctggggtnnnnnnnnnnnnnnnnnnnnnnnnnnnnnnnnnnnnnnnnnnnnnnnnnnnnnnnnnnnnnnntcgaagcgccacccatcaaagccgatggagttgcggaggtagttcatccactcgatcaggcccttgtggaccctctcctgcacatccatggggatggaaggaggaaactagtgttttctggaccggggcgtttttgatacatgcccagagagagcagtgccgtccgcccatgcccttctccaacacatgcccactcacgttggtgtggtccagattnnnnnnnnnnggacatgggaggccgtggcaggaaggctggcatgccctcttttccatgctgcacgacaagcagaaggccgtggtgcgttggcagccgccacccggcgacaccagcccaccttgacgtagnnnnnnnnnnagacttgggaggccgcggcaggaaggcgggcatgccctcgtctccatgctacacgacaagcaaaagaccgtggtgcgttggcagccgcgacccggcgacaccagcccaccttgacgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggatggaaggaggaaaccagtgttttctggaccggggcgtctttgatacttgcccagagagagcagtgccgaccgcccatgcccttctccaacatatgcccactcacgttggtgtggtccagattgggcgctgcagggtagtcgtcggtcttcttccacgccccctttcccccataggccgggttgttggagcagatggccgtcctgtcccaagccaggcgcccaccaaacttgttccacttgccatcgtccccctggaatgaggtgtgggtggaggggctcgagtggtgtgtccgtgtcagttggaactttgagcggtttgtgggattctggcactgccatagcaacccctgcacagccgagccaatgttgccaacaggcagccagggtgcggtgccggctgcacatccggcgtcatggtcgcacgcccatacaccgatgtgccggcggccactttcacccgtccccannnnnnnnnngggtgtgggtggaggggatcgagtggtgtgtctgtgtcagccggaattttgagcggtttgcgggattctggcactgccgtaggaagccctgcacagccgacacaatgttgtcaacaggcagccagcgtgcggtgccggctgcacaaccggcaccatggtcgcacgcccgcacaccggtgtgccggcggccactttcacccgtccccaaacaccccccccctcacgaacagacacacacctggtagtgtgcgcagcggtggttgatgacgatgtcggcgatgactttcagccccacctcatgcgcgacggcaatgcagtcgcgcagctccgcctcgctgccgtacttggagttgaggtcgtagaggtcgcgagggaggtagccctgcggcgacaccgcgtccgagggcggcggcagccagacggaggtgaacccgacctcggcggcgcggggggccagggccgccatcttcttccaccacgcctccttgcacgactcccagttgaaggcctgcaggatgatctcatatccgttgcccgcagcggggcccgtggtctgcaccgtctgcggcttgacaaagtcggggacagccaccgaggactgcagcgcgcgctccagcagctcccgccggctggtcaggatggcctccatggccgccatgcgccgctccagcagggccgaggcctcgtaccgctggctctgtcgttaggtgttgtgggggttggaggggtaagggggactgcgcatgagagaatcagggtgacaaacatcaggtcatgagcagtgtcgccgaaattcaggctggagcgcactatcatccctctccctccacccaatctcaggcctgcaggtggctgcgctatcccctgaccaggctcggcacctctggagtaccccatggaccccccttgaagccacccacccaacccacccaaaccctgataacccgcctgcttggccaggaggnnnnnnnnnncccaggctcggcacctctggagtaccccatgaccccccccttgaacccacccacccaacccctgataacccgcctgcttggccaggaggtcgttggtgctgacttcatcccccgcagcgatgatctcccgctccacgcccaccagcgcctcggcggcggcggccatctcgcgcgccgcgctctccagcgccgccgcatcggcctcggaggccacggccttgagcgcgcgcgcgtccacgtccaccgccgcgccgtggatgctgggcttgctggagcgcgtggtgtgcagcagcacacgcagcagcgcgtcgcgcagcggcggccaggcgtcggccgccactgcgccgccggcgcgtgtggtaaggtggtacacgtcgccgccgccctggctgccgatggccgcggagcggatggacatgccctggtctgccagcacctgggccacgcgcgccagcgaggcggcgtcccgccggccggtcacccgcagcaccgtctggccgggggcggcctcgttgtccagatccacgctagggccctcgccctcgtccatgctggcggtggccagcatggactccacggccgaggcgtgggcggggcgggggagcgggcgggggggaaaggggaggggcgaggaccgc

SEQ ID NO: 40251 - DNA, 61 bp, Chlorella protothecoides
ggatgggcggggaggaaatgagcggcagggtggccgctgaagggggggggcaactgaggag

SEQ ID NO: 40252 - DNA, 68 bp, Chlorella protothecoides
cccctgcatcagggcatcacggcccacatggcgggctcgctgagcgccgaggagcgcaagggcccgcg

SEQ ID NO: 40253 - DNA, 337 bp, Chlorella protothecoides
  modified_base (85)..(276): a, c, t, g, unknown or other
tgatggggaaacggagccagtctagctgcagggagtttttggtgggagcattgtttgattgtcaatggggagaggccagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcacgcatgctcttgcgctggacgcgccctcctcccactcctcacgttctggatgaggg

SEQ ID NO: 40254 - DNA, 73 bp, Chlorella protothecoides
cttccgcaccttggccaggctgccatcggcgttaatctcgcccgggaacaggttctccagctcctgaatgagg

SEQ ID NO: 40255 - DNA, 80 bp, Chlorella protothecoides
gcgggagcggggcgcgcagctgcgttccacgcatgccaatcatggcgcatccggccccgcaatctcgacggtgggttcca

SEQ ID NO: 40256 - DNA, 61 bp, Chlorella protothecoides
cttttccaggcccagctgttgcagggatcacccccttctccgaatctcgcaggcgcggccc

SEQ ID NO: 40257 - DNA, 16155 bp, Chlorella protothecoides
  modified_base (230)..(239): a, c, t, g, unknown or other
  modified_base (1053)..(1062): a, c, t, g, unknown or other
  modified_base (1647)..(1656): a, c, t, g, unknown or other
  modified_base (2466)..(2475): a, c, t, g, unknown or other
  modified_base (2633)..(2642): a, c, t, g, unknown or other
  modified_base (2701)..(2710): a, c, t, g, unknown or other
  modified_base (2784)..(2793): a, c, t, g, unknown or other
  modified_base (3681)..(3690): a, c, t, g, unknown or other
  modified_base (5416)..(5425): a, c, t, g, unknown or other
  modified_base (5619)..(5628): a, c, t, g, unknown or other
  modified_base (6468)..(6477): a, c, t, g, unknown or other
  modified_base (6932)..(6941): a, c, t, g, unknown or other
  modified_base (7259)..(7268): a, c, t, g, unknown or other
  modified_base (7946)..(7955): a, c, t, g, unknown or other
  modified_base (9817)..(9826): a, c, t, g, unknown or other
  modified_base (11287)..(11296): a, c, t, g, unknown or other
  modified_base (12769)..(12778): a, c, t, g, unknown or other
  modified_base (13097)..(13106): a, c, t, g, unknown or other
  modified_base (13173)..(13182): a, c, t, g, unknown or other
  modified_base (13354)..(13384): a, c, t, g, unknown or other
  modified_base (14317)..(14326): a, c, t, g, unknown or other
  modified_base (14899)..(14908): a, c, t, g, unknown or other
aacctcacgcatgggcccctgttgaaggggaggtgaggaagggagtgcgtacctcgacggctgtgtgacatcatcatggtggtataccaatgatgtcctcagtgaatgcacttggaggccagactctgttcacaaaaggcagctggtatttgttcagggatcgatgcctgctgcttcctagccaacaatgtagggatcatgtccaactacaactccactggccccatcgnnnnnnnnnngtttgttcagggatcaatccctgctgcttcctagccagcaatgtagggatcgtgtccaactacaactccactggccccatcgccaccccttcctcaccctccactcgagtggtcacctaccagttagtgaggttccaggcagcattctgcatggtggaggccccaactgtcaggacgccggtcgcgttcccaggtgagcttccacatgcctgagagccctcgttgccggccgccacgacaacaggtagctggaattcgttcaccagccgggtagcggcgtcggcgagggcggaggagccggtggtggagcgcagagagaggttgaccactgccggacgctgcgcattccgtgccacccaatccagaccctgtaggcattatgcgggcgagcaggtgtcaaagatggaggaatgaactgcagggggttgagaataggtctccagttgccctggaaagcaccgcctcacgaacaacagacacagccgtacaacaaaggcccatcgccatccccaggcaactccactggcctgcaggagggcgaccacgctggtggtgccatcgcagtcgacggcacgcaccgaccacagggtggtgtttttggcgaccccaaaggtcagcccacccaggagcgctgcattgtgcgtgccatggccgttgcagtcattcgcgtcgtcgtcaccaaacactgcggcagcgtggttgcatggggcttgtgtaggtccgtgagagtccagccagttcacgcaggaaggctgcgcctcccccgcaatcaccccacgaccaggcaaagcccagacagcaggcctgtcgccannnnnnnnnngggtccgtgagagtccagccaggtcacgcaggaaggctgtgcctcccccgctatcaccctacgaccgggcaaagcccagacagcaggcctgtcgccacccaagccagccggcttgggcccgccaccgacgcaccagacatggcgggcagggcacgggacgcgccagttccgtctgggaaggacgcaaactccctgtgagacagtctgatgccggtgtcgacgatgtatgcattcactccagagcccagggccgagaaggcatagtctgcgggtgggctcatccctggcgaccacctgcggcgattgatgcgctgcaggggccaggcgggaccatcctgagtccacagggagccacgtgtggacagccgtggtggggagtaggacagtagggtcatttcactggacttgctcacaagctctgccgtgtgaagctgggtgttgtcctccatggactggatgtcactgccatgcgaagagcgcaggctttcctgatcttcctggtccagcatgcctgcaggaggaatgagagtcaagctgaggccgtgaaggattccttcccgaacggtcacccacggctttgagatnnnnnnnnnnctcctggtccagcatgcctgcaggagaaatgagagtcaagctgaggccgtgaaggagtcgttcccgaacggtcacccacggctttgagatgggggttctgggcagcccccatgaccctataacctcacccgcaaagcctctgataacagaggtgaaaacctgctggcactttgccgcagaaagggacttcagctcgttgcagatgtcaatcaacaactcaatgctgacagagctcttgaaggatacaataacctctcgacttggactggatctacgagcaagcgtgaaaagtctggtagtgagcttcaagccgcagcgcacatgtcacgacgcggatgaccggacctccatgcatacggcgtacccgacagagctcgacgcaggggctgacgagctcagggtcctggcctggcttgtagtaaagcatagaatgaggagtatggttatcgttgaccagagtcttgtatggagatgccggccagagtgaggcatcctcgtctcccggaaggttaccatgccaacagattattcccggggagctcgcgaatccctacataatgttgtatgtctgagaataaacccttgagatggttctttggagcttgattttgagaagctcgctccagatcatggggttttgattgcccgaggtcccttccggatctcccaagcaacgaggcccacggcaccgccgtcatcggaggttgctgtttcgagggcacttttaacaaagtgaaacaattaatgcagggttcggttctcaaaggggggcctcgactctctagcccctcctagtcaaactccagctcnnnnnnnnnngccgtccggatctcccaagcaacgaggcccacgccaccgccgtcatcggaggttgctgtttcaagggcacttttcataaagtgaaacaagtaatgcagggttcggttgtcaagggggggcctcgaccctctagcccctcctagtcaaactccagctcnnnnnnnnnncatgtctgagaatgaacccttaagaagattctttggagcttgattttgagaagctcgcnnnnnnnnnnaatactcatcgcatccacttgacattgtaatccgttcgggcaacccccacctcgacacttcgtccccgcagaannnnnnnnnnatgtgggtggatggctcttttgaggggcacaatggagagcttgttcacatcccgtggcatcgccttgcgcatgtctgcaatggtcaccgcaagagatattgtgggcgcttggatatgatactcatcgcatccacttgacactgtaatccgttcgtgcaccccccacctcgacacttcgtccccgcagaactcacccagggcatcctctggggaaggcccactgtagtaccccagcactctcctgtacacgctgtagccaaatcgctcatacatgaggattgccgctgcattgcttgctcgcacaaagaggtcaacgaagaaagcgttgtgcctgcagcaccagcaggcggtgcaacaagaacagtgagccaagattgaagatacaattgctgctgctggtgtccaggcaagtcaatctgctccaccatggccatcactcacatcttgatcgtcgtgtcttccaaaatctgcataagctgctcggcgagcttctgccgacgaaacacgggtgcgaccgtaacggctgtcacatgtccatgccagtgagggccgtctccctccaccttaccaaggactacggtgcattgaaggaagcgtgtgtagggctgaaagcatgtaaggagggggaaacgggagatcgaagatggcaggacatcagctcaagcggtgtcctgtgttgtcgtccaaaaactcactgtagccctggaccacttcgccgggtgcggtcccacacaagcagtattccggccagcgagccaggtattgcaggtagaatggcaagtgatactacatgatagtaggatgcgggatggactgtcgcaggggagagtcactgagcaacaaggtggaaatcatagagagctcatgcaaacacctgaatgcaatcgnnnnnnnnnngagagtcactgagcaacaagatggaaatcatgaagagctcatgcaaacacctgaatgcaatcgccataccatcgcagactggcatatgcgcaccgtttcagtgaagtaatccagattgacattgttgaaagcaaagaggtcatgcgccgagaagcgccggaggcaggtcatcctgcctgcacaaacgctaagaattcactgttaatccgccgatgcgtgctgggcgccgatgaatctactggttgtgtaccaatcacgcatccgacggacgaaggcgaatcggcttgactctcgttgacgctccctcgtcgtctacttcgacatggccgtgatcctccacccacggcgcgcgaaaaccgaggacagggcgttgagcaaagtatgtgtgaagtcccacgcaagattcatatccgtgcttcgaaggactttctcgactgcattagatgactagtagaccttcggcaagacatcatcgcgctgtgaacttcctcgactccccccgtgtgggggattgcggactcccgtgtgggactggtcctcatctcaacgctcttccctgaaccgggatggtatcacagaatgggtcccagtctcggaagggtaaagcaccctccataccagccgagtggaaggtggagctgcctgaggaagggaatcgcggcgactctatcttcggtggctgccgcagtatagaggctggctaccaaagggagtttgtactggggcaaggaacctatggagaggtatgtgggtggctgcacgccagggtgtggcttgctatcgtgtcgcggtccatggattcccgctcgatgtggagaattagagtcccaggaaagcctgatgtctcactttgcacaggtgtatcgggccgtcgaccgggctactggagacattgttgctgccaagaagataaaaatggacaatgaaaaagaggggtttccgatcactgccatacgaggtgtggagagctggcggccgtgtgctggagttcttcgcagttggccaagtgactaagtgctgttatgagacacaactccgtgcccttccgctgcagctcacaatgccccttactcatcccacagaaatcaagatcctgtctgcgcttgcccagtcaaaggcagagatcaacggcaagatcctccgaaaccatgtcatcactttgcgggaaatcgtccgatcaggaagtgagaggggcctgtgcgcactacctttccctcaatcgacgaattgttaaggccaacctcagtccttgccgcacactctgtgtcaagggaagtgtcaccctgtatggtgacaattgttgcaagccaccaatgttccagtctccctccgtgcatctccctcgcaggccacaagtgcaacaacttcaggggttccatctacatgatctttgactacatggaccatgacatgacgggtctgctggcccggtcgcagcgggagggtcctccattctctgtgcctcagatcaagtgctacatgcagcagctgcttctgggtcttgcactcctggaaacaaacaaggtaattgaaggtgggggcagtgtcatagcaacgtttagcctttcaatgttcacctattcccacagaggcgcaagccccggccgctctctccatggcatgtggttgttgctatttggatggatcttgtgagagggtcgaggtggtaaggagggcaagctgcgcccaaggcgttccagcaacgcccccccccccccctccccannnnnnnnnnagcagtgtcatagcaacatttagcctttaatgttcacctattgccacagaggcgcaagcccctgccgctctctccatggcatgtggttgttgctgtgcttggatggatcttgtgagagggtcgaggtgttaaggagggcaagctgcgcccgaggtgtcccagcaacgccccccccccccccccccccccccccnnnnnnnnnntccatacggaactctcccaggtgctacatcgggacttgaagaacagcaacctcctcatcaacgatggagggatactgaggatcggggactttgggctggccaggtaccgcccccaaggcgaggaggacgggcagggaaatggcgcgaggatgactaatcgtgtcatcacattgtggtaccggtgagtggtaggcatggtggaagggggaagtgggcatgcatgccgccttgagctctcccgctgctacaagcctagggcatcgtcaaaggggaggcttgcgccgcgtcaactcagcttggctcatgcgaggtccaagcatccttccctcgcaggccgcctgagttgctcctgggcgcgcagtcctatggcccagagatcgatatgtggtcagcaggctgtatcatgtttgagatgctcacgagcaagcccctgttctctggtgaggtggggcgagctgttgtttggagccgaacatgaggccaaggtttggaaatgtgcacatgccgagacgcatgaatgctatgtggggcatgcaggaatggagactagtctgccagtcgacgatctgggttgcacattgttgtcgagccccccattccccctcctacacctgctagccaatgatgagcttgggatgtgtgacaagatcttcagcattgttgggaaggccaatgagaaaacaatgccgggctgcaccgccttctccaagtgaggcgtggacaagggaatagtgtgctgtgtggctgtgagaaaggcatgcagctcgaaaatgaccgactgtgtgtctctccaggataattgccaaacctccggcctcattgcctgctcccacctggctnnnnnnnnnnatgtggacaagggaagagtgtgctgggtggctgtgagaaaggcatgcagctcgaaaatgaccccctgtgtgtctccccaggataatgccaaacttccggcctcattgcctgctcccacctggctcgaggtctttgatcccccctcccttcctgctcgtcacctccatgtccgcagctaccagcacatcgacttcaacaacgccaagtaccccaacaacagccggctgcgccaccatcttcagaacagcagcattatggatgctcaagtgcgtggcgagcatgcctggctgtcagagtgggattggtacgatgatgtggtgcagactcctttctgtatcctttggatgtgcagctcagtggcagccccacacctttcgcaactcaggccaaggatctcatggagcaaatgctcttgctggatcctaagaaacgcatctctgccaaggaggctgccnnnnnnnnnntgtgatgagcatgtccggctgtcagagtgggattggtacgataatgtggtgcagactccttcttgtatcctttggatgtgcagctcagcggcagccccacaccttttgcaactcaggccaaggatcttatggagcaaatgctcttgctggatcccaagaaacgcatctctgccaaggaggctgcctcggtacgggggtgtagggcctgcatgcccctgcgaacagccacacaccgctgctggagctgaggcatgatgatttctccactgtctgtgcgattcaccctgcctcctccatctccccaaccttcgcacagcnnnnnnnnnngcggggggtgtggggttctgcatgcccctgcgaatagccacccactgctgctggagctgaggcatgatgatttcttcactctctgtgcgattcaccctgccttctccatctccccaaccttcgcacagcacccctggttctacacgcatccgctgccgatggagccgcacaagattcccaaataccaatccagccacgagatgagcatgaaacgctccaggcaggagggagggggcgcagggaggggtcggcaccccccccaccccgggcccccgtccggcaagcaggccaggctctccggccccggccaggccccgcaccccgggcagcgtgccggaccccagggccggggacccggcggggctggccccgcctcagcgggcacgtggcaggcctacccccctcagcagcaggtgccgctgggcgggcagcacccggggcaaccgcccctcaggccgctggtgcatgccgcctcgggcgcgccgattccgtaccccgccgcggccttcgtccagcaaggcgcgctgccgggtcagcagcccgggcgcggccagcacccggcgcgagctccgctgagtgtgggcggcgtgcctcctcccccgccagcagctcccatgcgcggcccgccaccgggagctgcgcccccgccgcctgccgcctggcagtcgcagcgccgannnnnnnnnnctgcgcggcccaccaccgggggctgccccccccccgcctgccgcctggcagtcgcagcgccgatgatggcgccgagggcgtggatgcgggcccaattttccttccttggcgcagacatggtggcgcgaggcatgcgccatcatggtgcccagtggtccatgtgacttgctggctctgccgctcgttgcacatggcggtcactggctgagcagccagtccactgcggcagcaaagtctggcaccgtggcgtctggggcggaggccgccggcgcaccgaatccctcgtcccccagctggtacttgcctgtctgcaccaggacccccgctaggcccgctgcctgagcgccctgcacgtcatcccgcacgtcatcccctgcggagcagggcagggtggggggcttgacagcagcgctggatggaggattgccctgcgctgctgacctggcatgaggtctgccctcgcagtgcatcgcttgatgcgagcattttccagagttgttaggctgggcaggcaggcaggcgggccagtgcctgcacgtgatctgccaccccgcactcgggaccagtggaatgaaaggcctgtgaagggaacagcgcacccaccgatcatgacagcgtgctccgaggccacgccgaggtggtccagcgctgccgcgaagaaggcgggcgccggcttccccaccacctgggcggtcctgcctgcggccacctccagagcagtgacaaacgggcccggccccagagagagaccactggcctcggcaaacactcgtccacggtggatggcaatgaggggggctgctggctgggcatgcaggagccggaaggcgctttgcagggtgagaagcatggaggcgtgacttgtccacagggtgcatggaagaacacgttgacgcagttcaaaacgggatcctaaaatggtgcccaacatggcgtgcaaagaagccgccacagatcatgcccaagtcctattaaatgatcacccctcccaggagaggctccaaactcctcgtgacccagagaataacatccacattctgccacgcaccgattcaggctgtcgtagttgaaggcctctcgggccagacccaccaccacagcgttaggatcatgctgggggacgtcgtcaaactcgggcagggcacgtcggtccaggagcagcaaggggcgcaggtcacgctgtttcaggagctggcgggttgcagacagggacgagaacacctgtggaggcgaccagggaccctcatggacagggagatgccagtcaagcaggggttgcatgtgaaatgctgctgatactcctgagcgcatggcagataccccgctccagatgctaatgggtccatccccacaacctcgtccttggagatgccaaagccaagggtttgcagtgtcatcaccagactgtccacggtgtccttggtcgtgttggtgacaaatctgcacggcagctgcgcggcgcgcaggcgctcaagagctgccacagcccctgggatcgcttgcccatcgatgtggagggtgccgctcagatcgatgagggcggccttgaatcgcatggccgatcacagagcgtcagcagtgggggatgaggaggaagaatgttttctcatccccagtacaaataatatgcgatgctctggtatcgatctccgtgtgaaacccggaaacacatcgagatttcgggtttcaagtagccgctcgctctgtcgggaacttgcagggaatgttcgaagtgccggcgttccatcaagatcttactctggctacccaagtaccccgctcttccgtcagactaggatatgcgcttagcgccgcttgagcaagtgacagaatcaccacggatagaaggtgcatccagccannnnnnnnnngtaggatatgcgcttagcgccgctcgagcaagtaacatgatcaccacggatagaaggtgcatccagccagactggaacgagaaacatgccctcccaggatgacccaacaactctaacggaaggcggcggtgaggaacagtacatgcgcattgctcacattcaaagatcatgtaatctccttgtgttgaacagcgatggtttatctcctgtacttgcgagctcaaagtctggatccactccgtctgcacatgcagtaagatgatcaggctgtcaatcttcagcaatgcctctgaggtgacacatgaaacagtgggccagctttgacagggcagggccaccccccgcctacattctcatacgccaaggaggtccagcttgctacagcagcatccaggtttccccccctctctcctcctcatcactcacgccggcacatcgaccttggccttccagtcatacttgctgttcttgacccagcccacccgcgagcgcagcgcgtccgcctcctcgggtccacgggaggagtaggggtatgggtggatgggcacctcccccgcgtccacggcgtgtagcaggggcgtgaaaatggcccaggcagcgcgcagctcgtcgcggcgcacaaagtgctgctggtcgccgcggatggcgtccagaatgagcttggggtaggcatcggggatgatgacgtctggatatcggctgtggtaatcaaggtccagctcggagatcacgggctccgtgtccagtcctgtgtgtgtggaggagggagggaggttgccggatggggcgggggggttgcgtctcagtgcatagggtcgagacctgctgctctcaccactacccctccacagtgccaagcaatttgccagtcgacacccttggtgccatgaatcctcggcgctcttgtttcccctcgacacaaagcgtctcgtgccaccccacccccccaggctgagctctcccacgccgcagacctggcttcttcacgatgaacttcatgtagatggcctcgtcaggctgcagccggaccaccagttcgtttcgggaggagctggactcgcccgcaaaaatgaagtggggggtctcgtgcagttggatgcgaatctccgccttgcgctcgtccagggccttgccagccttgatgatgaagggcacgcccgcccacctgtcgttgtcgatgtacagcacaatggaggcaaaggtgggggtcctggagccctggggcacggtggggtcctctaggtacccgtcctcgccattggcggcagtgtactgccccagcaccacattgtccagggaggggggcttgatgcaccgcaggacttgcacctggggccaatgggagagggggagggtggcgtggctggcggagcatctctctgcatggcaatgaggaggctgaagccaaagggccggtgcgccgaggttgtagcacctgcacccaatcttcagcctgtgccnnnnnnnnnnaaggctggagccaaagggctggtgcgtcgaggttgaagcacctgcacccaatcttcagcctgtgccatgcccgagccctcaccaggccactgcctcaccttctggtcgcgaatgtcatccgggtgtagactgacgggcttctccatgcccacaaacgccagcagctgacgtgggtgagagtgttctcagtggtgctctaccaaccacacatggagcttaaaaaccagccaggtgcgccgtgtcactgttaacaacacactatctcccattcgggggtggttcctcccgtcagcaggctgtgctaggcatgcaggcacgcccccctacctggatcaagtggttctggataacatcccggatgatgccaaactcgtcaaagtagccccctcgcccctgcgtcccaaagtcctcctgcatgccaacaagcatatgggaagcaggatggaataaaccctcagccatgctttgcttcagtaagatccttcttggtaaacaaaaaatgcacgatgcagagcctgttcgctcacacacgcatattaagctgccagacaatcgcttctgccaggccgccattcgaatgcccatcccgtgccatacacacactaacagaagggataccttgaaagtgatctgcacgtttgccacatgcgtcctggaccacagcggcgacaggaatgtgtttgcaaatcgcatgacaaacatgttctgggtcatctcctgcatgtgcaatgcaccatggaagcgggagaggggccgatcaggggctccaggaagagaccatacggccggcatcccccgtcaggtccaagccccttgagtagcacgagagagcaaaccgccttaggacagggtctcaccttgcccaggtagtggtctatgcggtacagctgctcctctgggtacagctcccccaggtgctccgccaggtcctcagacgactgtaggtcctttccaaagggcttctccaccacaacgcgcacccagctcctgcccggctccgagctcgtggcgatggaggagcagtgttccttcaggccccggcacacctgggggtacacgctggggggaagtgccaggtagaagaggcggccggcagggttcttgggcgtggcgctctcgcgcttgtctagcaccgctgccaggcgctgccagccgtgcggggtgtcgtagggtccagagacgtaggagcaggtcgccaggaaggcctctcgcttgtcctccggtgtgtttttcaggaaggggcgcaacttgtctcgcagggcttgatcgctgaggtcggtgcgggcataccccacaatgcgtacgttggagcacaggaagctgtgtgaaagttgatggtggtggccggggaggttgtgagaaggggaccatcgattgtgtatgcaaggagaggtggtcgctagaaccacagcaggtgatcaccagccatagagtcaagctccaggcatcaaagaccgccaggacccactgtcnnnnnnnnnntgattgtgtatgcagtgagaggtggtcgctagaaccacagctggtgatcactagccatagagtcaagctcaaggcatcaaagaccgccaggacccactgtcgcaatccaatggacgagcacaagattccaagcacgctcacccatgctgatacaggaagcagagcgcggggtatgtcttctttttggcaaggtccccgcttgcacctgccggttccagggcggagtgagctggacttcgacctgtgctctcgcatgagatcacattggccaccaacccacatctcgcctgatatgatacctgctacgacgattgtgagnnnnnnnnnncgcagtcgccatcgtttttaaatcaggagggggggtggactggcgatgttgggtttgccgttccgannnnnnnnnntgttggccaccaaacccacatctcgcatgatatgatacctgctacgacgattgtgagggtcagttgtcctggcaggactggctcctgccagccgtcccgctcggaggacgaagtgatcctgcgcactaacgaggtcagcatcgactcatcctcggtgaccttcactcgggtnnnnnnnnnnnnnnnnnnnnnnnnnnnnnnnaaaaggcccgcttcacactcgctgccgtggtgtgtcgtaaagtagtcccaggttcagttcgagggcatgggacaggcgggtggatcgcaaggcttcttattgctcgatgtaggtgtatgccatgaactctgaagggttacctgcacgattgcaggctgccatcgttatgtgcgaggtgagatgtggtaatcaatagcacgaccgactccctgccgtcggcgcgcgatgaggagaggggtcccatcaatgcattgatctgcaaggcgccttttcgggaattaatgggaaggacttcaacaagtcaatcctgtctcaacgcttcatttcctggcctggaatttcgctctgccgctgccatacgccgccgcagcctagtccgcgaggctgcagtatgtcgcaggcaacgtttattgccttcgatgcccgggaggacaagagcggtaccgagcaggccttgaagacgctggccaaggtgggtgtaggaaggggtccacatagcccgcttgccgtctgctcagccttactccagggctcgcatgcctccaatacaaggctgcactggtccaatctcctcctcacaggcgctgtcccaggacccggtgaccacttggttggcggggaagagcgatgccgaggcattcatggggagcctgctggagatgctcctcacctgccacccctccacccgcttctatgtgacgcccgacttcacggccgcggccatgaccagcgacagccagcagcctgagttcgaggccgatgccgatgccatggcggcaaccatggtacatgtccctcccgagcgcgctggggatatggagaccctgttcccctccctcgacgtccagaaagacgtctatgtcaaggtgggttggaagggggggggggattgcccgctctagtgcgatgaatagcgcagatcacttagttctnnnnnnnnnncgtcaaggtgggttggaaggtttgggggggattgcccgctctattgcgatgaatagcgcagatcacttagttcttgcagcttgtctcttctgcaccgggagcacttgccccatcgcaggtcctagcgtgttgcgagtctcaaaacattgcaagcatgcttgcacggcgctccccttatgtgccacggtgtgcaagccccgccaccactccagctccaactccctctctccgaacctctcaggaccacgggcatgtcgtgcacatccacatgataggcgtccgcgtgcagggccaggggatgggtgcccagctcatccagcacatcaaggaccgggctgccaaggccgggcggggcgtgtacctggaggcatcctccgccgcctccacccgcttctactcgcggcacggcttccagcatgtgagggagcacaggctccacgaggcggccccgatcctcaacctcatggcctaccaccccgaggtttgacggatgggcagcggtggtgacagcggtatcatccagtttttctttggagctgactttcataatgagacaagcttgaaaacatactnnnnnnnnnngtgacggatgggcagcggtggtgacagcgatatcatcaagtttttctttggagctgacattcataatgagacaagcttgaaaacatactcgtggcgtttcagtcgccggtgatgttgccctgcttgacttcctgtgtggctggtgccacctcaccccgccagctttgagaagtgcccgtgaacgcatgcccatcgtcagatgaaatagcccatgaatgcaaccgtgcgccagccctcttggcgtgccaggtcctcagtggcagcaaccatagctgcctgtgatacatgccacctcccttcctccccccccgtgctcccgatcgacaagaccccccctgaaactaggcattgctccctgatgtgagtgtccagggttacacatcaaggaggcacggtcagagttgcacaatggagaaggtcgatacgcaggtgtatgggaggatctgtggcctagcagcatgaaggcctcacaggccgtcctcttgcaagggttgctgaccctggggctcctcaggcaggccctctgcttgagccgtgacggtctgctggatctgggccagggcatgcgtggcgtcgccgggcagctgggcaatcgcgccgggtgcctgctcgccctccccggcccccacccctggcccgccatctggcagctgctgcggggccagctcctcgccgaccacctgcatcccttccaccaggccgcctggcggcaggccctcctcgcctgcatgagtgtgagagagattcgagtcgggtgtggaccagactccagccctggcaccggggcacatgcgctccccatccttgctgtccctgccccaacctggattctgtgccaacctcctcaacccacacacacagtgatcctggtcgcatcgccgccccacctgccggcttcccgacccagttgttgttgtacaggccgttgctgtagcagtagttggtgtagtaccaggcgtggaggtactgcagggagttgttgcccgccgcggccgtcgcggcgtccatgtacggcatctcctccccgcctgcctgcgcccccgccaccacggcagcctgctcctccgtcagctgcggctgcgcgccctccacgcccgcggccagggcggcgaagggcaggcccaggccctcgaagtgcagtgggcccccggccaggccgaggggcccgcccagcgcgccgggcgcgggcggcacaccgacctggccatccccgccgacctcctgagcggcctgggcgtcgcccgccg

SEQ ID NO: 40258 - DNA, 99 bp, Chlorella protothecoides
aggccccaagatcgaggaggtcgactgagcggcgggtgttggtcggtggggtccagggagccggcgcacgagcgagcccaaggcggtcgcccctgtcca

SEQ ID NO: 40259 - DNA, 97 bp, Chlorella protothecoides
agggaacccagggcgcccgcgtctggccgcgcggcgccgccctcctccggccccgagcgcgcggcggcccccgcatcccgccccggcccgacgcaca

SEQ ID NO: 40260 - DNA, 61 bp, Chlorella protothecoides
gttcttccggcaccacggccccttggccggactccaacctgggcggaatgagctgtatcag

SEQ ID NO: 40261 - DNA, 864 bp, Chlorella protothecoides
  modified_base (364)..(373): a, c, t, g, unknown or other
gccgcgcagtccgacggcagcgagtccggcgccagcacgccacacctcggcgcgcccgccccggggccggcctcccgggccaggtccgagctggccgccgcggcgcgcgccgccgtgctttcctcctccgcctcggcagagggtgcgtattttgaggagggtggggcgtcagggaggggcagagacgtgggagacttcgccggggtacagggatcgtgctagggggagtggggtggaaaaggggaagtatgcatcatggcatggcggttgcatgcattgccagcgtcagagctggacaggcgatggggtcgtgacaccggccgcatccccaaagtcctacctctaccgcctcaatagcccaccnnnnnnnnnnagggcaggcgatggggtcgtgacaccgaccgcatccccaacgtcctacctctaccgcctcaatagcccaccctcttccccccaacaaccccctcccattcaccaggcctggccctgaacgccgccggcgtggcgccggagagcagcctgagcccccggcgctcggcgccctccctgggcttccccccgcgcccgccgcccctgcacgccctctttgaggcgctcagggagggcggcgtggagctggggcccgggagcagcagccaggagcacagcctgggctccagcgtgaccagcccaccggcttttcctgccggcgaggccgtcgccgccgcgcccctggccagcgtcgtgctgggttcgccaccggccaccgcgcgcctgccgccctccccgcaccagggtggagcggcgcaggcgggtgcctccatctcgccgagcgcgggcgaggtggcgcagaagccctcgccgcggcccgccgcctcgcgcggc

SEQ ID NO: 40262 - DNA, 68 bp, Chlorella protothecoides
catccacgtcggcattgccgccactgctgtactcagcgccacgctctgttgactgcaggcgggccagc

SEQ ID NO: 40263 - DNA, 72 bp, Chlorella protothecoides
gtgttgcagggcgtgcgcactcgactcagcgcacgcctcgctggctgcgtgagatgtgttgaaaatgctctc

SEQ ID NO: 40264 - DNA, 61 bp, Chlorella protothecoides
aaagctgtagcacttgggcttcgtggcgggggctgaatggctacatggagtgctgacgtga

SEQ ID NO: 40265 - DNA, 78 bp, Chlorella protothecoides
cccaccccgctccctgcgctctctccaagagttactccaccgcgcagtccctcctttgacagctcaggacaaacactt

SEQ ID NO: 40266 - DNA, 79 bp, Chlorella protothecoides
gccagagtcacctccacccagcccaccacctcctttcccaccgcccgattccccgccgccagagtcacctccacccagc

SEQ ID NO: 40267 - DNA, 61 bp, Chlorella protothecoides
gaccgctcccggccgccagcatggcagggggggcacccgatgcatgccgggacgcgacgat

SEQ ID NO: 40268 - DNA, 7267 bp, Chlorella protothecoides
  modified_base (4617)..(4626): a, c, t, g, unknown or other
  modified_base (4871)..(4880): a, c, t, g, unknown or other
  modified_base (5350)..(5359): a, c, t, g, unknown or other
  modified_base (5428)..(5437): a, c, t, g, unknown or other
  modified_base (6419)..(6441): a, c, t, g, unknown or other
  modified_base (6667)..(6676): a, c, t, g, unknown or other
  modified_base (6738)..(6747): a, c, t, g, unknown or other
  modified_base (6809)..(6883): a, c, t, g, unknown or other
gtggcccgagcgctggcgcccgacctctgcgcccggcagccggcgctgctggcgctggcgctggccctcggcgccgaccggcacgagagggtggcgagcctgggcctggagcgcgccgccgcatccctccggcagcgagcggatgcagagggcccgggcgcggcggcacgagacgcacccgccctggcggcgtgcctggcgggcgcgctgcgcccgacccggcccttcaaggtgcagtgggcggcctgcggcctcgcccgggccctgctggaggttcgcggcagcgcaggtgaatgcgtggccgtgccagccccggatctcgttccgccactgctggagggcgccctatcctcccccagcgagcgcacccgggcgctgtgtgtggagctgctcaggacggccatcccccagatgacggggggcagtctggtcctggtcctgcagcgcctggcaggggcgcgccagggccgtcagctcgcaggcaagcttgcggggggtggcaggggtggtgcaatggcacagcagtggatgcatgtgtctgcgtgtgactgtgtgagttggtgagagagttttggctcaggtcttggcaggcaagaacgtttgccaaacatttccattctcatgccgtcctccaggggacactgttcagcgcaatgcccctcacttgcaaacttcccaagccaatgaggaggcaacacgtcctcctccactcgcaacgagctttgagccagaagaggatgtcctgatccgcctcgtcctgaaaagagcagaacacctgggcctggcggctgggggactgccctgctgcactcctacagaccagtcagcacaggatgtatccgcacacagccccacaatgctcgactccatgctcagcgactggctgcgccaagcagaggatacgcactccctccaaagcctggaggttgccaggcggggacttgacgccctggccttctctaaagaaggccaggagggcgggagtggtccttgcactatgccgtgatcggacccctcctttccctgcccctcagcatgccccggacgtcctcttcacgtgtattctatgcaaccctccttccgtatcgtcagctagagggcttcaaatccctgtggcaaccaaatttgctcacccctgtacacaagatccacccgatgctgggtctacaggcaggcacaggacgcggagcagttgcatactcttgccatcatcaagcggctgccagttatgttgaggctgcttcgtcgcctgcagccgcagcagtgacatccatggccgccctttcctcctgattcgactggtcaggggccgatggacccactgcggcgcccccaccagccgcagtcctgcccatataagcctgctccaattgcacctgcaatcaaacacgcagaatggtgggtcatatgtgggatgcacagatggcacagatcagatggccaccatctattctgagagcaagggtggtgtgatacaggagaagggtactgtagccagggcacagaattcctgtcaggatggcatcaaccaccttcaacttgtttgcacgcctggcacagagctggaaaacttccaggcatatgcattcgtgggcgtctctggggtcacctggctgcgcggtacgctgtaaaatgactcatcacccataccagaacaactccttcaaaaacatccacgacactcacggcctggttcatggcagaaagacgccgggatgcagccatacatcgctccagcacaccctccagttgctttaaggaatcgactgttgggtgcaaggtggaaaaaggagtgcaacgttagtgctggtagaggtgttcccctgtgaggctgtcaaacgcaatgcttcctgactctctatagatcccttctggacagatacaatacctcagaagtcaccttgcgaagtggacgcgtcgccaaatcttactgtcccatgttcttggtcaatgctggcagtcagctccccagagtccaccatcctgcggcatgggaatgcagtccaatgaggggggtgcactggccagcttctgccaaccaaaccttgacagaaactgatcctttccagacactgtcaaggagcgcgcagcgttgaagcaggcacgaggagctaaagcctgctcaataaacacatgctatcgagcctgaatcctacctcagtatgaggggctccacctcccggacgtctagtgacagctgaacgagacagtgacggggaaaaacaagtttctattcttggtccttattcccactgcaagagtgtcaaacgaggattccgagaacctggcccaccacctcacatccccttcccaagacatgggcagaggaaaagagccctcaccagctctgcagccttctcaaacgcgatggtggtgtacaccttggtcagtctgcgcaccgccctcgccttggaggcctgcagcgccagttgcagcagtccccagttcccgtcctgggttttgtgtacggggccaggggcaagtgttgttgaagggctggagggacggcgactgccacaatgggcaggttcctgctcagcagcaaggtccgcatcatgctgctgcgccccgcgatctctggggagggcagccagccactcgagtaaacatgaggagcattgtttggatgaccatgtgtgctgcaatgcctgagctcgccaatccagacccccctctccatgcgcttcagcacctggatgaaggcaggcgcagacgtctccagccaggaggcaaggtctgggaggggtcccaccacggtcaggtgccggccagcagtcaggtacagggcacactcggacttcacggtgcggctgaggatgggcggcgcgcttttgggcaggacaccaacgctcgctgcagggtggttgtggaggtgtatatttagggcttgtgaggatgacggcggcagggagaatgccgggcagagcagcattgtgccctgctccaacaatatccaatgtctgtgcaagactatgccggggccggagcaacatgcaggccggcctcacccttgtgcaggacatgcaacagcatccacttcttggcggctgctatggtgacggcgctgaccacccccgagggcacagagagtgcacattcaaaaaaccacagtgcacaagcgtagcgccgcctgaattcagattggaggaggggaatgtgtgggatggggtgcaatgtactggacacatgtgcaggctcaacattctccaagcagtgctttgacagaccactgttgccgcttcaagcacagctgcgacgctcatgtcctcactgcagctcacctggtggtctccaccagccctccatagtagcagtagaggagcacatccaggttggtcgaaccagtcttggaaggatccactgcatgcatgtaagtgatatgtgcagcttaggggaggtgtacctgtgacatacaatatctccaaacatatgcagcaagtgccgtgaaagaagcgctaaccttcacgtgaatcattgcctggagctcaccctgagcctgcaagccggtccaacccagcacacgagcaccagtgacttaccgtcataggcttcgtgctcaataaaagggagtgcagcatgataattcttggtgaggatgcacctattgcaagaaaacttcttgggtatgagtgcgaattggcagatctcatgccgccatagaactcctcacacaatctctccaaatgtgcatcccactgaagcggtatgcagtgcattgccaaagcgacgcaagccagctgaaaagtcattctgtaccccagcctaactcacagctggaaaatgtcagcatgcaaggggctgatgtacttcgtgccaggaatgagtcgcaatgctgccttccgcaaggtgcagagggcggactttccagccccttccctcagagccgcggacttcatgcgtctggccagacgtgcgactggtgagggacagcagcagtgaggtggtggaatggatcaggcaggtgtcaggcggccccgactgtggatgctttccgttgtatcgatgcgacaaggggcagtttgcaggaatactacgtgcaatctgttcttcccaacatacccagggccttgtcgatacatcaggcatacaacctgtctgctctaaaaccctatcagccaccagctctcaccaagtggcatgctcaactgaagctggctggcatccccattttccagcagggccacctcagcagccaagaggtccatgttcctatgagtgtctgggcttgctctgcccacagcatccctgcatcgaatgccaaggagtggtcagtctacatgcattgcaaccataccccacatctaccctgcgcacgattgcaatgtagatatcctacaccctcctcacactcacagcaagtacaggcatcccagggactgcaggcctggatctagggacgcagcagcagccagtagtgtgtcgcgatcgctgtttgccaaggattgcacgcatgcgtcggattcaagaatgctcttcagctccgtcgcattcgtcgtacgaatgcgggtgacaagctcctccatggcaagtgatctaggactcaaaggcccagcccgatgaccccttatcgagggcagtacgtttgagagtaatcagatctccagtgtgagcgcgatnnnnnnnnnntttatcgagggcagtacgtttgggagtaatcagatctccagtgtgagcgcgatatatacacacgatgcgggcacagccttccagtatgttaggctaatgatttcagcactgtctcaagcagagcgcatggcctctcaacggcgaggtcggacttgatatctccccaatgcatatatgccgcccataatgccccacctgggtcgaccagatctgcagtctaccgtcagaatcctccccgcagggtnnnnnnnnnngacctaggtcgacaagatcttgagtctaccgtcagaatcctccccgcagggtctaccgagggtgacgtccccaccctccgcgcgcgaagtgttgcactgaggctgcgagtgtttgtccctggcaccggccagcctacagcgccagagcgggaaacgctgggcagtaacgccggagacctgggccgattcgatcctcttcgacgcgacttctgtcactggggccaccgatttcaaggcagcatggtgcgagagggctgacgccgccggcctagactgtgggaccagccagccgtgaccactggggtgttgccagggatagcgactgccggcgagggtgctaggcggaatgggctagtttagaatacactccctgaccctttcgagcgttatggtgatgacgctgagcccgagaggtcctccggctggtaggcgggtcacagtcgggtggcttaccagcctatccccctccnnnnnnnnnnttggttgagcaaggacctggcctacccaactgagttttgtcctgctcaatgcctcgccttccccttccnnnnnnnnnncgtttagaacacactccctgaccctttcgagcgttatggagatgacgctgagcccgaggggtcctccggctggtagccgggtcatggtcgggtggcttaccagcctatccccctccacccttgcaggagaacaaccccatcaagctcgccattgtggtgaaggtcatcggccgcaccggcagccgtggccaggtgcgcgggtgaacgaccgcatggctgggtggttgagcaaggacctggcctccccaactgagttgggtcctgctcaatgcctcgccttccccttccctctctctcaggtcactcaggtccgcgtgaagttcctgaacgaccaggagcgtcagatcatgcggaacgtgaagggccccgtgcgtgagggtgagcgaggagtgcattgtggaggcgcagggatgggctcgggttgggctgtgggagcacccagctggcctgcctgggttgtcgcaacattctcaagcaggctcatcctgctcaaaaaccatgctccccacccctcctcgaaggtgatgtgctgaccctgctcgagtctgagcgcgaggctcgccggctgcggtgatcggcgcgcctgcgtcgcacctgtacctgcttcgtgccctggcctgccccggggtgctttgctatggtttcctgggcaatgtaaccccctcctcctgccactctggtcctcgtgcaaaagggatttgggaaggatgcggtgcgaacaggtggctgctggcctgagaaggcatggggacaagttgagcaagacccgcagctcgggggaacctgtgatattgcccgcgcaggccacttgtccccgccccgatgcccgcgtcgccacgcatgcgtgcgcgtctcgtgcgcctcgtgcccggcaggccgagacggccgccgctgcgccctcctgtgcagccgtcggcgcaggcgccgcactgttcatgcgaccatggagcaactcgcggataccgccctccagcgcgcgagnnnnnnnnnnnnnnnnnnnnnnnctggccaccacgccggcggcgcacagcgccacgcccgcgttgaggttcagcgcgtccgccacgggcccccgccccccgccaaacacgtccttgcataattttggtttggtggggggatgattgatcatgtccatgattttaaggagggcgtcgagcaccgtgcgaccggtagacgcccccgagtgatcctgcaggggcttcgttctcccccctcccacccactcgnnnnnnnnnnggtctcccctggcgccccccgccgctgcgtctcctgcgccagcgcgacgccgtcctccgcgnnnnnnnnnncgtctcccccggcgctccccgcctttgcgtttcctgcgccagcgcgacgccgtcctccgcgnnnnnnnnnnnnnnnnnnnnnnnnnnnnnnnnnnnnnnnnnnnnnnnnnnnnnnnnnnnnnnnnnnnnnnnnnnntgcccgccaaacacgtccttgcagagttttggtttggtggggggattattagtcatgtctatgattttgaggagggcatcgagcaccgtgcgaccggtggacgcccccgagtgatcctgcagaggcttcgttctcccccctcccacccactcggaccccctttccacctcgagtatggcggcgttcaacctcgcgtccccgcctttgaggtcctccaccgtggcccgggggatgcccaggtcccgcggctccagggagtactcccgcttcccggcctgcgtcacctccaccaccgaggcagggcccagcggggtcagctcgtccagccccatggagtgcaccaccagcgagcgctgggtgcccaatcgctgcgagggggggggg

SEQ ID NO: 40269 - DNA, 6672 bp, Chlorella protothecoides
  modified_base (384)..(393): a, c, t, g, unknown or other
  modified_base (1039)..(1048): a, c, t, g, unknown or other
  modified_base (1575)..(1735): a, c, t, g, unknown or other
  modified_base (1963)..(1972): a, c, t, g, unknown or other
  modified_base (2855)..(2864): a, c, t, g, unknown or other
  modified_base (3380)..(3389): a, c, t, g, unknown or other
  modified_base (3888)..(3897): a, c, t, g, unknown or other
  modified_base (4601)..(4610): a, c, t, g, unknown or other
  modified_base (5943)..(5952): a, c, t, g, unknown or other
ccgcgccgccaacccgggagagcgcgtcgggggaggcgcggtcgccgctggcagccagcgcgccggccagcgccacaaggtacgcctcggcagcgccgggcgccgccgcgcgcgccgaggccgccaggtccgcaagcagcgcgtccagccgggggctgagtcgcgtgagggcccccaggtcggcggccgccagggaccgcacctgtgcgcggatgtgggtggcggagatgagattttgtttggaggaggatgcagagggcgtggcactgtgagagggccctcgcacgatgcgaccccacatcacgggatgatttgtgcggttttgcgtgccggatattcctccaaccccctcagaaaccgacatggcccctcctcctcaccctnnnnnnnnnngtgtgggtggcggaggtgagactttgtttggaggaggatgcagggggcgtggcactgtgagagggccctcgcacgctgcgaccccacatcacagggataatgtgtgcggtttcgcgtgccggctattcctccacccccctcggaaaccgacatggcccctcctcctcaccctgggctcggggtccagcaggcacttgacaaaggtggtctgcagctggggcacaaagggcttgagcccggcgcccgccttggcgatgaggatgcccagcgtgcgcaggatggcggccttgacctgccaggggaagcggtcgccgatgatgcggatgaggggccccgtgctctgcaccacgtagggccgcagcgcctcctcccccgtgatctccaccagctggcccaggccctccgcagccacctcccgcagctcggccgagcccttataggatgggtgaatggaaagcgtggatggttgggtcttcaaactgtggcccgtacgcgaatcatggtatttggcggccttgttggtagggcgcaagggtggcgagcaaaggagtttggcctgagtgttcctctcttcccttttcccctcaattcccgcttccgtttgtctctcggtcgccctcctccccgctcctcccccccacctgcnnnnnnnnnntttggtggggcgcaagggtggcgagcaaaggggtttggcctgagtattcctctcttccctttttcccctcgattcccgcttccttttgtctctcggtcaccctcctccccgctcctcccccccacctgcagcatgccctggaggtagatgggcagaaccggccccagtgccttgggcaggcagaagcccttgaccagcaggggcccgccggtgcgcttgcgccgctccttgtccctcgtggccagcaccgcgtcctgagtgggtgggaagaagggagggggcatggatcagggattcggagcatggacaggtttctgtgcaagcacctgccgtgtcaggcatggaggggtccagcgctggacaggcgatggtgtgggtacagccctggtcccacaccacctgcaggtgccaatcgcgggtgtccacctgtcgctccccagcgcatgcagactccccatgcccccttccccacttccctcccgaacgcaagtatcgtaccttgaggcagcgcacatagttgggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcgtgggtatcaggccgtctgatgggagaagcatacgcatgtatgctcggggcctggccgcagccccgcacaaccccggcgcggaggattcacccccccacacatgggccctgccccggccctcccgcatggccccaggtctctccctgcaaacccaacaccgcaaccagaccctccacgccatgtcattctgtagctccgttctcaggccagccaagccccccnnnnnnnnnnagggggggcatggattggggatttggagcatggacggttttctgtgcaagcacctgccatgtcaggcatggaggggtccagcgctggacaggcgatggtgtggggtacagccctggtcccacaccacctgcaggtgacaatcgcgggtgtccacctgttgctccccagcgcacgcagactccccatgtccccttccccccttccctcctgaacgcaagtatcgcaccttgaggcagcgcacatagttgggctgcatctccttgggaatggaccccgtgacggcggccagggcctcccagcaggccacaacctcctcctcagactcctcggccagggctggcaccagggactgcgtgttgccaggggtcatgcgggggaagaaggcgtgggtatcaggccgcctgatgggagaagcgtgcgcatgtatgcttggggcctggccgcacccccgcacacccccggcgcggagggtaccaccccccacacatgggccctgccccgccccttccgcatggccccacgtctctccctgcagacccaacaccgcaacaagatcctccacgccatttcattctgcagctccgttctcaggccagccaagcccccctccatacacacgacgccaacacagactcacggcgatgagggcggggatgtgctcttggaagtcgaggcgcgagccgcggcagagctggccgatgccgacggcggcgcccacgcggcgcgcgtcgtcgtccagccccttgagcagctcggcgatgaggaggtacagcccgtcctcctgcacggccagcaccacggcgcgttgtgcatcgtgcgccgcggcggtggccggcgacacgtccgggtgctccgaggtcagcgccagcagcgccggcagcannnnnnnnnnatcctcctgcacggccagaaccacggcgcgttgtgcatcgtgcgctgcggcggtggccggcgacacgtccgggtgccccgaggtcagcgccagcagcgccggcagcagcgagcccaggtgcgcgtgcagcgcggcgccggcgacctcgcacagcgtgcccagcgcgcgcagcttcgtcgcgacgggcggtgggcgggtcaggcgtggcagcatggagcccagcaggctcggccgcacgcccaggatgacgcgcaggccctccagcgcctgcgcctggcgctccgcctcgggcgcgtccagcgaggccagcagggccgggaccacggagtccagcgacgcggcgccgccagacttgaacagcacgttgaacacgccgccggcggcctggtgaaaggcgaggggtgcttggggcggtgggatggggggatgatgtggtcgggcagcggccacatgcgttggtgggggaggggccagctcagactggggtgatgccctggcttgggcatgccggggtgnnnnnnnnnnggaaaggcgagggggtgtttgggggtggtgggatggggtgatgatgtggtcaggcagcggccacatgcgttgttgggggaggggccagctcagactggagtgatgccctggcttgggcatgccggggtggttggctggaccagcaaagcctgggcaatgaagacacagcccagaggggcccagcctggcaggacctagcgcagggtgctggggcctggattcccagcagagccatcccatctcagctcaccagcctgacttcggggtcggggtcgcagagagccgcctggatggccggcaggagcgagggcaggtgctgcgccagctggtcgcgcgccgcgttttccagcacgtcccgcaggccgctgcacacgccctgttgggatggatggcaaggggaaacgcatgctggggctgtgcagccggggaggggagcctgtgcgccagtgcttcgggcccactggtcgctgcgaggcatcatcaggttcccggcggggannnnnnnnnntgcatgctggggcagtggagccggggaggggagcctgtgcaccagtgcttcgggcccactggtcgatgcgaggcatcatcaggttcccggcggggaggacttgccgcgcggcgagccccgcactgcgccgcgcccctcctgcacggtccgcctaccccagccgtccagtccgccacaccaacagtcacgcgcacctggcgggtctggggcgaggggtcgttcatgccctcgcgcaggatgggtacgatctgggagagcacccgctcgcccatcttccgcaccagctcccccaggcagcgccccgccgcggcgcgcgggtcctcggccgggtcggccaggctgcggatgacctgggccatgagcgccggcaggatctcgcccagggtcttgggggtgttggtcaccaccgtcttccagacgtgcaacgccgcgccacgcacgccaaaggcctcgtcggagcgcgccatgtacagcaggctcagcacctggcacctcctgcagggggtggaggagtggaggaggggcgggaagggtcacaaacgggatcctgtggttggtcttccaggacggaagccgagctctagtccagcaagtgtgcagaaacgacgagaggcattggaggcgcgatggcattataatttctgttcggggggtggattcagtggttgattgggtacccccccccccccccccccccccccaannnnnnnnnngggaggaggggcgggaagggtcacagacgggatcctgtggttggtcttcctggacgaaagccacgctctagtccagcacatgtgcggaatcgacgagaggcattggaggcgcaatggcattctaatttctgttgggggggtgcattcagtgattcattgggaaccccccccccccgcaccgctcaaactatcactggcatgccggaaccgagcccgccgccagctttcttcctcacacacgccaaactacccacccacctctcgttgcccagggcctcggcgatggcgcggccgtgggcctcgacggagatgccctcgtcctcctcgttctggaggtcctgctggatgcggcccgaggtgccagcgacctgtgagtgagaggggcgagtgggagacgtcagggtctcagtgtgaggtgtcagcggccatcctacatcgcggtgcttggaaagtgcgtccaccgttcctgtgccgcatcccgcacatcccgccacagtgtaccccacaaggctccgacctctccactcggccacggaaaccaagtggcccccgccacccccctcgcccgcgcctcccaccttgaagagcaggtcgcccaggagctcgatgctggactggcggatgcgccagttggcattcatgattcccgcctccacggcgggcaggaggagctccagggcggaggtggcgtagaggtccaccgccacgcgcgcggcagacagcgcggcatcgcgcacgccttccgcctcgtcggccagtcccagcaggaccaccggcagcacgcgcgcgaggtgaacgcggaaggcggcgggcatgcagccgggcagatacttgaacagcgtgatgtggccctcccgcgcggcagcggagcgcgccctcgcgccctccaggatcctcggcagcagggcctccaccgccgcgtcgccctgcacggccagcacctctgccaggccctgggcggcgccggagcgctccacgccgctggcctccgagccgaggcgggtcaggagccaggggacgaggtcggagaaggcggcggggcccatgccgcgcacgagggtgcccaccgcgcgcgccgaggtggcgcgcacctccggcagcgggtccaccagcgccgcctggagctccggtagcagacgggcaacgtagggcgccatgtcgcgcgggtcgttggccagcgccgacaggttgcccacgatgcgcgccgcgcgtttcttgatgtccccggaccggtccttgagcccgcgctggaccacgggcatgatcagcgcctggggtggtgggattgtgtcgttggggggcggggagagggaggtgagctcagggcgggacnnnnnnnnnnaggcatgatcagcgcctggggtggtgggattttgtcgttgggggatggggagagggaggtgagctcagggcgggacgaaaattgcagaggttgctgaggaggcggtgcacctagtcagaagccccagcatgggcccaggcccggcctcggacccatgcctcacgccccgccccaacacgaggagaataaaccatgaccactcaccaagctggcggcgtccacggtgttgacgaagacggtgctgagcagcatatccagcatcttgcgcgtgtgcttgttggggtcgcccagcgccgcaagcagcgtgggcaccaggcgtttgacctcggggttgcggatgaccgaggctacctcgtccagcgagcgctgcgccgcggcagccacgcgggggtgggggtcgctcaacgcttgacccaggtggggcaccaccgcaggcagcgccgtgcccagctggcgcgggttgcagaaggccatggcgcccagcagctgggttggtcccgggaggggttggaaaggaatatttgagggggtgggaatgcttcaacgtgggtgatgcaagggttgactgatgacgcccaggggtgggcgatggttgatcagctcacggcatggcgctgtcgtcgcctctaattgcactgccttacccccccacccccacctccccaacacacaggaacccctcccccccctccccacccacctggatgctgccctccttgg

SEQ ID NO: 40270 - DNA, 106 bp, Chlorella protothecoides
cattcagatgaacacactgggtgagtggcgatggtagagcccccctcagtccatgcacgccgtcaatcgctcgcatgtctccgcccctcccgctcacaccccccac

SEQ ID NO: 40271 - DNA, 119 bp, Chlorella protothecoides
tggctgtggacggcattgtggcattgggcatgttggatgcgggtgtgacacgcctagtcaagctcggcagagcaggcaagcgagcaagtgggcaggcaggcgcagtgtcattcccaggc

SEQ ID NO: 40272 - DNA, 61 bp, Chlorella protothecoides
ccgcatcgtgcgcagcgctgctggcgggggtggaggccgcccctgccggcaccctctttgt

SEQ ID NO: 40273 - DNA, 154 bp, Chlorella protothecoides
actgaatcgttcgagcactggggcgaggggcaacccagggctaggacccggtcccaggtgttgacacgccagcttttcaaaattactgcatgggtcgccccgtccaagagaacaggccagacggtggcatggaggacaggcggcctggggctga

SEQ ID NO: 40274 - DNA, 61 bp, Chlorella protothecoides
agctgcaaagaagctgatccaggaggtcatcgtgtggcccatgctgaaccctgccatcttc

SEQ ID NO: 40275 - DNA, 117 bp, Chlorella protothecoides
aggcgccgagggcccctcgcatcctccacgccggccgcctccgtcctcgcccgcccccgcggcggcgatgcgctgggatgccggcgcgccgccgggctagcccccgctcgccgctcg

SEQ ID NO: 40276 - DNA, 61 bp, Chlorella protothecoides
tcgacatgcactgctgcagctcagcgcagcaggcgcacccacatcaaaaaggcacactgca

SEQ ID NO: 40277 - DNA, 75 bp, Chlorella protothecoides
tcagatctgcgcaccggatgaaggcatgttgacccatagacacagatggtccggtttgattgaggaggaagccgc

SEQ ID NO: 40278 - DNA, 101 bp, Chlorella protothecoides
gcacgccttgacgtctgcaagggagcaagggtgggaggtgtggcgaggtgtggcgaggcagggaggcgctgggctgggacccaagcgctgcgctgcagcac

SEQ ID NO: 40279 - DNA, 2660 bp, Chlorella protothecoides
  modified_base (119)..(128): a, c, t, g, unknown or other
  modified_base (508)..(517): a, c, t, g, unknown or other
  modified_base (815)..(824): a, c, t, g, unknown or other
  modified_base (1427)..(1436): a, c, t, g, unknown or other
  modified_base (1773)..(1883): a, c, t, g, unknown or other
  modified_base (1950)..(2112): a, c, t, g, unknown or other
  modified_base (2201)..(2210): a, c, t, g, unknown or other
ggccgcgtcgctcgcggtctgggcgtgcctggcagccgccgccctgcccctgatggcggccggcctcggcgcggcactggccctgcttgcccattttctgcgcccggcaagggttgtcnnnnnnnnnncgcggccgccgccctgcccctgctggcggccgtcctcggcgcggcactggccctgctcgcccattttctgcgcccggcaagggttgtctttatgccgcccgcagagctggggcccctgcagcacgcgctgcggtatgacttcagggcgccggggcggcttgtcgccggccttcgcgagctggatgaggcgggtgcagtcggcggggcccccacccgcctagaaagcctgggccgggcggcggcgctcctcatcgaaaaagagcgggatgtgaatagaaacggcccagaaccacgccgtcccggcgccgattcctggttgccgccgccggccctgcgagccatggtcagacccgggcgcgggcgcaagagcctgcgcgctnnnnnnnnnngtagaaatggcccagaatcacgccgtcccggcgccgaatcctggtcgccgccgccggccctgcgagccctggtcaggcccgggcgcgggcgcaagagcctgcgcgctgtgcccgctgcgctcgtgcgcgcgtggcacgtcgtcctgggcgccgtgctgctggacgccggcggcgagctgggacccctgcgacgcatgctggccggggcttcgaatggcgagaacccccggccggcgagcgtggagacccccccactggacgaggagccccaccaactggatgatgagctccactctcnnnnnnnnnncggcgaggacccccggccggcgagcgtggaggtccccccactggacgaggaggcccaccaactggatgatgagctccactctctgggagaggaggcccagtcatcggacagcgattcccagcggacgagcacgcccaaagcctgaagggcagccactgggcatgcgccgattccgaactgaaaattacattcacccgcccagggtgggaagcatggggtacatgagagcaggaataggattgcatgcaagccgcatcggccacgctcgggggctgtcgcggcctggttcccagggagctgcagggtctgagaggcctccagctcccgttccgcccatgcgcaccccactcctgctcctgatcgactcgttatcaggcgcttggttgcgcaagacggtccagctccagcgagtctcccctttcggcctgcggaccgcttcacatcgatcgtggtacgtgtgcagggtggggccgtcgaatgcccttcaggcttcggacctcgagttccgtcgccccgccctccgctcctcctgccgcccgccaccgtccccctgcagggtcacggcggcgcctagggccgccatgcccacgctcaccgccaccnnnnnnnnnncgccgcccgtcgccgtccccctgcagggtcacggcggcgcccagggccgccatgcccacgctcaccgccaccttcagccccaggctgagcagcgggtgggtgcgctggcgaggggagggggtggcgggaagctcggccccggccacctcgaacgccgccttgccctcctgggccgtcgccggctgcagcgccagcttgctgcgcgcgtgcagccgcgccgacagcggcagcggcggcaggcggtgccgcagcgcccccggccgcaccgccgcgatggtgcgcgtgtcctcctcgctttcttcttcgctgctgtcctcttcgtcggaggaggacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgccgggcgcggggccggagacgccgcccggcccgcccgccgcggcggccaccgccgcgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcgggacagagtgcgatgaccgcggggcgcggctgcaagtctgaccatgcaccacgccgacccagaggcctccctccgtgggctgnnnnnnnnnnggggtccagtgggaagggggtcagccatgcgggtgaggtcgacccgtgtgtttcgtcttgttgtcgggggccaggctggcaagggcacgctgatgcccaaggaaaggtggtcggccgggggcgggacagagcgcgatgaccccggggcgcggctgcaagtctgaccatgccgacccagaggcctccctccgtgggctggcttggccggccatccacatcagaacctcccttgcactctgcaccgtcaccgctcggcatgctccagccctcccacctccccaccgtccccccaaaacacaccaacccacggcactcgccttctccgcgtccgcctgcgccaggcggccggcgaggtcctcgccctcgcaccgtgcggcggccagctcccgcgccaggccctggcgctccgcggccgcgccgtcggccgcggccgtcagctccatgacctcc

SEQ ID NO: 40280 - DNA, 67 bp, Chlorella protothecoides
agctgggacggatgttattgttcccccccccccgcatagccctcccctcctccctccagcccacctg

SEQ ID NO: 40281 - DNA, 76 bp, Chlorella protothecoides
ggggggaggggatcgcatgggtgaaggaggtgaccgtttagggggtggaggggatcgcatgggtgaaggaggggac

SEQ ID NO: 40282 - DNA, 12430 bp, Chlorella protothecoides
  modified_base (698)..(707): a, c, t, g, unknown or other
  modified_base (770)..(962): a, c, t, g, unknown or other
  modified_base (2794)..(2803): a, c, t, g, unknown or other
  modified_base (4077)..(4086): a, c, t, g, unknown or other
  modified_base (4650)..(4659): a, c, t, g, unknown or other
  modified_base (4982)..(4991): a, c, t, g, unknown or other
  modified_base (6744)..(6753): a, c, t, g, unknown or other
  modified_base (7552)..(7561): a, c, t, g, unknown or other
  modified_base (9058)..(9067): a, c, t, g, unknown or other
  modified_base (9434)..(9443): a, c, t, g, unknown or other
  modified_base (10587)..(10596): a, c, t, g, unknown or other
  modified_base (11126)..(11135): a, c, t, g, unknown or other
  modified_base (12115)..(12124): a, c, t, g, unknown or other
  modified_base (12177)..(12186): a, c, t, g, unknown or other
  modified_base (12263)..(12272): a, c, t, g, unknown or other
  modified_base (12346)..(12355): a, c, t, g, unknown or other
ggaggaggggggtggaggtcggggatgaggaggagcagaatgcctagaaaggcttgtgtcccccacactccacctgttgcaacccatgctgcagggagcagaatgactctgccttccccgagaccgtggcggtgaacctgtggggtctcgacgccatcaagaccaagggagaaagcgtggccatcgtgctgcatctggtcggcgcccggccagtgaaggaggggacggggcgcatcgcaagattcgagctcatacccttggaaggcaaggcagatgctctgatgtgggtgggggtgggcggtgcgatagcacacctgcaaacgtgcgctccatcccagggtgccagcttcatctgatcgaggcattgcgtccattcatgagctacagtacccttgtccccccttcgaccgccacgaccacgcaaccctgccttctttcctgccccacagagttgggtcggccccgcattgatgtcctttgcaacatgagcggcatcttccgagactcgttccagaacgttgtggagctcctggacgacatgttccatgtgggtgggataggttgtagcaggggtttggggtccacaatgagaggtcgtgactcacttgcaccctcaggaggctagctggccacgtatgctggcacccctatggccctgcatctcatctctggacgaatgtctatgtgcacgctgcagnnnnnnnnnntgggcggtccaatagcacacctgcaaacgtgtgctccatcccagggtgccagcttcatctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggggtccagaatgagaggccgtgactcacttgcaccctcaggaggctagctggccacgttatgctggcacctttatggccctgcatctcatttctggacgaatgtctatgtgcacgctgcagagggcggctgccaccgatgaacccgaggacgccaacttcatccggaagcatgcacaggagatggcaaaggagggccactctcagacggcagcccgcctcttctccaatcccaaaggtcagtcatgtggtggtggtgggggggggggtgccccttgcgataccaatcagcatgtttggtggggccgtctgagcacaaggatatcatgagggtgaagctggctccggcccattggtggcacctggagcgccctggcaccacaaacgctgcccagatgccaatctccctgccctttggtccccaggcgactacggctccatggtgaacgagcgcgtcggggcctccaactgggagtctggcgaggagctgggcgacacctggtcctcgcgcaatgccttcagctacgggcgcggcggggagcggggccgggctcggcccgaggtgctggactccctgctttccaccacggaccgcgtggtgcagacggtggacagcgtggagtatggcctgaccgacatccaggagtactacgccaacacgggcgccctgcgcgccgcggcggagaccgcgcggcggcggcgcgggcgggagggcgcggggcgggtgggctgctcggtggtggaggccacgggccgggaggacacccccccgcgggagctggaggaggtgctgcgcctggagtaccgctccaagctgctgaacccgcggtgggcgcaggccatggccgcgcaggggtcgggcggcgcgttcgagatcagccagcgcatgacggcgctgctgggctggggggccaccacgcgattcgcccccggctgggcctgggaccaggcggcggagacgtacgcgctggaccccgacatggcagacaggctgagggaggccaacccggaggccttccgcaacctgctgcggcgctgcctggaggcggcggggcggggactctggaccccgggggagggggtcctggagggcctgcagcagctggatgccgacatggatgcagagctggagggtgtgaggagatgatcatggggacctgatgtgggcgaggatcgtgttgtttgccgtcggcatcgcttgagagacgcctgtcagccgcagcgccgctgtcaatttgtatttgtatgtcggggcgaaccccacatgcgagtcatgcacatgggggaccagcgacacataacgccgatctgccaatcgtctgatgcaaatcacacgtctcttgaacgcgctgctagattgccgtggatcttcaatatgaaggaatggcagcggggtggaaccatctgagggtgaggcactggacagcagtgcgtctctgtggaatgccgaaacgtgccgtctcgcccgaactggtagatctgacctcctcccccaagcgtcagcttgtggacgcctcatcgcatgccgctgtgcctgaggagcgacaatgcgtccgggccgccagctcctcccatggatggcccgactcccccttccacctgatgcgggtgaggggcctccccacatgggcaaacgaaggatccctgggcatcaagctgagcgaggtcgtggccggtcccatgcgcacagtcctgatatccaattatgtgagtggcgttgccggatcagagatcctggccagagagggacaggtggtgagtgctcgcgcctgcaaaactcgctgtgatccgtgtgcaaccatgtactgatgcgcgcatcctccaagcatnnnnnnnnnnaggatcagcgatcctggctagagggggacaggtggtgagtgctcgcgcctgcagaactcgctgtgatccgtgtgcaagcatgtactgatgcgcgcatcctccaagcatgcttgcatctggcaggacggcccgggctatgctttcacgcaccctcgaccctccatcgcaaaagatgctggactttgcatggctgctgagcgcctgtcctgacctggcgcgggccgagcgcctgatcatagtgcacggagagggtccagacaagtaggcttggtcgggagtgatgcccatgtgtgcggcatgtcccggacatcggccaccattgggtgcgcaatgccgttgattgcgctttcgtggccagggctcgaccccgacaccccctgccacccacagggcggcagccgtggcgcgtgaagtccgggaggctggcctggccagcaggacgaccatccaccagccgccgctgcccattccttatggcacgcaccacaggcaagaggaggaaagggctgggttgggggcctgagcctccgggatggctgccctggcctcgttcatggagatgggcgttccttgctgggagggggggtgccacaccgacccaagcatggcgccgcccccgacacacccatgcgccccgtgcacatcccggccacccacccgcatcatccccgcatcgcgcagcaaagcctttgtgatcctgtttgagcgcggcgtgcgtgtggtggtccacacagccaacctcatctacccggactgcaacaacaagacgcaggccctctacacgcaggacttcccccccgcgccagatgccactgtgaggggcttccatttcttcgtcatacattcctcgagaggcgtttcaggcccctgacacagccgctgcccaccgctgccggttgtggaagatctcacattgtcctggacctccagcctgggtcaccgccacccactggcatccccactgcaggccagcccattccaagagtccctgctgggctatctcgcccgcctgcgcatcccagcttcggcctacgagcccctgcgccgagcactgcagcggcacaacttttcctgtgcgagggcggccctggtcgcgtccgtcccaggctaccaccaaatgggtgtgtgggtggatgtggcggtctgcctatcgaccggtttcctcttggcctacagcctgcacctgggcgcctgcagagtacagcagggttcttgggcgagtcaaacatgcccacctcccgtctgtcatggaggcaagccccccactcctccannnnnnnnnncctgggtgtgtgggtggatgtggcggtttgcctgtcgaccggtttcctcttggcctacggcctgcacctgggcgcctgcagagtgcagcagggtccttgggcgagtcatacatgcccaccgcccgtttgtcatggaggcaagccccccactcctccacatccccatgatctcagcggccggcgacccgccctggggccacctgtccctacgccgagagctggcccgggagactgccttccagtgcgcgcatgcgtctacccccttcctggcccagttcagcagcctcggctcggtggacgccaagtgggtggacgccgagctggccggttccgccggagcgggggcctggcgcggggaggggggagggacgggcgggatgcgcgccccgcccggcatcgccaccctggtctggcccaccgtgtcggaggtccagaacagcctggaggggtggctggcgggacgcagcgtgcctggccccacctccaacgtctgcaagcccttcctagagcggtactggcaccggtgggggggccagccggtggggcggcagcgggccatgcccnnnnnnnnnngcgcagcgtgcctggccccgcctccaacgtctgcaagcccttcctggagcgatactggcaccggtggggggggcagccggtggggcggcagcgggccatgccccacatcaagacctactgccgcttcgatgcagcgacgggggaggtgccctggtacctcaccgcctcgcacaacctgtcaaaggtggggtggcattgcatttgctgcaagcgccaaccttgcagtttctggggctgcgttctactccatctctttcgtcctacttgaatacctcacctccaaactccgtccctccctctcaacccctcaggcagcgtggggnnnnnnnnnngtatttgaatacctcacctccaaaatccgttactccctctcaacccctcaggcagcgtggggcgtgctgcagaaaaaggggacccagctcatggtgcgcagctacgagctgggtgccctgcacctgcccagcctggaggcggcctacctggcctcgcagtggagggggtatgatgcagtgaccggggcctgcacagagcagcccatgccaggtggggctgtgtgtgtgtgcagggcgagccagttgtggaggtggaggggcaagaatggtcctcagaagagtctgcactggggatgagtgtcacacattcccacagaaactcaagaacccctttccgttcctcggcaggggccgatccagagcggctgcgcttcgtggcatggaatcgggggggtgcttacacgcccagcgaggacgcggaggggtgtatcagggtccccattcccatcccctacacccttccacccgctcagtataagaaaccggaagacactgcctgggcagtggactacccctggccaggcctggatcactttggctgcacagtggaggcgccatatggcgccttctacggcctcacagaagacatggagtgggcagacttgggcaggaggccgtgacgttggcaaggaattgctgtaaggttgctttttaggcatttcgttccaggcgtcacagtatgcagagactccgccatgctgaggcccatcgtctgctgaggaatgctctgccacccgagatcaccgcgcccacgctgggaatcttagggcgcgagataagtggcgaggagtgattaaggcatggcagggctgattgatacattcaatctcataattgtggtaatgctgagcatctgatcctgcctggatggtctccctcggctgacgcggaggagtgtgcgcggcgactggctgcagatggagccgctgctgtgaagcccgccgcctcgctgacaccggaatggcgataccggaggcgggggctaggaccgatttgaacagattgcaggtatgcgaatggcatcctgggacgagagggagcatctcttggtgccatgtttccacgcagtgctcacaggaggaacgccacactcacccgcagactgatcagaccagtttcttcgtcatcagggtggatgcctccccctccaccaccgccatccctggcggcacctttgtgacggtggagtcggggccgtatctgaacctcgacagtgctttgcattccctccagcacccccgccaacgggtacggacgtgcatctgtatccttgcgctgaaaggggaagggtttcccatgagaccagtcctgcacgctggatatgctgcattaggctatggtagtgtcttatcatagctcaatgcatgtccaacaacaggcacatgtggctcctgacatcgtcttcctccacgagagcgtgccggtctggatactggatgagcctgtcccggccaaaccccgcatgctcatcacagcctcccacctggaagctgcgagagccatgaggtgagaggtcgtctgcatgcagggcatgggagatgcagtcgcgggtgtgaaccaaccctaccttgttctgcacatttgggtcctgtagtcatctgacctacgcgtgccccagcctctccagcgcctcaagcctggacaccctgccgtgcgcgcagggagccatcagcacctccgagccagctgaaaccctttcccagcagcgcggaggtggagctttggcccccacggtcaggcaggcaatctcatnnnnnnnnnntccaacaccgcggaggtggagctgtggcccccacggtcaggcaggcaatctcatgcgcacgcccccgtggaacccaggggcgcggcatggagagtggatggcggcgggttggtggtgtcgcctggtggtcccacggtcaccaccccgttgcagcgggcggctgctcccaggaccttggacaaggccatgtctcccgggtcacactgcgccccttcccacaagtgatgaggcactgcgtgaggaactccgcgcacctctattaaagtgttgttatcaggtggcatctgcaaattcacatctgctctccccctctcaaacccctgtgtcttcttcgctgctgttcctgcttctccgaaatgatctatcatgagcgctgagacacgcgccgcactgtgacctatttaaggactcacttggtcagtcgaggattgggtgtgtggtgtgagctcacagcatgggccatgggcatgctattgctaacgctgacgtgtcgctttcggcaactttccgagatgatgcctttgcgacgtgacgtgacaattccccggagggcatggagccctgccctggacacgggaataccatcgagacatatcacacaaaaataatatctagagctcgtctgggactccgcagccagccctcaccggccagattgcagacactcgggacgggaggtccacgagaccccaccatgtcccgtcgtcaggacgttctggctggccacctctcggcgaccccagcccagaatgatgcggtggccccctgccccacctccgcgcgggcgcaccgccagctnnnnnnnnnnaaccagcccagaataatgcggtggcccccttccccacctccgcgcgggcgcaccgccagctcccccggttcgacgccacgttgatggagcgttacatggacccctcccacctgctgaaggaggaggtgtacgccgtgttccgggagcacccggagctgctggtgaaggagctggaggccctgtccaaggaggagcaccgggagctggtgcggcgctgcctgcgcgcgctgctggcgtcggggcagagcccattgacgctgctggcctccgacccccggcgctacttctacctgggcgagctcatgtccctggtggacctgagcctgacggtgaagatgggggtgcagtacagcctgtggggcggcagcgtgctgaacctgggctcggaggagcaccgccgccgctactttgacgccatcgaccgcttcgacctccccggctgcttcgccatgaccgagctgcgccacggctcgaacgtggcggcgctgcagaccgaggcggtgctggacgtggagaccgacgagtgggtcatccacacccccgacgacggcgcgctcaagtggtggatcgggaacgcggcggaggacggtctggccgccacggtcttcgcgcgcctcaaggtccctgcggcctccggccgccgcgagctggacgaccacggcgtgcacgcctttgtggtgccgctgcgcaccgcgccggggcgcctggctccgggcgtggacattcaggactgcggctacaaggtgggcctcaacggcgtggacaacggcgccatccggttcacgcatgtacgcgtgccgcgcggcgcgctgctggaccgcttcgccagcgtggaccgcgcggggcggtactcctcacccatgccctccgcggccaagcgctttgcggccacgctgggggagctgaccggtgggcgcgtgggtctcaccgccggcagcctgggcgtgctcaagggcgggctgaccatcgccatccgctactccgcgcagcgccagcagtttggccccgggggcgcagcgccggaggtggcggtgctggactacccctcccagcagctgcgcctgctgcccgcgctggccaccgcctacgcgctgaccttcgccaaggacgcgctggtggacaagtacgtggagatgaagcgcacgcgcgacgaggcgctgacggccgacgtgcactcgctcagcgcggggctcaaggcctacaccaccgggttcaccgccgccacgctgtcggtgtgccgcgagtgctgcggcgggcacggctacgcggccgtcaaccgtctgggcgccctgcgctccgaccacgacatctttcagacctttgagggcgacaacaccgtcctgctgcagcaggtggctggcctgctgctcaaggagtaccgcgactccttccgcggctccccgctcgccgcctcttggtcctacctgcgcgccgcgctgggcgatgcgctgcccgccaacccgctcctcgcgcacgacaccacgccacgccacctgnnnnnnnnnnctggtcctacctgcgcgctgcgctgggcgacgcgctgcccgccaacccgctgctcgcgcacgacaccacgccacgccacctgcgcgacccgcgcttcctcatctccgcgctgcgccaccgcactgcgcgcatgctgcacaccgtggccgcgcgtctgcgcaagcacacgcgccgccacggcgccttcaaggcctggaacaggtgcctgctccacctcctggtgagggggctggcgggagagggggcggggggtgatcattggcagggtggggaccgggggctgaagaggggcacagcagagctccagcggcacgattcggggagaaccccgctgtacccacgcgacacccataccccccctcgcaannnnnnnnnngagagctcccgcggcacggttcggggagaacccgccgtccccacgcgacacccataccccccctcgcaactgcccaggacctggcccgggcgcacatcgagagcgtggcgctggagtccatgtacgcgggcgtggagcgctgcaacgaccccgactgccgcagcagcctcaaggcgctggcggacctgtttgcgctgtcgcgcatccacgccgacatcctgttccgtaacgacgactacctgtccccggagaaggccaaggccgtcaagcgcatggtggagtcgctgtgcggcgagctgcgcggtgtggcggtggccctggtggacgcctttggcatcccggaccatatcctgcgagcgcccattggcctggccagcgcgcagcacgacccctacggcgagtacctggccgccacgggctgggagacctgagcgcgagagaacgaggggatggagggagcagcaggaggagggggtcatggggcaggacgatgacacgggcggtgcatcgtgtcaccctcctaaccctccctcctcgtctcctcagtgatcgcactcccacccccaccgtctggcatccaatgcatgcaccccgacgtagtagacaccccttctagcgcgacaaactgcacactttcctccgtgcttggaatcccttagcccgcgacgtagcgctgctcttctcctgcccattcttgcacaccggtgctgtagcagtacgtagtccatagcatgcccagcccaggaaacaacagcaggcagcggtccaggcctcacgtctccagccccagcacccggctcctctggcccagagccctctccaacacagcacgagcccgcctcgcttgcatggaagttggccgggctgcccggagtgggatgggctccgccaccccagggccccgtccctctggcagcggcgaagcctccctgcccctcgcgcctgcctgggccgccgcctccccggcggccgtggccagcaagaactcgttgtctgtgatgggaggcgggagggtggtgggggcagcctgggccaggggaggagtaaaggtccaccccgctgtctcagcttgtatatgctcccccaaccgggagctccgcgagcccacctgcgccctgcagggcctgcagcagcttggcccggnnnnnnnnnnccagcctgggccaggggaggtgtaaagttccaccccgctgtcccagcttgtatgtgctcccccaaccgggcgctccgcgagcccacctgccccctgcagggcctgcagcagcttggcccggcggtagccgaccaccaccacgtccagggacaggagccccgcggcagacgctgactcagcgccctgggcgagctgggccagctgctccgtcatcatctcggagaactcgcccagctcgatctcccccgtcccatccttgtccaccttgtccagcagggcggcgatgccagtagggccgatgcggatgcccagaagctgtcaggcgtgctgggcgggtgggggccgctggtggtgtgaggaatgggggcagcagggcagtgtgtatggaggtgttgcacaccagggtccacatcagcgcagccagggtgtgccccccagctttcaacacaacgagctgtccctgcggcttactccaaaggcgtcggagagctcgcttgcatcgatggcgcccgaggcatcgctgtccatcnnnnnnnnnncgtgccccccagctttcaacacaacaagctgtccctgcggctcactccaaaggcgtcggagagctcgcttgcgtcgatggcgcccgaggcatcgctgtccatcatgttgaaacacatctccatgtcggcgagctgctgtgctgtcatgcggggacgcacggtgcgcccatgcacccgcagccatttgcggatggaagggctgaggagagggaaggcctcctctaatctccgacctgggggaggggcgcatgccggggtatctgggcagcctgccagtgacccgacccctagcgagaccctccccaggggtcccctgagggagatgatgcaggatgatggccgctcttcaaacaacacttcacacgtaccatcatgctgtgctatggtcaaaggtccaagctctgacactgattgatcgtcgacggggcggggcccgaagggctggtcccgagcgccgtcattgtgggcggagagcaaagggacttctcctctcattcactgggcgtgagtcgaagtcaccctggaggtgagcaagtatcgagcagccccttcggaattcccattcaccgtggctcctctcaatgacgactccgacatgcccgaggtggtagcgggaagccggctgtcgattcaattcctggcccatcgcccctgccacgcctgctgccttacactgcacatccagatggggagcaggatcccgacctacacactatcctcccccgcggttctcttgcgccgctcctatcgccatatggacaggctgtcctgctgctgccctcccgccggctgcgcaaagccggggaagccctcgaagcccgggggcctggcaggcgggccccccgcccgggaccccggccgctgccccgcctcctcggcgccaagccaggtgttcagcgcgaggctcgccgcggcacgcgcatccgtcaagcccctggagcccgccccgcccgctcccgcggcggccgcggcgggcgagnnnnnnnnnngcgtggctccccttaatgacgcctccgacatgcccgaggtggtagcgggaagnnnnnnnnnnccttcaaacaacactttacacgtaccatcatgttgtgctatggtagaaggtccaagctctgacactgattgatcgtnnnnnnnnnnggccgcggcgcgcgcatccgtcaagcccccggagcccgccccacccgctcccgcggcggccgcggcgggcgagnnnnnnnnnnccccgacctacacacacaccgcccctgaggttctcttgcgccgcccctatcgccatatggacaggctgtcctgct

SEQ ID NO: 40283 - DNA, 63 bp, Chlorella protothecoides
ccgatcacccgatgcacgctcgactcagagttgcgatgtcatcaggaacatccaggtccgggg

SEQ ID NO: 40284 - DNA, 33309 bp, Chlorella protothecoides
  modified_base (228)..(286): a, c, t, g, unknown or other
  modified_base (768)..(777): a, c, t, g, unknown or other
  modified_base (1387)..(1396): a, c, t, g, unknown or other
  modified_base (3576)..(3585): a, c, t, g, unknown or other
  modified_base (4433)..(4442): a, c, t, g, unknown or other
  modified_base (7269)..(7278): a, c, t, g, unknown or other
  modified_base (7845)..(7854): a, c, t, g, unknown or other
  modified_base (9491)..(9500): a, c, t, g, unknown or other
  modified_base (10650)..(10659): a, c, t, g, unknown or other
  modified_base (11189)..(11198): a, c, t, g, unknown or other
  modified_base (14805)..(14814): a, c, t, g, unknown or other
  modified_base (15278)..(15287): a, c, t, g, unknown or other
  modified_base (16183)..(16192): a, c, t, g, unknown or other
  modified_base (17056)..(17065): a, c, t, g, unknown or other
  modified_base (17666)..(17675): a, c, t, g, unknown or other
  modified_base (18018)..(18027): a, c, t, g, unknown or other
  modified_base (18862)..(18871): a, c, t, g, unknown or other
  modified_base (18935)..(18944): a, c, t, g, unknown or other
  modified_base (19428)..(19437): a, c, t, g, unknown or other
  modified_base (20066)..(20075): a, c, t, g, unknown or other
  modified_base (21028)..(21105): a, c, t, g, unknown or other
  modified_base (21676)..(21685): a, c, t, g, unknown or other
  modified_base (23003)..(23012): a, c, t, g, unknown or other
  modified_base (24056)..(24065): a, c, t, g, unknown or other
  modified_base (25097)..(25106): a, c, t, g, unknown or other
  modified_base (25197)..(25218): a, c, t, g, unknown or other
  modified_base (25480)..(25489): a, c, t, g, unknown or other
  modified_base (25674)..(25683): a, c, t, g, unknown or other
  modified_base (27446)..(27455): a, c, t, g, unknown or other
  modified_base (28427)..(28436): a, c, t, g, unknown or other
  modified_base (29953)..(29962): a, c, t, g, unknown or other
  modified_base (30425)..(30434): a, c, t, g, unknown or other
  modified_base (31537)..(31546): a, c, t, g, unknown or other
  modified_base (33171)..(33180): a, c, t, g, unknown or other
cacccgtgctcttcgcgccgggggcgctgacctccgccggcaacacgccgcgcgtgggcgcgggcacgggcgcgggcgctggcgcggccggccccgccctggccagccagctcatgcacctgggcatgctgtcgggcatggccacccccgccgccgtgctggtgctgcagcagcagcaggcagccatgcagcacgcggtggcctctgcggctgcagcagcggccgccnnnnnnnnnnnnnnnnnnnnnnnnnnnnnnnnnnnnnnnnnnnnnnnnnnnnnnnnnnngtttgtgtggtggtcttcttgctgcctcgagagcaggacctgggggggtgggctctggagcccctcacggcgtcctgttggcctgcttcctcgagctgccctgtctggggaaactgtctgggtaggggccagggctcgctgagaactcttggccaccatcagatgcccatgtcaccccccccatcccccttcactcgatcgcagaaggtgccgggtgcgagctttcaggagctgccacgagaggaggcagcaccccccgccgctggggccccggtcgagcgcgacgcagcgcccacgtccagggagctccggaccgtaggccccttgcccgagccgagccctgcgcagcaaggagaggcagggccgagtgtgggccgcgctggcgattcggagcccaagcctacgtacaacatcctggcagggccttccagcaccgactctgggaaggaggacgcccagggcgacgcccaggtgctgtccgnnnnnnnnnntcgacatcccggcagggcctcccagcaccgacactgggaaggagaacgcccagggcgacgcccaggtgctgtccgcggtcatggaagccatgctggccgtcgcctgcaaggcgctgccgggcggggcgggcgagccgagtcctgtgccaaccggcgggcacctccggagtggggacgctgcagcggggcagatgcgcggcacgtcccatgcagagcatcagcccaccggcggccagacggcgatcgacggcagcgccgctccctcgcaagacgtcgcgctacttgtggctaactctgatcacggaacagaccagcacggcgagcagcgtcctgcgccgtccgagggaagggcggcttgagggcgtggacctctcctctctgtccactccctcgcctcacattcacgggaggctgatgccggctcaccacctgacccccaggtctcgaggtgagtcccggccattccaccccagcacgcacccaagcctccccagagcccccagccctggagcacctcatgagctgcccggcacagaatcgagtgcctgcacccgcttggtccccaagactgacagtctgttccttgctcagccctgacatgatggccatnnnnnnnnnncggagcacctcatgagctgcccggcacaaaatcgagtgcctgcaccagcttggtccccaagactgacagtctattccttgctcagccctgacatgatggccatatgaccatgtgaccgcttttctgacccctcatcacctcatcccagctttcatagaccctgactctgttacctgtcctcggtacaccgccccatgggattggaaggattagaaaaggagtcaggcctgttcacagttcagcacgcgcagcacgatccttctccagttctttgattcgaactgaagctgaccgcggaagcgtggtgtccggaggggtgtccatgtaccgacatcccccgtggagccgtgaggaatctcttcgcgaacatatcaggctcgagggtagagaccattgtgcccgcatcatgtgacgtccaaccagcggcccacctcttcacacccaggaacgctctcgaggtgccgggacgtcagccccaccatggcggcatcacacatcttcggaagcagtctcatggacttgatcgaggcgggcggcgatggaccgattgaaattgacacgaccctgctgtacagcgccatgccatccagagaaaacagcactgccagctcaccgaccaggcaaccgccctcgaggcgggggtcccagatatcacctgaggctttaaatgctgaccaattggattcccagctgaaacacacacttttgcgcccggaaagaggcttggcaggtgtgtttagggatctggtagtggaaagccatgctggtttgctgggtatggtagctgcgacacttgctgatccccaatatacaccagaaacaagactctcctatgatcacactcatgcaacaggagatgattatcatgagtctcaaggcacggcaggggcttgcaagacgcgaaaatcgctgtggcaagagcggcagcaatcctggacttcaagacagcctcccattgaagaccgtgtgcggttgcaggctcgacggagggagcttaggctagccagcttgcgtgaggaactagaaagggaagctctgggagagtgcacatttgctccaaaggtatggtaaatgatgggtgggtgggatgcaaatctctgtgatcgtctggtgtgtcatctacagcattgcattacatgccctctcaagttagtcctctacaccaaactgagagcatgtgcagccaaaagcaagctcctccctattccattgcagctggtcgctgactcggcgcatgtccttggaccagactacccctccctgacgacgaggaatgctgcactacacaggaaaagggcttgcatgcaggcgagtaacactcaattgtgggggaacactcaacacccaagtcgtggtcctcaagtatgcatcgcatttcccctgtggggcatggcatgtcggatactacaagatgggaaccccgctgtcggcacttgcaggaggaagctgctggaccgtttaagccagagctgaaccccagatctctcatgctggctgaggctgcagcagctcggaagctagagggagggttggatgacagaaaggacactcaaacacagcagcacagtccaggtatgttcatgaaccaaggcatgtgatgtcatccgggttacatgcagagcgtggtattgacatgggcagcgctgagccaccacatggaccacctaaacatgcccagcccacacactcatttgtagaagatgccattgtgcttcttgcagagagcatgctcttttccacttttatcttaggtatacctcactcctctctcccctcgccctcagtatgtacctttgagccaaaactctacttggcctctcagcggttactggagacatcagccaccgtccccgcatacttccctgagcggcaaaagtactttgagctcaagaagcaggagcgattgcagcagctacaagctgacgaggtgggggccgccaggggtgccctgtgttgccttgagcctgcaatgggttctcaacctacaaagagctgggcctggtgtaaaatgctggtgtcatgcttcggccctccggcatgattccctaagcaaacacgacattcgtctcacaccagcaccattccctttcccaccccatgtcccccccctgcacaccctttcttcccacgcaagcagtcgctgaccttcgtgccacacacacggcccctgcctggtgccnnnnnnnnnnctcactttcccaccccattccccccccgtgcacacctttcttccaacgcaagcagtcgctgacctttgtgccacacacacggcccctgcctggtgccgccgagcgtccagccgagacgcctgccgagcgagccctccgaatggctgtcaaggagcccgccgaagcagcggcacgccgagccgccgctaggcaggaagccgccgctgcgctctccttccagccggcgatcaacgcgcggtcgaggcgcatcgggagggtaggcagggtctgcaggggctccagtgtgccttgctgttctggagaaaccaagggcggtgctgtctttggccggctcagcccctccactgggcacgttggtagatgcttgcttaggatggggccctgtgcagtcaacctcctgtacgccacgaccagtgatctgctgctgcacactgaatgtcttcctgccgctcaaaaacgccatcctgaatcatgatcgcaggagagtggggtcgacgtgctcctcaccaggcctgccgtgccggcatccgcgaggagtgcccaggatgactcggcgccgccgaccagtccgatgcagcacaagccgctgaggcatcggcggcgagggtcacctggcgcagcggatgctggaagcacagcgccctcccacctgcccctcccggagcgcgcgctgcagaaggcagcagagcgcgaggctctcctcgcggcaaagcgcgcggagatcgacgcggcgcggctggcggagtgcaccttctccccggcgctggtgggcggtccccggcggccggcggcgttggccgccgcgccgccgccccgaggcctgggccgccaccttgagctgcagcggnnnnnnnnnncgcgctggtgggcggtccccggcggccagcggcgttggccgccgcgccaccgcctcggggcctgggccgccaccttgagctgcagcggctggcggcaaagcggcgggcggaggccgaggagagggcggcgcaggtgttccggctcgccccccgcgcgccggcgcaccccttcaccatcccgcagccatttcggttggagggtctggccaggcaggcccgcaggagagcggagggggaggagagccaccagctggcatagggggccttgagcggttgtgtggccggtgggcggacgagggcaacgctgaagacgctcattcctcccccggtcacgcattcaaccgagtatccattgctgcgtgagccttgctgtgcctatcctttaaatacgcgatgcatccccggctctgtcacggatgcccaggcaccgagacccagggcgcgctcttcaggcatgcagcgccacccccaacacccccggcacccggcaaccctcccagccacccttttcccctcacgcggagtgctggtccgcgtggtactttgccaggctgccgcccgccaggcgcggccggggaatgtcgcccaccgcgcgacccagcgcctctgcccgcgcgcgcgccagctcggcggcgcgccgccgcagctcggcgacggcggtggggtcggcctcgtcctccggtgggccgtagccccccccgcccggtgtcaggaggcggatgcggtcgccgccctgggcctggacggtggccttgccgcccaggctgacggtggtgccgtcccggcgttgccacaggttgaccccccgggccccaggcctgccccccaggataccaaaaggggccagcgcgcgtcgctcggagaggatggaggcggtgaggggacgcagaaactcgatctcccgctccacgccatcgccgccgcgccacatgccctcgccaccggtgcctgtgcgcggttgcggatgggcgcgtggggttgcgtgattgccggaggagaggaggatgaggtatttcggcacccccaaagtaccagccccagcactggcacctggtctgaggcagaagcggtgcaggaccagcggaaaccgacgctccagaatctcggggtcggtgatccgcgtgttggtcatgtgggtgtgcaccccggatcgcccgtgccagcccggcccggcgcccgcgccaccggccaccgtctcatagtagcccagcccctcgtccccaaacgtgaagttgttcatgcatccctggcgacagggagccgggagtacagggttattgttcaaggggaggggggatcatgagggagccaggttgcaaagcatcagcaatgaattactaccgggcaaagtggccaggcgatgccgggcgactcatctcaagcttcgccctctccctgtgctctcctgtgcgctccccgcttcatcacaaaccccattccctcgaaacaacaccccaaccccacctgggaggctgccgcggcctggaaggccttgagcaccacgtctgtcacgcgctggctggtgagcacgttcccgcccaccacccccgcctcgggggaggggtggaggagggagcgcggggggatgaccacctggattggtgccatgcagccatggttgagcggtatgtcgcgcgtgaccatgcagcgcagcgcgtagatgatggccgaggcggtgacggccgggggcgcattggtgttgccccacacctgggcgcccgtgcccgtgaagtcgaagaccgccgaccccgccgccgcatccacgcgcaccgccaggcagatgggcgtgccgtcgtccatggagtcgtgcgcggtcacgactcctccttcgcccaggccctgcgtggcggcaaaggcgcggagcatgtcgcgcacagccgcctcggccgctgcctgaatgtgggccatgtaggcgccgaccacgggcagcgtgtactccccgatcagcgagcgcacgagcgcgatgccgcgcgtgttcgccgccacctgggccttcaggtcggagaccacgtcggagaggttgcgggagcccacaacccccggggggtcaccgggtcgcgtcccgggcgccaacatcagctcccgcagcccttcctccatgaaccttggatgggtgggtggaggagggggggggcgggatgagggagtccagggtggctgtggacggcattgtggcattgggcactttggatgcgggagtgacacgcctagtcaagctcggtagagcaggcaagcgagcaagcgggcaggcaggcgcagtgtcattcccaggcagcctgacgactctgcaacattgtcgctgcatgcggctcgggtgatgggctccgcagagggatctcccagagcccccaggccagggtggtggaaagcagtcgacacacgtacttctagcggcagctcaaccagcctcatcgccccaccccctcccagcatcaggccagacctgccgtgggagacgagcttgtatgaaaccacggccacaccctcctccaccaggaggtgggagtgtgggggcattgaccccggggagatgcccccgatatctgcatggtgcccgcgtgaggcgacaaagaagacgaccttgccctcattgaacacgggggtgatgaccgtgatgtcgggcagatgggagccacccgccagctgagggtggttggccatcaccacgtcgccctcctgtgcagggatgcaggattgagaggcggtgggatgagtggatctaggcagggtgcacaccacggccctgcgccacagcctgccatgaatagaggtgcggaaccccctggccactctttccgcactggaccccatccccatcgaaaacaannnnnnnnnncagaggcggtgggatgaggggatctaggcagggtgcacaccatggccctgcgccacagcctgccatgaacagaggtgcgggaccccctggccactcttttcgcactggaccccatccccatcgaaaacaaagaaaaccccctcgcacctccaggggtccatgcagtctgcacccctcgccgtctggcgcgtagtacccaatctggaaacggaccgcctcagacattgcaccgaggtgcacgggtaggtggggcgcgttgctgaccaggcggccctcggggtcaaacagcgcgcaggagaagtctaggcgctccttgatgttgaccgagatggaggtgcgctgcaggacgcgccccatctgctccgcaatgcccatgaatctgcaaggggagagggaaggggggggggtagagaggggtgggctacaggccggggcacatgctaccctcctgggcgtctccagggcgtgcttgcaacaccatgccctcacagcacaatccttcccgatcctgctgggaacccaacaatctctcccatcccccgctcaagcacccaccggtgggagaannnnnnnnnncatcctgctgggaacccaagaacctctcccaccccccgctcaagcacccaccggtgggagaacacggccagctggatggggtctgcttccagggacaagccctgcttgccccccgcgcccaccgcctcgtccccgatgctgatcctcacgtcccccgccgcggtgaggaaagcggcgcaccccggctcaaccacgatcgtgctgatgtcgtcgaggaggatggctgggccgggcacccgctgccccggtgccagccggcccagcaggaaggcgggcgtgtcctgccggcccccgatctcaaagtaggcagacacgacggcgtcgggggtgggcacctcgtctacggagtgggggtgtggtggtgatggccgggtgggcgtcagtccactgggcacggtatcgcagagctcgtgatggcagtcagcctcactcgatacacttcccccagtcccagctgccacctgcctgtccatcacctttgcgctctggcgtggggtgggcagcctgggctgcggaagaggtccccacgcccctcaccctcacgtcatccaccacgatgtcccggccctccagcacaaatccaaattcacgctgcaatgaggaaggcgaggaggagactgtctcggaaacttggcgagaagagccaccaggcaggtcctgcacgggagcagacagagagacgctcattcaaacacctgtcccctctcacacccccaactcccaccttgtatcccgtctcgaacgcggcggcaaagttgccatcctcgggggtcagggtcatgatcggcacgtccgtcccgctgtaccgcaggttgaggtacctctcgcactcaatctgaccccggccgaagccctgcgcctccagctgccccgtcacctcggcctccagggcgtccaagcgctggtgcagctgcgtcagcgacccctcgctcagcgaggttgccgccggctcctgtgcatgtgcggtgtgggaacagcattcagtgatctgacatagcgacatcaggttgacagacataggacaaggggggtggcgtcagacgctgagtgccaggccagggaatgatcccactcaagggccgcccgccccctccccaccccccctccacccccgcacgaccgcgaatgcacagacacaggcacacaagtctcccacctcttcttgcgcagttcttccactccattcacccacccaaagaatctggacccatgcatggccacccaatccacaccgccacaacaagcaacctgcgcctccttgaccacttgggccagcccgatgccgacggcggagaggatgccggagtagcggtgcacaaagacggttcggatgccgagggcgacggcgatggcgcaggcgtgctgcccgcctgcgccgccgaagcaggcgaggacgtggcgggaaacgtcgtgccccttcatctgagtcagcgcgcggatggggcggcacatggcctcattggccacacgcaggaagcccaccgccacctcgtccaccgacttgggcggcgcgccggcggccgcgccgtgcgcattcacctgctccgtcaccgctgccagggctctcctgcgggcgagcggcggggatggcaaggtttggaggggatatacgcttgccccacggggacagggttggnnnnnnnnnnttcctgcgggcgagcggcggggccggcgagcggcggggatggcaaggtctgaagcgggtatacgcttgccccacggggacagggttggggcagcctcggaccccatggacatgcatcggctccatacccgacgcacccatccgtggcccccaccccccaaccccccacccctccatccagccgccccacctggcgacgtccaggtccaggggctggtcctccgtctcgccaaagatcttggggaagaaggcgggaacgatgtggcccagcaccaggttggcgtcagtgatggccaggtgcccgcccttgcggtagcagacgggacccgggtgggcgccagcggattcgggtcccacgcggaagacgcccgactcgaagaagaggcgcgagccgccccccgccgccacggtgttgatgtccagctggggcgcctggatcgtgaccccggcggtggtgctctcaaagacgtgctccagggtgcccgcgtagcgcgacacgtcggtgctggtaccgcccatgtcgaagccgatgagctggagggaggcggggtccacaccctcccactgcgtggtcagcgcatacccgacatacccacctggatcaggagggagaaggctgggatcgaggaggaggtgcggatgtccacactggcctaccacccaggtagcttctgcatgcacacctttcggcatcgcgaccccatgagactccatcatccagaagcattctcgcaattcaaatgatacctcggtccgccctcctatctgcgtcccagcttgcctgcaggcccagacaggatcgccttgtgccccgagaaggcgccaacctctgtcaggccaccgtctgactgcatgaagtacacgggggtgtcctggatgcccgcatcgaagccagcctggaaagtctggatgtacctgttggagacggtgggtgagggggaggagcatcagctcgaggtgagagactgatgactttttcaaacgcaaaatcaacaagggcatgttgagatttggggcaggtgccacgtcgaggccagtcctgcggtggcagatcctcgacacactcagcagagcgcactgcatcccaggggccaggcgctgtaggccaggcacccattcgaaacctgctgcacccctcagtcttgctccannnnnnnnnnaccaggcgctggaggccaagcaccccttcaaaacctgctgcacccctcagtcttgctccaagcagatcggccctcggtctcagaaaattcacctgaggatgtggggcgtgagataggcatcggcggccgcggtgtatccccgcggcaccatcttcaccatggccatgatggaggaggagagcgagacctgtgtgaagcccagctccagcgccagctcccccaccgcgcgctcgtggtcggggaagatggccgagtgcttcagcaccacggcaaggctggcgatgccggactccctgacctccagcaggcgcgtgcggaggtcctccaggtcgggggcccggcgcacgaccaccgcctcgcccgtggtcgcgacagccgctctgccctccaggggatgccgcgcggcgtcgcccacggggtccctccccgcgcggctggggagggtggggggaaaggggtgttttttttgtgctagaagggatgtaaacagggaagaaggaagtgtcccaggaggtggccgacgctgggcnnnnnnnnnngaaggggtgttttttgtgtggtagaagggatgttaatagggaagaaaaaagtgtcccaggaggtggccgacgctgggcacgtcctgaggggtccagaggtagctggagcttgtacaagcaacagcgcagccctggggcagtgcatgcaccgctggcactcacatgctgggtgtgtctcccaggggcaggaccacctgctcatcgcactccaccgccgtctcgtagaggacgtctggggccgagatctccaggtcgaagatctcgggccgggactggtttccgatatggagcaggtctcggaacccgcgggtgaccaccagggccgtgcgctcacccttgcgctccagcaacgcattggtggccacctgcagggtgtgtcgtggcatcggatgtggcgatgtccatgatgcagcactccggatcacggctgggcggggcaccctgctctgagcccccacccagccgaacattggtgatccgcggaccatacacaccgtcgtgcccatgcggatggaggttatcctggaggtatccacggggctggacctcgggtggggaatgcccgtctctgcctccaggatgcggcgaatgccctccctcggggcatccggatagtttgctgggtcctccgacagcagcttcaacacgcgctggccggggttcccctccgcatccacaaactctgcaaacacatcggtgaacgtccctccccgatcgatgctgaagcgaaagtcccgcggaccagtgcccatggtctttcggaatggtggtgttggggggcgaggtccttgcgatgggcacaacgtagggacgcccagcgattggaagaagtacttttgcaggttctggactgggtctggcccagttcctcggcttggtgtgggacgcgcgggggcctgagtcggatgggttttctgggcgcggaagctgtccttgtcggaatcgcaggagatgaccgaactcgagacaatccttcagaatctgagcgaaagagtacaagccattgcacagaataaccggcacagggacaggagtatggtttggttcaaacacgagtcatgccagcggcagccaggcctggggtgcaaggggcacttcacccggccgccccaccagccgtcaggcaggtttcggcaggtgcggggccccgataccctgcctgccgccccctgccgcgccccaccgcggcctgcaggtcctctgtgaaccccagcaggtccgccagggcccccactccggcatcacagtcgccgagctgcgccacgtcgcgccaggcggccggccgcggcgggaactcgaagcccttgcgccagcccacggcgcgcagcgcggcatcgccctcgcccaccagctcgcggttgatgagcaggcgcggcacgccctcccccacgcggtcgatgagggaggcaaatggctggaccaccaggctggtgcccatgacgatgagcaggtcggcagccgcaaagtcgtcggccagcgaggaccagaaccgcgccggcaggtcctccccaaacatgacgatgtcgggcttcacaaggcccttgcacccctgcgcatgtgtgtgtgtgtgcttgggtgttcgtggaaggccccgtggtttgacgcatgggggcccggagggatgacccctgcagcgggtgcgcgcagtggaagggggacagatgcacaccaggcctttggtcggccccagccgctgcactccccttccccagaggctgcgtctacccccaccaatacctcctcgggctccaacgatgcaagcctccccgtaacccccctccccacgcccaccttggaagagcagcgaggaatggccacgctgccgtccgcctggccaaacagcgcctcgcggacgtaggcggggtcgtaggagcggccgcacgcgacgcagctggcggagtcaaagttgccgtgggcggggatgaccaggtccgggggcaggccggccgccacctccagcgagtcgatgttctgggtgtagcagcgcagcaggaggccccgctccgccagcagcttgaggaagtggtgggtgggggtggggtggaaggtgcccgggtacagctcctgcgtcgggttgcatggatgtgtgcatgctggcagtgcatgggcgtagaccgggaagggggcagcatggcaggggtgggaggccgcgtcaacctggactgcgtcgcccagtctctgctcaggcaggcccccacaccctgggcctgctgacattgcacaggaacactgtggcgctcaaggcttgcatgtacactcccgcaaacccaggattgcatcctacacccccccctccctccaaccccccaatccctaccctggcgagggtgtagaacggcatggggttgcgcctgaagaagtcgatctcaaagatggcctgggggtagggcaggtcgtactctgccaggcgatggtacagccccgtcccgggtgtccgaaaatcggggatgccggcagatacgctgatgccggcgccacacatgcacactatattcctggcccggcctggaacatgcgcagggagcgggcgcgcataaacgtggggagcaggctatggtggaaggtttcaagcagggtgcatgggcgtgcgagaacgaggggtttccagggcaacagtcacgcagcaactgagctgccgaaaaccgcacaccctgcgaggctcgcacggcatcacccagcccttcccacccaccacccagcgcggcgcaccactgctgatgtagtgtgcgatgccttggaggtccaggctggtcaggggggaggccctgggggagaggggagcctggggctgggcatccagtcggaggacctccttgacccgattcagcacctccgcaaacgcctcatcggattcgctgctgctgcaggattcagcctcatcatccgctccgctttctcgtgcctcgtggctgctcccagcgccggcttgcaggtcaagccttggcgccccttcctggtgtgagtcgggagcggggggggtggagctgccggagctctccgaaagcgggggctgggcctccccctgccggctgctggtttggctgagggattgggaggactcgcgtggcctcatggcgacatctgtgggcctggaggagacgacgggttgggggtgggctggccccgctgtatccggcttgaccatctcaccgtcgctatgtggcccaattggatgtcgatttggcaaagatgctgtcgacatgtggacaaaagtcctggtacgctgcgtgtcactgcgccatcagtttgggatatttcatggcgcccgcgatgccccgggacccggactcgcagataccactggcaaatttgagtggtatcgcacatagagtgaacatggtcccccttgccgcccattaatattctggaccaccccaggtctgcttgtccagaacagattgccacattgcagtgtcggagctttggtgggatgaccggttgcacatgtgagtctccatgtgacaaatgatgggaggaagtacactgttgcaatacaggtcagtgctacgatggagatggtggatcaaaaatcgaggatatagtggtgcacatcctcggagcggcacgctaaatatacacagatgcgccggtgcctcagcagcagacnnnnnnnnnnaggagaagcacactgttgcaatacaggtcagtgctgcgatggagatggtggatcaaaaaccgaggatttaagggtgcacatcctcggagcggcacgctaaaatacacagatgcgcgccggtgcctcagcagcagactcaacaccttccctttctcatctgatgcagggaatgccccgccacttcctagctccactggtggggtgaatagtgcatatcagtgatccacagagggctgacggccatggaagcactgatgcagccggtcccatcgccggcagttgcctaggaactgctgagcagtttgggttaagactccaggggagggaacaaagtggattatggcagcacgtggccgaccctccgatgctccccggctgttgccagccgcgggctatattggacaggcaggcgggaagccggcccatgcacagcccggaaccctttgctccatgccctgttctgnnnnnnnnnnagcagttttgtttaagactccgggggagggaacaaagtggattatggcagcacgtggccgaccccccgatgctccccggttgctgccagccgcgggctatgttggaaaggcaggcgggaagccagcccatgcacagtccggaaccctttgctccatgccctgttctgcatggtgtccgaggacctttctataggacgacaatgtgtcacatctccggggctgcctgcttcagagggatgtgctgcgcggggccgcggcttccgtactcgcttgggtaaggtgaaaaattccgacgtgtcattccaaatctgggccggcttcattacttcgcgcacctggcaccatgtcatatacccttaggcaattatttctgctacatacattgtatttcttttgacttggactcgaccccgcccgaggcttcacccgcaatgacttccactgtgaacccaacgtacgccccaggtgtcgtgcatgacaccaagaagcatgacgacgcccccgagttcgccattctggctcagcgcatcgacgcgctgaccactgtcctggctgcgtctgcccagggccacttccagcgtaacctcgtcgcagcgtgagttcctgccagacctcgggcgcggtggattgtcgctagcgacgcccccgacaccctttttccgtgcgggatgtccaccgccgatgtttgtggcagggctctgaccttacaatcccctgctgtgccacctcaccgcctggtcggaagctggaggggttcctcctcgtatgggatgctgtcggatcatttcgaccccggatcgcctgacccccaatcgcctcctcccactcccacagtgacatcggcaaccccgcccccctgggctttttcgccttcgccatcaccctggggctgtacnnnnnnnnnncatcgcctcctccccactcccacagggacatcggcaaccccgcccccctgggattcttcgccttcgccatcaccctggggctgtacatgtgcgtcgaagcccgcatcgtcgagcaggcagccctcttctacgtcctccccttggcgtgagtggtgttttggagcggtggaggtgatgagaggcacgggcccaggtggcgcctcaccctttgcattgccttaattcccccccgctactccacccaattcacatcacagtatcttcctgggtggtctggccatgtacgtgactgctatcctggagctggtgcgccgcaatgccctgggctactccgcctttggcgcctatggcaccttcttcatcgccgtgggcgtgcacggcatgtgcgaggcttcgggcctcttcttcctccccgcccccaagggccagcaggccctgaccgccctcttcggcatcgtctccctcgtcttcgccgccgtgtccgtggccatctgcctcctcctccccatcgcctttgtcatgctcgccgtcctcttcttcaccctgtctgcgggcttcgtcaaccccaccgccaccaaggccgccggttggtggggcctggtcaccgccgccgtcgccatgtatgccggtgagtcgcccttcaatgtggtccgctgtatgtgtgggggcgttgcttcatgctcatgttcctgtttgcgggataggcgcaagcagtgtcctttggggcttaactgcaatgctgggctgcaagctttgaaggccatgagagaagggggtcatgcccttgtgcagtgccgccctccgtcacacgcaacgcgtgcgacatcccagcctgcttgctgcacatctgtctccagctcacgnnnnnnnnnnttcatgttcttgtttgcgggataggcgcaagtagtgtccttttgggcttaactccaatgctgggttgcaagcgttgaaggccatgagaaaagggggtcatgcccttgtgcagtgccgccctcccccacacgcaatgcgtgcgacatcccagcctgcatgctgcacatctgtctcaagctcacgacccttccagccatgccatcagcacaacacatgcaccgacgcccccctcctaccccctcccccgcaggcgccgccttcctgttcgaggagatctggggcaaggagatcctgcccatcttctacaccaagccctacaaggtgcatgccgcgcacctcttcccccgcatctccaccagcgacccgcgctccgtcaccgccggtgtgccctaccctggccgccccgagatccaccgcggcgacaaccaggtggctggacagaccgcgccctccctggtggacctcaacagggtcaagagcccccacaacggcgcggaccacgtttgatggggttccttcccttccagaacccaagaaacctcctgttcgtcaggtcgactcctagtgttccgtatgacaggtccctcagaccatcgcctgnnnnnnnnnnagggttccttcccttccagaacccaagaaaactcctgttcgtcaggtcgactcctagtttttcgtatgacaggtccctcagaccatcgcctggcacaaaaccctgtccccatcccatttgccaacccaacagccccacaccgtggtgccaggggccgctgccccttgacaggcggtcctttcatgtttccgtggaattattacgtgccgtgaaattattacgtgccgtggctgcccatggaaacccgtccgcccctgctcgaccttgctcgcaaggtgggacgggagtggatggcatccaggcctcgcccaaccaaaccgcccaagtgcttaccgtatgagannnnnnnnnnttgttgtgccaggggccgctgccccttcacaggcgctccgtttatgtttccgtggaattattacgtgccgtggctgcctatggaaacccgtccgcccctgctcaaccttgctcacaaggtgggacgggggtggatgacaaccaggccttgcccacccaaaccgcccaagtgcttaccgtatgagatctcactcccctgtctgtcacttagatgcttccattagatgacctcatcgcatgagtgggaagcaggttgtctccaagcctccgcttcgtcgtttaagttttgaactctgagaaatgcagcagaggggtgcgggatccagaacatgctgtcggtgggcgtattcactggcaccgctccgtttgattggtcccaagctgtgatagtaacggccaagcgctttcttcttggcctggaggcaccctccagcgtgcattaacggtggtgtgcctctcgctcttgatgttgcacattgccaacgacacaggaggggcgtttgtcagcactcggtgcacgcttgtgtggcatcgtgaggtcctgatgggcagggccacactggacatctgccagggatcccacccaagagggcacttcaagtcctgctggtggacatgtattgatctcttcacattaaattgcaacagcaggcccgagtaagtcgggctgaccccaggctgcctcaactatcttgcacttgaacttgtccaatgtatgcgtgtggtgtcccctaagaaggcgctgcaggacatttatcatcctgcaaccttacagcagacaattactttggatttgcaatctacaaggccttcagatgctacacaacacctcgcannnnnnnnnnccttggcctgaaggcaccctccagcgtgcattgacggtggtgtgcctctcgctcttgatgttgnnnnnnnnnngataaatgcgggtggtgtcccctaagaagggcgctgcaggacattctttcatcctgcaaccttccagcaaacaatcactttggatttgcaatccacgaggccttcagatgctacacaacacctcgcaagccctagatctgactctccgaagtgcaatgcggcagttacagcaacgccccagcggatgtggagcatcagaaaagtgacctggccgagggcaagcaatccattgtatgagcctgccattcagcactggtggtcctcggagggcgtctgcactccaggaagcaggcctagctagcctcgctgcggaggaggtagagcggaggtaaggctgagcaaacatgtgaataccagcagcaaatgaataacgaccaaacctcagcagttggtatgacttgctagcagcagcagctccacgacgcccgccagccagagacattcagggaactgagtggaaaccgtgcctgccccaccacgcctnnnnnnnnnngcgaccaaacctcagcagtggttatgacttgctagcggcagcagctccacgacgcctgccagccagagacattcagggaattaagtggaaaccgtgcctgccccaccacgccttccctgcccttcaccccttctccctcaccgccagctcaccatctgttgctgcagcgccagcacctgcgccttctggtccggtggcagctggtctagctgcgccggggtcagggacagcacttgctccagcagtactgtgtgggaggaagggatgaggatttggattgccgagatggtgatagggaggatgagccagcgtcaaagcgatgcttgacaaggcgctcagagcagtgtgtgtcaagctggggcgccacattcaaacgtatgctcaacatctacccgcctgtgaacccccccaacccccccttctatgaccttgctgctggtctggcgtcatgcccgccgcggcagacagcccggcggcggggccggcgttgtgcgatggcgcgccgccgtacccctgctgcggctccgtcatgcccggcgcaaaacccgccctctggcgcgggtcggctggcacggccgacgccgcgtcggcgtggggtgggtactgccccgcaccagcgtggtacccgnnnnnnnnnncggcgtggccgctgccgcgtcggcgtggggcgggtactgccccgcaccagcgtggtacccgttgccgccgccgtaagccgcacctgcgccgtgcgccggcgccaggcccaccggggccatgggcgcgtaggcgccctcgtgcccgtcgccataggaagtcggcgcggcaccataccctgccggctgtgcgccatagcctgtcgactgtgcgccgtaccctgccgactgtgcgccatagcctgtcgactgcgcgccgtagcctgtcgactgcgtgccgtagcctgccgactgcgcgccgtagcctgccgactgcgcgccgtagcctgtcgactgcgcgccgtagcctgcggcaggcggcgccaggcccgccgggacggtgccctgcgcatacccgccggagggtgccgcgtagccgccgccggtaccgccctggtactgcacggccggcgtggggtcggcgtggcggtactgcgccggcggcgcatcgtgcgcggcgccggcgaacccacgccccggcatcgtccccggcggcgcgatgcccttgggcgccacgtcgccgcgcgggttgctcacgtaccccaggatgacctggctctggaacagggccttggccagcgcagggttggaggccagcaggtcacgcgcagccgcgcggtccgcccccgccagctcctgcaccgcggccagcagtgcgtagagctcggagcgcgagcgcctcgccagcagcttggtcagcgcatctgcggtctggccgggcgtgccggagccgcccagtagctgcgccgcgcccagcgcggagtggtaggccaggtcgccgcccaccacgcggctggcgttgggcgcgcgggaagctcccgggaagccgcccccgggcgggccgcccgccgcggatgggggggcggcgcccccaaacccggctgggcctatttgttgggtagaggagagggtgcacnnnnnnnnnnnnnnnnnnnnnnnnnnnnnnnnnnnnnnnnnnnnnnnnnnnnnnnnnnnnnnnnnnnnnnnnnnnnnnggcgccatggcaggcctgggattcaaacctcagccaaaagcacacaaccgtgtggaggcaggcatgatttgcaccaatacagtgtgatttctgccacagtccccccctttcctccctccctctcccacccagccacacccgccgcacctccgcgagaggggaagcccccacccctggcctcaaagggtccaccctccgcaaaaacgatgcggatgacccggccattgaactccttgccactcaagtttcgaatggcgctctcagcggtgggaatgtcatggaactccacgaacccaaacccgcgtggcctgccagtctcccggtcgttcacgatcctgcatggccattgggctcttgccttcagcacgtggcacaggggcagccaaccctgtaacagaatcctcaatgcagcctcggagtcctgacaagtcaccttacgctcttgacgggtccacacttgccaaagtagtttatgatgtcctggtcagtcaggtcgtaggacaggttgccgactgcatgggtgggaaggagaccctgtctgtaattggtctacacctttgctcctgccgannnnnnnnnntggtgggaaggagattctgtcagtaattggtctacacctttgctcctgccgaaagatggtagtgtacgtaccaaacactgcgggcgcgggctcgccagctccctgcagggcagccatcggaggggtgccgccgaaactccaaagccccgctccttattcctccctcctaactgtatgtatctggaatggagctggaatcccagacagcgtgcacgatcccacttttgtcaatggagctgaaggaccgcgccatcttggagacccaaaacaatccccacctagggcgcgaaggattctacgccgaggactggtatggtccagccattacctcgcaaagcggtgacagcgtcaactacattcctcatacatcctttacttcaatcttaacatagatccgcttaagatattcaaaagcgctgtcggacgcttccgcagtgcctcaggatgccggctgccagcgaagtgacgtcgctctacagagccattctcagggcaggtgggtgacggtggccggcttctcacatgtcacgtactcgccgatatctcgaatcacgccagcaggctctccgatcggcccctcacgtcatacctttgtgctctccttctccatgtgcaggttcagggattcctaactacaatattagagagtgcgtgtgaggatggatagcgcggcctgatttcccagtcgtgaagaatgtgtgttttggagtcaacccatgcattcctgattggcgcgcgatgtctcccctgcagatacgtgaagcggcgagctggcgagaagttcagggagcttccgaagggagggagtgctgaggcagtggaggctgccttccggcgaggctgcgaagaactggaagttgttaagcgccaggctgtggtctacaagctgtacgcccggaagcagaagagtgtcatggtgcggggggtggggtggggaggggtggggaggggtgtgagggtggggccatgcaatgaggggctcgtgttgcacgaggccgttgtttggagtgcacatggacagcgttattctcggcgcaggaaatggtcatgatccatcaaccctttcgttgcaggagctccctcccgagggtctggagttgaaacctgtcttgtgatgcacctagttggttgacaagggcgtggaggcagcacccatgctcggtgcagctcttgtgcagcctgtttgacaattctttgtggcttccctttgtataatatgtgctagcgtgagcagggtggtaatccagcagtctcagtttcggtttcagtatcagtagggggaagcatggaggcaggattctttggaggatgggaagannnnnnnnnnctggtaatccagcagtctcagtttcgttttcagtatcagcagggggaagcagggaggcaggattctttggaggatgggaagaagtggcactgcaatccctacgcagagtcagctgtgtggttcaatggctggaggcccatccggtacagcaatgttcaactggccaggccctccatccatgcactcaccccccatgccggccagccccgcctcggccacgcccgccacctcatccagcgccgcctcgacctgcgcgttgcagagccccagcgcccgccaccacccgtgctccagtggccctggctcgcacggtgggcccccgtcccgctgacgcggcacaatcaagacagatgcaacatgcagcgcggccgacgccagtgggcccgggcggtggcgcgcagcgcacgcacaccccgccagcgcgtcgcccagcaggcacagcgcggcggccaggagtgggcggggggctcgccgcgcgccggcgagcgcgaggaggtgcgggtgggggtggtgcaccctaaggtcgaagcgcagcgtgcgcagcgcgcgctgctcgtccaggacgagcagcgctttggccgcgtagtaggtgccgcccaccagggccggaggcggggtggcgagggggtcgggaggggggcgctggtacgcggagggcgaggcgcacagcaggctggccacgttgagcaggtcgttggtcacgaggcatgtctggcagcagggagtgggaggggggtggggtggctggtctgggcgagggagctgagctgttggaggagagcaaagtgacccagcagatgcgtggagcgaggtccatgctgactcagaatcgagtgagccccgatgcatctaataataggttcacatcgacgcacctcctcaaccttggcggccaggaagaccacggtgggcaggatgcgctggggaatgcatgggagtgcgaggggggggaggggttggtgtgtagctggctggcagatgaccctgaggaaggccagggcatgagagcactgcgcaccctgccagcctgctgggagatgtgannnnnnnnnncccatgctgagtcagaatcgagtgagccccgatgcatctagtgatagattcacatcgacgcacctcctcaaccttggcagccaggaagaccacggtcggcaggatgcgctggggaaggcatgggagtacgagggggtggtggtggttaatgtgtagctggctggcacatgatcctgaggaaggtcagggcatgagagcactacgcaccctgccagcctgctgggagatgtgatcacaggcctcagccctcccctcctccatctgcatgcttacctcctgggtccatgcagtgccttccccagcaccctcctcctctgtcgccagctgcagcctccagtacagatagagggcggtgacgacggtgcgatgaggcaggctcagcacgtcccccaccgcccggatgagctgccctgtggtcgcggctggcgtgcccgggccatgccgcattcggctgggtcaccaccccagccccgccatgcgggcaggcagacaaggctgtgcagtgtccagatgaatctggtctggaaacgttgcttcgaagaatgatagcactggcatgattgctggcaccaggtccttcctcaccaatcagattgctgatcgacttcgtcgcgccctcgacgacatccaacggcctcgcacctaccttgcagccaggttctgcattcgaagttgtataaaaaatcccatgactgctgattacacaagctctacatgctctccgctctatatgtcatctagtgtaccaaggatctgctgcaatgagcacaaagttgaggaactcacgccgccgccaccctagcatctgcacgcccagaggttcgcgccgcctgctcggcagcctggaggccttccgccccacccctgtgcttgtgctttttctgcggctgggtgagccacagctcgtcgaacaccgtgccgcctgcgcgtcgagcggggattgagtcgatgcgcaggcatgcatggatgtgtgcctttaaagcttcatcattcgcagccgaagcgcccatcagcatcaacaccccaggttgnnnnnnnnnncgagtcaatacgcaggcatgcatggatgtgtgccttaaatgcttcatcattcgcagccggagcgcccatcagcatcaacaccccaggttgnnnnnnnnnnnnnnnnnnnnnnagggcctgcatgtgcaggtgggtgccgttcatgtgcaggcgaatgtggccgtgcacctccatattctcatagtcaatccacgtgggggtctcgtcgaagccattgggcgtcaggtctgagagatattgcggggggtggagagagggctcactgaggctgaggaccctggtcttcgatgggggaaaggtgtctgcggatcacgccgtatggtttggggccaagcgggtgcgagaatgttgttttgccagattggtaggggacnnnnnnnnnngcacgcgccgtatggttgggggccaagcgggtgcgggaatgttgttttgccagattggtaggggactggatccacgaaacagtgagcagcccctgtgccaaccccggcccaggaacccagcccaggtggccaaagggcatcaccagctatcctgaaatccctcacctgccccgccatgcccaaannnnnnnnnnccccaggagcccagcccaggtgggcacagggcatcaccaactatcctaaaatccctcacctgccccgccatgcccaaagcagacgtgcaccgtgccgtggtgcgagcggtggtggccgtgcgagtgcttcctgcgcgggtgcgcattggaggaggggcgcatgtgattggaggtcgccacagggaggcatggcaggggcgtgtcgcacagctcaagtctcccacagcccttcccctttcacccttgggcaccaaacaccccccctcctccaggatcaacccccccttccccccaaattgctcacatgcagcgccccttatgcactgcgcaggtgcgctggtagctgtggtggtgcccggccaggaccaggtccacggcatgctcgcgcaggaggtactccagcgcggtctgcagctggatggcggtggtctgcttgcccgtgggccagtagaagtcgttggcgtcgatgtacagcggccggtggcccatgaggatgagccagggcgtgcgctcgcggtcgacggcggccaaatcccccgccagccagaggtgctggggcgaccccgcagtgtagtcgtgctcgctgctcatgaccgcaaagtgggcggggccgaagtcgaaggagtagaaggcctggtcgggggccaggttggggcggggcatggggaagcgcttgtagtagggcacgccgcactcgccccccgaatcgtcggaggtgcggtagaaggcctggcccggccagtcgcgctcgtggttggcgatggaggtggccgcgggcatggcctccagcaccgcgcgctgctggaacaaaaaggtgtcccacagcgcgccgtacccgcgcgcgtaggagatgtcgccgttgtgcaggaccatgcggtacggctggcgccgtggcgcgcggccgtccgcgtccccgccaccctcggcgccgaacccggcgtggccggcgcgcgcgtcggccagcatgcgcgccgccacggccagcgcgggctggtactccatggccgccagcgcgccgtcgggctcgcccacgccctggtcggccacgcccaggaccgacaccgagaggtgcggccccacgcccgggtgggacaggaaggagcggggggcggaggtgcgctcgtggggcgcgccctgcgcgtcgcccaccacgtagtagtagcgcgtgtcgggggtgagccccgccatgaccgcggtgtgcagcgcgccggggtccacccaccccgcgcccgaggcggggatgccgcacatctcgcggcgcgagtaggtctcggtggtggcggggatggcgaaacgcaggtcgtcgggcgcggtgccgaagcggacaaagggctcgcccacgtcgcgtgtggtccactgcaccagcatgtccacggggcggtgcccgggcatgaggtggatgcccgtcagctcgttggggttggcgttgggcaggacaggtccctcgccgaccagcttgggggtgccgccgtcgccgccgcggaccagcacgaagcgcatgtccacccgcaggttgatcaggcgcaagctttgggcgggaagggaagggttacagggctgggggttttaaggaatgggatggggccgcagggactcgagggaaagtgaatgggggcagcttcgatgagagggatggaaaacacctcggcgctaaggggtgagacaccaatcgtgggggcattcatggtttccctgtggtctccgcccaccctcacatcccatcccaaccccgacagcctgcgcagcaaactacctgagggtgnnnnnnnnnngttgaaggaatgggggggcgcagggactcgagggaaagtgaatggggccagcttcgatgagagggatggtgaacacctcggcgccaaggggtgaggcaccaatcgtgtgggcattcatggtttccctgtggtctccacccacccgcacatcccatcccaaccccaacagcctgcgcagcaaactacctgagggtggcgtgcccatgcttgaggtaccgcgcgtccgccctgacgtactcgtacttgacaggcgctgcgccgtgcaggtgggcatccgcaggcgcgtacagggccaggatgtcgtccctgtgcgggcgagccacgccctgcacgctgacctccacccagtcgccgctgtgctggagggaggtggcgttgtaatggatgctcacgtcgtgctctttctccaggggcagcaggcccgagggaaacttctctaggtagttgtgatactgcatgtcgccggcgacaaatgccaggatcgcgaggaggaccgccgtggcgagggtcatagcgctcagtcccgcgcggtgaggccgctgtgccattggggctggcagcgcaggcgacgtgcacgggtggtcacgtctgcaacattcgagctccacgttgatgttgtaacgaggagattttcgtgtcatcgtgacctaccgctcagaatggggcttcatgggataatagatgccccgcatcatctgtgtgaagcagggaatcctcgacagtcgcggggcctcagcaccctcagcaggaagtgatccagtttgcgagccagaagccaatggcagctcgcggtggcaagcgggccggcgatggatggaggcgtggaaaccttcatcggtcccacccctctgacatccagcatcgagggagcgtgcctgcccctgcggcgtttaaatcgaccgagcatgcccccgccagattgaagggccgctggcccccaacccctccctggtccatgcacctcttcctgcnnnnnnnnnncccccctccagagtgaagggccgctggcccccagcccctccctggtccatgcacctcttcctgcgatgcctggtctttcgcctggtccaggccctcctcctgcgaacctactttgcccccgatgagcactggcagagcacggaggtggctcaccgcctcgttttcgggtgcggtgggttggccggatcttgcaaggtccagatccgggaccctctcacctccgcccaccgtgctcggcctcacgccagtgcaccccaggcgctctcgcttcccagccatcaaccctctgcccctttcccttcccgcacagggatgggcacctgacgtgggagtgggcggtgggcctgcgcccctacctgcaccccgccctcttcgccgcgccctactggctgctggcggcggcgcgcctggacgcggcctgggcggtggtgctttcttcccacctggtccaggctgcgatcgccgccctggcggatgtatcggtgcatgccctggccgccgagctggcgcccgaggatgcgtcgaccccaaggtgggccctcgcctgccagctcgcctcctggttcaacggctacgccctggtgcgcacgtacagcaactccgcggaggccgcgctgtgcgtgctgggtgtcctgaactggaccaaggcagccgcggtccccaccgccgccgctcagtggcgctggctctgcgccgcggcggccgcctttgccctgcggccccacagcgccctcttctggctggtccccgggtcgtggcgcctggcccgcctcccgccctggcagcggccccgcctggcggcgatggccgctgcgctgggggccgccaccctggccctgggcatgctggtcgaccgcgccggatacggcaggtgggtggggcttcgagggtggggagtgcggggtgcaggggagggccgctcactgccttggaatcgaacgccttgccaaggtcatggtccatgtcgctgcattgtcctgagacgatatactctacccgcacagcgccatcctgccggcgctgcctcccatagccctgcacccccaccctcccactcccccccgctggtccaggtgggtgtgcactccctggagcttcttcaggttcaacctgctggaggggggcagcgcgcagtacggcagccacccctggtcctggaatgtgacccagggtttcccggcagtgctggcgtcctacgtcggcctcgcggccatcgccctcaggggccagctgaagcgggggggcaggtgcgcaggaggatggatagatctgacaggggtccgcgggtgctgagcaggatcttgcatctgatatctccgggtcgagatcggcgtaagaaagggcagcagctgtgtgcctcaccacctccctccttccctttggacattcccaaaacatacaaaggccacccaaattccctgacttgtcaacccccgatccccaacccctgggtcacgcaggctggtccccctcctggctttcgtcggctggtcggtggcagtgcagagcatctcggnnnnnnnnnntgtgagaacgggcagcagctgtgtgcctctccacctccctcctcccctttggacattcccaaaacatgcaaaggccacctaaattccctgacttgtcaaaacccaatccccaccccctgggtcacacaggctggtacccctcctggccttcgtcagctggtcggtggcagtgcagagcatctcggcgcacaaggagttccgcttcctcctccccgccctccagctcagcatgcccctggtgggcttgggggccgcccgcttgtggggccgcccgcatgttgcgctgcgggccgccctggcagccgccctgctgacgcaggtcctgctctgggccttcttcgggctggtgcagcacaggtgaagggtgccggtgaacagggcgccctggcggggtggtggtcgaggtccaatgggtgacggccacgtagcccggccattcctgaggatcggtgcttgttggcannnnnnnnnntgtcgaggtccgacgggtgacggccaggtagccccgccattcctgaggatcggtgcttgttggcaatctcgcgcggtctgctccgccaggctgcagtatttcctccaacatctcccccgtccccgctggcccatgactcgtcactcacactcccccatgcacccacacccccagggcccagatcggcgtcatgccactgctgcgcggggcggcgctggcgcgcacggaccccggcgcggcccccttgaccgccctgttcctcaccccgtgccacgccacgccctactgggccaggatgcacggcgtggcggctcgcatgcgcttcctggactgctcccccgcgcggtaccgcggagaggtggccgccctgaacgccgccgcccaggcctggctgcccttccccgacgggctctgcctgccaggccaaagcgagctggagtgcctgcatcggcggcccgtggacgtggcgaggggcctggtggaggcaggggcccccagccacgtggtcctctttgcgccgctgggcaccgtggtgggggcgacgctggcggagggcgggtacgcgctctggcgcagcctgcccaactgctgggtccaggtggacgaagactacccctgcaccctccaggtgtgggccaggacctgagtcggcctccgaatgacgcttggcatgccctgctgtgcatgtcctgcaagcagcaagcggtgcccatctcccgacacgattagctgtgaaccagattcctgggacagaccgacgcatggtccgcggggagggagtcacgtttgggggccatgcgatggaggccggccgcatgcaccagcatcgctgcgatcgcaagcaaagatccagttcccgatcgagaactccagcggaccgcggcgacgcagctggttgcgatgaagatcagatactagcctcttgggaggcaaggctccggggtcaattgaatccgacactctgaaggtgcccctccctacgtggacggcacgccgagaaggggcccctcaatcttccttcactgtaccgcggcctgcaccaagcttgtggtggaccatgaatttaccctaaatagtattcggaacgcatgcctggagattannnnnnnnnnttgtaccgcggcctgcaccgagcttgttgtggaccatgaattatcatagatagtattcggaacgcatgcctggagattaatataccgggtgtcagtggtgtctctcgggctcctttggggtgtaccagttaaccgtgagcgcccgaaccccaaccccaagaccgggggcgtgctgaaggtgtgcggcgccggagcacatctaggagacgtctgtatcccatcatgacgaccgccgtgtaccaccaaagaggcctgcatgcctcgacgcaccatgcacaagacgcggccgacctcgtggagctcctcgacagtaaatggtgcgcgccgggtccgtcaggggctgacccctcccctgcccagtccatggccccagtgaagtgtacagctgggtagatcccgcatcgactccgcccctgcaccccctgcctcccaggttcggagacgcgagctcctcctcgtctcgccgcatcagtaggggcggacgccgggacgccaagtcatacctcagcctggtgggcagtggccccagcgacctcagcagcagcgggagcaaggcggagatggaggcccgggactgggcccccctcctggcagacgtccccgagcgcgtgcgcgacaggacggtctcccgctccgccaacacgagcgtgatggggcccgacctctccaccctacaccagccccacggcggcgtggcggcgggcccgcggcagacctccccgcctgaggcggtggacacggagatgcggcgcgagccctcccccttcgaggcggactccgactcgcccggcggccgcctgggcacctgggccggccgtcagcgcgtcttcgccgagttcctgcgcggcgaggaggcggaagaggccggccgcgcggcggcccgggccgccgccgcggcaacggacggaagcgatgacgaggaggagggcgagggcggcgagcgggtcagcccgcgcacctcggcctccccccccgaggtgcagggcgtgcgcccccgccacatctttggccccgccctgctcggcggcgaggagcgcgccgccagctctgggcccgtggtcctgggggcaacgcgcggcccggcgtcaaacgccggcggccgcggagccgacagcgccgccgccgcgcagcgctcagcggaggacgaggacgtcaacatggcctggcgctggaggttcacgcgcaagtggcaggtgtgtgtgtgtgtggtgtgtactgggggtgggaggcaagcatgagcatcagcgggagggtgaggagcatggcctggcgctgggcggtgggcatcagtgccctctggcacacccggtcggaaggagtgggtggagcccgcggccactgctcagccgacgcccctgctcagccacccccccctgccccaccccgccacccatcagatggagcaggccaagcagtttgacccggcctacggccaggacggggaggacgaggatgactggggcgcggcgctgggctacatggccgtgcatggcgggggcctggaccttgccacgcctgcctcggtgggcgaggcccacggcgggggcctggccggcccctctggagacgccggcgcgggcgccggcatcgaggtctccccctccttcagccagcccatgctgctnnnnnnnnnngggggacgtcggcgcgggcgccggcatcgaggcctccccctccttcagccagcccatgctgctggacgccggcgggtcggccaacctgggcgacgcgtcgctggcgcgggaggccgacgccgcgcccgc

SEQ ID NO: 40285 - DNA, 7732 bp, Chlorella protothecoides
  modified_base (485)..(494): a, c, t, g, unknown or other
  modified_base (782)..(791): a, c, t, g, unknown or other
  modified_base (1160)..(1169): a, c, t, g, unknown or other
  modified_base (1967)..(1976): a, c, t, g, unknown or other
  modified_base (3717)..(3726): a, c, t, g, unknown or other
  modified_base (5245)..(5254): a, c, t, g, unknown or other
  modified_base (6090)..(6099): a, c, t, g, unknown or other
  modified_base (6794)..(6803): a, c, t, g, unknown or other
  modified_base (6918)..(6927): a, c, t, g, unknown or other
  modified_base (7289)..(7298): a, c, t, g, unknown or other
gggcgcggcggccggcgccgtgcccccccctgcgccggcctgggtccccgccgcgggctgctggcccatggaccccagctgccgctccaggcccgtcagcgcggggcgcagcatctggccaaagggggtggccagcacctcctcgggcagcgccgtgatgtgggccgggatgccctcgcccaccagcagacgggcaaagtcatcggagaagttgttgcagttgttgtcgaagagggagtaggcggcgggggagtagcgctccgacaggtcggccagcagggcgtcgcgggtgctcgagtccaggtgcgtgcggctggggtggaccggggggagaagggtggagtgagccgaggcgcggtgggcctcacggcagcgtcagaggttgcagggttgggcgggcagcaccttgctgcccatggacgtctccccactgctctgcctccccacccccccttcccgaatccaaagcctcctcgcaccccagnnnnnnnnnnattgggcgggcagcaccttgctgcccatgaacgtctccccactgctctgccttcccaccccccctcccgaatccaaagcctcctcgcaccccagctcgatgacctcgaccggcgtgccgcagggcgtggtgcctggggtggcggagttgatgccatgcccgtagaaatactcggtgccccctaccacgatggaagtatgccacacaccctcgatctgaatggggagcggggttgggcgtgttcaaaagggacgatcatatggatgttttgggcagacagtcgtccctnnnnnnnnnngtgccagacaccctcgatctgaacggggagcggggttgggcgtgctcaatagggaaaatcgtatggatgttttgggcagacagtcgtccctgtctcccacgacgcaccgttttatccagcagcatcgggctgaagaccttggccagacccctgctgaggtcgtagacatacagctgcacagcctcgccatcactcattctgaaatcttctttgtcccagatttacgccacgatactaatacacagtaagaggtcagctcgaatcttcccgcatgccttcctgggcagagcatccgtacggaatagtcgagaacgtcgtgagcgcgctacaatcgttcaaactgcaaaatcaaccccttcaagccccccnnnnnnnnnnttgccttcctgggccgagcatgcgtgcggaatagtccagaacgtcgtgggcgcgcaacaatcgttcgaactgcaaaatcaaccccttcaagccccccctccagtcacaaaactttacaggcaggaaggtttcggttccgggttccacggcgcctccaaggccatgaacaatctcaatgtcattcgccaaacgcacacacagtcctggtgtgcgctcacacatccttcgtcacagctgcgcatcgcggcccgccagcgcattgaacaggtcggtgcgggtgaccatgcccaccacccgcttgctgtcatccacgatggggatgcggtgaatcttgtactgcagggaggggccgaccagggctgtgctggagcgtgcgataggagcgcttcatggcactctcacagaactcgagaagctcctggtcactcggttgagcttgccccgcagcacaacgataacgtctgctcaccaccatccacccttacccaccacaccactcccatcccagcaccttgagcatggtggcggcagcgtgctccaccttgtttgtgacgtggagcgctatgggcggcgaggtcatgatgtcctgggaaaggggcgaagtagtgccaaggtgtggctgtggagtgggcagggctgtgaggcatgcaggcaatgttgtcacggcatgctcataatgcaccttgagacaggggctgccacagcaacaaaacaggaaaaagaaatgaagaaccatggacaagatacatcaaacactgtccttagaaatgcacccacggcccacagaccagtgagccnnnnnnnnnnaccggcatgctcatgatgcatcttgaggcacggggctgcaacagcaacaaaacaggaaaaatagatgaagaaccatggacaagatagatcaaacactgtccttagatatgcacccacggcccacagaccagtgagccgatggtcctgggcattgcgtccacacaggagatgtgctctgggcggaacaaagagcttcccttcaaccaagtccccacccaccttcaccaggctcccagtcttggtgttaacgtccttgacggtgatcacgccgatcagagcgtcatcctcgggcctgagcaccggcagaccgctgacaacatcaaagtgacgagaggcctgcgattgtgtgtgtttcaacagtgagtctcagatgaatctgcttgtttgggcagacatcatgttgacatgtgcaacatccatagtgtgctgccctctgtaggaactaccccttgccactcaccgcactgatgggatcatcgggatagacggtcctgagatccttctgcaaggggcagaggcaaacaggaggatctgagctgagcatctgatcgagttggctgcatagggctcccaggaaatctactcacgatggtcatcagcctccctcgggaccccctcaccgacatgacggacgccaggcgcgtggtagggtgctggccctctttcagcaccctgcgattgaagtactcctgaacatcgtcgtagctcgcgagtgacctgatcagggagaggcgccggagggttgtcgggacgcaaggatctattactctggtttgatttcggagctccatgcgcgcacgcactcaccaagaggcctcccactctccgctgacgatgccgtccgcgtccacatccgccgatgccctggagaggagcatcctgggacgcgccgcgggcctcgtgtgcgccgtgcgcgtgcgggaggaggcttgggtcaaccttccgacatgggcgaggctggtagacagagacagggccgacatgctgggctgtgtcaggatccttccgagatcggtttggatgtaatgaaatgtttcgaatctatgtcagggagttcgggtttaaaccgggggcgtaacggcgtgccgaggtttcggacgagcactctttaaaaagtgcgggatatggtcgagatctgcaaatcctggagggtggaaatgggctcaccatctttcccaacaacgtgcggatgtagcccgagtgacagttcaggttgccaatttatagtctcaaggtgtacaagaaaatagacaagggcatgctgcaccgtcaccatagactggagacagccacctcggtgacaatgggggctggaatcgtgctggcccagtcggtgaggtgggtggggaacaggcccatgccgtagatgcgatagcacgcatacgcaagacccaggccgttgaccaggcagtagataaggcggggagtcagggtgtccagcttcttctcagggtcgggcgggaagactgtggaggggtgaggttggcagttgaggtcagggcaatgaccgtttgtgaatgaggtggctggttgcctagggtgtagaaaccttcttggacagagcactgctcccgtgcaatgccagcgatgcacgccaggatcagtatacacttcttgcacatccatccttttgaacattttggaaagtcaatgtgcgttgttcattgccgggggcccacctgccctccagactccaaaattccaacatacgccccaaatgcagcaccgtacccctaccttnnnnnnnnnncgcacatccatccttttgaacattttagaaactcaatgtgcgttgttccttgccgagggcccacctgccctccagactccccaaatccaacataggccccaaatgcagcaccgtacccctaccttcgcccgacttgaggatggcggatatgggttggtacaccccagatgcagtggtcatgatggaaaagaggtggagctgggcgccggccatccacatcatgaagctcatcattgcaacattcttaaaagggctttgcgccaggctgaagagggccgcctggcggtttgcgaggttggagcgcctcgatgaagcgccggaaagctccgactgcgggatgggtcgggaggcagaggtgactgggcactccggtgaagggatccctggggcaggttcgggactttgcgtggcgagagagtcacaaacctcacctgatcccttgcgaacgatagatcgaaccctataggatctccaaccgtcttctttgatgtcactaggctattggagtcgaggtccaccttgaacttgcggaactcggccatggctcgccaataagcacgatggatgtctccagaagggctctcacttaataagaatatatgcagtacaccaaactttgtagaactatcttgccgaaggacagacttcactgggttcggcttgacgaagaggcatcgcatgggccagtcccaaaaccctgcctggagggcgccggatggtaatctgcttccctgccctgtcacacctgatgactgaccatgggatggataggatgcatcgaatctgtagagcctcgtttgaatctgaactttgcaaatatcccagggcaagcgcttgtatgctacccatgtattccctgccatgctcacttgacaaacactaccttcaacgataatgaatggaggctagatgattcggatctcgcgtatgtgaaataaaagcgtcctgcatgcatcctgctaaaagtgacaggtgtatgtccatgccaggatgtcagacgacggcgctgcccatgctctggacatatgtgtggaggtcagcttccagactgctgccttcaagcccatggccaggacgcactcctccatactctgatggcagctcctctgctggaatgtactccaagatggctcgtcgcatagcctcttgctcctggcaaggttcgggaaagtggccattagagggctggaattatgctcagaggatgtactcttgctgcgaaacaactgggcatggagtgtcaagcaccacccaccagcatccgggaatggcaacccgatctctcgtcatggaaaggccgctagcgccggcacccgctcagccgcactcacccctctgccgaagacgaccatgcgctcccggaccttcttggtgatcaaggggctgaccagtttccaggccagagacctgcacagggatacggcagggagtgtttgggcatccctctgttgaatcccgattctgggtgcctgtgcatgcccctccccatcccattcccacatcttgcactggagtaccnnnnnnnnnncctgggcgcctgtgcataccccgtcccattcccacatcttgcactggagtaccccagtgtgcgggcatgtccgccaccttttgcccgcccctcccgccagcctaccaccaggagggtgcgttgacgaggaaggcacggtgcaatcgctgaggaaagttgacagccaggagggcacccgcctgcagggtggcggcggggatggcgagagtgagggtctgcccgaggccctggcgctcatggcgacgccggggttcgttgatcgaagtcgcgccacggtggagcatagccctccaccccaagccgcgcccccctcaccttgctgatgaacttgaatccctcggagcgcaggtctcccatgctcagcgcccccaggtccacgatcttgtaggtctttccccccggcagcggcgccgtgtccagcaccttgaacacgtactcgtaggtgaacatgaggtgggcgaggagttcgtcctggcccaccccctcccgcgccaggcgtgggtaggcggcgggcagctgggacaggcactccagctccaccaccgacccgtcccgcgcccggcccagcaagccgtgcgtgtagtggcgcttgacggcggcgaaggccggctgcggccgaaaggccacgtccagcatgcccctgctggtcacaaagtccaccatgccgcgcatggcggcggcggcacgtgcctccgtctccagccccgccaggaagcgcgccgccacgtccggcgtcagcacccccgggtgcgcgcgcgtcagcgccagcagccccggcggcagcgcggcgtgcacggtgctggcgggggcaagtccgctccaggacagtgtccggnnnnnnnnnnatccggcgtcagcacccccgggtgcgcgcgagtcagcgccagcagccctggcggcagcgcggcatgcacggcgctggccggggcaagtccgctccaggacagtgtccggctgacggacagggagggcatcagcgtcctctcctccacgatctcgatgctctgcagggtcagggtccagggcgggggggcggggggcgcaagcggctggcgcgtggctgggaggccctcggccgcacgctcgtgggcaccaggctggcgacaccgcgctttgcctggtcctctccagacctgcaggtcgaggagtgggagggcttgcagatgctgggtcgggccggggtgcagagcgggtgcggagactcgtcttcacggtgagcctgcccagcatgcagacccattgcagcaagtccaggtcctcccatccaaccactcatcaccacagcacgtcacgctccccacctgccaccagggcccacgctccgagccaggccccagccttctccccagcccacatgccagcacgcagaagggcagagccaccgtcgtcacccagcggggcaggttccctgtgcacgtgaggtgggaggggggagggggctcttgactacatgtcatgacacccgactaccaggcagcaggcagtcatgcgaacacatccaccctcgcccaccgagcggggcctgcgcataaagactggnnnnnnnnnnagggggggagggggctcttgactacacgtcatgacacccgagtaccaggcagcaggcagtcatgcaaacaaatccaccctcgctcaccgagcggggcctgcgcataaagactggnnnnnnnnnnagagctcggcacgccagtcgcgccctgctgggctgcttggcggcagggctgcatcagtcggcgcgaccatgctgcccggcacgcgcgacgccttccgccccgggcccgtcggcggcgccacctggtcggcccaggtgatgctgcgctgaatggggccgggctggggcgggcgcggcggctgcggtgcggccgcgggccggccgacgaacaccgccctgatgcacgcgccctcctcctcacattccgcctcctcagcgagcgcctccaggggcccctgcacccccagcgtgcactccaggcgcgcagcgaggtggctgcccccctccgtcccccgctgcagctccttgggcaggcgctggctnnnnnnnnnntgcgcggcggctgcggtgcgactacgggctggccgacgaacaccgccctgatgcacgcgtcctcctcctcacattccacctcctcagcgagcgcctccaggggcccctgaacccccaccgtgcactccaggcgcgcagcgaggtggctccccccctccgtccgccgctgcagctccttgggcaggcgctggctgaccaccagggccgcgtgcttggtccccggctcccccgccccctcctggtcccaggcctgggccaggcggtgggggttcaggtccagggtcacgacccccagccccgtgctgacccagacccggagcagcgggcctgctgccggcgcgaagccacgcgcgccgcgcgccgcgcgcgcggcgcgcgccacgctttctggcaccgccagcgctgcgccccaggctggcgcggtggccacgacg

SEQ ID NO: 40286 - DNA, 11258 bp, Chlorella protothecoides
  modified_base (255)..(264): a, c, t, g, unknown or other
  modified_base (592)..(601): a, c, t, g, unknown or other
  modified_base (981)..(994): a, c, t, g, unknown or other
  modified_base (1210)..(1219): a, c, t, g, unknown or other
  modified_base (1285)..(1294): a, c, t, g, unknown or other
  modified_base (2459)..(2468): a, c, t, g, unknown or other
  modified_base (2896)..(2905): a, c, t, g, unknown or other
  modified_base (3850)..(3859): a, c, t, g, unknown or other
  modified_base (4187)..(4196): a, c, t, g, unknown or other
  modified_base (4750)..(4759): a, c, t, g, unknown or other
  modified_base (5081)..(5090): a, c, t, g, unknown or other
  modified_base (5265)..(5274): a, c, t, g, unknown or other
  modified_base (5949)..(5958): a, c, t, g, unknown or other
  modified_base (6294)..(6303): a, c, t, g, unknown or other
  modified_base (7054)..(7063): a, c, t, g, unknown or other
  modified_base (7418)..(7427): a, c, t, g, unknown or other
  modified_base (8185)..(8194): a, c, t, g, unknown or other
  modified_base (8603)..(8612): a, c, t, g, unknown or other
  modified_base (8806)..(8815): a, c, t, g, unknown or other
  modified_base (9147)..(9156): a, c, t, g, unknown or other
  modified_base (10299)..(10308): a, c, t, g, unknown or other
  modified_base (10979)..(10988): a, c, t, g, unknown or other
cccccccgcgcgtgccctcccccccggccccaaaccccaaccacacctttatggaatacggccttgccggcctcaaccaggtactgcacagccacagtgacatcggcgactggcgagggcggcctctcctctaactcgggattggcagcgacgggcaccgacggttcttgactgccacctgggcccatgccagattcctgctcgtcagcggtgctctccaccacgcctacagctggctcgcgtcgaggagaggtnnnnnnnnnngccccctgggcccatgccagtttcctgctcgtcagcggtgctctccaccatgcctacagctggctcgcgtcgaggagaggtagcctcggtttcctgttcagttgcagccgacgatgaaagagatatgcggcgggccgcctccgcctccacctcgctgctggcgccatagagcgccagagcgatgaccagcccatcctgcaggcaggttaggacgagggatgggcctgaatttggatgcccgccccatacggtaggccgcacaggggcccgcagggccgccctcaactgcaaatcccacctccagccaaggcactgaaacgcctggcgnnnnnnnnnntttaggacgagggatgggcctgattttggatgcccgccccatacgggaggccgcacaggggcctgcagggccgccctcgagtgcaaatcccccctccagccaaggcactgaaacgcctggcgcacctggctggcctcacgctgcgcccgtcgctcggccacgggccccagcagctgcgcggcagctgccgcttgtgccagcgcagctcggatggtggcggcctcctcctgctgccgctgccgcagcctggagtggttgagagtgggggtgggggttgttacacagtctttggtggtgcgacagaagtctcaactcccacccgccacgtgatatggattctgggtttgagtgggcgcaacacaagagcgtggccaggccannnnnnnnnnnnnnaggaccactgcatcaacccccccacacctgcgggactggatgcctcgcgccagaggccccactacccactccttgcccacatagtagagcagcggcggcaggcagtacgctggagaggtgggtgggggaagggtgagtctcggggcaaaactacctgtacatgctgacgccctggttaagcaccatccacagcccccccatcgcctggcacggcannnnnnnnnntgcgcccagatcaccgtccaggtatcaatgcctcggccatccttgagctggggcagggaatgctgnnnnnnnnnncgggggaagggtgagtctcggggcaaaactccccgtacatgctgacgctctggttaagcaccgtccacagcccccccatcgcctggcacggcacatacatctaaacagtgaacccccacacctcctgacccattttcaccaggccccagggggggccaacccatggcggatttcccccctttcctcctcccatttcactcaccggcggccaggatgttccagtccagcaacgggctgagcaggatcgggaactcaaacatgtgccccgcacggttgtaccgcagcttcagcacgatgccctgcaggcggtgtttggaggaaagtggggtgggagggaaatagagcggagacacacgtggatggcggccccaagcatgtggtgtgccggcttccatcgctgctgcagccatgccccgcccttgggccacaagcatggcacgcacgcgctccgcaagagtccagtgatcgggaataatgacgcagagagcctgccttcttcatccagcaccccctgtttgctggaaacctgtcacccccgcacatccacagcatcggtccctcgcaccgcgggctcggtccaaccccggtgcaagacctcacctggggtccggtgacgatgctgagcccccccgtcgccagttcagacagcgtgcgctgcccgcccacatccacctcggcggaggcggggccgagccggacgccggcccgagccgtcgtcttctcgcccacgcgccttgcgacgcgccccacgaagccggtcaccgctcccacctccacacggccggtgaggagcagcttctccatccggcgagtgatgcccagggacatgccggcggcggtctccggcccgatcacccaggagtactcgccctggagcgtcttggacagctgcctcgtcgtcaccagctgcgggttgttgcggagaggaggcaagggcgggagggtgtgcaggtggttggtgcaagcaatgagacaagttcttgaagaagcaaggattccgcaatgcatcctcttgtgacacgagagagtctcggagaaaggccatgaggtagcagtgctgggacaggaatgatggacggcagcacccatttcaccaaagaggcatgccggcgacattcccgagacacctcctacatgatgctcatcacacccttcatcacccacnnnnnnnnnngcaccaacgaggcatgccggggacgttcccaagacacctcccagatgatgctcatcacacccttcatcacccacaaagccagccgcagctcacctggagaccgacaccttcgtctggctgccacgtggcggtgaggttggcctgggcatggggcgacagctggacgccagaggaaaccgagaagaggctcttcaggcccaccgcggcattcacatcgagcgtcgtgtagtctgtggagacggagggaatgcaaaccttacaatactatggcgagtacacagccgaaactttgaccgagatgagcggctgcctaacaccaatgtccacccaactccaagacggcaagagcgctgcccatggccttcattcacatcccaagccccatttccaagcccgagacacccttggcagccagagtcaccactcannnnnnnnnntaggagcgctgcccatggccttcagtcacatccccagccccactccaagcccgcgacacccttggcagccagagtcaccactcacccgagtagacgcgcttgtaccccgccaggaagctgccaccccctacgttcttccggacattcactaggcctcccaggtgcacaatgtcttggtctgcagccaggacgccccaatctcgggtgtccactggaatgtcgaccccgctggtcatgtacaccgtcgtcagctcgggaattcgggacgccaccttggagtagggtttcaccagagctgtggtggcgtgaggtggaggtgggacaggggagagcgaggtgagtcaaatactcatagaaggcattgtggaactcaataaacgccaagtagcctggctacacgacagattgtagcagtcgcatatgaaaccaggcccattcctcagtgagcattggcatcttgacagacattaaggtgggccctacttaaaggaggaggacgcacaatctcacgaccagaaaatcacacacctgaagcatcagcacgaaagatgtatgcgccccggtagttgacttgcgagtcaatgcgggccgtttcctgctcaggaaaggtgtgacaccattagtcaagcgagagcactgggcaggctcctgccatatcaccttcaatacctgcattcgaccatcttgcacttccaaagccagctgcaatatctgttgcacatgtattgatcctcttcctgctgaaaaccagacacgaaaaggtagtcatccccccacccccccaaatcccccaacccaaccgcccactcatccaatcaagcacctggcgctccctgaactgctcccactcctttcgtaggtcgtccttattctttaccctttccccaagctccagtcctgcagccaggccctccttgccgtacacatcgtagatgtcacgcttannnnnnnnnnatccttattcttgaccctttccccaagctccagccctgcagccaggccctctttgccgtacacatcgtagatgtcacgcttatcagggttgctcagcacctgcaaaagattgggggacaggtatgcatcggggacaggttatgcaggcatcagaggaaaggcgtagtaacgacgagattgagggagacagaggggcaactggtgggtccctgcaacatccgaataacagattgcaacatctttcagattcattctcatcaaggccatccacaagtggaccctgcaatggcctgcatgtaccgtcgcacaaccttggtcacccacctcnnnnnnnnnntatctgtcagattcattctcatcaaggccatcctcaagtggaccctgcgatggcatgcatataccgtcgcacaaccttggtcacccacctcataggcttcttggataatggtgaaaagctgggcagcatcgtcccttctctccggatcctgggtcttgtcagggtgtagcgaggtggccaaggctcggtaggcgcgtcggatgtcatcctcagaggctgtggggcctacccccagggctgcatacaagctctggtcctcagtatggctgcttgctgccgccatgaagggtagtatgggggattcagacacgaagattaatggggcgcattcagtattgatggctgagtctcaaaatgcatactatgatgggctcagatgattcctcccggcccagctctggagtgatctacgtgacagacagcagcgcactctccaagtaggcaggggagaaccctttgcatagatttcgatccttctagctcgatacatggtgagtcttgtctcctcttcgccatatgcatctactcgcgcctggccccctcccagctggcannnnnnnnnntctttgcatagattttgattcttctagctcgatacatggtgagttttgtctcctcttcgccatgtgcatttactcgcgcctggccccctcccagctggcaatgcgtcagggggggtggggtagcgcgccgggtaccacaaaatacggaacctttcaatcaacagctttcaacagagagccctccaggtgcagccctgtgagcagacaggttccacgcgcacctcatctgcacttcgagggcatggaatacagctgggtggcatcgtcttccctcggatcgccgaattggcgcttccacccgcgtggttaggaggggatcccnnnnnnnnnncatggggcaatgcatcagcagcctacagcaagccggcgaacctccagaagaatacaaggtgagtggtgccctcacggggcttgcagggcatacgatcgagatgcgggtgtcccctcgggcgccgtgggttcctcctcgcggcgcgcatggagcactcctcggacacactcgctgnnnnnnnnnnataggttcctccccgcggcgagcatggagcactcctcggacacactcgctgatggataaccttgcaaaccttgcagcgtcgatggacctcaggacccggcgtcagcgatggcgtcgacggagggtatcgggcagcttctacatacactaccacggttggtgcagagcacggcagggagggtgatggatttcctgtcataggcccacagtgtgatacaaggccttgatcggatgagtcattaccttttaacatgtttgtgaatatcattcatcctcattcgtacgattcttggccctgcttgcagttcctaattctcgttggcactccaactcacctcctctgtcaacgcaggccaatgttgggatgggcacgggcaaggatcgctttgttttcctgcagcaccaggcaggaaggcacgcactggaccccatcgatgagcaagcctccctgaatggtgcggaggtgtcaaggcctcaattctgtgggtgcacagactctgatcatagatccaggaatggggttgggcatggaggccacaagccacatgctggtgtgcaggacttacaacacaagactaatgacaatgcttggcagacgcccctgagcagctcgaggctctggaaggatcaccgcctctctctgtaggaccccgtgcattgacccccccatcaccgnnnnnnnnnncctgatcatagatccgggaatggggttggacatggaggcaacaggccacatgctggtgtgcaggacttacaacataagacaaatgacaatgtttggtagacgctcctgagcagctcgaggctcttgaaggatcaccgcctctctctgtgggaccccgtgcattgacccccccatcaccggctctgcccacctgcaaacactctcccccccccatcctatgtgcagccaatacgtcgccggctcggcagcacggcggctgggacgagagcaagaaagacctggccaaatccagcaacagcgccctccgaccacgcgcctcctgcggcggccccccgnnnnnnnnnnggacctggccaaatccaactccagcaacagcgcccttcgaccacgcgcctcctgcggcggccccccgggcgccgactcgcgccagacgggccccctgaactggaccaagggcgagttgatcggccagggcgcgtttggctccgtcttcctgggcatggacaacgacaccgggcagctgatggcggtgaagcaggtgcacgtctccaaggccggctccagcaaggtgagcgagcatgtgacggcgctggaggcggaggtcaggctgctgcagcagctggaccaccccaacattgtgcgctacctgagcacggagaccaccaacgacgcgctgcacatcttcctggagtttgtccctggtggcagcatcgcctccctcctcgccaagttcggtgaggggggtggtgaagggggttggcgagcatgctttcagggggatgggctgggccagaatggcaggcgagggccgggaattgggcgatggtgatgctgactgaagtgaggaggaggtgcagggcacgatgggcctgcacatgaggctgggatggcccgatgcagtgtgtgatgctgcgtcgcctccctgtgtgtcaggcttcctgctgtgaactgcatggcagcagtggcgatttgatcacacccactccccgaaacactccatgtctgccctactatgacctcggacccccctcccccgcttaaggccatttccgggagacggtggtgaaggtgtacacccgccagatcctgctgggcnnnnnnnnnnccagggttcctgctgtggactgcatggtagcagtggcgacttgatcacacccactctccgaaacactccatgtctgccttttttatgacctcggacccccctcccccactcaaggccatttccgggagacggtggtcaaggtgtacacccgccagatcctgctgggcctggagtacctgcacgcccacggcatcatccaccgtgacatcaaggtgtgtctttgtgcgtgtggggccgggggtgaaggtagtaggttttccaaaagtcctgtgtaaatgttcatgcaggctgagaggatcaatgcagggatactcccctggctcaatgcatgcaacaacccagtcacaaacccacnnnnnnnnnnttgaaggtagtaggttttccagaagtcctgtgtaaatgttcgtgcgggctgagaggatgaacgcggggatactcccctggctcgatgcatgcaacaacccagtcacaaacccacccccttcccccttccctcatacacacaccctcagggcgccaacatcctggtggacaacacgggtttggtgaaactggcggactttggggcatccaagaagatcgaggacctagtgaccatcgactcggggttcaagtccatgaagggcaccccttactggatggcccccgagatcatcaagcagtcggggcacggccgccaggccgacatttggtcggtggcctgcaccgtgatcgagatggccacgggacgccctccctggagcgggctgggcagccaggtggcagccatgttccacatcgcgtcctccaaggggccgccccccatcccggagcacctctccgccgagtgcaaggacttcctgtacctctgcttcaacaggtgggggtggggggttgctgggtggggtccttgctctgcgcattggatggatgggtgcagaccgggaggggggtgggttggctggaggggtgccatcacatgccactccccgacgagcaggatgtcgggcgcagcatggcgggggaggctggcaccccacccacgcgccgcatggccgtcggtcgtcgacgtcgacggctctctgtcgcactctccctgcggcctatgacacgtcgtgaccagccgcccacagtggcacagcnnnnnnnnnnaacgtcgacggctctctgtcgcactctccccacggcccatgccttgtcgtgaccagccgcccacagtggcacagccaaggtcatccccactctggccttgattgcctccatgaaacaccccgtaggaactggaaggaccggccgctggcggcacagctcctccagcaccctttcctggcctcggtgccgccccggacggtggctgctccactggccagcatcgccacgggccgggctgcaggagtaggtggcgcccccgccatccctccagtcgccgctcgtgccgctccgccagccacccaggcgggggagcacgcggccggcggtgaaggggcccagggagacctggacagccccgcaatcaaggtgagtgcttgtgaatgaaggggtgggccccgaggaacacggnnnnnnnnnngggggcccagggggacctggacagccccgcgatcaaggtgagtgcttgcgaatgaaggggtgggccccgaggaacacggcagtgctgtcgatcacatcgcagcccgcctgctgccttggacttcaaacccggcaaaatcccgccggctgcaggaccatgcagtgccacgtcacctcctcgcccgaccccatccnnnnnnnnnnagtgatcacatcgcagcccgcctgctgccttgaatttcaaacccggcaaattcccgctggctgcaggaccatgcagcgccacgtcacctcctcgcccgaccccatccctctcccgcaggcgtggcgcaccccccccaaggccggcgggtctccctcgggctccagcgatgccggaagggtgggtgatggcgacgcatcggatccagacaccccaccgggaccctctggggaccccagccccgccaagggctcggaggggccggcgcggacggcgtcgcagggccgtggcgtggcagcgggccccggctccgcctgcggcgcgttcggaggcnnnnnnnnnnaccccccaaggccggcgagtctccctcgggctccagcaatgccggcagggtggatgatggcgaagcatcggatccagacaccccaccgggaccctctggagaccccagccccgtcaagggctcggaggggccggcgcggacggcatcgcagggccgtggcgtggcagcggggcccggctccgcctgcggcgcgttcggaggcggcgcggcagagggcgctggggttgacgcgggaacgatccccggccccttcgtcgtggcggccaggggcgcagtggcggctggcaaagccgctcacaccggctcgcccctcccctgccgcaccggccccggactctcgcagcggggagcaggtgagggcccgccgccgctcctcgcgacggaggacgtgggcgccaaggtcggcgtgccgcgtcaggcctcgcggcggcatgtgcgagcgtcgcttccctcgcccgtcgccgggcagcggggtggcggcggcggcgcgccggggcccctccagcgtgcgcaccgggctcgtgagggggtgggcgcggcgactgcagcccccgccggacctttgactgtcggtccgcccggtgggcctttgatcgcgtcgcagtcgcgcgacgccgacggtgcacggggcagggaccggtccgaggcgacccctcgccgacggcagctgtcagcggcgaccagcctgcgcctggccgggccacccccggccatggaactcggcgcgtgcgccgaggggactccaggacccgatcccggcattgccgcgcccgcgatcgtgcctgcggaaggcgagcgcggcggggacggggggcagtcctgcgtggacgcgacgggcacgagcggcgagggggggggtgaggcgggcgcccccgtccgctccggcagcacctcccccggccggcgggaacggcccgcggccacttccatccgcgccgcgccgtcggcgggcgtacgccagagcatgcccgcgctgctgcgggagcgggaggcgtcgcggtcgccgaccgagcgagcgctgtctgggagcgccgccttcctgccggggcgtgcggggtccgtggccggcaggcacctccatcgcaggccctcgggggagggcacagcagcctgccagcaggccgaccttgcacctggcgccgnnnnnnnnnnttgaagcgggcgcccccgtccgctccgacagcacctgccccggccggcgggagcggcctgcggccacttccatccgcgcggcgccgtcggcgggcgtgcgccagagcatgcccgcgctgcggcgggagcgggaggcctcgcggtcgccgaccgagcgctcgctgtctgggagcgccgccttcctgccggggcgtgccgggtccgaggccggcaggcacctccatggcaggccctcgggggagggcacagcagccggccagcaggccgaccttgcacctggcgccgaggcgccgggtggggactcgggggcatcgtctccactccatgacacctccaggacgtcctcgccggggcgtgcgggtgaggaggaagctgaggcctgggtcctgcacagcgtccccccttcccccgccctggtgcgccgctggcaggccccagcccggccccaggagggaatgccggccggcggtgcgtccgcgccgggcagcagcgaccagtccttggacccgggcagcaaccaggtgggcgcacaggaggagcggggggctcgcgatctgtcgactggccttccctcgcaggagcggtgctggtgtggggatggtgctgggcactcgttgccgacaatgaccaccctccctccacatccacccccctggcttgcctgtcgctgnnnnnnnnnntgggctcgcgatctgtccactggccttccctcgcaggagcggtggtggtgtggggatggtgctggggactcattgccgacaacgactgccctccctcaacatccacccccctggcttgcctgtcgctgcgcagtgcgcaacttccacctgctccctcgcgcagagcacatacaacccgatggaagagccgtcgtggatgccaggtggcgcggcggccgccgccctggcggcgcgcctggcggcagcgccctccgaggcagcgccctccga

SEQ ID NO: 40287 - DNA, 126 bp, Chlorella protothecoides
gttgccagacccgatgtcctgcgatgatggagttgcggcattggggaagttgggcgaggaaaggcgctgggcagggtttcgaggtgcacaaggcgcctgctggggccttgcaagcttgcgagcctt

SEQ ID NO: 40288 - DNA, 94 bp, Chlorella protothecoides
ggagtggcccatgaccacggcgcgactgaagccgtggcgttccagcgtggctgccagcgcgcgggccacctcgtccacctccgcggcctgccag

SEQ ID NO: 40289 - DNA, 4064 bp, Chlorella protothecoides
  modified_base (447)..(456): a, c, t, g, unknown or other
  modified_base (814)..(823): a, c, t, g, unknown or other
  modified_base (2030)..(2039): a, c, t, g, unknown or other
gcgggggcggcagccaggccgcgccgtcgtcccgcgcgcgcacaccccagtgcaggaccagcgcatcgggcgcgtcgctgaccagctcgaccatcagctctggtgagtcatccgcgggcgcatgggggtcgccgaggcgccgcaccgtggccagcagctgcgcgccatcccccaggttgaaggtctgccgagaaggagatgagcatggggggggggaagggggcaggtgtgaggggtggcagcgactgacgaggtatacatgtgtgcgcggaggggagagggggctcagagcgcgacgttggcgtggcggcgggcgtcggcacgcggggatcagctgcgctctgaagagcccaacagcacctgggaaggtcctccgccccactattctgcccctctcattcgcttgaccaccaacaaacagacccctggaccgcttcagtccatccnnnnnnnnnnggcgccgcccaacagttctgcctctctcattcgcttgaccaccaacagacccctggaccgcttcagtccatccccccacacaaaacaaactcaccctgtgccagcagactgcgtcgtcctccccggccgcgcggaccaagggcgccaggggcgagtcttgggcaccgggccgcacatcggccagcagcggtgcggccgcggggcgcttgatcaggtccagggggtccacgctgcgcattccgcgcgaggcgcccaggcccgactcctccgaagtttgcgctggcgctggcgctgacgccggcggtgcgcccgtctgcgaggccgtttgcgaggcctctggcggggatgcacccagcgnnnnnnnnnngagtttgcgctggcgctggcgctggcgctgacgccggcgctgacgccgtcggcgaggcctctggcggggatgcacccagcgcgtgctccagctcctgcaccgacctgcccgcggccagctgctcgcgcagcacgcgccgcgcgtcggcgccaaagtccgcgccgtccggcttgcctgcggcctcccacaggaggtacgcctgggtgcccaccagatgttcgggcacggcgggcgcaggcggcgccggcgccggcggcgacggggccccctcggctcgccccgccgccgcgtcctccccgcccactgccccacccagcgcggcctggaactgggcccagggcacttgaccccgggccacggcccacagctcgtccaggccgacgccgcggcgcaggagcaggaccagctcggccacgccggcgtcgtactcggcgtcggcctcggcgccgctccgcgcggggcagccggcgcgttcccaggccaggtaggcccagacgccgcacagctcctggggcaggttgggcaccgcgtcggcggggaggagggcggggcggacgtcgccggcgggcgcggccgcgccaccccccttgccgtcgcgcagctgcacctggaagttggcgccgttgaggtcgtaccactcccccttgccctcgttcttgatcacaaagttcaggcggtcggaggcctcggggccgggcagctcaatcgacacggcctgcccgccgtcggcggcgggcgagaaccgcgtctgcagcgcgcgctgcttgtactgcaccgtgcgcggcgggcgggcgccggggccgggcaggcgccagcctccctcgtaccctgcgccaccctccacgccccagtgcagcagcaggctgccgggcttgtcggtggccacggtgatggcctgggtgccgcagggcgcccgagtcaccacctccacgcgcacgcgggccccggggatgtcaaacgtgcgctcgctgcgttgcgcgtcggcggtaggggggacgtcggtggcggccgccgccgccgcgggggcacggcagtgggatcccgggcctggccgggcatgcccgccgagggagcgtccaggggtctggactggggtggtttgagagggggtgtaggggttgcaagatggggccagggcacgcacggtagacgggtcacaacggatgctgtgcatgtgagctggtggattcaccgcccagcagcactnnnnnnnnnncctggggtggtttgagaggggtgtaggggttgcaagatggggcaagggcacgcacggtagacgggtcacaacgtatgctgcgcatgcgagctggtggattcaccgcccagcagcactcctggccttgatcaccagtcttcacacacaagatcaggggcccaccttttgcgtggtagctgtgccgtgtcagaccgggggccctgcatatggttgagggtaggatggcagagaagccctcctccccatcatacctgccaacgtgcgtgcaccgaccgcacgcagacacggacgagcggatactattcactcttcaacagtatgacaggaaataacatcccagttggaaatccatggtgcttccagcaaagcgcgacacgagctcacctggctgtaaaaccccacccgctagcactcgccagcccgctccgatctctggcctgcagcccggcccctgcctggcaagccatcgagcgatgtgaattcgatgttgacatgtgtttatcggccagctgctggctgacgacggatcttcttgcggatggcgcgcgtggtgggtgcaggggttcacggtttgccccgtaaacgattaggctagagcttgacgcgatcaataacagtgatatctatccggcaaagcgaaaatgtaatgtcgaattttgcagggtgcagaggacatactaagtgctggcgacggttcttggcagctgcggtttctggcagatgtgggcaggggggactctcattctacagggctgatgtgtgcatcgcaatgccgcggccaacacagcactcttggatagcaagtgatgcttgctgcaatggattgcatgtcggcgtcacattcagggcaacattgttacgtgcacgcggatcaaccctcccatgcagggcgatgcgatgcccagagaggaaactgcggccgtggcccaacgttcattcaatggcaactcatgattcttgttgactcactggtgctccagtctgggtggcacactggacattgaatgcgttgctgcggagccgcctgttaccgccagcaattttccttctctcctatgtcctcttcagcctcacaaatataccccttcctggtccttccaatgcactgcaagtcgaggatgtgagcgcagccgctctccagtttctccatgtgcagagttcgccacggcatcatatgtcctccgcccttctcccaagtaagggctttctcagcacccttgcaaaatggcatcgtctgccaaccagggtggagatggcggtcagagatgctactgaaactcgtgactatgatgcagcgggagtgaagcgcgttgttagcacaactcgccatacactggtgatataggtacccaggaggctttaccctgtccatcggtcgttttgaatgccaatgaggaatgatcccacccagattaagtacaccccccgatagttcgaagtgtgaggtaagtaattcgagtcgctccaggtgagaagctgacttggggttcacggatattttcttctgaaagctcactttgagtatcgtatccaagatgagaggatctgtgcagtcgtcttgtatgcatctcaaatgcaatctgccctcaaagccgaaacacgtcgatctccggggcgtggtccggtgccacctggcgagcgagagaaccgcgcgtcgaaatggatgtgacggtctgacgaaccctgagaggatttaccgctcacactcaacatactctagactcttagtagcttaagatctgtaaggtacaaaggcgctgcggatccggaatgacgtccgtggtgatcggatgtggtggttgtgacacgggtacatgttccggtctcgcgggtcccgcgccgcggtctttccccgcaattgagaacatgtcgtatagccgttcccaattgaggattttctgtcacatcgaagttgagcttgataaccctttaacccaaaggaagccagatcacacggcgtgcatcccaaagggttccgatgttgcgaccggttgctttagtgcacttggtattgctcatcgtact

SEQ ID NO: 40290 - DNA, 157 bp, Chlorella protothecoides
ctctgcggcttggcgcgcggcgaacgccgcgaagtgggtcggcggggtcgtggcgtccagaaatgcccggctcctgacgatggagcagggggtcgtcgagggagggggaaggcaggctgtgagaggaccagccttgggattaaaggttggagtggtg

SEQ ID NO: 40291 - DNA, 61 bp, Chlorella protothecoides
ggccagctcctcgccgaccacctgcatcccttccaccaggccgcctggcggcaggccctcc

SEQ ID NO: 40292 - DNA, 75 bp, Chlorella protothecoides
gggatggagggtggtggggtggtgggggtggtgggggtgaggaagggactcaggtcacagccgcctggccctggg

SEQ ID NO: 40293 - DNA, 61 bp, Chlorella protothecoides
cggaatttttcgggtcgccagtttcacctcaaacttatttctgccaatcatcgcgctgatg

SEQ ID NO: 40294 - DNA, 100 bp, Chlorella protothecoides
tggtagctaggccgaaagattggccacccttaccccgtcggcacgaccccgacacagtccaagacgatcctcatactcgaagaaatggggcagaccccga

SEQ ID NO: 40295 - DNA, 66 bp, Chlorella protothecoides
atgcagcaggcccagcacatgcagcagatgcacgcacagcacgcacagcagatgcagcaggcgcag

SEQ ID NO: 40296 - DNA, 131 bp, Chlorella protothecoides
tggcccgccaaagtcgcggcacgcacagggactccctgcattcccgcaccccacctgccgactccccaggacgcccaagcaagccttctcccccccacctaccacttgcacagtgttcagcgtcgtcaaat

SEQ ID NO: 40297 - DNA, 61 bp, Chlorella protothecoides
ggtctcgttacaggctgcatcatcccgggggtgggtgtcctgggcatccactcctccttct

SEQ ID NO: 40298 - DNA, 160 bp, Chlorella protothecoides
gatgcactccctcgccctcaccgacagcggagaggtgtgtgtgcatggttggttttggaggggggaagggggcactgcatgcggtcatgtgctggagggcctagggaaaaccccttgcacgatgttattaactctgaaaggcaagagttcccgaaggaga

SEQ ID NO: 40299 - DNA, 154 bp, Chlorella protothecoides
gtagaggcacacagcttcaccatggcaagccaagcttgcggccaccgactataaccgcctggcagcatgtgccgatccgaggcaggcagcaaagaggcatgatacttctgaggatcggaaccaaaagcaccactacaaataaactccatcctcc

SEQ ID NO: 40300 - DNA, 61 bp, Chlorella protothecoides
ggccctcctggtcgacctggaaggtccaggcatagatggtccctcccagccatgcagctca

SEQ ID NO: 40301 - DNA, 77 bp, Chlorella protothecoides
cctcctcagagatgtcaggcctgggatcaaaagagcatgtgtggtgggcgctggggacatggcagccaggagctgca

SEQ ID NO: 40302 - DNA, 151 bp, Chlorella protothecoides
cgtcctcatccccacccacgagcctggttctgcggccccgtggcccgcgcccgcgcccgccccctcggccccctcggctggagcctcggccccggctgcggccgcctcgtcgtcgccgtcttggtagtaccccatgcctctggaccccagc

SEQ ID NO: 40303 - DNA, 80 bp, Chlorella protothecoides
ctgcaatcccacccatacccaccagctgatatttatctcccccccactcaattcgacccaggcacatctgctggtcctcg

SEQ ID NO: 40304 - DNA, 66 bp, Chlorella protothecoides
gcctgcgccgctgtgtttgccgcggcctctgccgcggcctgcgccgctgtgtttgccgcggcctct

SEQ ID NO: 40305 - DNA, 61 bp, Chlorella protothecoides
gctgcgtccggctggagcggccagtggctggagcgctggcaaccttcaagcagagatacgt

SEQ ID NO: 40306 - DNA, 97 bp, Chlorella protothecoides
cagcgccgccgtgtgcttggcgtcctggttgcgctgcaccgcggcctgcttggaagcctccttgaccgtcaggtcagccaccgtgcggcggcgggag

SEQ ID NO: 40307 - DNA, 94 bp, Chlorella protothecoides
cacgctgtcctgctgcagggaacgttttccgatgcaatgtatgggtcccgaagcagtgcgtacatcctgtcgcgttcatcctctattgcatcaa

SEQ ID NO: 40308 - DNA, 1117 bp, Chlorella protothecoides
  modified_base (459)..(555): a, c, t, g, unknown or other
  modified_base (982)..(1040): a, c, t, g, unknown or other
ccgtggcgtccgcggcgtcgtccgggctcccctcccctccgcctcggcgcagcgccacagcatacccctcgcgcgccgcggccaggtcgccgtccgcgccggccagcagtgcgcgcagcgtgtcgcgctgtcgcgtgactttctccagcaggtcgcgcgcggcggcgccggcggccttgagcgcgtccaggtcggcgcgcaggccggacagcacgccctcaaactcggcgcggacctcggcgcgtgcctcctcgcgccgcgcctccgcctcgcgcgccagctcgcggttcaccgccaccagctgcgcgttcctgcgctgcagctcctccaggtcccggaactccagcagcaggctatcggtcacctgggacgcggtggtcggtgggccggcgggtggcgccgactcggcacggccctggcccccgtcgccgccgccgaccgcggcgccgccggcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccagcaggcgcacgatctgcgcgcccaggtcgacgcgctgctgctccaggccgcgcagctcgcgcgcgtcgcggcggcgctgcgcgcgcagggcctcagcctcggcgcgcgcagcgcgggcctcggcctcagcgccctccagcgccgcacccatgcctgcgtacgcgcccttcagccgctcgtactccgcctgctgttcgcgcactagcaccgcgcgcttctccacctccgcgcatagctcctccagcacgatctcctgctggcggaccttgagcgcctcggcgcgcgcgcgcgtggccgccgccacatacctcgcgtacacctggctggggctggacagctgtgctgcagagggcggcggcggggaggcgtcggcgtcaggcatcgcgccgtcgccgccgcctccctcgctgtccgcccccgnnnnnnnnnnnnnnnnnnnnnnnnnnnnnnnnnnnnnnnnnnnnnnnnnnnnnnnnnnnccacctgcccggcggcaagcaggacgcgctgtgcgcggtcgcgctctgcagccgcgcgccgctcggcctcgtcgcgc

SEQ ID NO: 40309 - DNA, 416 bp, Chlorella protothecoides
gcatcctcaccccctgtggaggggcgcatgtgggggggtgaagtcggggcggtcgggtcacccggcatgcccagggcgagtgtctgtgagccctgatcagggtgcggcggggtgcttgccgggaaggtcgagggtcgcatcatgccgccaactgggtgtgcgttcaggaggggggtgctgccgcatgacgagacaaggtgccatgggccccacgagggttgcacacccagattctgagcctcaaccagcccctccagggccgcaccccaccagcctcgcactgcaaactgccccctgctcggcccctgcgctcccagaccccaacagcctcccccaccctccggcttcactcccccaacaaaccctcacgcacctggagcaggccgaaggaggtggtcctgaggtaggccaggtcc

SEQ ID NO: 40310 - DNA, 74 bp, Chlorella protothecoides
ggtcacccggcatgcccagggcgagtgtctgtgagccctgatcagggtgcggcggggtgcttgccgggaaggtc

SEQ ID NO: 40311 - DNA, 75 bp, Chlorella protothecoides
gcaacctaaataagtccaaattgttccatatatgctcggtatagtcctggttcctggcgtctcgtgcatgtggtc

SEQ ID NO: 40312 - DNA, 61 bp, Chlorella protothecoides
aagatggctgctgatggggacagggtcgctcgggtgggtggcggccggcagtggcaagcgt

SEQ ID NO: 40313 - DNA, 3657 bp, Chlorella protothecoides
  modified_base (202)..(211): a, c, t, g, unknown or other
  modified_base (962)..(971): a, c, t, g, unknown or other
  modified_base (1153)..(1387): a, c, t, g, unknown or other
  modified_base (1468)..(1477): a, c, t, g, unknown or other
  modified_base (2127)..(2136): a, c, t, g, unknown or other
  modified_base (3230)..(3239): a, c, t, g, unknown or other
cccccccccttacccaccaccgcacccacccatccctgcgtcccccgcagaccggcgccgccctccagtcgcacaagcgcagcgccgccgggcagctcagcggcacgctgagcgcgctgcgcgaggaagtgcacatgggcattcgcgagggcatcagcgctgtgctgggcagcggggtctccgacaccgccgccgcagcgcnnnnnnnnnntcgctgcgcgaggaagtgcacatgggcctgcgcgagggcatcagcgccgtgctgggcggcggggtctccgacaccgccgccgcagcgcccgcgacggggagcggcggtgccagagccggggcccacagtgccgcggtggctccggcggccctgctggaggacccctccggcagcccccagttccaggcctggctgggcgaggggcgcatggaggcccggcgctccgccgcgcaggcctccgacccggggctggccggcctgctggcgagcctcgtccccggccgactgtcggaggaggcgttctggcagcggtacctgtacgcgcggtactgcgcggaggagcggcgccgggcgctgcgggagctgacgcagcgctcgcgacgcgtggaggaggtggactgggactgcgaggacgaggaggaggaggaggacgaggcggtggcgggcggccccggtgaggtcgggccaccggcagcaggggcgggggcggcgagcccgggggcggcggggaagggactggcgcagggaacagcaccaggggcaggggacgaggcccgggcggcagcactcggtcggaagtctgtcacggagagcctgggtgccggggaaccagtcgcggcgctggcagttccctgtgcatcaggagcagcggccgaaggcagctcggtggcgcatggcgtgccgagccgggaccagccggcagccggtgggtcggcctggcccggcgaggaagtcggcagcgtggcgcagnnnnnnnnnngatggcgtgccgagccgggaccagccggcagtgggtgggtcggcctgccccggcgaggaagtcggcagcgtggcgcaggcgcgggtcctgctggccgagccgggcgcggtgagcgccgctgccgccgccagcaccggcccgggcgagggcaccgcaggtcgcagcgccgagggggaaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgatcagcgagggcccgtcgggggagtccacgcccctgggcccccccttggcgcccgcggtggggaaggcctccaaggnnnnnnnnnnaagccgggcgcggtgagcgccgctgcctccgccagcgccggcccgggcgagggccccgcaggtcgcagcgccgagggggaaccggaggccgaggaagttgcagcccccacggcagcggtcacggcttgcggaggaggacccagctcgccggacggagccgacacagcgcctgaccccgcgggccgggagcaagccctcgcagacgccctgctagcctcgcccggcccgctgcccgccagccccggcagcagcgggcgagcgggcgaggacgcggccagcaccgcctcccgccacggccccagcacctcgtggtcggtgatcagcgatggcccgtcgggggagtcaacgcccatggccccccccctggcgcccgcggtggggaaggcctccaaggcggccagcgacgacgactggggcgacgactgggagtgatcgtactgttccctgtatcttccgtctgtatactagatgtcaccactctcgtgccccctctgcaccggcacctgttgccgctttgtttcatagatgtctgtccctcaacatggacatagcgacgaggaaagacaacgcgcgcttcgtcaggaagcgcaccgacaagatgcaaacaggagatatccttcccttgagtcccactgaccacccgcgttctnnnnnnnnnntctcttcaccggcgcctgttgccgctttgtttcatggatgtctgtccctcaacatggacatagcgccgaggaaatacgacgcgcgcttcgtcaggaagcgcaccgacatgatgcaaacaggagatatcctccccttgagtcccactgaccacccgcgttcttgaatgatgttgtggaggtagattctgggatcctgggtcggagtgctcctgagtctcccggcacactgtgtgtctagatcacttcttggcggtcgcagtatattcacatacaccatcacgtgcggctggtcgggtctccacacacaggaatgaggttatagccaccactcatgtgcacagtccacggcgctggttgagtactacctcccctgcccaaggatggcgtcggaggaggacggggacgacatctccctgctgtcggacagcgacacggaggcggagcctgcacccgtggcaaccaggtcatatgcaccctcaaaatctcagatccagcctggcagccaggggcccaccctctggtccgaggtagggatgggagtgctgacctcccgcaggcagcacccactggcactgcacaacagccccaacccacgcatgggctgccgctccctgctctgtcgccctcctcgccgagtgcagacagaatgttcccccccaagtatcctcaagctgtgctatcggccccgcaggtgaacacggaggccctgcagcagcttgcggcatccatcgtggccgtctccctgccagccggcgacgatgcggcgctgggtcaggccctgccccctgccaccccggcgcaccagccggtcctcggcgggtacgaggaaagggaggcgcgtccccacgacccgctgggcctggtccagctggacgccgcactgcgggcggcgctggacggcgagggcgccggcaccgcgctgccgcgccaagtcagcgccgtcgcgcgcgctgcggcggccgccgacgggccctccacctacgagcggctgctggtcacggggcctcactttgaccctggcctgtacctggccaccatccacaaggcacgtgcgtggtttggagatggatggatggatgcttcagatccatagnnnnnnnnnntcacaaggcacgtgtgcggtttggggatggatggatggatgcttcagatccatagaggatcagaaagcagtgcagcaaaccctacgccattcagcacaggccgctgtgcagcgctgcgcctggtccggggcttcagaggcctctctcgcccagctcatctagccccgccccctccctccctctgccatgccctccaggacaccaccctggccgggctgcagatgggcatgcggacgctgcaggcgcagctggaggagcactcggcggcgctccgcggcctggtccgcgacaacttcggccgcttcatctccagcaagagcaccatcgacgacatccaggcacgcctgcgcagcattgaggccggcggcgccgccagcggcgcgccctcggccgccgtgctggcgggcgtgtcgcgcgc

SEQ ID NO: 40314 - DNA, 112 bp, Chlorella protothecoides
caagtgcgctgcatggcctgtgttgttgttgttgttgttgttgttgttttttggggggggaggaggtggggcgcagggacgcagggggtagtgtggtgtggctgaggctgtg

SEQ ID NO: 40315 - DNA, 80 bp, Chlorella protothecoides
caaagaagaggaagacgccccacttcatggagcagagcatggacaggaacgactggccgatgacgaaggagaagaggaag

SEQ ID NO: 40316 - DNA, 80 bp, Chlorella protothecoides
tgactggcgtcgccacgttggcggccgctcaacattggtgcactgtgaggacccatgggcattgcggcttctgaaatcca

SEQ ID NO: 40317 - DNA, 61 bp, Chlorella protothecoides
gtttccccaccccccgcgtctcccgctcctgcagggctacctccaggccaccgaccacgtg

SEQ ID NO: 40318 - DNA, 77 bp, Chlorella protothecoides
cagggccagtttgatggaaatcagggcgaggatgtgtatcgatgtgcgccatggccatgtgtgggtgggtgcccgag

SEQ ID NO: 40319 - DNA, 61 bp, Chlorella protothecoides
gatccacgattggtctggtgtgtccgtggcacaccaggggggtctgactcttgggtctgcc

SEQ ID NO: 40320 - DNA, 61 bp, Chlorella protothecoides
ccggtatgcggggttcccggagttacacgcacctccctcgaccctgcaacgcggaggctgg

SEQ ID NO: 40321 - DNA, 165 bp, Chlorella protothecoides
gaagggggaggggggttgaggtggggggggcggcacggagggggggtgcaaggtggcagtatgtggtggccgacgggggggctggcgcatgaccccaatggctgcaggcagcatcctcagcataccccctttctacctcatgcatgcaggaggtgaagacaaaga

SEQ ID NO: 40322 - DNA, 14336 bp, Chlorella protothecoides
  modified_base (108)..(117): a, c, t, g, unknown or other
  modified_base (325)..(334): a, c, t, g, unknown or other
  modified_base (468)..(477): a, c, t, g, unknown or other
  modified_base (1522)..(1531): a, c, t, g, unknown or other
  modified_base (2142)..(2151): a, c, t, g, unknown or other
  modified_base (2647)..(2656): a, c, t, g, unknown or other
  modified_base (2874)..(2883): a, c, t, g, unknown or other
  modified_base (3453)..(3462): a, c, t, g, unknown or other
  modified_base (4098)..(4107): a, c, t, g, unknown or other
  modified_base (4531)..(4540): a, c, t, g, unknown or other
  modified_base (4632)..(4641): a, c, t, g, unknown or other
  modified_base (4895)..(4904): a, c, t, g, unknown or other
  modified_base (5573)..(5582): a, c, t, g, unknown or other
  modified_base (6337)..(6346): a, c, t, g, unknown or other
  modified_base (7426)..(7435): a, c, t, g, unknown or other
  modified_base (7964)..(7973): a, c, t, g, unknown or other
  modified_base (8055)..(8064): a, c, t, g, unknown or other
  modified_base (8238)..(8247): a, c, t, g, unknown or other
  modified_base (9371)..(9418): a, c, t, g, unknown or other
  modified_base (9651)..(9660): a, c, t, g, unknown or other
  modified_base (9753)..(9762): a, c, t, g, unknown or other
  modified_base (10121)..(10130): a, c, t, g, unknown or other
  modified_base (10549)..(10558): a, c, t, g, unknown or other
  modified_base (11288)..(11297): a, c, t, g, unknown or other
  modified_base (12699)..(12708): a, c, t, g, unknown or other
  modified_base (13940)..(13949): a, c, t, g, unknown or other
  modified_base (14016)..(14025): a, c, t, g, unknown or other
gggggggttagggaaggggggtggaggggtcagggacggggtggaggagtcaggggaggggctggaggagggcgttggtggaggccgtgacgtgtgcaaggcagaccnnnnnnnnnngggacggggtggaggagtcagggggagagcgtttgtggaggccgtgacgtgtgcaaggcagaccccattacttggggtcgggtgggtgtgttgagctgaatgagcagcccttggggaatggggtggggggttcctggtgtgatccagatgcaagtattcaggatgcatgtggtagtctaggctcacatccttggagtggcggctcaannnnnnnnnnaattcagaatgcatgtggtggtgtaggctcacatccttggagtggcggctcaaaagcagctcgcacgtcacccaatgcccaagactccctgaagccacatctcccttgttcccggcccctctccacaggaggtnnnnnnnnnnatcacccgacgcccaagactccctgaagccacatcttccttgttcccggcccctctccacaggaggtggactccaaggcgccattcctgtgcaaaccgtgccggggtctgagggtgcggccccccacctcggccgccatccaggcggccatcgccgccgccaaccgccccgtccccgcagactgggcgacgcaggtcggcgccacgttgcaggccctggcgcggaagcggtgtgcgcgcgctttcctggagccggtgcccaaatccctggtcgactaccacacttttaccaagcaggcgaggggggctgcttgtggaagggagggggagggtcatcggctgcctggtgcgatgcttgagctcgagcaaacgcagccacccgttggatccgactgaccgctgcctcccggtgcatcggaaccacatgcgtccaccgtgaccagcgccctccgagctcgcccacatccccatggcagcgaggtgcctgctccggaatccttctccatccccaccgtttctccacccccctcacgcagcccatggacattcagaccatacagcgaaagttggccaagggcgcctacacctccctgacccagctggaagctgacgtggccttggtgggttgggccaggcgcctgggtcattcatgctggtcacatgtgggggtgcatgccgccttttcagacgcaaggctcacccggtgtccgagatgaggtcagactccatcgccggccctcacgtcgcccatccccccccgcccctccaagatctggtccaactgccgggcttacaacctgcccaccgcgcccgtggtgggcgaggcggcggcggccgaggccgcgctcgacgcactgtggcaggaggcggacctgcccaagacactgaatcccgccgcggcgacggaggctggcagcacggatgcccctgctccggccaagcccgggcccgccctgaactggcggaagccggccctcaaggtgcgtcgggttgcttgaggatctggattgttcttactgccttgcggggaggctgcccggatggcnnnnnnnnnnggtcgggttgcttgaggatctggattgccgtcactgccttgcggggaggctgcacggatggcagcacatggcagcgacacgtcagatttccttgatcaccgacccgccacatccagcagtcccccactccctcccacccccggcccgacgcaggtgctgaagaagctgcaggcgctgtccgtcagctaccctttctgggcgccggtgcgcgccgaggacgcccccgactacggcgcggtggtgaaacagcccatggacctgggcaccatctccgacaggctcaagggggaggactacgccacgcccgcccaggtgcgggccgacgtggagttggtgtggcgcaacgcgggggcgtacaatggcaggggccaccccatcaccgtcgccgcggcggcatgctccaccgcgttcaagaaagcatggcgagatgtgggcctggggtaagcctcgcgagcagtgcttgcccgtgccccatcctgaacccttgctcacccctgttactgatctacttgttgagtcattgtgagaccgcgcagcttgagcataagatctgtcgatgggaagggatcaacgggcaggatggcagcagtaaaagagaagtgcagggcacnnnnnnnnnngagatctgtcgatgggaagtgatcagcgtgcagggtggcagcagtaaaagagaagtgcagggcacaacatgtgtgcataactgtttttacagggaaaactactgaaaagcagatcaggtcggcttctcgccatcaagttctccagcagcggctgcctttttcctttttgcgggagactgcgctttcttcttgttgggtgagcgcggcgccgaggcggcggcgctccacatgtagtggctgcccacgctacgatacggcttccaggccgccgccaccccctccatcgtctcagggtcgggcaagtcctgtgaggtgtattgcggccttggatgggatgggagaaagtcctgtgttggacttcaaaggcggagtagaatgtggcctcgtgcccaagatgtcaggagacaagaaaacgcccatctccctacattcgcattcctgagaaaattgcagcccgctccgacacctgcaccctccacatccactcaccttgagnnnnnnnnnncagccactgcatgcccttccgcacccccaggtcccccactggcaagatgtcagggtggcccaggtggaacatggctgcacaagggggttgcgccgcggtcaataatgtcacgtcgagctgcaggagcacgacgggggcaagagcacgtcggtctgccatttccatctcgacaccttcaccaaaactcaccaaacatgtggaccgaccactgacccagnnnnnnnnnngatgtcacgtcgagctgcaggggcacgacgggggcaagagcatgtcggtctgccttttccgcctcggcaccttcaccaaaacttaccaaacatgtggaccgaccactgacccagtcctcgaactttcgtcagctccatagtgagcgttgcgtcgtccatgcctgggcattcgggcgggtggcaggtgagtgggtaattggctttagcaacctactttgggatgaagccatccagcccacaaggcccacttaaaggtgatttaccaacccccaacaccgaccccacactctccttggaaaaaccaacccccctgaccttggatgccctcattagtgagcaccccatctgagaagaggcgggcaaggcccgtaaggtattcggccttcctctgggatagaccacaggctcgcaatgcggccatgtccgtcgttatgagggattcaggggtgaggaagccggtgtctaggcactggtttggggcgggttgagaggcaattggtgcaggtgcctccatgcgcactgagggtccagatcatggagctgcatagccacagcccccccccccccccnnnnnnnnnncggtgcaggtgcctccatgcgggctgagggtccagatcatggtgctgcatagccacagcccccccccccccccccccccccccccccccgcattggacctccaagcacggctcgccaagtctcacttggcaagcctccagagttcgctggaagatgacagctgcggccttggtggccagctgctggccgattatggatcgggccagggctgcaaagctcgatccctccttggccaggaggccactgggtggaccatgctcctcaatgaggggtagcagccctgtcgggattcgttgctgtggtatgatgccggcaaacgcgctcccggcgctcctggacatacgagagatcctccttcctgatgcacatgcccatgcctactacatgcattgcaaccaggatgcgagggtcccgatctcatcgacgtacgtgcgtccacctgtttgaggtgctcgactgcctcatggagggtggccatggtcagtcccaccgttgggccagcattggccggagattgcgactcgagggatgttgcggcaacaggatcgttcatgaccagcagtgtctcaatggccggtgcgtccttgtcggcgggcacccccatggatgccacatttcgcgcagtagggtttgtgnnnnnnnnnntatcgttcatgaccagcagtgtctcaattgccggggcgtccttgtcggcgggcacccccatcgatgccacatttcgcgcagtagggtttgtgccgcgactggcaggcaggggcctggccggccttggtcgcagcatcctgcccgtcatgaccgctcgacacaaatacgataaatgcataccgagaaggcagccttcgcagtgagcgcatgaggtgatgcgcatgcatcctttcatcatgtcacacggtctgtatgctgcgggtgctgcgctgatctcgtgaaatcgggccgtgctttcgaattggccccaacgcaagacattaagccgttgcagaacggatcctcaaatgggactgcgatcttctagtcccggtaaaaaacattccttaagatatgcagtgcacaaaaacagtgtgcgggagtnnnnnnnnnnacggatgctgcgctgatctcgtgaaatcgaggcgtgctttctaattggccttgacgcaaggcattaagccgttgcagaacggatcctcaaannnnnnnnnncgagagcaaaacattgagcaaaaatggagtgcaccccaggagagggggtgggtaaaagcggactctccagatggatgatgataccgaaaatgcgcaaggagttcatgaggcatacacagggaggaaatccccattcctggttggacggggttcgtccatgctcatacgtcctcagatcgcttctggtaactccgccacatactttcgttgcgggggggatcttgagggtgtcacggtcactgccgccgtcgtcnnnnnnnnnnagattgtgatcttctagccccggtaaaaaacattcgttaaaagatgcagtgcacaaaaacagtgtgcgggagtttgtttgataggctgggctctcctggtcagagagcaaaacattgagcaaaaatggagtacaccccaggaggggggcaagggtaaaagcggactctccagatggatgatgataccgaaaatgcgcaaggagttcatgaggcatacatagggaggagatccccattccgggttggacagggctcgtccatgctcatacgtcctcagatcgcttctggtaactgcaccacatgctttcgttgcggggggggtctcgagggtgtcacggtcactgccgccgtcgtcaggtctgcctgcgagccttggactggggtggatgcaccactcttggtgtcagactcactgtacagggggcaggtgtggcggttgagaatgtatgaggttgaagggtttcaggaagggatccttgatgatgaagcggtcatgccacattgcgccggtacagccagctggacgcaaagcgaggcaagatacagagtacagaatcggcgcgtctctctttgcgattagggttgtcaactgcctgcaggcgaggatgcccatacctgccgagctgcaaggtaaaatacccatatccccctccccccccccccttcctnnnnnnnnnnccctgcaggcgaggatgcccatacctgccaagctgcaaggtcgaaaacacccatatcccccctcccccttctcaaacagacacacccctcccccatcctccccagcacacatgtcgggctctagtgtgggcgtggcaacgccccggttcctccagaacaccaggatggcggcgaggaggaccagggcgatgatcatgcccaccccgttgggcacccagaggaaggggtcgtggatggccaggccgtaggccagccatagcgcgccgttgagcgcattcatggcgcagaggggcagggacaggctgtcggcgcagcgctcacgcagcacgtggtacagcgtgctcatgggcgcggcatagtagcagagcaggatggcgttgctggtgtagccccagagcaagcgaagcgctgcgtggtccaggtggcggaaggtccccaccgcccccgcgctgaccagcacgacggtgaagaggacggtgacggcgcccatcgcgtccagggtgcgctgcggggccaggccggcacaggcgaagatgtagagcaggcccagcaccaagccgatggcatttgggcccagcacaaaaccgttggccacgaccatggcgtaggccacccagcccacgcagttggcgacgatggcggggtaggggatgaggttcaactcctgagagtggggcgggatggggtggggaaagggtctggagatgggccttggggcgcgggattgcattgctggaggggcggtgagcttgacnnnnnnnnnngaaggggctggagatgggccttgtgcggggttgcattgctggaggggcggtgagcttgacaggcgaggccccggcactggctttgagggaacagaactcgcgtccagcgaccgcggaataccctggaacagcctgccggtccgccagcacgaatgcggcagacttacccctagttcaccagacttcctggctcggagcactgcgggcatgctggccagaaacatgaggaccgctgcgtgtggcaaggtgcgcggggagggcccggacgagatgtgggagaggggggcatctcgcagctatggaaattgattcagggcccaaatacgtaatccacggccctcgtaaagctccacgcacctgtcacggcccccagggtgggcaccacatactccagcacgacctccttggaggacgtcattgctgggaggagatccccttcccctcccgatcaaagggatgctggaaagctattttagcagctgaataagtatttgtgtctgtgttggcaagcttggcccataacctcaccaagcgcaggtgtcctgtgctgggcgcgcccgaaccgcgaagatacgctccgcctcactcgctcccagcgctgacgaggccggcaaggctggcaaggcgtcttggttcagacgaggtatatagttgaattcattatcagaaagcattgcattgtatcaaatgcttccgcttgtcccacatggacaggcgcggtgccgggacatcaggttgaaaatggtcatcgagccgccaatttgaagggtggctgggtgttgcaaccggatcttcaaaagggcccctgtgcagaaataccacgtcattcaggcgtgaacaagctccatgattacaaaaggacaacatcctcaattccaagactgaaaagcgacatgggcggcaaattatcagacagccaggccccaaagaacacagggcagccaatacaaggggcacaattagtgtacaagattccagaatgaggtgctgtgaaggtgagccgacattgggatgcagtggggaggacatttgttggggattggggaaggcgtgcaatatttggcaccacagggaagtttnnnnnnnnnncagggtggctggctcttgcaaccggatctgcaaatgggcccctaagcagaaacaccacgtcattcaggcgtgaacacgctccatgattacaaacggacaacatcctcaattcctagactgaaaagcgacatgggctgcaaattaccagacagccaggccccaaagaacagagggcagccaatacaaggggcacaagtagtgtacaaggttccaaaatgaggtgctgtgaaggtgagccgacactgggatgcagtggggaggacatttttgggggattggggaagacgtgcaatatttggcaccacagggaagttttgttccaggaggaatgagatttctctggccatgggtgttgcccgggccaccgataacatgtgccaggtcccatcacgtcagcttggagcttgcgcctgccatgtgccagtacgggctgtaccgctccggcatcctttccccgggggaggaactgggcgtcgggtctggctcccgctgccccatctccacgccgtcctccttgcgctgccccagnnnnnnnnnnaacccccccccacccaggcgtacatggcgggggcgagacctgcctctgcctgcccgttcttgaacatgatgatgcaggagannnnnnnnnncatggagaagctgttgctctgcctggaaggtgaactgttcctgcatgtgcttgatggggtgtgtggtgtaatgagggggaaggggtgtgtcttcaacaccaagcatccacacgctggggcccgggcccgagtccgcacagccaggcagggtacaagtggtttgttggggtcaannnnnnnnnngtataatgagggggaaggggtgtgtcttcaagaccaagcatccacacactggggcctgggcccgagtccggacagccgggcagggtacaagtggtttgttggggtcaacgggcgtcagaccaaccccccccccccgctcccgggcgtacatggcgggggtgagacctgcctctgccggcccgttcttgaacatgatgatgcaggagagtaggatgatggcgatgcccaggcccacgccgttggtgacccagatgaaggggtcgtggatggccagcccataggccagccacagcccgccattgagcgcattcatggcggccatggggacggacaggctggccgcgcagcgcgtgtgcaggacggtccagattgtggagagcggggaggcgtagtaggccatgagcaggacattggaggcgtagccccacagcaggcgctgctcggcgtgggccaggtggcggaaggagcccaccgcgcccaccacgatcatggcggtggtgaggaccaccagcatgccggccatgatgtccaaggtgcgctgcggggccaggccggagcaggtcatggtgtagaacaggccggcgatggcgcccaccgaccccgccgtcagcatgtagtagttgacgatgacgtagctgtaggccacgcgccccaaacaattgacgatgatggcggggtaggggatcaggttcaggggctgcatgtgggcgggtgttgggtggggatgggggatgaaggcgaagtttgcaaatacaaggggggctgatttgaaggggttcggatgcccggagaaaagaggcggccaccgcgcgacggagtcccatacaaatctctcaggggcatcgtgactgccaatccacctcgactcacccccagatcacgagtccttctggccttcaggacggccggcatgctggcaaggaacatgatgcaggctgtggggtcgatcgggggggggtgggggtgtcggcagaagcggctagacggaaaaaaccctggaggtcggcagcccaacctcagcggggagaatctggcaatgcagctactcacatatgatggtacccaatatgggcacaatgtattctagcacgacctccttggcagagatcatgccgtactctggnnnnnnnnnnnnnnnnnnnnnnnnnnnnnnnnnnnnnnnnnnnnnnnngctcgcccgagctcacccttcaggaccgatcggaatctcaatgcacagtttgagagcttgtaacacactggtaagctcagacgcaacacccctgaaaaacgtgccaaggtatgacccgcggcccaaaagtgacgtgatccgtgatagcccttgtcccttaccgaggattcgagatcgatcaatctcaaaaccgtgctcatcatccttccacgacatgttacaggacatcactnnnnnnnnnnactcgcccgagctcacccttcaggatcgatcggaatctcaacgcacaatttgagagcttgtgacacactggtaagctcagacgcaacaccccnnnnnnnnnngggcaatggctcagggtagaaagataccttcggtagtttccacatatggctccccgagctgctgtttataagtgtgccaggagagcacgttctccctccaagcatgtttgagggcggtaatgctgcgattaataccacaatgctcccttctcctttcaagaagccgccactgagctgcacctgttgcacgtcttcaggcagtaagggcccgccttcatggcatcggagtcgcaggcatcggctgagcagctgccgcccgctggcggggtgtcagagcacccatctggtggaagccaggaggtggaaggatagagtgaagggatttccgacgtccttgaacaaggctcactctcagagcnnnnnnnnnntccaggaggtgcaaggagagagtgaaaggatttccaacgtccttgaacaaggctcactctcagagccttcaatagcgagccgttgttgccttgcaaactgcgtatcgtgcctcaaataccctcagtaccacgaaggcacatatgcacgcggcgtggcacttgaacgcaggccatgccccatcaagtacatcagcacccacaagcaatcaagtctcacctccacaccgcccgcaggacttgaggcagaaggagtacaggtagatgaagtctgcattgcacttgtcaaattgctgagcctgctcctcacaggtgaacgacgtgtcgggtgcgacatcagtgcagttgctgacgcgatctgttgggtaagggagatgcgggggaggggggagggcaaagtcaagcgcatgggcctcgcatgnnnnnnnnnncgagggagatgcggggaaggggggggggcaaagtcaagcgcatgggcctcgcatgccatcctttgtcgatagcgcatagccccaatcaacccaggcagtatgcatgcaacaagggggaaaaccgagcaacatcagcatgcagcatgcagtctggtctgtccttagttacgacaataccatccaaacatatgggaacaaaacgaccatccattgatagtctgctcactcattttacctgcaatggcctgagtggtgcatgctgccgagtcgctgggaccctggctgcaggagttgctcacattctgcagatttgagataatgggggtctgtgagtggctacgctccggtatcaaataaagttgaacaatatgcaaggcagctcaacttttgcacgtgtaccaagacggtttccaatactactccaatgcacttggttccaactcctcgtgtgccaccaggcgctccatgtgctgccgccccacatgatcccatcaccacctacccccgctgtggaggttccagacgtcgtagaaccgggacccgtggcagagccgcttgtgctggcagagtcacctccggggcagcctgcgccagagcaggcgttggcaaccgccgaggcggtggttccggtcgctacttgggtggcgatggcgtcgcggaggccccttactgcacgaaacgggatgtcagggagtggaagaaggtcgtcagccgggaattcctggttgcnnnnnnnnnnaggcggtggcgcggaggccccttactgcacgggacgggatgtcagggagtggaggaaggtcgtcagccgggaattcctggttgcatgcatgcgtgttgacattacgctttgttcccctgcctccaatggacgagctatcgacttccccgcggatccggtgccctccatgcccaggccccatactcacgtcgcacttcgccaagacgcgcggcggacgaactgcggttaaggaatagcaaggcttcaacttagcttcaaattctactatgatgcaatccaatggcacgttagcgaggtgggcggcccgtcattccccgacatgccgctccgagattggaatcccttccgtacctggcctgtgtggaggcgaggcacgccaggcaggcgaccaacacgatcagagtcttcattatggtggatatttgttacagtgatccacggtggaagtgaggtaaatggtgggccccccgttctcgcccctttccttgtgccgacccgttcacgcggtggactcggcatgttcggcgcgtaggtgaacgtggcaaacgctcggacgccctcgtcacccagtccgatacgccccggtgcggtgaccacccagcaccggggatcggggcttctcggtgatcggttctcgcatggaatggcatgtcgtttaggaaaattggcgtcccggcgcatgcgccgtcgaggctcatgccctcgccgccccttgctgggcgccagtaaagatcctgggacctcgagatcttcgaatagattcctctgatgacaaggacggagcccggcctccttcatgcagctggcaatgtttcttcggatgaccgagcatcggctctggagtcatgtgggggtgcatcgcgtttttccactgcccatactctagtctctgtccaatgggaggaaccctttcatactggggacacagttcagcaggattttacacaccacaggacccagacacagagggcatgggttgtcagagggggaaggcgagtcatctagatgtgggcatctgtacgaggtggcgcgccagcgccacagcgacccaaactcaggcaccgatctgcgcggagatgaggtccgcggcctcctggacggtggagatcttctcggcaccctcctcatccagctgcagctcgaacttctcctcaagggccatcatgatctccacggtgtccagggagtcggcgcccaggtcggagaacttggcgtcggcggccacctgcgaggcaaggatggtggtggaggaaggttgctgggttggcggtccacaacatgagatgggtggtggtaaagtttggcagtgttggtgtgccgctctccatgagatgattggagagcggacttacggtagaagtaaagtgtgtgtctgggagatgtttgtaaagaaaacacgcgnnnnnnnnnngggtggtgaagtttggcagtgttggtgcgccgccctccatgagatgtttggagagcgaacttacggtagaaataaagggtgtatctgggagatgtttgtaaagaaaacacgcgagtgggctcatgtgttttggcgaggcgctcggcaacaggcaaacacaggagttaagcccttgcatgatgagacttggaatcacttgcaggccgatttggtaacaaacatagagggcaagcaatcaaacctatctcatctttaagtctcgtcgtaccccatggagtggaggagcttgcagaatgcaccacaaaaacacccatgtgctgccctaccccaccttgtcaagatcggtgccgagctgctctgcgatgatagagcgcacgttggacagcacgctcgccttgtcctgcggtatggacattgggtacatgcctgatgcaacacgcaaggagttgcgcttgcgtgggcacgtcgtcgttccgtcagcgcctcgatcacccccgcccaccaggccgggtcggtggccccctcccgtccccgacctgcttctgatcgccgcaatccaacactctcgatcaactcaccacggcatggcacaccaggcgctgggcgcgcatgggcttcgccgacaggcggggggcctgcattgtgggaaggtggcaccaacctgtcagcacaccgctactcgaccccgccccctcccctgccgacactatgaatcacgtcaaaccctcgacggtgcacctctccagagccattctcgccctcgcatcccctgcgatacgccgcccgcccatggatcctgatccccaccccccacccaagccgtcacctgcatcctgaggctggcgcggggagcgcacacggcgcgggtggaggccatgcacagcgacatgtttcctggatgtatgaggttcggtgggtggaggcgagaatggtggccatcgcgtccagatggggggtactcatccgcttgcgtcgacctgggtgcacggaggtgggcccggggtggaaagggccaccaatctggcagcagggttacatgtgggggtgcggggtgagtggatatgcatgggaccagggacacatctgtgcccaggccccagtcagtctgtcagggactccaagagcaatgcagtgcgcatcaagcatcggcaatctgggccctgcgggtgcagcgtggatgcactggccatgcccaggcgccgcgggaggggggggggggggggggggggccnnnnnnnnnnccggcaatctgggctctgcgggtgcaacgtggatgcgccggccatgcccaggcgggggggggtgggnnnnnnnnnngccgaaggggcccatcacgcaggtcccatcggaagcccggggcctctgcacgttttgcacgcggaacccccctcaaaagccggcgctgcagctgagcgcaaagagcgtggtggccgcctcgtccgtctccacgtccccagaccgcgcggccgcgctgtcctccgccaggaggtccaactccttcttcaggaggctgacgcggcgggccacatgggcgcgcgggggcacgccggggacgggcctggcccccaccgccgcgcggcgcttgccgggcggggaggccgggccggcgggccaggcggcgctcaggg

SEQ ID NO: 40323 - DNA, 84 bp, Chlorella protothecoides
gcaaagtggtccctgcacatggtgcgagccatgttggacgggggggatgggccgagggtgggtcagcggggggccctgctgcct

SEQ ID NO: 40324 - DNA, 80 bp, Chlorella protothecoides
cacacacacacacacacaccaagttgagtccaacgtccacaaaccaattcctcaggacgtgtggggcaaggcagtgtggg

SEQ ID NO: 40325 - DNA, 61 bp, Chlorella protothecoides
ctcctgtccctcctcctcctgcttcccctgtccctgccccgcccgactgttccgcaacccc

SEQ ID NO: 40326 - DNA, 146 bp, Chlorella protothecoides
cttgtactccctgcggatcgcatggggaagctgattagtaattcccgcagcgctaagtcccagcccccagggtgggccgatgcaccccccccacccatacgcacgtgtcggcatcgaagggcatggtggagccgtagtacggcatg

SEQ ID NO: 40327 - DNA, 152 bp, Chlorella protothecoides
ccccagccatatccatttccctgtgattcaaataggctgggaaagtgctcaccaagacaacttcaatccccaaccccgggcagccggggccaccctcaattccacgaaggctcgctcgcacgtgcgcacagcatccctcatcccaccttggt

SEQ ID NO: 40328 - DNA, 77 bp, Chlorella protothecoides
ttgggaagagtgtctgcgtgatgtccggccgttacagctcgacactaccctacacccaaaccacacagggccccgcc

SEQ ID NO: 40329 - DNA, 72 bp, Chlorella protothecoides
tttgtactgcacaggtatctagcgagtggtgccccacctgcatgcgccttccttcatcccagtggctccctc

SEQ ID NO: 40330 - DNA, 3110 bp, Chlorella protothecoides
  modified_base (206)..(252): a, c, t, g, unknown or other
  modified_base (408)..(428): a, c, t, g, unknown or other
  modified_base (606)..(688): a, c, t, g, unknown or other
  modified_base (906)..(955): a, c, t, g, unknown or other
  modified_base (1776)..(1785): a, c, t, g, unknown or other
  modified_base (2611)..(2757): a, c, t, g, unknown or other
ccgggcgtcggcgccgcgcgcctcctgcgcctccccggcgacgaagccacgggcgcagtgaccccggaccccgaggtcctgcgcgtcgcgcgggcggcctttggcctggaaccatgcgccgtggagcgcgcggtgcgcgcgcgcgaggcctcgcccctcgccgccacgtacctgttgctggccgaggaggcggcgcgtgtgccggnnnnnnnnnnnnnnnnnnnnnnnnnnnnnnnnnnnnnnnnnnnnnnnggttcggccgcatgggcgcgcctgcgcgtcggtgccgcagtggcggaggggggcgggggagtggtcggccccgccagcacagaccctccgggcacgggtcccgcgagcgtggaccccgcgccgtcgtgcctccccccccgcgtggcggcgacgacnnnnnnnnnnnnnnnnnnnnngacgacgtcctcggagcgcgaggccgagtcgctggacggcacgccgcgcgcgcgccggcgcccgctccgcgccgaggaccaccagctgctggcgcggaacctgcgcctggccgcgcccgcgccgccgccctcctcgccgctgcccatcccggccgccgaaaaacggtgcgtgacctgnnnnnnnnnnnnnnnnnnnnnnnnnnnnnnnnnnnnnnnnnnnnnnnnnnnnnnnnnnnnnnnnnnnnnnnnnnnnnnnnnnnatggtgcgctgtgctctggtgatctggagggaggggtggttggggagggctggctcccccctggagcgcgaatcctgctgcccagcctgaggcagtgcactgcgctcggtccagcctgctgcctcgcgatggccgtcggaaagagcttcgaccctgggcaccctcgccggccccctgcactcctccctgctccccccccatccacagcggcccccacnnnnnnnnnnnnnnnnnnnnnnnnnnnnnnnnnnnnnnnnnnnnnnnnnnaggccccccaccactcaccgcattgcaggacacccagcccgagcggctcccgctcccagaccccgcggtccccgcacagccccgtctcctggctctccgaccgcctgcacaagggcgccgcgctctcccccggctccaaggcggcgagcctgggggcgctggaccgcgcgccggccagcccccaagccctgcagggcatggcgctccgtgccttctccatccccgcctactcgccacgcctgctgggggccggctccccctggaccctggagggggccgccttgggcccccggggcgagggccacaccgtgcacacagtctgcgccgagggcggggactgacggccacacccgatgctcgtgggagggagcgcgggcccaccgccgacccgcgacgccgcgaggacacggctgccagcgacgcgtgtgaccccaaccgctgcccgaaggcctggcggccggggcaggtccccccgccgcagctcacaaacaccaccgtacgactcgagcgtcgacgccgtacctacaggccggcggggagaggagaggtgcgcagtgggagcagggcgcacctcccctcccccgcccgaatctccctactacatgccagtttgcattgtgatttttattgagggctgtccccaccgacaggcaccatcgtgacaacgcagggcacccctgtacctttgtcgagtccccccctctcccgtgtgccttcattgcccctttttctgaacccctgtcaccgcacattcaatgcatgcactcccagtccctggggtgacgagcgtctgggggccacgctggcgatgccccctcccnnnnnnnnnnctgcatgcactccccagtccctggggtggcgagcgcctgggggccacgctggcgatgccccctccccggataccatgatgctggactttcactgcatatcaggctcatattcagccttgtaattggcaccatttcactgtcggagagggcagcagcgggcttggtcaatggacagagcgtgcacctgtctggttcggtagagtggcaactcaaatgcgttccttggaggatagagggatggtgtggtgagtggtgcacctgcatgtcaatgatcatggattgcccagccggccttctcatccctcgaccggccagaccttgtcaaggcagaaggtgttcaacagcctggtggggtcgtggcatctgtgacgaattgtatgacagctactgcgccagcaccatggatgtcctccttgcacttgtgataggtcgttgcctgttacagacaggaggcaagagggaatactggaggcccaaagaggcctccgcttcaaatccaagggtggaccggcgatagattctgctgggagggggggtggtatagagacagagcggaggcatcacagatacatggcaggccatgaaaattatgagtggggggaagaacagggggccggcaggctgggtcggtgggtgcacatttgcgcgagcatgcgcgtgaaaggatcgaagcgggactcgccgggctcctatgaacgcgctcgtcggcctgcggtccgagcactgggcgccaatggacaggcagagcgctcatcagcgcacgcggagctgggcggggcggttggtgaggaagagccccgccgcggtgaactcggcggcctcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggtggcgtcctggaccctggtgggcgacccctgcctgctcgaccctcgggagctcggccccggggcccacatgccgatggacgggtccgcggacccgtacgcccactcgctggcagaggggcaggggggtgaccagggcctggaagagaaggcgctggtggggttgaaggtgctcgtccaggcatggacttccttggaggcagcggctccttccccccaggcctgcggctgaggccagcccgcggccccaggcggcgagggcccgggcgcgtggcgctcgcccgcgaccagcgcgtcgcaggcggcgcgctggaggcccgtcgctcgacagaagtgcccgtccctggcct

SEQ ID NO: 40331 - DNA, 89 bp, Chlorella protothecoides
ctgggggcctgttgcctgccatccaaggtggttgcgccccctcaggcccgaggtggggcagtcatgcccaaaccagcgtgggaacaatc

SEQ ID NO: 40332 - DNA, 90 bp, Chlorella protothecoides
ccccgatgcagcagggcacccttccgcggttggaagtgtgctgcgtttcataactcactcccttcacatcccagcctcgtcatcccagcg

SEQ ID NO: 40333 - DNA, 94 bp, Chlorella protothecoides
ggatgtagaggtgcgtctgcactccccttttctttgaccatgtcagcggcgcagaaaccgcggaagctgcgtggagctgggctccttctatccc

SEQ ID NO: 40334 - DNA, 100 bp, Chlorella protothecoides
caatcgaagccgcccaccatcccactggtgcaatcatttgcagaacccaacccctgttccaccccaccctctgcagtgaggaggaggcgtcagagacgca

SEQ ID NO: 40335 - DNA, 77 bp, Chlorella protothecoides
cccccccccccccccccccaaaacacacactgacagctcctttctccggccccgcccacctcctccacaatgtcgta

SEQ ID NO: 40336 - DNA, 3930 bp, Chlorella protothecoides
  modified_base (1213)..(1222): a, c, t, g, unknown or other
  modified_base (1670)..(1679): a, c, t, g, unknown or other
  modified_base (1997)..(2006): a, c, t, g, unknown or other
  modified_base (2084)..(2242): a, c, t, g, unknown or other
  modified_base (2335)..(2344): a, c, t, g, unknown or other
  modified_base (2500)..(2509): a, c, t, g, unknown or other
  modified_base (3030)..(3039): a, c, t, g, unknown or other
  modified_base (3206)..(3215): a, c, t, g, unknown or other
ggtgaggggcggccggaatctacgattcctaatgaggctcccatgccatcgccagcctgtactcctatcttgagctaccatagtgagaggccaggcccccggccaatccctggacacactgctgacaatgcttttgctctcctctgcgctcccacctctccccgctgcacatgccgactgctccatccagcctgtacacgtattttgaatagaggagtggggtggtgtgggatcaaaagagccggctgatttgggtggtgctgagctcctcgagcaatgtgtgtggccctttccaccgccgtggcccctgcctttcgcacggtaatcaccccgcaaggcccgctctacactaggccatatcgaagcaccagtagtctcgtctccacgttgatcaaggtacccctgaagcgcgggttttccatagagacgcccccgcagcgccgagggccagccaaaaaccgtcgtcgagtatctcgctaggggctctcacccgggagcgagcgagcatggcagctgccaaggccaccacggctctggccaagcccgccacggccgagtttgtggtctccaaggtcgaccagctggtgaactgggccaggaagggctccatctggcccatgaccttcggcctcgcctgctgtgcggtggagatgatgcacaccggtgagagggggcccgggctcagggtcgatatcggaggccgcattcccaatgaatctcgttagcctcgttcgtgagcccgggtgcattccgcgtccgtcgttgcggggtgctcaggcgtcacgctcgtgcaagctgcccatcctccaacctctccctggcccaggcgctgcccgatacgacctggacaggttcggcatcatcttccggccctccccccgccagtccgactgcatgatcgtggcggggaccctgacgaacaagatggcgcctgccctgcgcaaggtgtacgaccagatgccggagccgcgctgggtgctgtccatgggcaggtgggccgcggctggggctgtgtggatggctgacgaccacttgaccagggaggatccttgagtgggcaaggggggtttgaagaaatgcgctgagggcaacacctgccaaggtgctttgcgggctcgagtcccctcggtgccgctccctcgtcaccgtcccatcaccctcccctcccacagctgcgccaacggcggcggctactaccactactcctacgccnnnnnnnnnntatgcgctgagggcgacacctgccaaggatttttgcaggctcgagtcccctcagtgccgctcccttgtcattgtcccactaccctcccctcccacagctgcgccaatggcggcggctactaccactactcctacgccgtggtgaggggctgcgaccgcatcgtccccgtggacatctatgttcccggctgcccccccaccgccgaggccctcatgtacggcctgctccagctgcagaagaagatcggtcggaccaagaagacgcaggtctggttcaacaagtaggcggcgcgagcctcgagcggcgcgctcgccgctctgggatgcgcgccgggtgccgacaccaggaaagcgtgccccgcgtgtcctgcgccccgtcgcgcatccttgcccgtcagcagagccggccggcacgatctggcatgcactgccctgcgtagactcccttnnnnnnnnnncatgcgcgccgggtgccgacaccagggaagcgtgccccgcgtgtcctgcgccccgtcacgcatccttgcccatcagcagagccggccggcacaatatggcatgcactgccctgcgtagactccctttcgtccacggcgcctcaccagcgccaccccgaagaaacctgtcggaatgtgcgtccccccctgccctccagatgactggccccgatgtgccgctcatgtaacacaaaaggcaagcgtgacagtggacctagtgatgggaatgaaaatgaggagcaccttccacatcaccgctcctcatggggattggatggnnnnnnnnnnggtggacctagcgatgggaatgagcatgaggagcaccttgcacatcgccgctcctcatggggattggatggtgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggggggggacagcgcaagtgccggctgagggtcctgctgcagcctgctgagattcccagatcatcacccccaccaccacactgcacaccnnnnnnnnnngagacaagcccgcatgccccgtgacgctgcagcccccatgctcctagcggccccctcgccccctcgactccccctccccaccttcccctcccgctccctccgcccatccaaaaccactcaccgcctggaacaggtctgcaaaggtgtaggtcttcnnnnnnnnnngaaccctggcagctggggggaagtgaagcctcacaccgcttgctccagcgccttggtcaccgagatctccatgtcctgggcggtgagaccgccctccgggtgcgcctccatgcggcccatcatctcggtctgcagggggtcccgggggggacagtgcaggtgccggctgagggtcctgcgcgccagctgcagcctgctgagattcccaaatcatcacccccaccaccacactgcacacctacaacccatggcctctgggccacgacccctcaccatcatgatcatgagctcgcgcggcgtggacagcttactgaggtaggagctgaagtcctccactcgcacctgggatggtcacgtggagggcaggtgtcgaggactcggcatgcacggcaccggcgcatccgtcttcgaacagacagatgcatgctccagctgggagaagggcgtgtgtgacgtgccgagcgtgtcgccgctccagtccgcaagcacagcatgctcggcgcatgcgccagcctcgtcgnnnnnnnnnntgtggagggcaggtgttgaggacacggcatgcacggcactggcgaatccgtcttcgaacagacagatgcatgctccagctgggagacgggcgtgtgagacgtgccaagaacgtcgccgctccagtccgcaagcacggcatgctcggcgcatgcgccagcctcgtcgnnnnnnnnnnaagacaagcctgcatgccccatgacggtgcagcacccatgctcctagcagcaccctcgacacctcgactcccccttcccaacttcccctcctgctccccccgcccacccaaaaccactcaccgcttggaacaggtctgcaaaggtgtaggtcttcccccccgccacgctggacacgtcggcgttggccaggcccgcgccgccgtccttgcgcgcctcagcgtgccccgcgcccgcggcggcgcggcgctgcgcctccagctgcgcggccaggaagcggcgctccgccagctcctccagctggtgccgggaccaggtgaggtcgcggacgaagtgacggtcgaagcgcgcctccttgagcgtcttatcggtgttcaggtccagcgcgaggcgcgagtccgggaagaagaagtgcatgcggccaaagttgaggaggtcgttgcggcagacctcgcgcgcgaagaccttgatggcgccggggtactgcaccgggtccagcagcaccacctcgtcgaagcagtcgccaaagacggccaggccctcgtaccccagcgtgcgcagcagggccgacaggcgctccagcttctggtgcgccgacacgccgaccgtcagcccgcgcaccgtctcggcggagtcgggggcggagtagagggacgagagcagggacgccagcacgggcgcgggctgctgccgcaccacgcgcaccgcggccgagac

SEQ ID NO: 40337 - DNA, 61 bp, Chlorella protothecoides
tgcgggggaggtgcgaggtggtgggggggggggcaccttgttttagacctcttacccaagc

SEQ ID NO: 40338 - DNA, 61 bp, Chlorella protothecoides
cccacagcccctggagaggaccacctcttctagaaagccgtcgctgcgtgtgaccgaggca

SEQ ID NO: 40339 - DNA, 3323 bp, Chlorella protothecoides
  modified_base (424)..(433): a, c, t, g, unknown or other
  modified_base (618)..(627): a, c, t, g, unknown or other
  modified_base (921)..(930): a, c, t, g, unknown or other
  modified_base (1400)..(1409): a, c, t, g, unknown or other
  modified_base (2148)..(2157): a, c, t, g, unknown or other
  modified_base (2234)..(2243): a, c, t, g, unknown or other
  modified_base (2304)..(2313): a, c, t, g, unknown or other
  modified_base (2373)..(2382): a, c, t, g, unknown or other
  modified_base (2840)..(2849): a, c, t, g, unknown or other
ctgccgcgcctgccccacgccgccccgcgcccgccccccggtcgggcgccggcgcgcgcaagccggccggcaagctcgggggcggactgggcatccgcaaggccgccgtgcgagtggatgactcgctgttcgagcaggagccagccgcgccggaggaggcgcccggcgcgaccaacggcgagggccgggcgaccgggcccaagggtcaggcccacggcagcaaggactttgacgacgaggactttggcggcgcacaggcgccctcgtcgcgcttcgacctggacgctatggaggagcgggcccgcccccctgctcaggtgaacatctcttgggggggatctggcacttgggcggcgctccaggatttcagttgtgatggtggcagcgctctttgagaagcaatggtctcgccatgccccagggnnnnnnnnnnactccagtttttcggttgggatggtggcagcgctcttcgagaagcaatggtctcgccatgccccaggggatctgtctgccattgtctcaagcagccactgtctctcccctgagtcgcatccctgttgagaaggcctcccccccccggccagccactcatcacttgagcaccaccctgtcgcagcnnnnnnnnnngtgtctctcccctgagtcgcatccctgtcgagaaggccttccccccccggccagcctctcatcacttgagcaccaccctgtcgcagcgcgggcaagacggccacctgaagctgacgtctaacgacgacttcttcaacgaccccctgggctcagacgccggctgcaactcccctggcggtgggggcttcggcggcggcgggggctctagcggctggggccgagcctcccgctccgtgcccgctggccccccgcccaccacctcggacgcgtcggggtcggccgcccaggcccgcnnnnnnnnnnaggctctagcggctggggccgcgcctcccgctccgtgcccgccgggcccccggccaccacctcagacgcgtcggggtcggccgcccaggcccgcttcgggtcggccaaggccatctcctcggctgcctatttcaaccaggacaagggggagaacgactacgagaagcaggcccggctcgcaaagttctcggtgagcggcggcgcatgcggggccgaaggcagggcgggcggggcggagggcatggaagagggaacgcatgtgaatgataatgctcctcggtccatttctgtctggctctcccttttcacttggccatgacagggccccactatggccggttggcccacccccaatccctgcaagtttaccaaaccttgccctgcatccttaccctttcgtgccctcaccccccttcaaccccccccccaaaaaaaaaaatcatcgatccacgttccgcagagcgcgggcnnnnnnnnnntacctagccatgacagggccccaccggttggcccacccccaatcctcgcaagtttaccaaaccttgccctgattccttaccctttcgtgcccttcccccccttcaccctccccccccccaatattcatcgatccacgttccgcagagcgcgggcgccatctcctcggatgcctactttggcagggaggacgagtcgcggcgcggcggcggcggccccggcgcaggcaacctggacatgtcggccgcggagctggtgtccaagatcagcctgaccgcgaagcaggacatggcgcagctgaagaacatggccagcgcggcggggtcacggctttcgtctctggcgcagggcttcatgcgggacctgcagggagggtactgagcggttggtggacgcgtgatggcatggccgactgcacccgctggcaggccgcctgcctgaacccccaatcaaatgtctgggaagcgatgcccgaaaatcatgctcatttctggcccgccatggcgaggcatggacgttgtaaggaatactgttgagtggagatcatctaggggcactaagaccgatgccgacgacacctcctcgcgcctccgatcgccgtgcacgatgctcgcatgagaaggtacaaagcgatgcgtatcaggctgcaaggcgtcgtggagtagagggcaggcttgatcagcagtcgcatgtagcggacggaaggcctgaccgggggtcacgcgcaaagcctcgagcatnnnnnnnnnntagggcaggcttgatcggcagtcgcatgcagcggacggaaggcctcaccgggggtcacgcgcaaagcctcgagcatnnnnnnnnnncggcaagcgatgcccgaacaccatgctcagttctggcccgccatggcgaggcatggacgtnnnnnnnnnnaaggcccctggaatgagattttgggacggctgcatggggtcgtgccaggcagtcagggtnnnnnnnnnngcacaagtgtatcggaggagatggagctgccccggaacaaggtcatctgtcatgtggatttggatgcgttctatgcgcaggtggaggtgcggaggccccgggaatgagattgtgggaggactgcatggggtcgtgccaggcagtcagggtttctcctactccctcccgagcgtctcgtccaaagcccgacgccttcccctctctgccccgggctcccaggccaagcgcgaccccaacaggctggcaggcaagcccctggcggtggtccagtacaacccccagggggacctgaggacgctgctgccagaggacgaccgtgtcatacctgcctcctccaactccatcatcgccgtatcgtatgtgagaccgcctggcctgccccaatcattgacgaatgctacttccccttcctggcagaccccaggcgaggtggccccttgccacccagatgcatggtnnnnnnnnnngatcattgacgaatgctacttcccttctctggcagacccctggcaaggtggccccttgccacccagatgcatggtcattgttacagcagcccaggactctggcaatgtaccggcccctcaaatcgattctctccaacctcacacgcatgcacgcgtgcaggaggcccgggcgcagggcgtccggcgcaacatgcgcggcgacgaggcctgcgcgctctgcccggatttgatcctggtccaggtgcccaccgcccacggtaaggctgacctgacgctctaccgcgcggccgggcggcgcgtgctggcgctgctggcggcatgcgccggcgcctgcgagcgcgcctccatcgacgaggcgtacctggacctgaccgaggcggccgccgcgcggctggcaaagctcggcccgccgccctttgcgccgccgcccggcgcggagcgcatgcacgtcggcgcggaggcccccgcggcgcc

SEQ ID NO: 40340 - DNA, 22214 bp, Chlorella protothecoides
  modified_base (480)..(515): a, c, t, g, unknown or other
  modified_base (907)..(916): a, c, t, g, unknown or other
  modified_base (1001)..(1158): a, c, t, g, unknown or other
  modified_base (1935)..(1944): a, c, t, g, unknown or other
  modified_base (3009)..(3018): a, c, t, g, unknown or other
  modified_base (3466)..(3475): a, c, t, g, unknown or other
  modified_base (4217)..(4226): a, c, t, g, unknown or other
  modified_base (4511)..(4520): a, c, t, g, unknown or other
  modified_base (5013)..(5022): a, c, t, g, unknown or other
  modified_base (5888)..(5897): a, c, t, g, unknown or other
  modified_base (6407)..(6416): a, c, t, g, unknown or other
  modified_base (6908)..(6917): a, c, t, g, unknown or other
  modified_base (7605)..(7614): a, c, t, g, unknown or other
  modified_base (8334)..(8343): a, c, t, g, unknown or other
  modified_base (8801)..(8810): a, c, t, g, unknown or other
  modified_base (9177)..(9186): a, c, t, g, unknown or other
  modified_base (9254)..(9263): a, c, t, g, unknown or other
  modified_base (9710)..(9719): a, c, t, g, unknown or other
  modified_base (9968)..(9977): a, c, t, g, unknown or other
  modified_base (10232)..(10241): a, c, t, g, unknown or other
  modified_base (10870)..(10879): a, c, t, g, unknown or other
  modified_base (12787)..(12796): a, c, t, g, unknown or other
  modified_base (12992)..(13001): a, c, t, g, unknown or other
  modified_base (13214)..(13223): a, c, t, g, unknown or other
  modified_base (13284)..(13293): a, c, t, g, unknown or other
  modified_base (13374)..(13383): a, c, t, g, unknown or other
  modified_base (13655)..(13664): a, c, t, g, unknown or other
  modified_base (14033)..(14042): a, c, t, g, unknown or other
  modified_base (14572)..(14581): a, c, t, g, unknown or other
  modified_base (14704)..(14713): a, c, t, g, unknown or other
  modified_base (14887)..(14896): a, c, t, g, unknown or other
  modified_base (15041)..(15050): a, c, t, g, unknown or other
  modified_base (18578)..(18587): a, c, t, g, unknown or other
  modified_base (19721)..(19730): a, c, t, g, unknown or other
cccccctcccccttcgctgcaggtgagctcgggggtgatgcacctcctctccctgatgctcgtcccagagccaagctgccgttgtgagctttcagccatcatacatcacccctggtgcgtttctcagggggcaggatgagggctgggagtgcaataagctagtctataaaggttcccgaggggtggtccgctgtgcaggttcttgtgcagggagaagtgctggcaaggtccaagtgcacaactactgagagctgcaggaagctgcgtcgcacaaccttcacccctcccaccccgcccctgccaggtttctccaagacttgcctgccggagccttcgagatgaatgctcggttgctagcggagaaattgcagctagaggatgtgccttacaggtggggcaatcgtcgggaggaagcaaggtgcaaacggcgcgtctggccttccatgctgcctgcacctgccagtcacatccactcatgtnnnnnnnnnnnnnnnnnnnnnnnnnnnnnnnnnnnncacagggtcaatcgcttggtggacatggcgcagcgtctgggcgacgctcgggagccagtgacttttgtgcggctgtgagcttcgaggctcgagcaccggcactgcgttggttccggagacttgcgccacacacgacgggcgcagcacatctgccatgccgcccgagaattgccccccttttccatttttgtttgacccttgcttcgccggcgattttactctccagtactgcacgtcatgccaggtcacggcattccaaccctcccagctcctgttgtgcctttgtctcggacgaaacctctgtctcaaggactgtgatgggatggacctccagtgtcattgctcaccagggtggcacagtgcagccccccagggcactggaggtggttgannnnnnnnnntgccacacacgacgggcgcggcacatctgccatgctgcccgagaattgctccctttttccatttttgtttgacccttgcttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacctccagtgacattgctcaccaggttgtcacagggcagccccccagggcactggaggtggttgacatcggtgaggcgtatggttgatccaggctggaaagattctggccaggaagggtcactctgcagctgtgtaatgcagccttgaggataacacctgatcgacagactgcacatgctggtatacatacgcactgacatctgtttcatacagcgctcagcactacacctcgtcttgctcttggggcaccggaagggctcagcatgcccaggcacaaactccggcccagagtaaatcctgcgctttgacactctgaagctttctacaatcatgcgaggggcgcagcaaatgctgtgaagggtggtagaggcttactcattgggcgggaggatcatgaaggtggtcagagtggaacggtcctgaaaaatgtggtgagtttgagaaggggacaatgggcggctttcgaaaaggtcacccagcgaaaaatgtcagtcgacgctgccaagccaagatacagctggacaaatgttccaggctgcagtgtttcgctggcgcggctgttgccttcatctcatgaaagtcgcacgtcgcaggtatctcggctgggtcacccgcctacgcccggcggcagaaacactgctcaatgccatggcagatctgcttcaccagcgtcactggagacagctgtaagaaagtagggacgatgcaatgagtcccgggcatggatatgaggcaatgcgccactgccgaccgacccctgccctggcatccgtnnnnnnnnnnggggacggtgcaatgagtcccgggcatggatatgagacaatgcacctctgccgaccgacccctgccctggcatccgttcttaccaggatggtcttcagaccactgacgagactgccagcacctccgcgagccattgctgttgattagtgaaaaggtaaaggaagaaaatttagggcaaattggtggcgaagatggtaaagattgggtcttttatcgacatgcgtcccaaggggtataagtgcagagtttaccgtgtgtgagaagcttcgccatcgcttcgcgcacatggtagcatcgtcggaccgtcctaggtcctggaggtaggtcggccaccccggtcatggacaggaagagccagatagtgtccgatttacaagcatacgcaggaaaacatcctgggtaaaccgagggttctgggttacaggaaggaggcatacagtgcctggcctcttttgaaggagtactgatcagatactaaaacttcatcagctgtcggcggggctgctgaagctttgctccctgctgcctcgggggctggctcctttacattgccttccaccagtacggagtaggagcgccgggtcctcggattcaccacggtgtcctgcagagtgggtgtgatcgacaggggtgcagggctgttgaatggttaccacccgagattgctgtgagagctcacgacacagctgacggccatacaccagaatggagtctgggcctaccaagagccaaaaggacagtaccctgaggtaacctctgctctcccttgcctcgaagaaagcgacgagctcctcttgtgtgatgctccgcacggcagctgcctccagctcctttcgcggaaatctgcatgatgcagggtgcagctggctggttgacacaggctcctgatgctggcacagcaccagggcggtccttgcatagcgatgcagcgatccaaggcggcaatcagtacgccccggaggctcaagcaggcaggttctggaggcaaaatggtgcagcatgtgcagaattggcgatgcatcagcgtgagaaaagaggtgccaggaccgtttgcgtggtctcagnnnnnnnnnncgtgcagagctggcgatgcatcagggtgagaaatgaggtgccaggaccgtttgcgtggtctcagcggtgtgtcagggatgagctgcaatgcacgggggaggcccttttccccagagcccctcccagactcgtgaacacacgtcgccggtacgccacaaggatcacccacctcaaggtgccgtcgtcgatctcggaccagtcggtgttgatggcatccctcaatcgtttcggtttttccagcttggctttggccagctcctccacatgcgcggcatactcctcggcgggcatcccacgcagcgagtccgccaactggagcagcggacgatgggggaggatgctcagcggtgcacgtaggcggagtgcctgacactgcactgtgaaactggggcgccctcaaggccccagcctccctccagtgcctgcccgtgtggccttgggccacacnnnnnnnnnnataggcggagtgcctgacactgcactgtggaaaccggggcgccctcaaggccccagcatccctgtagtgcctgcccgtgtggccttgggccacaccaccgcctgcagcatgcctgctgcagcggatcgcccttcttggcccacaacatgccacttccgggtacctttgggaggaatgcgtctatgcgagactgcaggtaccgagccgaatgggccgaggactggatgagaacgaggatgttgctcacggtcagcgtccagaatgccgacaggtgggtgatgtacctgacgcggggtgggtttgggcagggggtgggtggcatggttgcatgccgggcggtgctgggccggcatgcacaaggcctgcctggcagtcggcgcacttcccggtgatcctgtggactctcaggtctggaagccgcccggcagctggtccacccagggcccagccacgccccgcccacccgagctgctccacggtgcgcagggtgtggaaggcttccctcttccccaggtggccgaccaggtcgaccagcgcattccgcctgacgtcgtcgcgcccagcctgggggtggggagcgggaactgcatgaaattcctggtcgccagggagcgctgaggcccctgaaggaggagccagcgtgcacccagcacatacgacctctgaggcatgcctgctgggcgcaacaccggcatggctaccactccccgtgcacctggaaggcgacgacgacggcggagtnnnnnnnnnnttgggcgcaccaccggcatggctaccgctccccgagcacctggaaggcgacgacgacggcggagttgtcgttggccgggttgggtcccggcacagcgtgcacggcacgcatgggcgagggcagcgccacgacgcgcgcctcgttacgctgcgaggccgggggaggggagcagcgcctgcggtgccgacgtgtgcgtgggagggtggttgtcgtgccaggcgcgaagcgaggaatcagagggcagcgcagcagggccacgggagccctctcggtggtcacagagcnnnnnnnnnntgtgtgcgtgggagggtggttgtcatgccaggcgcgaagtaaggtatcagagggcagcggagccggcccacgggagccctctcggtggtcacagagcagggcgaggggtgccacccagcaactgacagcctcaaaaccccacccccccctcgcaccctgccagcagccgcgcctccagcgcctgcagcagcgcccgcgcgtcggcggacggcacgttgccggcgatcagggcatcgatgcgcaccgtgcccagcatggccgtctggaaagcgcggagcgagtcccccgtcacgccaggcagcaccgcctcgtagtcgcgcacgtgccagcgccgagcctccagccccacgctcagcaggtagaggccgtgctggtacggctgctcatgcctggggtcaaaagggggaggggaggtgtggcgctcatatgggctgggtcggggtgggtaaggagtaggtcctgcgcatgaaaaggccagtgcccctgcagatcnnnnnnnnnntgtggggaggtgtggcgctcatgtgggctgggtcggggtgggcaaggagtaggtcctacgcatgaaaaggccagtgcccctgcagatcgtgcctgggccacgatagaccactcggcattgctcacagaccatcttaacaccactcttccagtgacccccacccacctcatgttggcatagtccttggcctggtgctccttggccagctcaaatctgtccggcagcacctcgaactccaggaggctgtccagcaccgtctgtcaggaccagggggccagtcggggtgggggaagggcttgtaagagccgaggacatcacagggggcagcaactctcttccctattcaatactgtacacagcagattctaggtcacggggagtgctgtcatgcgcgaaggcagtacgagtctggtccccctccaggaacagtgcggccacgactccagagcgagatctctctggccctccctcatctcatgattcaggtccaacagtcacgcaagccgacctggaccaggcgcggcagggtgtggctgtggccccagaaggacaggagcatgccagatgtggtggcccggacgccgtagtggagccctgccagctcagccgggtacgccaccttggggcatcatgtgtggaagggtggtgggacgcaaacatgcagagagggctgagcgacatggcaagggtctccagccaaaaagcaggcacccacctcggacagcttgtcggtgaggagccgggagatgagctgagtggagacagccgctctaggtgtcagataggcctctgggtgtgtttgaggggggggagcatatgtgcagagggtaggtgcagcactcagccatgcccagcctagggcatgnnnnnnnnnnagcctctgggtgcgtttgaagggggggagcatatgtgcagaggggaggtgaagcactcagccatgcccagcctagggcatgagcgtcagtctcaccatgttgacagcaaggaccaggctccctttgcacccgcttccttgctttccctttcagtgtggccggacgagcccccgccaattccacaagatcctcggcagcctcctacccaccaggcattctcaagtggaggtagatggcagtcttgggcactttgaaacctgtctccggtcggtgccacagggtatacagcggcgcggcatggatcttggcagggctggagctggattcctgggatgggcatggttcagatggggagcctgtcaacattgtgcactgaggctggagagcagtgttgaaaaaggtgaagctgcagtgcccttcaggaacaggatgcagacaggctcacacagtggcagtgaagccacctccaccattccccctgcccaccttgatgagatcgaagcgggaagnnnnnnnnnngtggttcagatggggagcctgtcaacactgtgcagtgaggctggagagcagtgtttaaaaaggtgaagctgcagtgcccttcaggaacaggatgcagaaaggctcacacggtggcagtgaagccccctccaccattccccttgcccaccttgatgagatcgaagcgggaagggatgtatgggttagggggtggcaggtgcatcccacagaatctatggccatccttgtcacctagggcggccccctcgcccccccacgcggcctcccagtgagtcagccactcggctggcagcgggcctgcactgtgtgccgtcccataccagggctccttcaggggacagtcggtggggacctgtcgggcaggaggcgatgatgcgggtggtgagcctgatgcaaaagtgggtgcagagggttgcaagcctgaccctgatcaacattccaagcagcatagaaacatcacgtcatgagctgtacagccagctgtacccaccnnnnnnnnnntaggaggtgatgatgcgggtggtgagcctaatgcaaaattgggtgcagagggttttaagtctgacctgatcaacatcctaagcagcatagaaacagcacatcatgagctgtacagccagctgtacccacctggaaggagctggatgcccagagaactcgaacctcgctggggcaaagcgtgctcagcacagtgtccagaagctcagggtcgtatcgctgaggcacatggtgtatcgccagcaggaggtcatgccttccgtacacctttgtgtcgggtggcaattggcagggaggtgatggatggaggtatgcgtgaacagggttgcctgtgaggcacaacccatgcatgctccatgcggatcccacaagccatagaggagccagtcaacagtttcagcactccttagcacacgacatcctccccaagagcacctgcatggcaccggccagagtggtggcgtacgaggaaggggccatcttctccgcaaagtcaaatctcagctgcgcagggaccagggaacgccaaggggggttgggggttgttgatactgacatgggaagggacactggaggcctgggtaaaatgcttatctgaggggactgcaatgtagtaaggaggtcctgaatcaattcaattgtgaagaacccgcgcctaacacctgcgcgagggctctggcatcctcccagnnnnnnnnnncaaaaggctaatctgaggggactgcaatgtggtaaggaggtcctgaatcaatcaagttgtgaagaacccgcgcccaatacctgcgcgagggctctggcatcctcccagacctggtgcgagattcctcccggctgcctcagcatgccgaggtagctgcaggttgcacaggcagaggaggggtggggaagcgtatgccggcttatcgcgctgttagtgtgcctgccacgcagctcagtgcatagcctatcatccatgaatagttgtaaacttgggtgcagtatcaccctgatccggtttcttcccgcctgcccaacaatcatgctcttgccagtggcatgccagcaaatgcctcggctattccctccattccccccgcctgcttgcctgaagaccagactggtcacctccggcacatgctcctgcccggcatcggtcagcccgatccgcaccatgaagatggaggccgccgagaaggaggtgccgctctcgccggcacacaggtctgtcgcccagccgcgagctttgagcagcgcaaacagggacccctccccctcatccctgtgcagccgagggagcgaggcccaaggtcgggggttgcggcaccggggtattggaaaagggctgcatgcacattcttggacgcaccctcccacatgtcagagtgtgcgcggggagccgcccagtcacaaccccgcctgcggcccccctcccagcccggannnnnnnnnncgcagggagccggccagtcacagccccgcctgcggcccccctcccagtccggaccgccgcgcgatacccaccccagcaggtgcgaaaagtattggcagggggcagcgtcgtagtgcttcagctccggctccacacgccactgcagctccagggtgtggccgctcctctccgggacagccttcatcagcaggcccgcacgaggggtggcctccggcgagaagctgggggcccgaagcccgcggcagggcacggggccgaaggcggagctggcgagggcctgcaggtcgtccagagactcgcgcccgatgatgaccgcccgcatgagctgggagcagtagtgcttctcataaaactctttgagcctgtgagatgggggtggtgcctttgttcctgctgatgctctggacacgcaggcctctcatcagggaagagaccatgtacgatgggcttgatcatcnnnnnnnnnntgtgcctttgttcctgctgctgctctggacgcgcaggcctctcgtcagtcaagagaccatgtacgatgggcttgatcatccggcatgagcacgcagacatgatccctcatccctgcccatcctctcccctcaccttgtatgaacctcaacattcttccgagctggcccgtccagcagcgtctcgaggttcccagtggcgaatcggctgcttgcaggtgaggacggggggaaaggatggcaagggtagtttctgcagatgatcagagatgtgcaaggcccgtgtctctggtctcaagcacgcccaggacccggcctcgtgccagcacaacagcagcaaggtcaatctgttcaaagggcattgcaaaannnnnnnnnngatcagatgagtggtacctgagtgacacataggtggcgctgcttgccttgtgcacactcaagcagtcnnnnnnnnnnaaggacccgtccttgtgccagcacaacagcagcgaggtcaatctgttcaaagggcattgcaaaagacatgcagagcactggcagacagagagtgaacaacctcgtccctcctacctgaacggatggtctgggttggcagtgtgcttccacagctgcagtgccttccaggcatcagagttcagattcttcccatgcctgacaggggatcagaggggtggtacctgagtgacacataggtgaggctgcttgccttgtgcacactcaagcagtcgtatcttggatccaggcatttgccttgaattgggacacaggttcccaccaacatatagaaactgcccaacaatgaagcctctgctgtgctcattcccggcgcatgtgtagccagcgaatcaacccgctccgctatcccctttctcgctcactctgagtccacagcatgcgcctccnnnnnnnnnnaaattaacccgctccactatcccctttcttgctcactctgagtccacagcatgcgcctcccgatcaactccatccctgctgatgagagggcagatgaagaactgcgcaaacctgaggtggaggatggaaatggcttgtgtatggtaattgtggcctgggagttgtctaaatagcgaaaagggcttgtggcaagaagagagctccgctcactccacccccatgcctgtccagtgctggtgccagggcgtnnnnnnnnnncggaaatggcttgtgtatggtaagtgtggcctgggagttgtctacatagcgaaaatggcttgtggcaagaagagagctccactcactccacccgcatgcctgtccagtgctggtgccagggcgtcccaattaacatcaaagtgatagtttgttgactcgctcgctgtgaaggcgttggtctggcctccatgcttggctatgaacttgctgcaagttggattttaagcaggacttcattgagggagacaggcaggnnnnnnnnnnatatgaacttgctataagttggattgattgagcaggacttcattgagggagacaggcaggtgactaggtgatccatgcaccccacccagcacctcacctgggcttgcgaacactacacagctccacacaaaatgcaaacacacctgtactcgtcctctactgggtacttctcgctgctgtagaacagcatgtgctccaggaagtgcgcaagtccaggcagatcatccgggtctgataggctccccacccggacctatgcaggagggaggtatttggttcagcctggtcaacaacgggtgccctcatgctgggccatggctggaacactcttcctcaatggcgaggtctcctcacatcgcatgccacggcggccttgtccgtcttggggtcgtgcacaagtagtacttgaaggccattgtcaagcttgacgaagcgatatccgttctcgtcggtgatcgggcagcgcagcaggccaggagcaccgccacccagatcggtgctctcccttgcatgcaccatgctgtatggattgatttggaatcgaggcaaacacaggacttggtgggcgcccgctggtgtggtgggaaaggcgtgatgaacgatctcgcgccttggactcccatcgcgcnnnnnnnnnnacaaacacaggactcggtgggcacccgctggagtggtgggaaaggcgttgatatacgatctcgcgccttggactcccatcgcgctggctccagccggcacagacatgcagattcctgcaaatcactgcaatgccccgccttctcagatgctgcacctcaagaacaccgtctctcttgcccttgtaacaagtgcgttggcatacctttacatgggacattcgcatcaagcaccatggtctgtcaaagcccggtcaccaatcatgtgttctgcctcgagggctgataaggggcgagggtcccttcacagcttcttggcggtgttggagctggtcaggccggccagccccgcggcggtggtggccacggcattggcgaggagcaggggcaggtagcggccgccgccgccgtccgcggccagagggcccagcgcggccagctgcaccacgccagccagcaggacgccggcgttaaggatgcggggctgggtctcgcccagctcgtcgttgtcggccttctccttcagggtcagcaggatggcgggggagatggtcagcagggcgccgccgatctgacgccacaggtacacggagtcggcgcccttgagcacgtagcccagggtgccctccagcgaggcggcgggcgaggcggtgaaggcggtgccggccaccacggtggcggggaccagcagggcgtacagggcggaagtgagcttgaagccacccttggacaggtcgaagacgcggcccagggagtcgaaggcgcccttgatcctgtccccgatcttgcggcggccggagccggagaccagcaggcgcgcggcggggacagccagcgagatggcggcggtggccgcgcccgcggccaggccgttgggggtgaggtcattgacgtgcgccaggttggcggccaggttggaggcggcgaacccgatcaggcccagctgcaggttctcactggtgttcaggtccagctcgtggcgctcggcgtcgcccttgagcgcccaggccgcggcggtggcgctcagcaggcccccggcgaacaggcccagcaggcggtcctgctcgatgttggtgggcagcgcggctgcgcccagcaggaactcggcggtggactggggctggaccaccagggggacggccagggctgttggaggagggtgggttggtggaggagggtgggttgatggaggggggtggcaaagaggaagaacgcctgagagcaggatacgctgcagcagaacagggtgagcagattgatgctcttgcagggcaacaaagctcgaatgcttgcggaaagtcatcagtccaaagccttatatactgtatgtcgggcgtacccaccccttccagcccgcaggcgatctcccgccaaccccgcacgcacatggcggcatccgggcccaaccccacccattcccaccacgcaccagcgctggcgatggcaacggcggcgaatccggcagcatacttctcgtggtcgctggtgcctcctgcagcgatggtggaggaaggcatgagagaggcggtgagatcaaaggggatgcgcagaagatgcggccagtgtcggatggggacgaggggggaggcccattcccagtaccggcaaaggacatcggctccatgtcaccccgatcacccaggagggccactctggcctcatacccggccacgagaaagggtgccacgggcacggtacccacctccgacagacttctcgtagcgctcctcgcgggagtaggagtagttcgcggggcggggtggtggctcgaccgacatcctggcgtgtgttttggtgatgttcggtgcgatgctgcaaaagatggggggaagacaggtgcgtagaatcagatccacgtctgttcaacggacacccaatctcatgcttgtctgcacttcctcacagcttccnnnnnnnnnngtggggtctctcatgctgccgatggcttcctcatcgtcattgtgggcagttgagacccacctcgtcctggagagcactaccctcaaacacccccccacccccccgccaccccattcccctcacacacacgcacgcatgcaaacattcctgcaatgatgtgctattcatccagcatggaggttctaccggttgtgannnnnnnnnntgatgattgcctcacgatcctctcgatgcgcacgtgggccaataaagttcgggcacgctccaggagtcccagatcgcgcgcgatttaaatgtgcaaaacgccgacgacagatcgccggacccccctcagacagttcattcacatctaaaaacttcaatcagtaggaaagaatgcgctgtgtccccccgctactcatacccccagagggccccnnnnnnnnnntttgtccacggggcggcaggggacctagcaacagccacctctacgtactacaagagggagnnnnnnnnnncgatgattgcctcatgatcctctcgatgagcacgtgggccaataaagttcggcacgctccaggagtcccagatcgcgcgcnnnnnnnnnntgatcttgtgctctaggagtcccagatcgcgggatcgaaatgagtaaaaacccgacgaacagatcgccggacccccctcagactgttcattcacatcttaaaacttcaatcagttggaaagaatgcgctgtgtgcccccgctacccatacccccagagggccccttcaccacggccgacataatggtcgccaatgccagtgtccacggtacctaccacaataagcctgtgacacaggcaatcattcctacggagcgcgtgtatgacttcctnnnnnnnnnnggtgcgcggatgacttcctacacggcgaaggccgcatgttcaaccccccctttctccaaccccctttcccacaggtgcccgacccataagacagccagcacagaggtgcttctgtcgcggggcgcgtggatcgtccccaccttgcgacagggcctggcctggcacagggacgggaagccgtttcgaaaggtgcgccaccaggcatacgtcggcagggagcgggccatcacccggcttggggagcaattccgcgccccccctggcatgaccactgtcgtgggcgtgggcaactggtcggcccggaccggggggacatcgtgcggggccctccgccaggaccctggatccgcttcttgcggcgcctgcggnnnnnnnnnngcgatagaagactcggacgccgcgcccgccttgccgcctgggagcgactgtggatgtggtgtacaccagcagcgaggtgcacccacctttcccacccccccaccagccacccacgcttgtctcgctccaacaacacaactcacccccacccacccccctatacacacctccgcaggcggggaccccctccagagaatgccaagatacgccagtacgtcggcatcgacccgggccggaccaagatgtacaccgctgtggatgaacacgccaacgtgacatcctgctcttcaaaggagttccacgccatgtcggggtccaagcggcgggagaagaccattgcgaaatggcagccccacaggggtgggcactgtgtcacgacatctcacatcgctccaattgtaccaaccctcttgctcaaccccacccccctcttcccgcaggtgcccgacccacaagacagcgagcaccgaggtgctgctgtcgcaggcggtgtggatcgtccctaacctgcgacggggcctggcctggcnnnnnnnnnntctacggagcgcgcggatgacttcctacacggcgagggccgcatgttcaaccccccctttctccaaacccctttcccacaggtgcccaacccacaagacagcgagcacagaggtgctcctgtnnnnnnnnnnaacaggacgtccttccatcggaaggcccaccccgcgacccgggttcgaattcgaatcacatccaatggatgcccgtgtgatgagcatgcagccggtcccctttccgctgcactgtgtaaagaggggggacaggggattacactcagggttatcgaaattgcgggtttcgaggannnnnnnnnntaacctgcgacgggacctggcctggcacatgcacgggaagccgttccggaagctgcggcatcaagcctacgttggcagggagcgggccatcaaccggctagcggagcagttccgccccccccctggcatgaccactgtcgtgggnnnnnnnnnnagcgaaattttcgggagaatcacatttttgaaattcgactccgaagtttcgagctgacatggcagttgcccatggggctgggcccgcccagcgcacagtgaggatgatttgggcgggctgagcaagtgtgggaataagcgcagcgtgcgcaaaatgcaactggagttggtaccaatacgttcacagcacgttacagggtaggctttacattggaagtgcaatggatctggtatacatctgtgccaactcccgttttctgcgtgccttggacaaaacttgccccttgagtgagctctttcacgatgagtatctcctggacgctagcatgctatctgatgcagatcgaaacactcatatggccaagcgtgttacctcctcgccccccctcccccctgcatgaagcgcctgatgtagtaaagcccgaaaaatttcgatatggccggattttcagctcgaaaatttccggaaattcacatgatcgaaaatttccattttccattttcgatgaccctggattacacagctctcacgggatgcagggctctcggagactgagaaggcgctcatctggcagagcgcgtgcaacaacactggcggcgtcatggggggtgcaggcagtgccctacccgccggaggtgctgcataccgacgtgctgatagccctgccccgcctggtcatgctgagtgtgaggggcagggacccgcaaggagtcaggctcgttgcatcgacgtggagtggagattggggtggtgggtaccctggcggtcagttccaagttgctgctccccagcccacttggagctggtttaaagggagcagatagcattgaaatcattcagattggtgctggggccgccccgcccttgccagctgttgataagaccgccacccaagcctgtgcaaccctactcatcgacctggaacaccttacatgtgtatacaatcagagcagcaggaatgcatctacagcagccctctcatcgatcaatggaccggggttgaacaaggaggcggcatgcgcggggcaagggccttgcctccatcaactcggcgtatcaaaagcatagcgtggacattgtgttgacgtggcacactgcacctcagaccacacacgcaagcaaggtatcaatattggtttgtaaggtttggaatcacatccgcccggggactactcggtactggctacccacgccggcctcctcagccatggccctaagggaggaggtctcctgcgacatgagtcgggccacggtgtcatactctgccaccttgccgttctccatcaccagcacctatcgtgtgaggggttggaggttagggtggtaaatgcactggtatgagggatgggcaacatggtatggcagcggccctggagggtggatcaggaagtgttgcagaaagacggcctccagtgctcttgctagccattaaaggcatgttcagcgcctggcagaacccccagcgaccattgcactccccttcacgcacagagacctcctcattgcagacaaagaaaggtccgtgcacaacacacaccttggtggcatccaggatggtgttgatgcggtgtgcgatggtgaggctggtgcagtgccagaattcgcggcggatggtctgctggatgagtgtgtctgtctcggagtctactgaggccgtcgcctcgtccgccaccagaacctgaggcttgcgcagcagcgcgcgcgcgacgcaaaagagctggcgttggccgacggagaagttatcgccgccttctgccacgcgtgccgccaggccgtccgggagcgctgccacggggtcgcgcatgccgacgtgcgccagcgcctcccacacatcggcgtctgtgtagcgatcatatgggtcgagattggcgcgcacacttccgctgaacagcatcgggtcctgggcgtggagtgggggagggatggtggttgggagactatctggcaggggggcccgattggagcttgcgagggtgtatgtatagtcaagcgtgtagagggggacagaatatatcacgactcggctgtgcagctagtaaagggcgccaaggatgcaggtacaagacagatcccatcccaaggccaatcggcaaccccgaaaggccacagattacccaaagggtcacataacacccccccaacagacacacacctgagggatgacggcgatgcgagagcggatgtcgttcagacccagggacagaagatctatgccatccagcacaatagagccctggtacggctccaccagcctgaagagggagacgatgaggctggacttaccgctgccggtgcggccaacaatgcccaccttctcgccgggtgccacggagaacgtcacgcctggagagggagggaatgggagttgaaagggagaagagggcacaggcaaggtccaacaccttggagtttaccacctaatgcgcagactcctgcagatgctacttgcgcaggtggcggatgccaagccccatccagcctggggtcccctcccgccaaccccagctcacccttgagtaccgggcccagctctgcacggtaccgcatccacacatccttgtactccagtgcgcccttcttgggccaggcgtcaggggccctgcatagaagcagacgtaggtagggatgagggcaagttgggggccataccctgcaactggcaacacgctcctgtggaggaacgaactccataacctgcctatcccatggacctacaagcgcgggaggtgcgcatacaaacaatagctcacattttaccccttcccctgcttcttgtgctacctcacaatgccagttcaatgaagactctttgaccccaacaatagccctcgtcaacaacgacgcactctttcccaggcaggtaggcaggcgcctcctggggcaggtcccagtacgcaagcaggcgctccactgagttgaaccggctctcaaactgggcggaagaagtcaccacgaccttcaggaattgggtgacgcccagcgcctggctcagcgtcagcgctgcattgggcatggggagagggatgaagggttggaagggaggtgcgaagggagggatccttgggctcctggcacatcacaggtgcaaggtctggagccagccgccatgtcagacacagcaggtcccttgcaccacagcagtacatctttggtctcacatcgatcccaccacctcacccaaaagggctacatcgctggagtctcgcttgacgatggacaggatggcgaccaggacgacgatgatggagcccataaagtccaggcgtatgctgagccactcgttggctatgctgaggcaccagaaggcccgatgattggcgtccacctgcccctggctgtcggctgcaaaggcgtcgctgagacggtaggcccggatggtgtccacgccagacagcgtctccgaaaagtgggcgaagatgggggagcgggaggtggcgtcctgcctctggaactcaatgtacgagcgcctgggagggggaatggagtggcgggtgtcgacgatggtggatcgcgaggttgcagatcagnnnnnnnnnntcgggatattgcagggtaaacacgagtctggtggagataattgcatgaagggggtgagcatctaacttcagtcagttctgacaggtctttggcaagagacggttacccggtgtgcccatccaagaagtaacatcctctgcatgtcaaagcgtggcctcacctgtagaacctctggacgaagtagtagatgacgagcaggggggctatgcccaccaggatccagggctggatgacggcgatgaacgtgagggtgcccagcaggttcatcaagcacgttcccaattgggccacggacatggaaagcatgaaatccatgtcccccgtatcctgcgcagcgcagaggatgtacaggagggtgaaaagaggatggggggcagtgcatctccgtaaaccaagagctgggcatccatgctcacacatcacctctggccacttcaagatggacagcaccccacgtatggcttgttctgactcagagaccgtgcctcagcccctcaggactgtgttcccagccttgagcttgcaccgccccctccacttcaggttcaagtaccttggagaacctattcagtatgcgtccaatcggtgtggtgtcgaagaaggcgacaggggacctgttcagcgacagcaggctccgtgcatggatggcgcgggaggcggtcagcgagctggccaagttggcaatggtgcgcagggtgcccagcaatacataggtgagggcaaagcccaggtagccaccgatgtagctgatgcggttaaagtcggtggggagacctgcaagagggatggtgagacgctcgaatcatcagaaaactgcggtgaatgaagggatggaagacccaggctgcgtgagcagggatgagaggcttggaagagtggtgcaggggagtgtgcacgttgtgtcttcacaatgccacagcagcttcccaaggagctgcacacaattccctctggcaagggaccccctgcaaatattgctgtggcctggctccatccgccagtgcctccgggaactccaagtagcccaccgcatatccacctcccaccaaacccctcaccagcttgcagatccactgcgagcacgccctcggcggtgctccacctgctcagccaccagttggtcagcacactcgnnnnnnnnnncaaacagcagccctcaccccctaccagcaaggacaaagcagcagcaggcattgctttggcatgactccaatcaccagtgcctgtcacaactcacccgaccacacatctacgccccaccaaacccctcaccagcttgcacttggaccgcattcagggtttcagcggtgctccacttgctcagccaccagttggtcagcacgctcgtggtctcctccccgctccagcagaccagcagggccagggccgcccagcgcccatagcaggtgatgtagcgccagtagacgctccacgccaccgacccctgcgccttgtcctctgccaccatcagtgccccggtcaaggggccctggaggagtgagagcagaaggcagacttgtggcaaggctgctggcggtgtgagttgcagagaagtatcatgcaagccgggggtgaccatctgaaacgcgtcgtgggggggtcaaggcgtacagtgctgcgggacaccagttgaaccacaccaaaccagcagccatgtgctctggtgcatgcagccacagtcgagcccattcaacgagatgggaggggctggcagccttgctccctcaccccagccccagcctgcacgccgatagacaccttgacatcgtgctgctcgatgccggaagtggtagagacccgggaaggccggaccagcgggctccctgtgagagcaagcctggcggatggggcttgtggcagttcctcaaagctgaactctggctcccagtccagctcctccagcacctcatgctttgccgcctcgccgcgggagacggcacgcatcgacagctccacgctcaacagcatggaggacagcacagccatcggggcctcctcatcagcccttgcctcggcggcatgctcccgcaccagcccggcaaagatggggtgcgccatgcatgtatcgtagtcgccctgcaccaccacccggccctcatccaccacgatgatctggtcggcgtgggggcagtactgcagctggttggttaccagcagccgcgtcttggcctgcggagggagaggaggagaggaagcatgggtgggtgactgaagcaataggggctgcactgcgcagcagagaagtcaggatggcagaccagactgcgcaagaagcccagacatccatgcatcctgcaagccactgcccacaaaagactatcatgctcaagccccgaaattctgcaccattcgatgcagtgaggataacataccatgcaataatgcagcgtacaccccataagcaatcttgcccaccttgagggctccagtgatgaggttctcaaagatatgacggcccacatggacgtccaccgccgacagtgggtcgtccatgatgtagacgtcggcatcctgagaggaggaagggcgagaaggggacacaagatgcgtgatctcaccaagacacagatgggctctgaagaatgacagcagaactgtgctgctgatgtgcaccagttggccactcaatcctagccaagcccccacctgatacatggccctcgccaacgagacacgctgcttctgcccgcctgaaagattgatccccttctccccgatctccgtgtctgcgccgcccggcagcgtcgccaggtcttgggacaggcagcatgcctggtggggtggggcggggcggggagatggggagcgtggtgcagcggccagtggccagctgcaaaatgcgtttagccagggcattattgaaaggtaagaggtggccatctgattaagaacattgcattagaagaacctgaaatgaatattgaatcgaccttccctgaatgtctttggtccatccccatcaagcaccccgagtggctgacagcactaccagagcgtaggagcacttccgaccaagctgctcaacccacctccacggtcgcattccacctggcctcatcccactcctttccgaaagacacattgtccttgacggtggcgttgatgatccaggcctgctgtgcaacgtatgccaccgagccacccacctaataggaatgcgagaggcatcaggttgagtgattggcacggtacatccgtactgcatacacccttgtctttgcattatgttcatccgacgccaatgtcaagtaagagagatcagaggctgaaggcccagatatcaccccgcttccacctccacagtgcacttcaccatcctcaccctgacgtgtccagattccttgtccatctccccgagaagggcctgcaccagggacgacttacccatgcccactcgtccaacgcagcagaccaactccccaggcttgatctgaattgggttggtggcataaagggtgaaaaggtgaataagccattggcacaaacatgccaacactggctgatattctacccacaggctctcaacgtatgtaatcatcggaatttgataagaacagcttaccttccttctcacccgattcccctgcatggcttccctcctcacgattgtccccctcccccccccaa

SEQ ID NO: 40341 - DNA, 71 bp, Chlorella protothecoides
gggccagctggacgtatgcccagccggcggcgacctcgggcgtgagcggcggggcctgttcagtgagggcg

SEQ ID NO: 40342 - DNA, 154 bp, Chlorella protothecoides
tcttcaggtagaacccgcggctgcctgcgatgatggacgcatgggtgtggccgagctgcgacggctgcaggatgggggcacgcgtttaactccttccccgggcttggggctgggcaccatacaccttgctggtccaccgtgagtccgaaagccc

SEQ ID NO: 40343 - DNA, 61 bp, Chlorella protothecoides
caccggcggcaaccgcaccaagacccctgggcccggcgcccagagcgcgctgcgcgcgctg

SEQ ID NO: 40344 - DNA, 80 bp, Chlorella protothecoides
cagtgacctttctgacgctgtagttcttttgtcgaggggtggctgtctggcaagggcaggttgacctgcatcgctgcggg

SEQ ID NO: 40345 - DNA, 800 bp, Chlorella protothecoides
  modified_base (560)..(569): a, c, t, g, unknown or other
cccggccgctgccgaggccgaggccgcgcccgtgcacgacgacaacgagtggggcatagaggtggtggccgaagctcacgcgccgggcgccgggccggccgtggcccggcccggcgctgcggcccaggcgctgccggcgggcgtggcctactccgtgcccctggggcccggggtcacggccgaggagcttgcggcacacggcgtgcagcccagcgaggaggggctggacgacctcctgtcccagctctccgccttgcaatgatggggggaccactggaggggccgaacgtcgcgctcaggccatcgtgtggctggggtgtagatgtaatcatacgtgcaaggggaggaagcccgcagcgatgcaggtcaacctgcccttgacagggagccacccctcgagaaaagaactacagcgtcagaaaggtcactggagacaggggggcgaggaagagtgaatgtgtagaaacgggcgtgctgcagctgccagccgctctttgggaaggaaagagggaggtccaggaggatcgcaccttcatctccccctccgtttggacttcccnnnnnnnnnngggaggtccaggaggatcgcacccttcatctccccctccgtttggacttccccacaataaaaagactgacagtcctcaggccctgacggcgctcaggcgccgcgccgaccaccagtgccgggcggccagcgccagctggcgccggccccggcccagcgtgctgcggcagtgccgcgccgctgcctgcaggccctggcgcagcgcgcgcctcggctccgcgcccggcggcac

SEQ ID NO: 40346 - DNA, 6999 bp, Chlorella protothecoides
  modified_base (691)..(700): a, c, t, g, unknown or other
  modified_base (818)..(827): a, c, t, g, unknown or other
  modified_base (1785)..(1794): a, c, t, g, unknown or other
  modified_base (1856)..(2075): a, c, t, g, unknown or other
  modified_base (2335)..(2344): a, c, t, g, unknown or other
  modified_base (3986)..(4034): a, c, t, g, unknown or other
  modified_base (4135)..(4144): a, c, t, g, unknown or other
  modified_base (4245)..(4254): a, c, t, g, unknown or other
  modified_base (4320)..(4329): a, c, t, g, unknown or other
  modified_base (4506)..(4615): a, c, t, g, unknown or other
  modified_base (5361)..(5370): a, c, t, g, unknown or other
  modified_base (6875)..(6884): a, c, t, g, unknown or other
cccccccccggaaacacgtcaggtggaagatccaggtgcgcaaggtgctgagcgccgacaacatcttccgcaacacggggcacaagcagaagcacgagacggtgtggcagctggacccggtggcgctgcaggagactaatgcggagcgccagcgccagcgcgccggcctgccccccttccagttgccgacggaggtggccgccggcctggcgggtcaggacggcggcgcaggcggcgccgccgcgggtcccagtctgccccaggacggcggcgccggcgccccgggcgccctgccacacattccgctggacgtcgcgtcgctcagcgccggccccggcgccggtctgggggtcagcgcggcgatgatgcagcaggtgctggaggcgacgacggggcaggcgggcgcggcgccccaggtgccacagcagcagcagcagcagcaccacccccacccccaccagcagcaggccgaggggccgcagggcggggagggcgccgccccgtcgcagcacctcggcatgggcatgccgcactcgctgggcctggaggctggccagggcgggtacggtgcgcgccccgctcacaactacgatgaggccgctcgaggcaggggctgatgagggggcggacgaagcgccgagcaggcaccggctggacctcgggctgcgcatggtcaatgtccttgggctgnnnnnnnnnnaaagcgccaagcaggcactgtcaatgtcctcgggctgcgcacggtcaatgtccttgggctgcgcatctgactgccctatcgttccacctgcacctgggtgccatgtcgcgtgtaccgnnnnnnnnnntcttgggctgcacatggtcggtgtcctgcctgcacatctgactgccctatcgttccatctgcacctgggtgccatgtcgcgtgtaccgttacctgttgcgtgtaccgttacatggagcgaatcaggcatgggatggagcgggggagggggcggggagggaccaacaggcgtgggacgctcgtcactgccggcgtaggcccgcgtcacagcgagcgcgccaggacggccgggtcggcgttctccacgatccaggggtccgtcagcacctggctgagcggtaagcgggccgctgggtccttgaccaggagctgcggaaggaagggaagggacaagggatgggagtgggcgtgtggcggggggggggccaacaaatgcgctgatgtgtggcacgctctggtgtgcatggcggcgtcgatcgggtgcgatggctggcagacgcagggccccccccccctcattcgcccaccttggagatgaggcgccgggcccccgccgacacgacaggggtgtccggaaagcggaggtccaccttgaggatgcgcttgtaggtgtcgctgtgccccgcagcctcgaaggggggggtgcccaccaggaactcgaaggccagcacgcccagggaccagatgtcgacgccggtgtcgtgggcgcgcccctccaccatctcggggggcaagtagtccagtgtgccgcacagcgtctggcgccgcgagttgggggcgtgcacggacctggagtcagaagggcgggggtggatggaatgtggccggggctgagcttcaggtgtacacgtggtgcgaagctgccgccaccagaggctggggagtgttgtggcgatgctggacagttgcatctccctgctgcctgcacacgccatatcctgccatacgtcgccaagcagcaccaacaacagggcggcacggtcgacgcagactccgcctgccccaaaacctcagccccnnnnnnnnnnatgcacagacctggcgtcagaagggcgggggggatggaatgtggccggggctgagcttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttcttcgcaccagccaaagtccgcgatcttgagttcgccgtggagacccagcagcaggttctcgggcttgatgtcgcggtgaatcacatgcttggagtggcagtagagcagggccttggccaggctggcaatgtacctgcggcaacgatgttggtaggagcgtgtgaggggtggaggattgtcgaaagttccacagcatgttgtgcttggagctgcgcatgcatcgggcgcctatgcatggcctggtgtgcattgnnnnnnnnnntttccacagcatgttgtgctcggagctgcgcatgcattgggcgcctatgcatggcctggtgtgcattggttccagcacgcacgaccgactcctccctgaggcaaccctggtgaccaatcgcaaagtcatccatcagcccctgtcctgcaccctcacgtcgcagtccggggctcgtcaaagtgcccgaccctctgcagctccttgtacagctcgcccctggcagcgtactccaggataaggtacacgcgggtctgggaggaagggtgtgggaccagggtgcgccgatctgggtctgacgactagtaatcgagaaggccgtgtagaatggcagcacatggtgcccaattgactccctgcccatacctctcaaatccactgcagcatgctgcacagcacacccagacctcacctcgtcgtagaagtagccgtaaagccgaaggatgttggggtggcgcaggtggctctggatctcgatctctcgccgcagttggtgctccacgttggatgtctgcagctggttcttgaacagcacctggtcgggagggaggggatacggtcatacagggggtgccatggagtcctccaagcactcgaggccctgagacgcagtcactgcaggcactccccaagcctccacagctgtcacccaccttcagggcaacaatgtacttgttcttccgttcccgggccaggtacacgtttccgaacttcccccggcccaggggcttcccgatgtcgaagtctgtcagctgccatcgcgcacttgcactgctgctggtcctctccgccgtgcgactctcggcagctgctgtcttgaccgggcccgtcggctgcgcagccttgccgggagccgcgctggctgctgtatttgatgcgacattgacactgaggggctgaaggactgcaggacgcgcgccggactgctccgtcaggcccttggcaacggttttggtgcccaggtgcgtgggtctgaagggcaggcaattctcctgtgatgcagacggagcggggcttccttaggcatggtgaggaagtaagatcccaatttggtacccatgcggggctccggcataccttgtccacttggagagtagccatggctgaaaaccgtttcccttgtccgttgcctcggcggagataaggcccctcagttgcgcatgcttgtattagaaatcacttcgcccgccatacatttgtgatgctgggttgtcgtccgcattatgtggcgagtgacagctccactcccccttgtcggggaatttgcgcgtcaggtcccctctgacggggacgaagcaagggcccagagcacagcatgaggcagcgcgagcccttcaccaccctacttcgtaccaattcgattagcactggaaaatgatggatctctgtgattttggtatagagcacgcagcctaaacacatctggtgagcactagcaaacagcatgttcttgtccacgacaggtaccagcctctgagcctggactgaggccctgtgtttccccggaggcctcgacgataagttacccgggtccagaatgcatctttgataggcactacagccaggacatgctgctacccgatgagctttgacgatttgtcacccagacaagtttgggggttggccagatctcggtggcgaccannnnnnnnnnnnnnnnnnnnnnnnnnnnnnnnnnnnnnnnnnnnnnnnngagtcacggaagaacctttaaaccgtgccatctcatgtgtaatattgggcacggccccttccccgagccttccccgagctgtgcacacaaagattttcagnnnnnnnnnntagtcaaggaagaacctttaaatcgtgccatctcatgtgtgatattgggcacagtcccttccccgagccatccccgagctgtgcacacaaagattttcagnnnnnnnnnntccctccaaagttcgcgcgcgtgcatgggtggggggggaggcccaggggccgtccctcacccgggnnnnnnnnnnaccgggtccagaatgcatcttcgatgggcactacagccaggccatgctgctacccaatgagctttgacgatttgtcacccagacaaaactgggggttggccagatctcggtggcgaccaattgaacgtccacttgatgagtgccatcaccctaagatagtctttacttggcggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagcagagtggagaattcatagcatgtaaaatcaaattctcccgagaacgatatttcttgtgtgcccctccaaagttcgcgcgcgtgcatgggtgagagggaggcccaggggccgtccctcacccgggacaaacggacgttgcccactctctccaacgccgcggaagccaacagttggggagcaaatctgtgctatatgttgtgctcccgtctgttttgacccggcgtcacccttcgttacccctctcagacgggggctcggaccccggtcctgctgcacaattccctgagagccctctccagggccaaaactgggcctgccctgggcccggggacacaggactacgaaccccggaaggagctgtcgcgtcccactccagcgccatggacggccaccacgatcatggaggggacccttcgacactttccccggcagaggttcccgatgcgctggcaaacatcggtcaggtggcccaggccatcatccactccgccctggtggatgggactgagccaggcatggagcacggcctgccagaccggctgcatggcctggtgggccctgcaggcctgtcacacgcgacacacagtgacaccgagtctgatggggagctggaggagatgacggaggccggcatggaccctggtgagcgtgaggaacaggggaagggccatgcgcctgccgccagggagggacgataagcactgctgttgcacccttccctgccggcccaggctcctgnnnnnnnnnncgccgccagggagggacgaggagcactgctggtgcacccttccctgccggcccaggctcctgccaggggggcgctctgctacgcgtgggattgtctgctgggtcgagagccggcgcacctggaccacctgatgcgatcctccgcttgccatctccctgccatgagcgtaatccccgctccctgctcacttttactcccttcccgcccacctcccgtgccccacagccgactaccgcatgaccactgccacggtggactcccaggccaagaaatccgacgaggcctggaccccccaggaggaggacgagctggtgaagctggtggggcaggaggactaccgccgctctcggctgggcgacaccaccaccaagtgggcccccatcgcgcgccacttctcgcgcaccgtcaaggccgtgaagcgcaagtacgacaagctccagaacccggacaagggtgagcggtggtgctcggtgcggtgttgtagggggggggaaagagggggtgcagtttatcctcggggtggggattggagcctacaggaggggggctggcaaggcgcccctggttcctttgatgcgcccccctcgggccaggtgaaactcacggcggacagcacggcgttgttaccccatgcagcctcctgggcctgccttcaggacctggctcccacgccaggccccagttcttggatgagccaccctgccaaagctccatcccccccccctcctccctctccccccttggacacccaccacagagcaacgcaagaacaaggccctgcccccgcgccccgccggcgcggtgttcagcatgccccacggctacatgtccatggtctcgcacctgcacccatctgccagcgagcagctggcgggcatgtacggcggcgaccccggctcgatgggcctgccgtactacggcgcggcgccgcacggcctgacacccgaggccgccggcgcgctgcagcacggcctgacgccggagcagtactcctacctgtccggcggcgccggcttccccggccaggccatgggctacgccgggctgtatgagccgggggacggcggcgcaggggccatgcaccttccccccaacttcaccgacgtgctcatgagctcgctacagtacggcgtccccggcacgcacccgggcgccggcggcgacttcgcagcgggcctgggcgggggggccgcgctggggccgggcggcgccatgccccatcacgaccgccgcttctggaacgaggccgaccagcaggagctgctgcgcctggcctccgacgccacctaccgccagaccctgctgggtgagcagggggagggggggggggatgaggggtggtcggtctgaagcaggctaggccttccctgagtccaggggctggctgcaatggcatattcgtgctccgacagcgacaggaggcctgtcgagggagttgcggggcgcgcggagggcgtttgggctgggttcctggcctgcctctgccctgcctgccgtgtcgggcnnnnnnnnnngctaggctttccggagtccaggggctggctgcaatggcatgtgtgcgctccgacggcgacaggaggcctgtcgagggagatgcggggcgcgcggagggcgtttgggccgagttcc

SEQ ID NO: 40347 - DNA, 61 bp, Chlorella protothecoides
gtcttataatggcatgtgccggcccaatttcgcagtctagggtgcatcctctacccagttt

SEQ ID NO: 40348 - DNA, 134 bp, Chlorella protothecoides
cacgcgagatgaacgttcattgagggatcgcgagctaggatgatgcccctcaaacgtattgcatcgcgtcttcgtccgagctcccggtgtttcgaaatgggcatctgtccgtagctgccggggtttcccgccaa

SEQ ID NO: 40349 - DNA, 93 bp, Chlorella protothecoides
ccggccagcgcctttgctccctccagcgacgaggggtggaggggggaggaggggcaagaggcagagccgtcctcgtccctgctcttccggctg

SEQ ID NO: 40350 - DNA, 83 bp, Chlorella protothecoides
acccattgcttcccccacctcaccttccccgctcctatgccctccccttcatcacccattgcttcccccacctcaccttcccc

SEQ ID NO: 40351 - DNA, 61 bp, Chlorella protothecoides
cgcaacccagtccacccaacccccatcccatctacaagataaaagtatcacactcacggct

SEQ ID NO: 40352 - DNA, 101 bp, Chlorella protothecoides
gcactgcgatcagtccgccacgccttccagaatcgcaagcggggcgtgcaccccccagccacttcctccttactctcaagcaccggcagcagccccctggc

SEQ ID NO: 40353 - DNA, 1317 bp, Chlorella protothecoides
  modified_base (278)..(287): a, c, t, g, unknown or other
  modified_base (617)..(626): a, c, t, g, unknown or other
  modified_base (1211)..(1220): a, c, t, g, unknown or other
cgggcgcggcatgggcagagggggggccgagggggggccggcgcctggagggtcggcgccggaggggccggcgccgggcgcgcgacgcacgaagggcgggaacagcgccgcaacggaggcccgcgccgcatccagttggacccgcagcagcggcgccaggtgcgccggcagcggcctgtgcttgtaggcggtgcgtgtgtgtgtgttgtggtgtcatcgtgtgtgtgtgtgtgtggagtcctggcgtgtcggcgccggtctgcggcagagcgagcgcnnnnnnnnnntggcggagcgtgtgtgtgtgtgttgtggtgtcatcgtgcgtgtgtgtgtggagtcctggcgcgtcggcgccggtctgcggcagagcgagcgccgtgcaagcatgctccaatgtctggcccctgccggcacgagactgagatcgccaggcaagcaccgcaggtcaacactctccttccacccttcccccgcccccaccctccctgcaacagcgtctcaaccccgacacatcccggtgcaccgaacccctcacctggccacggcctccacggctgcacggtgcgaggcgggcgtgagcccacgcagcgcggcctggaagtccgcgcgctccnnnnnnnnnngcagcgtctcaaccccaacacatcccggtgcaccaaagccctcacctggccacggcctccacggctgcgcggtgcgaggcgggcgtgagcccgcgcagcgcggcctggaagtccgcgcgctccacgcgcaccgcctgcaggtccagcaccaggcggtcctgtgtgtcgtagacctgcgggtaccgccgccgcagcgcggccaggctggcctccgtgcacagtgccttgaggtccgcgccgccgtaccccaccgtctcggcggccagctcggccagcagggcggcgggcggcggctccgcccaccgccgcgtgtggatgcccaggatctcggcccgcgcctccagcgcgggcagcgggaacaggagctccctgtcaaacctgcagcgggggagggagtgggtgttgggcggcggcatgagtgcgccggccgctcagtcggccatgtgaggggggccttgcgctggcagcatgggcggcgggtgggcatcgactcgcctgttgcggcattctgcagcctggccaggcgtcgatgagggccgatgcagcatggggacgcccttcccacccctcctatgtctccgcccnnnnnnnnnntgatacgcctgttgcggcattctgcagtctggccaggcgttgatgagggccgatgcagcatggggatgcccttcccacccctcctatgtctccgccc

SEQ ID NO: 40354 - DNA, 174 bp, Chlorella protothecoides
gcgcgcttgcatcaggaacggcctgcgtgcgtgcgtgtgtgtgtgtttgggagggagattgtgagaggggggatgggatgggaggtatggggccacggagtataaatgggggcaatgcatcacttcctcctcaccacccatacgcatcccctccgtcgcacgcacatgctcccc

SEQ ID NO: 40355 - DNA, 241 bp, Chlorella protothecoides
ccgacgggccggcgctgggggccgcgctggccgagctgcgccgcgccgcgccgggcgtcgctgtggacctgcggcgcgcggagggcgccttccagacgctgtgctgacgtggcgctgccgcgacgcgggcgtcgcaacaagaccaccccccaactcctgccggctggtgtttcccttttttctttagattccttgtggggggctcgccacggccccccttcccccgccgctgcagtttctt

SEQ ID NO: 40356 - DNA, 461 bp, Chlorella protothecoides
  modified_base (169)..(391): a, c, t, g, unknown or other
ggacgaggtggaggacctctggggctaccaagcatgcactgagcagttcatgcccttcagccgggatggcaagaatgacatgttctggccacaggtacggggcgatatggggggatgcaccagcggccacagcgtgggaaggtgcaggcgggcttggctcgaccgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggaatcgggatttgtagtgggaaggtgtccgaagaggacgcccactacgtttccaatcgccacgag

SEQ ID NO: 40357 - DNA, 481 bp, Chlorella protothecoides
  modified_base (322)..(331): a, c, t, g, unknown or other
ggcgtggcgctgggccgcggtgtccggggccagcccgcgccggctggaggaggcggagagcgggtgggaggaggaggccttgcgcgagggcgggtcaggggcagggccggcggcaccggggggcccgccggccgcgacgacggcggggagcaggggcggcgggggcagcgggcgcccgctgcccagccggcgcagcacctcccccgcatccatggaggagcggcgggagtggccgggcgcggcctcgctcaggctgccggtggtggagagggggctggcgccgggcacggtcgcgtaggcgccacgccaggaggattcggannnnnnnnnncagggggctggcgccgggcacggccgcgtaggcgccacgccaggaggattcggacgcgcgagcctccaggtctgcggggcaggagagggaggggagggtggggagggaggacagggcggcaagcagggaggtgatgtagagtaggtgagc

SEQ ID NO: 40358 - DNA, 97 bp, Chlorella protothecoides
agcgcggctgggaagaagtaggctgttttgatagccaggctggcttcttcagggggagcggggtcagctcggagcatgtggtactgtgctaccaatg

SEQ ID NO: 40359 - DNA, 71 bp, Chlorella protothecoides
gtggcggtggcgactttggcggcggcggcggcgactttggcggcggcggcggttggtagactgacatgact

SEQ ID NO: 40360 - DNA, 127 bp, Chlorella protothecoides
ctacgcctgctgcagcatcctcaacacagccgggcacctgtggtttgccctgctgctggtcgcagggtttggcatcacgctgtgcgtcctgtgcctaccctgcatacacagcatggacgacgtgccc

SEQ ID NO: 40361 - DNA, 103 bp, Chlorella protothecoides
gagcaggtgtggaaggagggatggccgcaaaatgctttggcgatgcagcatcaacaataccacataaaacttccctcctctcctgactctgtactaccagcct

SEQ ID NO: 40362 - DNA, 129 bp, Chlorella protothecoides
gggggagggaggtgggcagggggtgggggggcacataccagtcgttgtgcctgagaacgggagttttgtgacagtatggtgacaagaaggccgttgcatactccttgcaggtggaagaggctctgcagc

SEQ ID NO: 40363 - DNA, 65 bp, Chlorella protothecoides
cggaatcgccgtgattcgtgatcaccccagtgcctcagggcttaccagtgaccatcacgctgttt

SEQ ID NO: 40364 - DNA, 61 bp, Chlorella protothecoides
tccaggccgcggcccctcccacctcccacccgctgaaggcgacttccatcaaggcccgagc

SEQ ID NO: 40365 - DNA, 78 bp, Chlorella protothecoides
tcattgcttggatgagctccatcatcacattcctcgaaacgctgtcacacaacgaaaatatccccattgctagagcga

SEQ ID NO: 40366 - DNA, 106 bp, Chlorella protothecoides
gcctgcagcgccggctcctgcaaggtgggagggagaaaactctaggaactcccattcccagaatcttggcgggagcctggaggcggcggatctgtcaaggccatcc

SEQ ID NO: 40367 - DNA, 61 bp, Chlorella protothecoides
ccagtccccctgccgttgcgtctgtgcctgtgatgtcagggccagacaggtcttgtgaaca

SEQ ID NO: 40368 - DNA, 61 bp, Chlorella protothecoides
gcacgccccacacacctcagcggcggagggagtgtaggagaagtagacgccggggatgaag

SEQ ID NO: 40369 - DNA, 61 bp, Chlorella protothecoides
tgctctggaagaatttctccctcttcctctaccggtgggcagtatacacgatctgcgcaca

SEQ ID NO: 40370 - DNA, 61 bp, Chlorella protothecoides
gatgcccattcatgcgtgggtgcccattcacgcgtgggtgcttcatgcacgtcccttcatg

SEQ ID NO: 40371 - DNA, 61 bp, Chlorella protothecoides
ggagacggtgatgggagccctctgaggtgcaaccctgccatgagttcatgtgagcagggct

SEQ ID NO: 40372 - DNA, 5960 bp, Chlorella protothecoides
  modified_base (442)..(451): a, c, t, g, unknown or other
  modified_base (663)..(672): a, c, t, g, unknown or other
  modified_base (1172)..(1181): a, c, t, g, unknown or other
  modified_base (1524)..(1533): a, c, t, g, unknown or other
  modified_base (2759)..(2768): a, c, t, g, unknown or other
  modified_base (3576)..(3585): a, c, t, g, unknown or other
  modified_base (3994)..(4003): a, c, t, g, unknown or other
  modified_base (4563)..(4572): a, c, t, g, unknown or other
gtgcgcgcgggcgtggcggcgcggctggcgcccgaggcgccggggcgggaggggggcgaggccacgctgggcacgctgcgccgcgtgttcctggccctgccggagggcccgctggcggtggccgaggtgctgcgcttcggggagggggagggcgtggccctggcccgcctccaggaggtcctgggcggcgcggtggtggccgaggccctggccctggatgcgccgctggaggtgacccggtacgtgccgggccaggcgctgcgccagtccaggaatgagtacgccatgaggaacctcatcatcgcctctgtcctgctcatgatcatcttcgtgctctacatgacctacttccatggccgctgacggcggatgggagggaggactctctggggcaggagcatcataccttgggaagtacccgccaccacctcctccgttgttnnnnnnnnnntatgggagggaggactctttagggcaggagcagcataccttgagaagtacccgccaccacttcctccgttgttaaccggcccgcgacgccacccaaggccgacatgggtgcatcactgcggccaatctggaacgcacaaccttggctttgcacgggcccctctgtacgacgagggcgtggcccgcccgtatatcggtcccaccacctcgagnnnnnnnnnngtgggtgcatcactgcggccaatctggaaaacacaaccttggctttgcacgagcccctctgtacgacgagggcgtggaccgcccgtatatcggtcccaccacctcgagacagtcacgtggcgtcgtatcggcataacacgattcccgacgtgttggcgtgggcagggaaaccaatgtccctatgcgcagacggaggtgtaaccctagcacaagacatttcaaggagctgaaccccaggcagtgcgccgaatgcatgcgcctgccgcagattgcgcagggcgaccgggagttccgcttccgaggtgcggcgtgggcgccgaagctccgaactcgggaccccatgtccgacgcattggccgctcgcccaacccgcacgaaccccgcaaacctgctcgcgagcgaggactgagctcgaccagcgagcatggtacaaataccaggcctgagcacaattcccagctcgccatttcaatcaagtcccccacccccatctggaatcnnnnnnnnnncggcctgagcacaatttccagctcgccattccaatcaagtcccccacccccatctggaatccccaaggtccacagcccctccctcgccatgtctcggacctgaatcctccccaaggaacctggaaaaggttctatatctactccagcaccagaggacccgacacgaacgcgcctgggaggacttgctggactctgcatgcagcgctgatgagcggccatggtaccgagtcgtttctcgggaagaggtaggttgggcatttgggccaggagcaagcttatgagaatgcttgatggaggtttcggaattatacccgccattcttggcctgcacaatgaccgatannnnnnnnnncatgagaatgcttgatggaggttccggaattatattcgccattcttggcctgcacaatgaccgatatcgttgcgccacatcgctgctcgcagggattccagcgggcgtcgctcgtccggaatcaggaggaccgcatcgagatatcgcggagtgacccaccatagccgtaccaacgtgagggcaggggggtggaatgaggagtgcgtcagcatgatatacaagaacttacgtgccaagcacggaggttgtgggtcgagagccgcacaattgttcggtcaagtatgaggggtggggtcctaaacatgttaattgcccaccccaacacctgcgcgcagagatacgaggcccatgtttggagcgagggtaaacaagtttacctcggaggatatggtttggaagtgcaggtagggcatctctcggatgttgttttctcggcatggcaccccttggggaccctcggattgccagcgtgcgcgagtctgggatgaccaccctccctccctcccatatgcccgcaggccgccacggcctatgaccttgccgcatgtaagtttaggggccaagacgcccagaccaactttgatatcttccgatacagcgcggagttggaggatcataccgcgagtcaggaggaggtcgtgcaacacctgcgagcgcagagcaaggccatgaactgcgttgccaaggatactaatctcaccatggaggaatgggagctggagatatcaggtacggtccttatcaccaagtttccgacctgcggcccagcggcgagcagggttcattggtcgccaggccggcgtcccgttgtcctctccccgaggtcccatgcgtgcatggcactcttgcgagcatgcagcgtgtccacttcatcgcattgcatcgacgcatgacgcttcacagtacgttcccatccttccccctgcagctacggtgcaccccgacaaggagcacctgggggtgtttgcagacgagcgggctgcggcgcgggcggtggatcggtcctgcatccagaggctgggactgggtgccaccacctccttccccctggtcgactacctagacatgctgggtgagaacaatggcgtaggggttgacccttgagaggggttgggagagcttgatcgtgagggtggttgtcggcatgaagcagtgtcaatcgattggcgccattgttcctccgaatcctcacctttactggggcaaagcgcccgctctgaaatccnnnnnnnnnntatgctgggtgagaacaatggcgtagggtctgacccttgagagtgggtgggagagcttgaccgtgagggtggttgtcgtcatgaagcagtgtcgatcaactggcgccattgttcctccgaaacctcacctctactggggcaaagcgcccgctctgaaatccttcaccacaccatctccacctcccacagatggcgagcacatccaagcagcggtgaagcgaggcctgctccccccggtcctccccaccagctacacccctcccccggtgccgacccccctgctccagctgcagcgggctgcccgcgggcccagccccacgctgaagaggctgaacaccccccgagcaggggagtacgacgtcagccccatcagccagccttctggggcccagcaagccccagcaggctccatgcagtcccccagaccccaggccacgccgggggagggggaggccaacgcccaccaaggtgctgagctgggtgtccaggtggtccctcgccggacctctgtgacaccccgcagcgtctttgacttcatggagttccagaccatgctgaccggtgagcacagggttaccccggtccgcacgcaggcgacactgggttttgggatgtgtgctgacgcacaatcgcgcccatggtgccaggactgggtcccggtcagccctccgtcgcacacatccccaccaccctgacactgcgcacccttgtacaccgccctgacacggcccacactcaaaatcttcatccaagcctcctcccccaatcctgccacttcaggtccctcctgcgctggcaagcgtctgcnnnnnnnnnnttgtgctgacggacaatcacgcccatggtgccaagactgggtcccagtcagccctccatcgcacaaatccccaccaccctcacaccgcgcacccttgtacaccgccctgacatggcccacactcgaaatctccatccaagcctcctcctttaatcctgccactccaggtccctcctgcgctggcaagcgtctgcaggaggaggcagacggctcgtgcaagagagcacgaacggatgacccggatgcatggatgcaggaggacgcactggccatgctggatctccaatgaggacccaaggtggtcaccgtccgccccacgtcagaacgctgctgtcattgacagcaactttcggcgctctcctgctcaatacatgccctccgatccctgtgccacatcccactgccggcnnnnnnnnnngggacgctgctgtcattgacagcaacctcccgcgctctcctgctcaatacatgcccccccgatccctgtgccacatcccactgccggccatcccacgcgatccctcccaatgtgcagcatgcccatcccctcactgtggagtccattcctgcaactgtgtcctcaaacccttgccctcccgagccttttcccgagtcggctcgctgcgtgccttccttccgctgagtttgcaggttccccttttacgcctccactcctcttacaaaggccgctcgcacaccacgttttcgatccctgctcggatttgaaatcaatacaccgttggacctaatttctcaaataagaataagatttggtttcaggaggtgccagataatgtgatcgaggttgaggcgacagggaagtacacgccggggtagcagacacgcaagtccgccgctcgtgagggaatacccagcaactttgttcgtcatgtgaccctgatgcagtcccgatctgtgtcatgggaggagggagcacgcactctggcaccctccgctcgacctgcctcggtccggacnnnnnnnnnnccaggggagtacacgccggggtagcagacccgcaattccgccgctcgtgagggaatacccagtaactttgttcgtcatgtgatcctgatgcagtcccgatctgtatcatgcgaggagggagcacgcactctgataccctccgctcgacctgcctcggtccggacggatgcctcgtttccggcacccgcgatcgtgaacgccgccgaggcggaaccaggccaggtgctcacgaagcacccacggccggcatgttgcccccacccacatcaaaacccactgagagctaagcaggtactattacatggcataattgccccggcgaaccccacttcgtcccgcccaggccgctccttcgcgaactggatctgcaagcatggcgtactcacccaggcactattgccaaccgctcagcacccccgtcacccggaagcgcagccgcgagagctccggggaggacgaggccatgcccagtagacgcagcagtctgcatgagctcatgggtatgtcccgatcggcccccgggacgcccatggaggccgtgccggagtacaagggggtcaccctccacgtgcgcactaaacgccatgaggtgggcttgggggtagtgatggtattcagggatggtggtggtgcatcctgcttcagtggttttctgggcattctgtgcatacatttgggaggatgaaaccttcttgggtacccactggaatccagtgctcgggctgttggccctggggtaccatcatgggactgcagcagccgtccccaggttgcacacctggaagtacccacttccttcccaacccacctccaccctggccactccgagctgatcccgaacctttcttatcacccccccgcatatcctcgcaggcccacatctgggagggtcagcccgggcggcagttctacctgggcgggttcggcagcgctgccgaggcggcgctggcctacgacattgtggccctgcgcctgggccggcgcgagaccaactaccacctgtcctactacgagccctggctggacctgctggaggcccagcccctggaggatctggtgtccgggctgcggcgccagagcaagggcgccagccagcagacctccttcttccgcggcgtgacgcggcacgccaaggggcgctgggagtcgcgcattggccaggccgcggggcggcgctacctctacctgggcctgcacgacacggaggtgcaggcggcgcgcgcctacgaccgcgccgccatcgcgcagaagggcatcgacgcccagaccaactttgcgctctgcgagtacctggaggagctggggccggaggccgccgcgcgtgccgccgccaggggcctcctggggggtggcgcggcggggggggccgaaacgcccgccgccacgcc

SEQ ID NO: 40373 - DNA, 61 bp, Chlorella protothecoides
cggccagcaccaacatgccggccaacacaaacccggcgcctgccgcgacgcccgcgcccac

SEQ ID NO: 40374 - DNA, 70 bp, Chlorella protothecoides
cccgagcccgagccccaagagccccagccgcagccccaacagcccgagcccgagccccaagtctcccagc

SEQ ID NO: 40375 - DNA, 116 bp, Chlorella protothecoides
gtggcaagtgctgaccgaaacggcatatgcggaaaggatcggtgtgcttgcagtgccttgggaccgggctgaaaagggtgggtgcagatcccgggactgtgatggcacgtcgccga

SEQ ID NO: 40376 - DNA, 61 bp, Chlorella protothecoides
aggatgcgcagcaggcacagcaggttggcaaccgccatatcagcgcctcgcttgctcgccc

SEQ ID NO: 40377 - DNA, 83 bp, Chlorella protothecoides
ggctagcatgccagcgttcactgagcaagtagagcatacctcgacatgcctccgggagggtgactgtggatcttgagcagcca

SEQ ID NO: 40378 - DNA, 79 bp, Chlorella protothecoides
gacaaaggcgccgttcttggcggcacccacatccccgtcctccggctcgggcagcgcctgcttgaaggcctggaccagg

SEQ ID NO: 40379 - DNA, 127 bp, Chlorella protothecoides
caaggtcatgcagtacaacgaccggctggatgactacgacctcatgcactgagcgtgcggcctgtgtacactcacggctccgtctcttcatcgcattggcgccgtcgctggggttcccttcccagca

SEQ ID NO: 40380 - DNA, 4939 bp, Chlorella protothecoides
  modified_base (172)..(181): a, c, t, g, unknown or other
  modified_base (847)..(856): a, c, t, g, unknown or other
  modified_base (1049)..(1058): a, c, t, g, unknown or other
  modified_base (1140)..(1149): a, c, t, g, unknown or other
  modified_base (1235)..(1244): a, c, t, g, unknown or other
  modified_base (1324)..(1333): a, c, t, g, unknown or other
  modified_base (1393)..(1402): a, c, t, g, unknown or other
  modified_base (1614)..(1623): a, c, t, g, unknown or other
  modified_base (3488)..(3497): a, c, t, g, unknown or other
  modified_base (3911)..(3975): a, c, t, g, unknown or other
  modified_base (4355)..(4364): a, c, t, g, unknown or other
gagctgcttgtccaacctcgctgcatgggtaagaggcaaatgacaagggtgggctacacctcccagacaatatccgtttggctgttactcgttcatttgcctacatgtcgaggtatagtcatagggatcctatgactgaaatctgccttctgtcttaagaattaccccccannnnnnnnnntcgtttggcttttactcgttcatttgcctacgtgtcgaggtgtagtcatagggatcctatgtctgaaatctgccttctgtcttaagagttaaaccccacccatacacgcacacgcacatacacacctcccctgcccagccaggcgagccaaacgcacctgggtggatttgcaatggtaccctgtaccagccgagctgtctgtatggcacgctctatcgcgtccagccgcgtttccacgccagggaaatgcatgtagcgcttcacgtgcctgattttcggcaggcgtggtgggcacccacacgcttggcatcgggcaactgccagacttcggctgcagtctcgtgacgtcccccctcctgaggatggagggggtgcagtaaaggcctcagaaatcccacgcagggtataggtctgcagctctcaccctatcagacatgaaggcgatctccaaatcaaacacacaccgtttcgacaacaaaaatgtttcaagaaccacgtcacactcacgaaggaccggggagcttggacgtgttgggaaggtgggcgaggattggcgaagatgtcgagcgagagatcaaacgccacgctcaaccctgtcgaacagagtggagaggttgtggtggtgaccttcactactgctgcaggagtgataaagatccgggcaannnnnnnnnnacaaccctgtcgaacagagtggagagattgtggaggtgaccttcattgctgctgcaggagtgataaagatccgggcaatctgatggtgggttgccgtctgccgggacctcgctgatggagcagctcgagacggacccccccgaacgacgtagcctcttgggaatgctccggttcgtccaccggggcacccggnnnnnnnnnnaacgacgtagcctcttagatacgctccggatcgtccaccggcgcacccggaactcaccaagacattacagatggttgggatnnnnnnnnnntagatacgctccggttcgtccaccggcgcacccgggactcaccaagacattacatatggttgggatggcggcaaagagtgttcgcnnnnnnnnnnttcttttcaatatgagatggcactcggggggtaccgataataaatcggcgcaaagtcggccagaatctcgcctttattcnnnnnnnnnnggcatgagtgcgaccggaggagggcgcacggacagcgctgggtcgacactgttgccaaannnnnnnnnntgctgcataacacgaccctcacgcttcccggacaaacattatatgtcgggagccgaagccactgcaatctgagtgctcaagtgtaaagagggtgtgttggggttggtgaacagctggtcgtacttcgaaggaaccaggggatgcatggtcttcccaggctttcctgaaacactgaaggggctacagcccagactctctaccttcaccatcannnnnnnnnngttggaaagtaggtcaatctggagtctgctcctagcagctgctgccacctactaccccgctgccgctgccggtcgttgtataacatgaccttcacgcttcccggacaaacatcatatgtcgggagccgaagccactgcaatccgagtgctcaagtgtaaagagggtgtgtttggggttggtgaacagctggtcgtactttgaaggaaacaggggatgcacggtcttcccaggctttcctgaaacactaaaggggatacagcccagactctctaccttcaccatcacctcgaacaagtattggctgcctggcgttgaggactgttttatctgtgctgcaaccgacgccgctgggtggcaggttgagcttagggtcaaggtttgcccgcagaacaacgagcggcgggtgtgtaggcgattatgtgttgctcttccttcctgtgccatgatggctccatgggcttgcgctgtaaatgcgcaatgcgtcctacagacagtcgggaccgaggccgtcaccgtcacaacccacgacgtggagggaggggaggtgggtgtaggtgtgggtatgtgtgtgtggagggggggggggaggggttcgagaccccataggcatggggtgttgaactgctcccgtaccgggtaaggtggtgcttacgcgggtttagcaccattctagagttgaccgagaccgtgacaccagcccgccccttgttacattgctcgggctagactgccaggaagtaacagcagcatggtcaaaatatgggcatgctcgagaaggtggccctgtaggggtgctatgtgtgtgtgggcagcgtgcccactcgcatcattgccagcatgccccagtcgcaccgttcccttctcccctccctgggtgattggatgagatcgatggaggtggctgacaccgcacgtcgtgtcccctcactcatcggcaaccctcgtcagattggtaggctcgtcatgtcgtgcggggattcacactgccagtgaacaacaggggctgcctatccacttgataacacattggattgaggtgtgtgtacggtgcatcccgccgaggttgggatgggaggtagtctgaggggagaggagagcacgcactggaagaggggagggaggggggccgccgagtgcaaagggacgggggtcgccgtctatccacaggcaggtcaaagtcagtatgttggatgctgcgttttcgtccctgttcacagtggtcacgggacagtcacggttggagcagcgcttggtggcatagctggttttgggcacctgggttccggtgcccccggcggcgggtacttaaggggctgcaaggggcggtgacagagtgcgcacaactttgaggtgcggaactcgtggatcaccaccaccgtgcaaaactctcgcaagtacttcacaaactcgaaccaggggccaggcgggtgaccccgcataatccccccccgatcgtcagcgctccagtcgccaacaccgacgatggtgaccatcccaggcgggggccggaactgtttggccagattcaccagtgcctgctgctggcgggcgtgggcgttgaagctcagttgcctgaagggctgggacatgtgccatgccaggacatcccagagcgtgggtgccatgtacgtcacgcgccgcagcagcgcctctccactcgctgttctgcgcgtggggcacctgtggggggcggtggggcgtggggtgtggcgatgtcaggtgggtcgatgaccggcgccagggaccacgggaatgcaatgggcatggtgagcccacccacaaacttgcgcgatcgcagcataaccccgtccttacttataagcgcgcttcacgaagtccggggcgctggcctgcaaggccgccnnnnnnnnnnaatcgcagcataaccccgtccttacttgtaggcgcgcttcacaaagtccggggcgctggcctgcaaggccgccacctttctggtgaacttgtaaatccctgcctcagcatagtgctgcttggcggtgtaccgcacgtggttgttgtgcatgtccttcaccgtgaggaggtccttgcggcctgggtcaatccccaacgtcatgtagatcttgtcctggctcggcaactcctcacgcctgtgtgtgtgtgtgtgtgtgtgtgtgggtggtggtggtggtggggggcgagttgtaaagacgaatagcacgatttgcatgccgggaggaggacgtgtgagatgtggaggctaccactgaggttgggtgggtgacaacacagtttcaccaccacccccctcccctcccgcctcggaaannnnnnnnnnnnnnnnnnnnnnnnnnnnnnnnnnnnnnnnnnnnnnnnnnnnnnnnnnnnnnnnngatgtgcctttaccaaacagtgtgtgcacccagcgcccccactccgttccgactccactgaactgcaggactcattcgtaatccggcggccctggtcctgcgtcgccccatctcgcccgcgctcttgcccgcgcttcgcctttggcgcagggggcggagggtcgccagggcggacgtcggtgctgggccaccgcgtcttggcaccgacggcgtagccgtcggtctcccaggtgccgctgaaccgccagctgccctcttcaaacctctcaaaatcgagaagttggtggcagaaggcccatcccaagtgcaccgcgaggccaccgctgcgctgcacctcctgccgatcgaccaaaacgccgcccagagcgacccactcttcnnnnnnnnnngtcttggcaccgacggcgtggccgtctgtctcccaggtgccgccgaaccaccagccgccctcttcaaacctctcaaaatcgagaagttggtgacagtacacccatcccaagtgcactgtgaggcccccatcgcgctggacctcctgccgatcgatcaaaacgccgcccagagcgacccactcttccggggtaaggtcctcggcgtaaaaaccgagcacgcagagggcctgcaagaggtgaggagggtgtgtttagtatgaccgggggaaatgacaggagctaacattccaagcaggcaggaaagttatgggcaaaaaattcgagaagcaacaaagtccatgtgtaagggggttgttgataaatggatggacagggttcccgtccctctcagcatcctcgcactgcaaattccgatcatgctaccccccgcccgagatatctcaacccgtccaatgtatacgcttatcaatcactacgaccgggcagtgacaggctcgtgcgcatagcgacttggcccggcatgccatgttgatgctgttgagcacctcccacagcgtcgtgagggtcacggtcac

SEQ ID NO: 40381 - DNA, 79 bp, Chlorella protothecoides
agaacgaggggatggagggagcagcaggagaagggggggccatggggcgggacgatgacacgggcggtgcatcgtgtca

SEQ ID NO: 40382 - DNA, 61 bp, Chlorella protothecoides
ccaggctgctgtggatgcaacgaggatggggggtggtatactgcgcatgctcaaaatggat

SEQ ID NO: 40383 - DNA, 97 bp, Chlorella protothecoides
gtctcaagtgtgtgcaagtggacgttgctcaaccgacatccactctcccctctcacacacattcattgtcaggatgcgagacagctgatcgtcagcc

SEQ ID NO: 40384 - DNA, 61 bp, Chlorella protothecoides
gcccctccttcacgccccccatgctgcattcgaggcaggagatgaaaaagggtcggtgttg

SEQ ID NO: 40385 - DNA, 114 bp, Chlorella protothecoides
cgcacgggtggcagggtctgcactgccctcaaaccggtcgcctgtgtgtgggtaggagggagggtggaaaagaggtcagcaacatcatgggtgagtgggtgtggccagacacgt

SEQ ID NO: 40386 - DNA, 123 bp, Chlorella protothecoides
gtcctgaccccccctcccgcgtccgggcgccgcctgcccatgcacgaccaccctcccaccccatcatcacccttttccctgcccgatgcgcagggccgcgacggtcccaagccctgcccaccg

SEQ ID NO: 40387 - DNA, 612 bp, Chlorella protothecoides
  modified_base (150)..(159): a, c, t, g, unknown or other
gccgagccgcacggcctggcgcgcgtggacccgcgcggcgccgacctgccgccacccacctgcaccaacggcggcggcgccggcaccaacggcagcggcgtggggtacctgcaggccaacgcgctgcaggcctacgacgagctgctgcgnnnnnnnnnnacgcgcggcgccgacctgccgccacccaactgcaacaacggtggcggcgccggcaccaacggcggcggcgtggggtacctgcaggccaccgcgctgcaggcctacgacgagctgctgcgcgcggcgctgggcgcgcaggggtgcgggcggcggaatctgaccccggagggcccatggcgctggctgctggccgagtttgcgtcggcctacggcgtgcgcccccagtacgccgcgctgtcctacctgaagtgggtggtgggcgaggaggtggccagcctcacctccgactgcttcggcgtgctggcgcgggagctggcgccgctgcacgccgcgcgcgccgccgccgcactttcctcgggcgagctgggcgtgctggcccaggtctgcaaccgcgtggacggcctgctgtcccagtgcttcgagaactacttcatgctcaggtgagggttggcg

SEQ ID NO: 40388 - DNA, 367 bp, Chlorella protothecoides
  modified_base (124)..(311): a, c, t, g, unknown or other
ggagcgggcgagggaggatgggcagccacaacgtgcaaggcaacgcttgcggacctcgctcgttaggcattggctgggcggcaggagcccaaacactcggtgctctgccgtgcagcctcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacccaaagacagctaaatccccccccccccacttcctcaccagtgatcaggtc

SEQ ID NO: 40389 - DNA, 11662 bp, Chlorella protothecoides
  modified_base (127)..(136): a, c, t, g, unknown or other
  modified_base (807)..(816): a, c, t, g, unknown or other
  modified_base (1703)..(1712): a, c, t, g, unknown or other
  modified_base (1997)..(2006): a, c, t, g, unknown or other
  modified_base (2318)..(2327): a, c, t, g, unknown or other
  modified_base (3298)..(3307): a, c, t, g, unknown or other
  modified_base (5790)..(5811): a, c, t, g, unknown or other
  modified_base (5879)..(5888): a, c, t, g, unknown or other
  modified_base (7676)..(7685): a, c, t, g, unknown or other
  modified_base (7863)..(7872): a, c, t, g, unknown or other
  modified_base (7927)..(8126): a, c, t, g, unknown or other
  modified_base (8599)..(8608): a, c, t, g, unknown or other
  modified_base (8736)..(8745): a, c, t, g, unknown or other
  modified_base (8873)..(8882): a, c, t, g, unknown or other
  modified_base (9043)..(9215): a, c, t, g, unknown or other
  modified_base (9723)..(9732): a, c, t, g, unknown or other
  modified_base (10640)..(10649): a, c, t, g, unknown or other
  modified_base (10814)..(10823): a, c, t, g, unknown or other
  modified_base (10932)..(10941): a, c, t, g, unknown or other
  modified_base (11271)..(11280): a, c, t, g, unknown or other
tcctccgtgtcatgcaggggtcctgccgccaagtgtgctcttgcaccctgggatgcacaagcctgcatggcaccatctgatcttttccccttttcatcccaccaggcacccgcacgccctggaacgnnnnnnnnnncaagtgtactcttgcaccctgggatgcacgagcctgcatggcaccatctgatctttcccccctttcttcccaccaggcacccgcacgccctggaacggcacgtgcgcaagtttgacgagacacggagccggcttacggaggaggagcggcagcagcgtgctaaccagctgcagcgaaccatgcatgtgggtggatgtggggccagtggtgcccaagcatgcccgggggttgtgggcgtggctgatgggtcggctttgggatcgctggccggagtcctgtgccagaacatccacaggtcactggttcggagccttgtccatgcggaccccagacccaaatccacccattcccacccaaagccccccctcaccttacccccccgccccccctcttccctctctgcagatgctggtgcacgcctccgcctgctccaacccggcctgcccctcctcaaactgcgcgaagatcaagcgcctgttccagcacgcgatgacctgccccaagaagatccacggcaactgccagctgtgctggtgcgtggtggcgcctgcccagggcgggaaaggagggagttgggggctggtcccggtgttggggaaggcgccgtgtgactgactgcagcctgtcccacgcaggggccgttgggggcacctctcagtcctcgcatgagnnnnnnnnnntgcctggggcggggaaggagggagttggtggctggtcccggtgttggggaaggcgccatgtgactgactgcagcctttcccaagcaggggcagttgggggcacctctcagtcctcgcatgagctgcgtctcccctggcttgcaaccccacacctgcacccaccctcatccgagctcaaccccctccccttcaaccaacacaccccaatcattacacaggcggatgtggtcgctgctgcaggtccacgccaagcagtgcacggtgacggactgccccgtgccccgctgccgcgagctgcgggagctgtcacgcagccaggccgcgcgtcgcgaggaccagcggcggcgcgcctaccgtgccatgctgacctcgcaggccgccaacccgtagccgccgtgcttccaactcacttccttgtcaccactagatccctccttgccttggcccccaaggacaaaacctgacaccacccacgctggtcggccctcagccgcatgtcaccccatacactgggagctttcattgcatgtattcccgctgctaccctgacccgccccaaccgctgcggatctgtctccttgtgcacatttcgaaccgcaggcaagatgcggggcgtccctgccactgggacgccacgccaaattggacggttgtaagcctcacacagagccgggtggcaagcatctcgtgaggaggaagggtggagcatggaaggtccaggggggaaggatacgcggaatcaaatgcactcccaggtcgtcaatcaaggtggtgggcgaggggtgtgagataccttggaggcctggccacggcatgcaggtgtctcctcacagtcacacggcgatgctgggtgggggagggccgcatgaggcagcgtctgatcattnnnnnnnnnnaggatacgcggaatcaaagtgcactcccaggttgtcaatcaaggtggtgggcgaggggggtgtgataccttggaggcctggccaaggcatgcaggtgtctcctcacagtcatacggcgatgctgggtgggagagggccgcatgaggcagcgtctgatcattcaggtgccccgcgccaagccgtgtctggtccagcggacactgaggacgtgccgctccggtccattgcgctcgtgcatgcagaggcagtcggctgcgcaggagcgctgccggcctgacagcgcannnnnnnnnngagcgcttgtgcatgcagaggcagtcggcagcgcaggagcgctgccggcctgacagcgcaggctcagcaagcccccggaaggcacgactgccagacagtcgtcgccccccgctcatctccgctggtgtgcacgcgccagtgctcggggacgatggaggttgcggggccgtaagccttgcgctgagagttggccagcaccaggacgcctccctggggagcgtgggagggcatgggggaggggacggtcactggttgagaaacagaatctgcatcgactctgtgaaacgccctggtgcaggccaggcgccttgnnnnnnnnnnatgggagggcatgggggaggggtcggtcactggttgagaaacagaatctgcaacgactctgcgaaacgccctggtgcaggccaggcgccttgtgtcacgttcacgacacacatcatccctcccctcgcccgcaccgaaggctggagcagcttcacggcgcgtctgagcgctgccaggcgcgccatgccctgcacggcgatgaatgagtaggcgccctccctgttttctggtgcctcgacgtaggcggtaaagtagtgctcatacgactccgcctggaggaaggtgagcaccggccccgccggcgggacgacccgcaatcgccaccgcgcctgcaggtcctccgccccgaatgccgactggagaatcgtggacgtgtgttgcggggctcagcggcggcgtgccgcccaggtgcgaccgtggaaggctggtcggggacgcccgtggcagactgaccctcgccccatgctgggctcagatgtagcgccccccctccacccccaccccccatggcagcctgtctcacctgcatcgtggcgttgaccctggttgcaacccccacatcatgctccacgctttccagctgtccaatcaggccggagaggagccagagcgtggaggagcccgccccccactccaggccctgccccgctccctgcagcgagagcagggatcgaaccaggttgatggcctcccgcgtccactccggctcgcaggcgttgccgtacaggtcggaggtgaagaccacggggcgcgcgccgaggctcagcgacgcgtggcaggaccccgggatgctgcgcagcctggccgcctccacggcggcctggaagctgtcgagcgctcctggaagcgtttgtgggggaaagggggggaggaaaggacaggtgggaggcccgacagtgtgctatcctatgggaatgtggccaccccatgacgaggcgccgcctggccagcatcgcacggcccgcccccgnnnnnnnnnncgtgtgctaacctaggggaatgtggccaccccatgacgaggagcagcctggccagcatcgcacggcccgcccccgctgtgaaaggtcgagcacctcaccttggctcgacgaagtgtcacccgcgagggtctggacctccagggtggcaccgggaaccactatgaagcggaaggagatcatggtcagagtcgcgcacagcaccagcacgacgaggatcccaccgcgcagggccctgcagcgcgaggaccgagacgggctggatcccctcatgccgcgctttggggccgcgcctgccagtgccctcgccgtcctggacagatctggggtgggcccgtctgaatcggcggttgctcacgcaaagagaagtccacggccgctccacagcaaattatgcatcggcggcatgcaaccatgaataagttcccgttagaaaactagtgattgctttcttgcactccagagcgagtttcattacagtctgcgttgagttggttgcgaaacaccgctcgtccgtgatccgcgcgcgcgctaagatctcgccagatcacggccctgcacagtcaacttggcggctgcctggcgtagcgctctccccgcttgcgaaaggaggacacagaaatgactaaacactgatgaacgcgtgcaatcctagactgccatgccatgaaagtgctgctccactgatgggagcagcatctccaggtcgcatgcatgcaaacaccttcctgactggaggcaaagcccgagagaaggctgaggtgtgttgtgcgaggcacgcaggcagatcgccgtgcgatgtcagtgttcaaggtgccctgagcaggttcactcttggacacagggtcgtcaccgcctgtgcccattgagcgagagccataggcggacggatgcttgggcgggggagggtggaagcccctttggtctggccacctgttgtcttcggcagcaacatttcgtgttctcagcacagaccaagcctcacttcttggtacacagtgccagcccgtcgctgatgggtaggaggctgaagaggattcgctcgtccgccaggaggaagctgttcagctctcggatggcctcggtgcgggcgtcggtcgccccggcatccgccacctgcccgtaccacagcacattgtcaaaggcgatcacacccccaggccggaccagctgtggcagtggtaggagggtgaggacaaaagctgacgacgatgagaacggttcgcaacacactttgcggtgaggctcccatgcctgattggggcccgaatcttgctttcccataccatcggaggcagtgtcatgagcgtacgatgcatcccacagccacggccacccccaagccaccaccccaccacacctgcaggagctgttcgtagtaccccatgtacccgcgcttgtctgcatccacaaacgcaaagtcgtattgccctgcctcgcctgcgctcagcagcaactccagcgtctcgcgagctggacgaacatgctctacgatcttggggccaagaaaggaggggtttgtgttgccggacaggggagcaaggaccgctgtgaagcagtgtcaatattttcgacatccaccacactgccaacccagaggcctcgcactgtcgacacaaacggcccggcatggaggggcccatgtcctcctccaaacacccaaacagagttgcatgcatagattgcacaagcattcttgtcgccatgggagtatctgctgggcagcgccctgaaatctcttgaagcatgcagtcgcagcagcaagcaccagagaagaagggacgcacctatcccggcaccaaaccccctgctccttgcagcgggtctggaccgcacaggagacgggagccgcacatccgactcgcatacacccctccccggccacattggctcaccctgtcgagtacgccggccctgtcccagcatcttcgtgccactgccagcgcgcgctcgtcagggtcgcaggcaagcagcttcccgccaggtccgagggcggtggcggtcgctatgctgctgtaccccgtgaacacacccacctcaatggcccgcgtggcgcggagggtggccaccagccagtgcatgaaggcgccttgatcgggggagatctgcatccgcgctgcggcagggaagagctccgcagtctcccgccggagatccttgagcacctgtgcataccagtggcaggaatataataagaaaatatggacaagacaaagggcgttctccgctttccgcgactgctcctgctcacctccgtttcgcgagtgtgctggagcaggtacccgaccagcccatcatccaagccagcggacaccttgtttttcgcgcattgaaccgatctgcgtatgtcggcaaggtttgcctcgtgttccagcttgctatgggtatccccccgtggcggtatgcatgtgaaacagtactccgcaccttgtcgccaaggcacgcgtggtcgggctgcctaggccccgcgaacagaggggcaatcnnnnnnnnnnnnnnnnnnnnnntgggcgacacgagaagcactccgatgctcctgaaccgcgtttcgactggcggttggggtttcaagatnnnnnnnnnnatcggggatgctggtgtggaggcaatgagggtgtcagtatctgcaatgcgaccctttgaacacacaaaccgcgacgacaatggcggtaaggaaggggcgagtagggtgtcggagtcaacctcaccttcgtagctcacagcgcggcgaagggcgatacgagaagcactcccatgctcctgaaccacgtttcgactggcggttggggtttcaagatcccattcctgtcccttaatggcatactcgagccaggtgtagtctctcaaagaatcaggaaaccaacgccctgaggagtggcatggggcgaagtaaaggaaagcgctgccggagaccgtcccaagctcaaactgtcaaatctgtgcgaaagtggaagggggcatggaacggcggcatgaaactcttcgacctgcccatgaccattctgctcaagattctccatctggcgctaggcgtggattccatcttgaccgacgtcgtcggacgatttggatggacggttgacaggcctccgctctggaggtgcatgcccggggtttgtaggtgctgtgttttggggctccgggcaccggacatgtatggatctgcatgctgggcaagcgttgtctgtggagcaatcttgtctaggtgtccagagcgcagatacggcacagcactcttgccagccttgtatgagagattcaccagcagcacccttccctgcagtgctgcatcagtgctgtgcaaggcttctctggcgctgtgcgtccaggctgggtggtggaggcagctgcacgtgtcttgaaaatcacagaggcacccatgccgtgaagagttcaaacgcatcgttctccaccacctggccacgacggagacgatgcacatccttcacaaggaccacggcggcttctccaatgcctggatcttgcccatgatgatgacggagagggctccaccgctgagacacctcgtcctacctcacattgtatggccgagcctcgtgcaaccgaccctcctgcaaagtgtgaagtcccaatggtgcgaggggctggctagcactgcagtcttgggggttctgaacgacacggtgcattacaacgcccggagatggcgctcatgaggtgctgcagggatgggggagggggtgggtcccccgtccccacgacggctccagcagttgccggcgcgccggagccgcctctgctgcgcatcaccccacacaccagactccttgatggggcggcgcctctgtgccggcggtgtctgtgcctctttccccaccctgaacgcccggctgctgaagcgcccaggtgccccattccccatcccggaacacctccgccacaccttgcagcgaggcccatcacgcctgcctcgggccagggccgtgcctggagccctccaggaagctgcgcctccaggagctcaccatcgagggcgaccctggcctcgatgcagataagctgcagtgcctgccccaggtctgcccggacttggtcaccctggccctggcacagccgggcatccagctgccgccctgctgccgccagctgcgatctctgagcagggtaaagctgcacgcgaaaagtctccccgtgggcggacttcagtaccttgaaagcctgcggacgctcgacctgtttgcagaggggatcggtggtgttcccccgggcgagtacgactggctgcgcctgaggcagtatgagagcgaggtggagaagcagttgcaggcattggggcatggtcccagctgcctccagatctccacctcgcaccaccacgctttctaccacacgccgcgcttcgacctagccnnnnnnnnnnttgttggcagaggggatcggtggtgttcccccaggcgagtacgactggctgtgcctgaggcagtatgagagcgaggtggaggagcagttgcaggcattggggcatggtccctgctgcctccagatctccacctcacaccaccacgccttctaccacacgccgcgcttcgacctagccnnnnnnnnnnacgaaatgtatccccgtgggcggccttcagtaccttgaaagcctgcggacgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgcggctgcaggtcctgcaggtgttttgtcggccgtcgcttcgcttcggcctgccgccggagctcagggtgttggaggtcaagaacaacctggtggaagatggttatgggatgtatgactacgccccagatgtcaagaccatccaagacatccacctcccagccagcgtggtcgccgtcagcctgatcgaaagctccaggagcatctgtccagaggcgggtgcaggccaggtgaaggtgcttgggagatgccggttgaaagaccactcacccagccatccagggcagcaggtggtcagcggcaacaaggagttctggcgcagggcggcctccctgcccgaggtccagctggatgcgtatggcgctgcgtatgcaacggagtggtccagcaactcgaagatccattactttaactgacccccacccttgatggcccatttgagagcttctcttgttggtggagccggtgnnnnnnnnnnacttggcgatgttcggtccgctggacttttgtgcacaagcaccttcttcaagtgttgacacaagaacccgtgagggtcgatggtgatgggtacatccattggcagggcgggcggtgcttcacgcaggnnnnnnnnnngcttggccatgttcggtctgctggacttttgtgcacaagcatcttcttcaagtgttgacacacgagcctgtgggggttgatggtaatgggtacatctattggcagggcgggcggtgcttcacgcaggnnnnnnnnnnaaactcgaagatccatgactttaactgacccccacccctgatggcccatgtgagagcttctcttgttggtggagccggtgcgggaatgtactgctgaaattattcagtgtgcggtcattgtcgacgcaattttagcatgtcactcagggcatgtacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgcacaaaatttccactaatggtgatggaatagatctgtttctgctcgtgcacctgattgtaaaatgtaagggacatcgagccaaaacataaaaaatgtttgacacagataggggtcgaacctacgaccttccgctccgtaggcggatgctctatccattgagctacagtgccgatgaagacatcgcatgtcggatggttgatgaaagattcgatatggttgccttatacataccggggtttgatgcgaatccgggtgggtgtcttgcattttcctgggggtgaggttcttgaatactggagagcacgtacagatgcatggaggaccttgagcttgtcatcagatgaatgagaacacgtcaagtgacctctttgcacggaggtaaaaggatgtgggctgctcggcattgtcccacatcccgtcaaacccactggcaggccagaaccccccaggggtgcattggtgcatccagtcaccgcaattccatccagcagtcggcatgccnnnnnnnnnnagtgaatgagaacacgtcaagtgacttctttgcacggaggtacaaggaagtgggctgctcagcattgtcccacatcctgtcaaacccactggcaggccaggaccccccaggggtgcattggtacatccagctaccgcaattccatccagcagtcggcatgcctgttacagggagggtcaccgcatgggcgaggaggcgcatcccgcatggcacgagagggatcaggggaaaagcgggctgacatcgcgtggtcatgataccttaaataaaacattgcagagggagcacgtgcaggtggggtgatgccgggtgccacgggctgcggaggcaggcatgccgtgggaatggtggtgaagtcagactggggttgtcgggcaggcgccgtgatacaccgggggcaggcaggccctggggtggtgttgagtgggatgagggtgatgccgggtggtctgcggggcgggggcgacgatgcctggaccttgtcctgatggacaagcccgggcagggaaactcgtggactcggctggaaaagatctccaccgccggaatcaggccggtggaccggggagcgcctcgccctcccgcccctgccgccggatgatgcgcaggtggatgaccgtgcggtcctccgtccagcgctccagcgccagggtgtcgcctgggtgttgatgcagacggggtgggtggacgaggtgccagggacatgtgggccttgctctgtccaggcctccccaagcatggctcgcacgcgtgttgagactgggcacaccactgggatctctgcctgagaagcatgcattgcatcccccacgtgcacgcactcagccaggccctcttggcagctggccgcactctccccacccccctcaccgatggccacgttctggacgcgcatgagcccactccannnnnnnnnntgcacgcatgttgaggttgggcacaccacttagatctctccctgagaaggatgcatgccatcaccctcatgcaggcactcagccgggcccccttggaagctggccgcactctctccacccccctcaccgatggtcacgttctggacgcgcatgagcccactccannnnnnnnnngggggggtgggcggcggtggcatgggctcatcgggttgtatgggggcaccagggggagcaagacatgagggggggcggtggagggtgacgggagcaggcctccctgacnnnnnnnnnngcccgaggtcaggcggaagtggcgctgcccgctggacatgaagccctcgtactgggacagggggggtgggcagcggtggcatgggctcattgggttgtatgggggcatcagggggagcaagacgtgagtggaggcgatggagggtgacgggagcaggcctccctgacctcgggcctgctggcgtgccccgctcacacacacctgcccctgtgccccgtcctctgatgagggcgtgggcctgggcgcgtcgcacgccgtgcgtgcccatccccctcctcccgcaccaacacaagccaaaaaaaggggcaaacctgcacgggccaggcctcnnnnnnnnnngtgagtgcgagggcctgggcgtgtcacacgccttgcgtgcccatccccctcctcccgcaccaaaacaagtcaaagaaaggggcaaacctgcacgggccaggcctcgtccgcctcatccacgatgaccaggcggtgcttgaagagcgagttgaagttggcgggcgcgtcgccctcgcggccgggggcccggccgcgctcccgcgcctcctccggctgcgggaacaggagctgcgccatctgctgcgtcacgtgcaggcggttgatgtaggtgccgttggtgatggggcgctccaccttctccagcggcgcgcgccgcgcccgcgccagctcggcgcgggtctgccccggcgcggcgcgggctgggatgggcccctgcgggccc

SEQ ID NO: 40390 - DNA, 61 bp, Chlorella protothecoides
acgagatcgccgcgcttgctggaaccaaccaccggcagcctctctggtatgcatctgactc

SEQ ID NO: 40391 - DNA, 68 bp, Chlorella protothecoides
gcctccacccccacctcccgggccctcaccctcctctcgccctcacctgcggtacaaagcccgtgacg

SEQ ID NO: 40392 - DNA, 61 bp, Chlorella protothecoides
tgctctgcaggaggggtgtgtcgaggcgggtgagtcgggtgggacatgggccacgtgtgct

SEQ ID NO: 40393 - DNA, 61 bp, Chlorella protothecoides
agccacacttgccacggagggcacggcgggggctgattccggtcaggatgggtgctaaaag

SEQ ID NO: 40394 - DNA, 61 bp, Chlorella protothecoides
acacagcattgtcttgcgatgcccgcatatacacgtccttgccccgccgcacctgagatca

SEQ ID NO: 40395 - DNA, 34454 bp, Chlorella protothecoides
  modified_base (174)..(183): a, c, t, g, unknown or other
  modified_base (1445)..(1454): a, c, t, g, unknown or other
  modified_base (1917)..(1926): a, c, t, g, unknown or other
  modified_base (2042)..(2051): a, c, t, g, unknown or other
  modified_base (2179)..(2188): a, c, t, g, unknown or other
  modified_base (2399)..(2408): a, c, t, g, unknown or other
  modified_base (3424)..(3433): a, c, t, g, unknown or other
  modified_base (4483)..(4560): a, c, t, g, unknown or other
  modified_base (5546)..(5555): a, c, t, g, unknown or other
  modified_base (6025)..(6034): a, c, t, g, unknown or other
  modified_base (6851)..(6860): a, c, t, g, unknown or other
  modified_base (7529)..(7538): a, c, t, g, unknown or other
  modified_base (9161)..(9170): a, c, t, g, unknown or other
  modified_base (9871)..(9880): a, c, t, g, unknown or other
  modified_base (9962)..(10124): a, c, t, g, unknown or other
  modified_base (10189)..(10198): a, c, t, g, unknown or other
  modified_base (10534)..(10543): a, c, t, g, unknown or other
  modified_base (11465)..(11474): a, c, t, g, unknown or other
  modified_base (11807)..(12062): a, c, t, g, unknown or other
  modified_base (12171)..(12180): a, c, t, g, unknown or other
  modified_base (12465)..(12515): a, c, t, g, unknown or other
  modified_base (13636)..(13645): a, c, t, g, unknown or other
  modified_base (13789)..(13798): a, c, t, g, unknown or other
  modified_base (14148)..(14157): a, c, t, g, unknown or other
  modified_base (14306)..(14315): a, c, t, g, unknown or other
  modified_base (14447)..(14456): a, c, t, g, unknown or other
  modified_base (15032)..(15041): a, c, t, g, unknown or other
  modified_base (15358)..(15367): a, c, t, g, unknown or other
  modified_base (15451)..(15460): a, c, t, g, unknown or other
  modified_base (15767)..(15776): a, c, t, g, unknown or other
  modified_base (16073)..(16082): a, c, t, g, unknown or other
  modified_base (16583)..(16592): a, c, t, g, unknown or other
  modified_base (17171)..(17180): a, c, t, g, unknown or other
  modified_base (18180)..(18189): a, c, t, g, unknown or other
  modified_base (21473)..(21679): a, c, t, g, unknown or other
  modified_base (21753)..(21762): a, c, t, g, unknown or other
  modified_base (21881)..(21890): a, c, t, g, unknown or other
  modified_base (22328)..(22337): a, c, t, g, unknown or other
  modified_base (22807)..(22816): a, c, t, g, unknown or other
  modified_base (23158)..(23167): a, c, t, g, unknown or other
  modified_base (24113)..(24122): a, c, t, g, unknown or other
  modified_base (25113)..(25122): a, c, t, g, unknown or other
  modified_base (25359)..(25368): a, c, t, g, unknown or other
  modified_base (25727)..(25736): a, c, t, g, unknown or other
  modified_base (25924)..(26140): a, c, t, g, unknown or other
  modified_base (26783)..(26792): a, c, t, g, unknown or other
  modified_base (27439)..(27448): a, c, t, g, unknown or other
  modified_base (28540)..(28549): a, c, t, g, unknown or other
  modified_base (28850)..(28859): a, c, t, g, unknown or other
  modified_base (29306)..(29315): a, c, t, g, unknown or other
  modified_base (29510)..(29519): a, c, t, g, unknown or other
  modified_base (30106)..(30115): a, c, t, g, unknown or other
  modified_base (30230)..(30385): a, c, t, g, unknown or other
  modified_base (30453)..(30687): a, c, t, g, unknown or other
  modified_base (30918)..(30927): a, c, t, g, unknown or other
  modified_base (31560)..(31569): a, c, t, g, unknown or other
  modified_base (33029)..(33038): a, c, t, g, unknown or other
  modified_base (34085)..(34094): a, c, t, g, unknown or other
gcgctcggcccgtcgcgctgccgcccctgcgccaccagccgccctggcggcagcagcggccctggcccggagctccggggaggggagggccgcgaggcgccccgccaccgacgcgctggcggcctgggaggcagccgccggcgtcgcccgcggcgccggcatggaggggtcccnnnnnnnnnngccaaagcgctggcggcctgcgaggcagccgccggcttcgcccgcggcgccggcatggaggggtcccattccgctccgataccctccggggatgcgctgcgcacagccggctgctcttcagggccgacctcactgccatcccggacctgggtctgggtgtgaagaatggggtcctcgcttgcctcccctgccgtctcagcttcctcccggaatggccctggcgcatgcctgccctcatcgctcgccggggcaggaggcggggccctggcaggatcagcgggtgcaggcccggccaggggcgcaggtgtgtgtccggggcgggcccgagaaccgacctccgcggcgacaaaggtgctggatccagggctgacccctcgctccgctgccgaacctgtccccggcgggacgggcaggctcgcagagcccagcggcttcagccccgacagggccgctgctctcgaggtgcttcgggtgggagtgacggggagcgtaccacacctccagtctgcaggtgctctggctgcctcgccggctgtcagggtcccagtctgactgcttgcaggctcagaggccggcgcggcagacccctcatggaggcgttggtaggcacctgcacatggagtggtgggaggcgtgaggtcagcgtccccatgccaacctcttcgaagcagaaacgagaaatgcagggatccgccgctcccagtcacactgcggccatctgtccaacgcacggagtcgaaggtagaagaatgcggagatgaaggccgcccccccgatgaggccaaaatacaccactcggcctgcacttccagaaaggaggaaataagggtgatgatggtctgtgtatacctcacactgagccatgctccatatctgtctggagggacagattcataccgcgcggccatacaccagcggatccacctacccagaattccagcaaatgaagtatgcctcactgacttcggcctgtccctccaatcatccaaggatctgccagtgtcgatgggcacctcatcccagctggacagggaggaggcctggaggccagcatcggggcgacgagcaacgtgcactgcattctctgacggccctaccccttgcacagggggaccagcggcttcgaccggggtccctggctcatgagggttcgcgccgtttgacgagctgtacagtcgatgttggaacactgtatgagattgcctcggcttcaaggggaaccgcagaataatgggatggacatgggatgcctgtcgttggcnnnnnnnnnncgacgagctgtacagtcgatggtggaacactgtatgagagtgcctcggcttcaagggaaaccgcagaagggtgggatggacatgggatgcctgtcgttggcccacagaggctgtgtgagcacattcccgcctgctgctaccctcgcacgtaaaaggggtcaccactgagatgttcattttcttctcatcgtgctgtttcgttctagtgattttgacagccatcggtggcaccctcgaggtacaggattgctcctccgacaggtgccccgaagtgctgtgcgtgctgcatggatcacttccgcacgatggagggaagccctatgtctcccctgcccaggacctcatcccattcgacggattttatcgcggcgatcaagagcttggatcaacatgagggtacccaggaagcctgatgagaacggtacggggtcgtggatgaggtggtctggactggccctgcgtnnnnnnnnnnctcttctcatcgtgttgtttcgttctagtggttttgacagccatcggtgtccccctcgaggtacaggaccgctcctccgacaggagccccgaagtgctgtgcgtgctgcatggatnnnnnnnnnntcctccgctccccgcgtgcccatatgattgaactcggcctcccgtcacaggatggctgggcatggggcccattgtcctgggactcatcctcctgcatatcgcggccctggccttctggatcgtggccnnnnnnnnnngcctccgctccccgcgtgcccatatgatcaaactcggcctcccgtcgcaggatggctgggcatgggacccattgtcctgggactgatcctcctgcacatcgcggccctggccttctggatcgtggccctggttcgcacaagcggaggcaaggccggagctaggaagtcgccgctcaagcagcagtgagccgggccgcacgcttggatcccnnnnnnnnnnggtcccacccgccctgggtccagtctgtcgcgccctggcccgcccagggctgggtgtttgccccaggccgggtgcagcacagcgagccctccgcccactgaatcgacccctggccagtatccagacccccgaacctgccgccacgtcattttcaaatgacgctgctccggcacccgccccgccccacatccccgtcctgctggaggaggtgcttggggttttcaaaggcgcgcacattccctctttcttcgacggcacgctgggcgcgggcgggcacgcggccgccgtgttggagtcccacccggagttgcgggtcctgctggctaccgaccttgacgccgccgctcacgccatcgccgccgcgcggctgcgccgcgccggggcggccgtcagccgccaccccaacctggggtctctctcgccgacggctgccggagggggacacacaactgtgcccggagaccttacagtcgctgcgcccaacaacggcacccttgctgcacctgcagacgacccagagatggccatccccaggccgggcaccacaccctgtgcgcacattctgcacgccagcttcctggcgggtcccgaggcactgtggcgggcgggcctggcggggtcgctgggcggcgggctgctggacctgggcctgtcctccatgcagctggacgccgcggcgcggggcttctcctttggaaaggatggcccgctggacatgcgcatggacggggcgggggccctgaccgccgagcagatcgtgaacacctggtcagaggacgagctgggccgcatcctgcgggagtacggcgaggagcggagctggcgcggcattgcacgcaggtgcaggggggggggtggatgcctggtggcggtgtgggtgtcagggtgcgggaatggagccggaggatgcagatgaaccctagatgtcacagaagtaacccggggcggtggccgcggagcgaggcgtacacccccccagtctgtgatgcctcacatgccctgcccacttctcaccnnnnnnnnnngggtgtcagggtgcgggaatggagccggacgatgcagatgaaccctacatgtcacagaagtaatccggggcggtggccgcggagcgaggcggacacccccccaatctgtcatgcctcacatgccctgcccacttctcacctgcggcaggatcgtcgaggcgcggtgcagagacgggcccctgctcaccaccagccagctggcgagtgtggtcggccacccgggccgaccctctcctggcaggaaggcaggcgcgcggaaagccacgagggccaagcacccagccacgcagaccttccaggcgattcgcatcgcggtgaacggcgagctggcatgcctggaggcagccctgcccgggctgatcgacgccctggcccccggcgcccgcctcgccgtcatcaccttccactcgctggaggaccgggcggtgaaaatggccttcaagcgcgccgcaggggagctggaccccggggacgaggaggtcctgcccgcctggctggcctccgccaggagggaccaggccaaggaacaggccgtggtacgcatggtgaccaggagccccctcgtgccgggggaggcggaggtggcgcgcaacccgcgagcacgcagcgccaagctcagggtcgtggagaagctgtgaggtgcgctggcggcgcggtctgggaggttggaaccctgatgatgcattgcccgtcacctggccgtgcctgtgtcaatgccaatccaggcctgaccgagatgtggccgacgccttgtacattgctgatcctgcaaatggaatctcagatggcagaatcactggccacccctttcgagccttggtgatgctgtatggagacgacctgccttggagaaagcccgggggcggcaggcgactccggtcaaccggatacggatccacgaagccatggaaccctgtccccacgatctcaagcacttgaagcagtcacgcccattcccacctaccatttatttttgttccagattggctcctgtggtaaaaagatccaggggccgccgaaatggcatccccgggacctcctcccattgannnnnnnnnnnnnnnnnnnnnnnnnnnnnnnnnnnnnnnnnnnnnnnnnnnnnnnnnnnnnnnnnnnnnnnnnnnnnntctccgtcttgaccaatgccgacccagagctccacgaggcgaaaggtgcccaaatggttgttcaactggacagctaccacgtcgtacccgccttcgcgagctctgagaacgtgcagcttggtcgcgagatccacgtgcgttcagggccggtctaatgatggggacggatggggagccatccggtcactgcttctcgtccgaaaaagcctggctggtacaccatctaggtgttaatgatgaagcttacgtcggaactggcgggtcaaagcgttgaaagatagggagagggcgggctgctttgcattggatggctcttgggaacttgtgcagactggtgaagcagtcattttggcactctgtgatgcttgatcaggatctagagatccagatcaaggctgcgcggctggctgcagaggaggatagggagcagagcctacagctgcggcgccacctgggccgctcacagaagagcatcacgtctcttcagcaaatggtgggcagtgtgacggatctctggctgacctctccctctgggaaactgtgtggatgcctgagggaggacatgagggttagggtgaggggtctatgccaggcatgattgctggtggacaccattcattggtgactgctggttactcatctaccatcttcctgcttggggccaactctgttctccccacaactcccatgctcaggtgtgcgatgccgcgcagcagctccagggcgagtccacgctgctgcaaatcgctcgttttgccctgaagaggacccagacggagaccctgcgcttgcacagggttgcagacacagccaaggagttggaagaggccgtgcgcaatcggcaagtggctgcagggctgcagctccagcatgcacaagccagaacgcaccaggctcaggtggggtcctttggattattccctgaccagagtaacctggcctgtcaagcgagaaaaggaccaagtatagctggaaggttgaccggnnnnnnnnnncgaccagagtaacctagcctgtcaagcgggaataggaccaagtatagctggaaggttgaccgggctgggggtccaagcagctgactgcttcgaatgggtagaccatctgcacatcctgccgcactgacctagcatgccctccggggtcctgatgaaatccgcgcaccgcaagcgactctcactcccctgctacacccaaggctacgctggaggaatggactgagaacctgacataccaggaaacaacgctggcctcggcccaaaccctcacccaggccgaggaggctgaagaacggcggctcatgcagcacgtgggtggcaccaaatatgcatggagacgtctgtgcatgggtgcccatatgggaggacaacctccctttagacaccacatgcacctacatgccatgcacccaagcaaagtatgttggtctccgacacgaaacgtagatccagaaggctgctgagacggnnnnnnnnnncctgggaggacagtctccctttagacaccacatgctcctgaatgctcctgcactcaagcaaagtatgttggtctccgacacaaaacgtagatccagaaggctgctgagacggtcaagagtctggagcaggaggtcctgtcggagtctgctgaggcagaggtatgcaccgtggtccatggcgcccaggttctgggcatgtccatgtgtttcgatgccatgaatgggcaagagcaccgagcgatgcatcagtttctaaaaccaccctggcacctgatggagggactgctgttgccagcactcatcatgccccctcatccacaggctgtgctgttagagctagaaagggtggcgggggcgtaccgccaggctcaccaggagcaccaggacctgctgcgagccgtggaggttgcccgcgccgggctgaaagaggctgatgcctcgctggaggcccggcacgccgaggtggcacgctctagaaaggacgaacagggcggcagggcggcggccgccgctgcgcaggcgaggctggacggcttgaggcaggaagcagctgccagggagcatcagattgccgctgcagaggcccagcgggctcagcgggctcaggaactgcatgcagctcagcaggcggagcaggacgctcagcagagggtggaggaccttcggctccagctctccagggtgagtaggcctggtatgggtggctcgggtgctgatggacaggcagaatgtatgcagggcttgccatgtatccaccccaagtggctgtagggggagatgtgcgcaaatgcatggaatgcttgtcgtcaagttcctnnnnnnnnnngtccaacccaaattgctgtagggggagatgtgcgcgaatgcatggaatgcttgtcgtcaagttcctgttgcgctggtttacctatcaaataaaaattgctacccctgaagtggatggctggtctaaaggcgcccttgatcactccccggtctgtgcaggccaggcaagaggttgctgggcgggaggaaacactcgccagtgccagggcgtcgctggaagctctgcagcacgtcgcccaggcgtcgcaggcggcagagaggacagatgccgcctgcttagtaggaaaaggaggcgaggaggagcagggcacaggggcactgctggacctggaaacagccagggacgccgcagcattcgagcttgcaggcctggagcgggagaggacaaaggcgagagacagggcggctgctgcggtggctgcactgaaggaagccgagcggaacctgggggcgcttgccgtgcaggtccagcaggcagcgggggccctagcagccactcagggccagaattctgcgttggagaaggaggttttcatggagcaggtgggtgattcaggatggcaccttagggttagggcgctgggtatctgtgcccgagaatgaaatgcatggtagcctgctgtgcactgatcttgctgccctgctactcactcagggatccggttcgtcnnnnnnnnnncagggcgcaggggtctgtgccagagaatgaaacgcattgtagcctgttgtgcactgatcttgctgtcctgctactcactcagggatccggttcgtcaatccacttttggatcatactcttatgctgcctcagaacgccatgggtcacaaagtcttggctccaaccctttggcaggatgtgctgtatggctgtgagatgcagcggcataggctggagcaggaagttggtcagctgacgagaggtatcaagaccgaggaggaggatctcgtgaaggcagtggcagctgcgcggcaggtgggcaggtggctgactctctggcgtgccgcatctagagttgaccttcccatgtgcctcttctgtgtgagccttgcactctggtcttgagctgcggaggactgggcactatcccaatgacgaagacagatctctgcaggacctcaagactatgtgttggtattcaacacgattgtcaagggttacctgcagtgttgaccatcaccctcccctctctaattttaccccacaggacttggcaggggctaaggctgaggaggcgcgagtcaggacctcagcaagggaatccaaactcagactcggtacattggtcgagtcccacatcagggctgttgcagtgttcaagaatggatcaccatcgaatggcagggagatggggaatcaacccaaccaaattttgtgtggtacacaggggcaacagaaattcccaagtaccaaagacgtacactcattcatgcacagagcaagctgttgccaagaagaatcatgtggaggcatgccttgtggaggagatggctgcgttacggctgcaaatcactgctgtccagaccctagaaaggttacttttgggaggcactgatttggcggtgactcctggcgatcagagatttactggaggccgacagagtgtcttgaccttgaactcagagagatgttgcactcagcaccctgatcaaacctctacacttcccccgatgcttgatggtctgcctgacccaacactctgcaggatggttcactctgccaatagggacagggtggctgcactggtgaagctggacatgtggcgcatggaggtccgctccttagatgtgactgtagacaggtgcgctctgattccctctgggaagggatcccgatatggcacgagagtaaggcacgcttatttggaagcctgtcatgttgatcatggtgcattgcagacatcatcaactccagatcccacagcattacctcaaacagctctgtcatggcccaacttctacccagggaaaagtcggacctgacacagcatcaggcagctcttcaggctcagagtcaggcattcctccaggagcagtcacagctggctgaccgccttgcagagctcaaggtggaggagattgggcgctgctacaatgatgttgggaagttgggatgcattgtcatcgtcggtttgtagtcttgggttgccaatcaccactgctgcaaactctgcgtcctcaccttaggcactgctggccaaggagcaggcggcagcaggactagccctgagggatctgcgtgtccaacaagctgccaccgtggcaatccgtgccaaattggaggtcctggctttcaaagctggannnnnnnnnnggccctgagagatctgcgtgtccaacaagctgccaccgcggcgatccgtgcgaaattggaggtcctggctttcaaagctggatgtgctcgaggtgcgctggggggggtgagggctctgggcaaaggaccagttgatgagagcagagtacaccagtcacgttgagccccggctcgtgaagccactgacttaactcgcagaaggacctgtctgaagcaagtaggacgtatcactagatcagacaagcatgcagggttgttgagcacgtcaagcaatttcactcatacaccgcgatctttgccgcatggcaggggctgagagggaggccacagccgcagccgaggaacatgaggcccaggaggccgtgacagctctgcagatggagcttgttaagacacaggacctctctgcagggctggaaaaggcactgagtgaagctcaggaggcgaacgccctgtctgccaagcagggcaggtaggtttgggtggggggtggaagtccattcctggcaaggttctgaacggtaggacggtgctgtgtcaagcatgtgatactcctgctctgggttccaggtgaaccgactgcattgatgctcctgtgcaggctcgcatccaatcagcagatggcggagcagattgtggaggacaaggcagccctgctcaaactgctggacgaggtcaaggtgcgaacaggaatgctggannnnnnnnnntggtgctgtgtcgagcatgtgatactccagctttgggttccaggtgaaccaactgcattgatgctcctgtgcaggctcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactcattatctcgctcccatgggactctcctgtccaggaactacgccgggaaaacgcggctgnnnnnnnnnnagggagctaggggtcatgacagtgcgatgctttcaaatgatgcccagctgcccatcccctctgaactcataatctcgctcccatgggactctattatccaggaactacgccgggaaaacgcggctgcagagcaggcggctgaggctgcagaggcggcatgcatggaggccgaggttgaggtggaagcggcacgagctgagctggagcgactgcgtgccgcccaggtgcataagcaggcagctgctctcgtgcttgtcttctgtcgcattgaagagcatgtctgccaccatcctggccatgaggtgcacccttcacccatgttccccacccatcatnnnnnnnnnnatgccgcccaggtgcaaaaccaggaagctgctctcgtgcttgtcttctgtcgcatcggagagcatgtctgccaacatcctggccatgaggtacacccttcacccatgttccccacccatcatcacaacctcccacccccccctcccaggtcactgccaggagctccctggtggaccagctcgccaaggccgccagggcgcacggtgccctggcgcggacccacgcgcccacggcggcccgctgtgcgcagcttcccgccgccgcttggtgtagggcagcgggggcagacctccgcctgcctgccaggatcgagtcgctgcggcccctggcccagtggctggacgtggcaggcgcccctgtccagcttgccatgctgtccatgctgcagcgggcggcggtggacgccctcctggccgccgacgaggcctgcccgggggcgggggtggcacaggcgctgagggaagcagccccctgggccatccgcggctcggccgcgcagcgcagcgggcgcctgcggcggcgcagtagcgtctcgcagggcatggactcggcgcggagctgctgcagcgccagcgggcagatcctgctgcgagtgcaaagcgtggcgctgggggtgcctgggctcgaggggcgcggtgaaggatcatgacccttgtttaccaatgtgatggagcatcatcgttactgacgctcgatcaggggcctggtattggaatttggtgccatagaaagagtctccgcgagagggccatttggaagtttgctacttgagacatgtccgcccaacactgatgacgtggatcgatcgcctccggaagctgggctgcatgtgggggtttacgcatgagtggtagcgtcccacgctattgtgtcggaactgggtcccgaggtcccacaactcgatggaagaggacggagttannnnnnnnnnccccacgcaattgtgtcggaacggggtcccgagggcccacaactcgatggaagaggacggagttattcgagcgactacggctgagaacatggcggcagcaacggagcacttcaaccgggggaatggggcgaccggcagtgaggtacggaagtcggcctcgttgtcggggatgggtgcagaggggaaatgcacgaccacgaatccgatccacatgattgtaggatgcattgtatgtgtatgtgtgtgatgtcggaggatcgcatgaaagccttggcgaggacatgcactgagacaaccccttattcccctccgaccccccaggccagggcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcatggtgcaagagtgggctggggcccaagtggcatcgctggctcttgcatgccgaataatctgtgaccctggcacgtgtcttgcaccctgcacgccgcgcctgggtnnnnnnnnnncgatgccggcgcaggccacctccccaagatatccccgagggtgacctcgagtgccaatgggaagctgaccgtggtgtctacaggtgcgtgatctgagaggtttcgaccccgccccagagctcctcgcgcgcgtggggagggattaatgtacagcaccacaaccccgacctgaatttgcgttcccccctctctcccccaggtgccagatgggagaatgaagtcggctactcccgggctgtgaagcgtggaaacttcatcgccgtctcaggtacattgtacgggaannnnnnnnnnnnnnnnnnnnnnnnnnnnnnnnnnnnnnnnnnnnnnnnnnngcctgcatctgcgcgggaggccatcaactcacaacccaagtggccccaatgcaggcacgtcgtcggtggagcagagcactggcaacgtgctgcacaagcgcgacccatatgcccaggccaggacggcgctggagatcgtggcgcatggcctggaggccctcggcgccaccttggaggacgtggtgagtggcaatggggcattggttgctgtagacgtcctgtgcaaggggtgcctgcgcgctgcagggtcagcagcctctggcacggtgaccgtaagcgcgtgggcacggacctgcccacctggactcctgccccccccacctatatgtgccgtggtacatgccatgctcagtcacgccgacatccctagaactccaaaccccatgcagattcgcacgcgtgtctaccttcgcaacatgggccgggactccgcggcggtcagccgggcgcatggcgaggtcttcggcgccatccgccccgccagctccatgatagaggtgcaacgcctagtgcatgatgacatcctggtgctcatcgaggtggatgccatcgtgtcctgaccgcgccccctgcctcacgggcagcctgcgcatgcctcgcgcacagactccccgcaccttgttgtggttgtgaatgtatcgctgacatggccaaggtgctgtaagtgcactcgagcacagaaaactggacatgtgcatggtattcttggtggtgggtcacaaaatacttaaagggggagggtacttgtactggtcatgggggtgtaaatgaggaccactggccattgttgcagggtggaggtagtctgtgcggaccccgagatgtcttctgtagccccttcgccgcagcagggagccagctgactcatcgtcaccaaagccgatggtcaccatctcagttcacggtacagcccgcagctccgcccccggcggcatcatgttcggcctgggtgctcgccttgcagtgacaccggtcggcgttgggaacaccctcgagagcggagtcgatgtgcttgccgcacccgaaccacgtgggcttcccgcacgttccacactttcgctgatgacacatacttggagatataatgtgctcaaggaatgatagcgacgtgagagtcgggnnnnnnnnnngatatgatcggttgcctacagctcatagacacacttcccactcgccaagctgctccctctgggtttcccgtcctgtggcgcgtataataccatgcataggtcctcatcacgacagtggtcgttgggcaccgggatcccggaagnnnnnnnnnnggaatgcccagaagcagtaatccagcacagcaggctccccacggcctaacctcgagggtccttgaccagatcatacaaaatatgattggttgccttcagctcatagacacacttaccactcgccaagctgctccctcttggtttcccgtcctgtggcgcgtatcataccgtgcataggtcctcatcacgaaagtggtcgttgggcaccgggatcccggaaggataccgcaaggcttcccgatcagggcaagtgcacagagctagcacgtatgactacctgttgcagagacattatctgcagacaaaaagtcagtcacatagcaagaggaatccccgccgcaccaaggtcnnnnnnnnnntagagacattatctccagacagaatatcagtcgcacagcaagaggaatccccgccgcaccaaggtcattcgcgtgattcattccccgaattggcctgaatacctgcacactacttaccccgggttctgtgtcgatcatcacgaaccgannnnnnnnnnctccccgaatgggcctgaacacctgcacactacttacgccgggttctgtgtcgatcatcacgaaccgacctccgacatagtaagtgctacgagataatatgatcttatcgtaggttagaaggattggctggnnnnnnnnnngacggatacaaattgtactatggtctcgcagctcgcgcgctctcccgggttcagttgggggctaacgcgagacatacacctcctgctgggtcgatcgtcgcccgagttgccataaaagccagatcctctatccaactggcgtgcagaacatcgcactggagatcccttgtgggtgtttgtaggagtacgggtctggtggcgacgcgcgcgttgcgaggatctggggcccccgtcccagagcttacgggccatggctcccagcacagcaggtgctggagcggaagcagagtatgacctgtccatatcccaagtgaggcggggggggggtttgctgctggagattgtccttcgagtctggggacccgaccctgccgctggaccaccggtgtcgacggatctgaagcttcttcctgctcgtctccctccagcgggcatgcctcggctccttctgtgccctcctggtcttgtggatatactcggagattctttcccgaaaagcatcgaggtagggtgcctggatctgaagtgcatggctcgtgggcaggtccttgccgagctttgggctggccttgggannnnnnnnnnggggtgcctggatctgaagtgcatggtttgtgggcagctccttgccgagctttgggctggccttgggagcgcttcccgtgggcggttgctcgacggtcacgctggaagtcgcgtcgcaaaccttgcgcctgccaggacctctttgtgaagcgttgcccgggccccccttccattcgaatcccttgctgccgcagcgagttggatacccccagcccgcaccggaagccggaccgggaggaggaggcgatggagctgctgccggtgacggccagcctggatccctcagcagaagtgccagctgcgcacctcaacggcannnnnnnnnncgcccgagccccccttccattcgcatcccttgctgccgcagcgagctggaggaccccagcccgcaccggaagccggaccgggannnnnnnnnntgcacgcgccctgcagcccccgtcccccgctctccgcggccgccctggttgcgccaggcggggcactgtcctgggccgccatccgcgggtcgggcctggcacgatgcgtcctcctggaccgggccgccctcgtctccgcgctgcccacgctgcgagcggcggtggaggggggcgcctggatcatgtggttcttcctcgccgatcgcaccgccttgctgaactccaccggcagggtgcgtggcggttgggtgtggagaaggaggagtgtgttcttcatgtgtggccttggctcggcgagcacggcgcnnnnnnnnnnctgctgaactccaccggcagggtgtgtggtggttgggtgtggagagggaggggtgtatctgcttcatgtgtgtggccttggctcggcgagcacggcgcgaggaatggcacagcatctgttctgggctggtcaggccatccgagggtgcccagtcgcctgccaccctcctcctcaagcatcctccacatccatcaggcctcggaccctccccaaacacccctctcccatgccccccaaactagatctactcgcgtgacaccttccttttcatgttcctggccctggccacatgcgcgnnnnnnnnnnccacccctctcccatgccccccacccctagatctactcacgtgacaccttcctcttcatgttcctggccctggccacatgcgcggcgctggccagccagcggcccacggggcggccgcctgctgtgctgaaccgcgggcagaccgaggagtggaagggctggatgcaggtactcttcctcctgtaccactactactcagccaaggaggtgtacaatgccatccgcgtcttcatcgccgcctacgtgtggatgacggggtacggcaactttgcctactactacaagacctccgactttgggatgggcaggtgggaggagggtttggggagggggcaggtgaagtggagactctgccctgccggcatggtcatggatgcatgcgtgggctgagcagggccagggagctactcagtgcacagacactggttgacacgtgagtgcgcggtgcaagcaagagctgactgcatcgtggaaggctttccgcctgcgccgcgccgtttnnnnnnnnnncactctgccctgccggcatggtcatggatgtatgtgtgggctgagcagggccagggaaccactcagtgcacagacactggttgacacgtgagtgcacggtgcgagcgagagctgactgcatcgcggaaggctttccgcctgcgccgcgccgtttccccgccatcctcagacatccaggacgtgggcaagaaagcgtcgccaggcttccttggacgcccaccagatgcccatgcgcacctttccccccgacgcccaccctacagccacccccagtgctttccctccccgatccctgcgcaggttctgccagatgatgtggcgcctgaacgcgctggtggtggtgtgctgcctggctctgaacaactcctacatgctctactacatctgccccatgcacacgctcttcactgtgtttgtctacgccggtgagcgagcgtgctgccacctgccggggggctcggtctggggttcgccctagcacgcgtgtctgcgagggatagtgcaggggacggggagatgtggcggggcccgcaccaccctccgagtctggcattgccgatgctggggtgcactctggannnnnnnnnncctcttcactgtgtttgtgtacgccggtgagcgtgcgtgctgccacctgccagggggctcggtctggggttcgccctaatacgcgtgtctgcgtgggataatgcatgggacgaggagatgtggcggggcccgcaccacccaccgagtccggcattgccgatgctggggtgcactctggagccaggaccaagggtgtcgagtgcggcgcatgcaaagtccagccggcactcgagcacctcacccactccaacaccccacccccagcgctgggcctggggcacgcccacaacaagcgccccggcgtcatctgggccaagctggcggcctgcctggtgctcacccacctcctctggatgaaccgctcggtgttcgacctggtctggcgcccgctgcgccccctgctggcgtacaccaaccccgcccggcccgagggcgaccccctgcacgaatggttcttccgcaccggcctggaccgctacgtctgggtgcacggaatggcctgcgccgccctgctcccgcgctgggaggcggcgctggcggcgctggaggcgctggggtggaaagcgcggcgcggcgcccgggccgccgtgctggcggtctgcgccctggtggggtacgcatggtatgcgcacgtcttctccaagcccaagctggagtacaacgcgctgcacccctacacctcctggattcccatcactggtgggtgggtgtgggttgcgtgtgggcgggaggggtgaagtgggctttgggaggggggcgggggagggcttttgtcgttacaaggcattgcacctggggttgaaggggtttgctaggagaatctgcggcagccttgtgttgttggggagcaggcaccacgtggcctgcgcgcatggggtgcttgtcgacgctggcctcgccccctccctcgaaacacccccacccacacatccaccagcatcccacgaggcccattcgacccctctgttcccccctccccaaaaccgaacagtgttcatcnnnnnnnnnnccatccaccagcgtcccacgaggcccattcaacccctctgtttccccctccccaaaaccgaacagtgttcatcgtggtgcgcaacctgacccccggcctgcgtagcgccaacctggttctgtttggctggctgggtgcggtgacgctggagacctacatcggccagttccacacctggctgctcacgcgccgccccgacggccagcccgtcctcctcctggacctgctcccaggctacccgctgctcaactttggcatggccacgggggtgtacatcctggtctcgcaccgcctgcacaccacgacgctcacgctgcgcgacgcgctggtcccacacgacgacgacgcccgcctgctgcgtaacgccgtcatgggccttgccctggcgggggggctgtacgccgtgaccgtggcaggggttggcctcgccgcggccctggcccgatgacggcgggagcccatgacggccgggcacggggcctctggcgccgtcatacgcggcgctcccgcctcagtcccacccagcctgtggcaacccgcggtttgccacactgcctttgtaaacggcgctcgccaaccttgcacctcaccggctgggctgcctgctgcgccttgcctgtcgtgaattaatgcccttcccagcttttcctccgttttgatccagctatgtcttgttgtaacaccctccagcctctgaaggcaacaagtgcctgggaaggggtggcagctttgaccggtccacgccgcgcgcgttctgtcgtggtcgagagcgcgtggtgctggttagcccggtcagcgcagtcaggctcctgcatgtcgactccgggcatttaatacgtggcctcgtacctaggccggaatccgtgagcgtgcgtatcacccttccgacaccccactccttcccaaccacctccaggcggaagcgcctggtgtggccccgctcgcaaccccctctagccacagtccccgtccctcatacattccctaaagcagatagcgagcttcatccccctatccactccctgtcgacacctccgagagccctggatcagttgccaatgtagcttcctgcagccggcctgacacgagatgggcccacctaccgcgagcaggtaggaggccgaggcgcgatgcattgtgccctaagacttcatgattgtcttcaatacgcgtttgcctgacccagataaatccctgggcaggtgggcatggctgcgctcggtcaactggtctcgcctggcgctgggcctggccctgctgtccggcatgatcctggcctacgccgagttcgatgccgcgcggcttgaggcagtcctgatctggctccagggccacaagctcaaaggaggggccctgttcgtggtgcgctggcttgggagggggggagggatggagggtaccccatgcgctttacacatcggcaggtcgctcccttctgagatggtgctgacgagtgcaggagcgggcttgcatggctagttgacacactgtccaccttggtaccctcccatatcgagcctgagcatcagcgaatttccatcggaggccccctgttcctcccttgacaccacacgttcaccttccctcggaagcccccccttgacttcccctccaaaccacctcaccgacagctgggcttcaccctgggagtggtcctcatgctgcccgccatggtcatgggcatggcggcgggggcggtgtttggcatcctccctggcaccctgctggcctggctcggctgctccctgggtcaggtcctggccttcatcatcggccgctacctcctgcgcgaccctgtgaccgcctacctgacgcgccagttcccggcctggaccgccatcgacgccgcgctgggttccgaggcctggaagctggtcaccctgctgcgcctctccccgctggccccctggaatgtgctcaattacgcactggcggtgacggcggtgccgctggggccctacgccgccgccagcgccgccgcggtcctgccctacctcgcgctcttcgtctacgcagggtccctggcgcgctcgctggccgacgtgctggcgggggatacggggctggacgcgggcgccacgctgggcgtggccctggcctccggtgcgctcatgctcgctgccgtgtggtacaccacgcacgtcagccgccgcgccatcgcgcgcacgctgctgcgccacggcgatggcctgcccccggagctgaccaccgacgccgacgtggtggccctgctccaggtggccagcttcggggaggagggcgcggaggagggcgcggccgggcacgccgccggcggtctcagtccgcactggctctcgccgcgggcgcggccgggcaaggcggagaggagcgacgcggaggccgtcgccgcaggcaccgcctcgatggccagggatgtggagctgggggcgctgctgccggaggggcgcgccgcggtggagctggacgcgcggcccagccgcgccgcctcgccgctgcgctcgccggggccgagggccagcggcagtgtgaccccggtgtacggcgcgcggcagggggccaggcagaggggtgggaccgacttcgaggcctttgcctgactgggctggagtggaatgggccggcccggcgcgtgaaaggtgcagtcgaggggaaggcagactggcttgctgtagggtgcaattttcgctcggcctggatgcctcctggccgcgccaggccgctcctgccgccgcatcaaacgacccgtcattgctgccgtcttctggatgccggggtcctgcaggcaccaagtctgctgcccgctgcatgggtgcttgcctggatgctcctttgtccctcagtcagttctccttttttcatctgtgcaccaccgagtgaaaaccctccagaccttgcaatgcatacgaaacgtgaccttgatgcttgctcaccgcccttgattgtgactctcacgacgctactcagcgagggcccgtgccagaccaggtgccgagaacggggactgggctgctgcctttgtgagtgctgcactgtcctaggatgggtggtggatactggtggaccccgccagacagcactggccgggtacaggagctgttctacgtgattaaatagggttgggagacgacaccgataccgcagacagacaagaaattggatggcgatgcaagtgattgcgatgctacgcactcaaaaggaagtcagcgatacacaagactacaggacggcagttctttcaatggacggcgatagcgctaggctagtagaaaagggagaggcacgcccccgcatgggaggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtccagacttgcgaccccttgcggaggggccgcccgtggggcgggctccccggctcctcggccaggtccatgnnnnnnnnnntcaaaaatggcgcaagggtggacgggaatcactaggctgcattcattgtggcgtcgctccgtaccagcggggttgcgaaagacgacgcagcgctgcggggggattgaagagtgagcagnnnnnnnnnngcaaaaatggcgcaagggtggacgggaaccactaggctgcatttattgtggcgtcgctccgtaccagcgggattgcaaaagacgacggagcgctgcggggggattgaagagtgagcagaagcaggaaagggcagcgcgtcagggccccgggtagtccatggagttgctggccacggaggacaggaagaggtcagtccagacctgcgaccccttgcggaggggccgtccgtggggtgggctccccggctcctcggccaggtccatgtctggggtgagggttgggagggcaaacctctcgtatgccgggattgcaaggtgcgtgagagggcccccgtttgggagcggcagatgagcggtgttgccctggctacacgtccaagcaagctacgctcagacacaatccccttacttccaccatcgcccctcaccgaagaggtnnnnnnnnnnggaggtgcgtgagggcgctcccgtttgggagcggcagatgagcggtgtttgccctggctacacgtccaagcacgccacgctcagacacagtcccttcacttccaccatcgcccctcaccgaagaggtggccgtccccctgctctggaacggcgtcgtccagggcccccgtcacttgaccctggccatggccctccaagaggctggcgctgagatcctgagacccaagaccctggggaatggggatgggctccgctgagccggccgacagcccggtgacgaggtcgtcatcgagcagcgggcctgggtttgggtggggagcggaggttgttcaggtggtgcagcgggcacagcgggcacagagctcggatcgcttgagcttgacagtcttagggcctggatccgcgctgttgcaagttccacagcacaccacacgcccacgatgaacaaggcctgctcatgcgcctgcatnnnnnnnnnnggaccccggggaatggggatgggctccgccgagccggccgacagcccggtgacgaggttgtcatcgagcagcgggcctggggttgggtggggagcggaggttattctggtgcagcgggcacagcggcacagagctcggatcgcttgagctcgacagtcttaggacctggatacgcgctgttgcaagttccacagcacaccgcacgcccatgatgaacaaggcctgctcatgcgcctgcatcctcccagacccctctctccagcaccctcatctgccactcacgctcttcactgatgggggagtgtgcgggttggctgccccacacctccgaatcggcggccnnnnnnnnnnccaccctcatctgccactcacgctcttcgctgatgggggagtgcgcgggctggctgccccacacctccgaatcggcggccgacatgcccagggtgggcatgtgcagccaggagggcaggctgcggcgcaggttgacgcgcgacgcgtgccgcgagcgcggccccagctgggagccggggacggtccagcgcggccccgtgccctgccgggcccccgcccgcccgccctggctcgccctgccggccatcaccccacgcaggcactcgtcgatggtggcctccaccgcgcagttgacggcgatggcaggcagcttgacccaggcggcgcgctgcccctcccgcagcgcgcgcagcaggtcggtctggctcaggttgaccaccgacttggcggccgacagggtctggaagggcagcaccatggtgcaatcgccctcccaaggctggttgaagagggtgagcaggcgcgcaaaggagctgcgccgcgcgcccagcggcagcagctccaggatctgcgtgtgtgtgtaaagagggggagggatgtcggggggtgaagggtgcctgacagagcagcgagtgcgggaatgagggggaacccttgggagtgggcaggtgagatcggatgagcaagcttgcaatcttccaggcaggaagcatgcccgacagaagtcatctgcctcatggcaacccggcctgtcgacagcgccgtcttcacatgcatgtcagtgacagcagcagcgcggcaagggactccaccctgatcatcgagcacaccccacacacccccacctcagcctcgtcatccccaccacagccccttcccctcctcctccctcctgcactccaacaccgatatctcacctgtcgacagcggtgcttgaactcgctctccaccaggtggcccagggcgcgcggcgtcgccttcttcagcgcgatgatgggcaggaggnnnnnnnnnnggtcgacagcgccgtcgtcatgtgcatgtcagcgatagcagcagcgcggcaagggactccaccctgatcattgagcacaccccgcaaaccccaacctcagcctcttcatccccaccacagtcccttcccctcctccaccctcctgcactccaacaccgatatcccacctggcgacagcggtgcttgaactcgctctccgccaggtggcccagggcgcgcggcgtggccttcttcagcgcgatgatgggcaggaggtaggggttggcctgcgacaccaggaagtagttgacattgaacatctcgctcagccccgccatgggcaggtccgcctccaggctgccgtcccgccagcgccgatggtgcgccgcgggcttgggcgagggccagggtgctccgggagggccgatacccggtgaccccgggggggtgacctcgccgccggccaccttgcccgccgtggccgtggtcgtggccgcgcccgcccccccctccgcccaactccccagcgcgctcatgaactcgacggtgctgccgtccacccagcgcgccatcaggggctggggctcgaagaggagcgggaaggcggaggagcaggccaccgcactccacaccagcacctggggggcggtcaggtaattcagcaagcgcggcggctcctctgtgtcggccgccgtcaccaccacgttcaggatgcggcctgggggggattgatgatgcgtgtatgggggggaagactgaggtgattggagaggatgaggccgaagacagggcgggtgggagtcctgggattcgccagaggacggtgcctggcacagcagggtactggatgcaacgcaggtccctgccgagacggcatgcccacacccccttgcaaggccccctcatcccaggtggggcatcacatgcaatccctcatcctaaccccttccagtgacttcagtgatccgccatctcaccagagcgctggtaggcgtccgcaaaggtgaggtcnnnnnnnnnnaggggattgatgatgcatgtatggggggaaagactgaggtgattggagaggacgaggccgaagccagggcgggtgggagtcctgggattcgccagatgacggcgcctggcacagcagggtgctggatgcatcgcaggtccccgccgagacggcatgcccacacccgcttgcaaggccccctcgtcccaggtggggcatcgcatgccatccctcatcctaaccccttccagtgacttnnnnnnnnnnagaaaacgcggcagggacgggagtctatctgttgggccccgccgagctacctatggccattttacacaatggccagcacacttcaggctggccacacaaggaccctgcctcgctggatcccagcacacctcgtccccgagccctttctccctttctcctggccgacccaccttcttgagcaggtgccggaccagggctgggaaggagttgctggtgaagaaatccatgtcctcgagatcatgcacggagtcgaagagggcaagcagctccgcctccgtccgcgtcgccacgatggcacatgctgggcggggtgggttggaatatggaaggttggtgggggagagttcaggggcgtgggnnnnnnnnnntgaaaacgcggcagggatgggagtctatctgttggcccagcccagctacctatggccattcagacaatggccagcacacttcaggctggccacacaaggaccctgcctcgctggatcccagcacacctcatccccaagccctttctcccttcctcccggccgacccaccttcttgagcaggtgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaggtgggcacacggcagagcagcctctcctcacccctgccccctccagcccagtttttcattctccccaaactccttcattccaaaacaccagccaccccaccaacggctccggcactggaccccgccaggactcgcggcagtagcttggcgtcgagcaacgctctgaccacgcccatgtggaaggcgccgaaggagccgccgccggacagcaccagcgcggtgcggccaaaggcgtgccgcgtctcgcgcaggaaggccacgcgctcctccagggggatgtctgggcggtgtggggaggagagggcggaacgtgtgtgggtggatggatgaatttgtagggcggagcccggatttgagggagcgaatagagtaggaatgtgaagatgcgtgtgccataccagattgtattacatcaatcatgcagaccgtcaacaagactaaccctcgccccatgcacacacctaaatctaacccaaacacgcccttgcaccactcgatgtctccccccccggcaggccatccacactgctccttgccacagaattccttctcaattcctctcctttactcccaaatcgcacctggcgcctcggcgatggcgcgcacatgacgctgcacctcggcggagtaggcgcggnnnnnnnnnnctgtgccatgccgaactgtgttacatcaatcatgcagaccgtcaacacgaccaaccctcgccccatgcacacacacaaatttaacccaaacacgcccttgcaccgctcgatgtcttcccaccccctggcaggccttccacactgctccttgccacagaattccttctcaatttctgtccttcccccccaaatcacacctggcgcctcggcgatggcgcgcacgtgacgctgcacctcggcggagtaggcgcggatgggctctggcaccgcccggcaggtctcgtgcaggtcggggctggccaggttgcccaggttgcgcagcaggtcggagcggatggccagcgcggaggccggcaagtcccccgcagcgcgcaccgatgccaggtacgcggtgcgctcctccagcagccgccggtcgtacatgaggtcgggagaggggccgcgggcggacaggccctcccgctccaggctgctcatggccgcgtcccagacccttgaggtgtggaaagggtggagaggcatatgagggttgtgggaggcggagtgggtgggggtgggtgggtgtttgtgtgtgtgtgtgcagagacattcacataggtccaacggaatagtggagggcggcagccgagctgcaacggccactgagnnnnnnnnnnattgtgggaggcggagtgggtgggggtgagagggtgtttgtgtgtgtgtttgtgtgtgcagagacattcacatagggccaacggaatcgtggaggcggcagccgagctgcaacggccactgagtagggtcgagcggagatcgacatgtgctgcacttgcaggggagccttggcaggtgctgaccagtgtacaagcaacaaaacaacaacccaaccacagtctcactcataggtctctgcagcctcagcctcctggagcagctgccggcgccgggctgcggccggccctcgctgggaggccacgtgcctggcaatgctcagcgcagaccagcccatggtgtagccggctgtcggggggagaataggttgtattgattatacagtgtaaagaggcatcagatgatgaggggaaccagacagaggcgcaccaccaaaccacacggtccagcccccacctaggacgatgtggtagcggcgcagggccctccagggcagccagcggcgcacccaggggggtatggccacgaggacattcagccagccggcgaggcccagcagggtgcgggacaggagcctcacgcccagggagccccaggagtagagggcaaccacccctcgaaagggatgcagcacgatggctagggcgcgccacagggacaggctccagatcagggatctggcatccttagatcggatgagggatcgaggcgaggcatcctggatccggcctgcgcggatgaggtggaggaggccccgtcgcgcgagggacggagagagtgggcagtctcggaggttgctggatgcacgcccctggtcctcttcagagcgcggtcctcattacctgccatatcgtattcaatgatggaatgttcaaggcagctttgcgcctttatatgtcgcgggactcggaccgcagtgggggaagcaagaaaagccctcggcctcgtcagccctcggggattaggccatcctcggaatctagagcatcccgcacagataaaagttgtacatagttgacactcaatcaagtgcggtggagagctggctatctggggcccctgttttccgcagcaccccccatattcctttcggnnnnnnnnnngaaagttgtacatagttgacactcaagcaagtgcggtggagagccggctctctggggcccctggtttccgcagcaccccccatattcctttcggaagtctgggcatcgcagcagggcgccagcatggacgaagcgcaaccagcagaggtaaaaggggggatctcaatactccacagattggtagctttaaagctcgcgttactgagagcccttgcatggtggttgtcaatgtatgtcaaaaagttgatgctgaaaagcttccatttttatggagtgaaagtatacaaaacgcccgaacagnnnnnnnnnntaccagcagaggtacaagtggggatctccatactccacagattggtagcttcaaaaggtcgcgttactgagagcccttgcatggtggttgtcagtgtgtgtcaaaaagtagatgctgaaaaagctttcttttctcacggagtgaaagtatacaaaacgcccgaacagcgtgaggaggacacccagagttctattcgagtctcaaaatccaaagaccagcaggtggcttgagtaacacttcgtcagagtcttcgtcctaactactttgtgcagggatgacagagagggcagcacaggatcgatctctgtatgcttgggaaaataccatccgagtacggggcaaattctctacatatattgtgcagtcttgaggaatgtgatgatgcgtgatcttcattctcagtgttggggtagttctctggtaaatgagcctgcaaacctgcatgtnnnnnnnnnnatcctaattactttgtgtagggatgacagagaaggcagcacaggatggatctctgtatgcttggggaaataccatccgaatacgaggcaaagtttctacatatattctgcagtcttgaggaatgtgacgatgcgggatcttcattctcagtgttggggtagctttctggtaaatgagcctgcaaacctgcatgtnnnnnnnnnncggaacgttgctgcgtcaacgtagggaaatcgcggatgctgatcgacaggtgatttgaagacttggtgtggattgggtctcccgcggcgaatttgacccggggaccacgctcggccatgtagcgccatgaaatccgcaggtgccgatccttcgagcgaaggcatcgacgggcacagttctgacgagattagttactttaggatggctgcaatgggcctgacctcgctggcatcaccctgtgccttcaccaccgcccggcctaccacccgccgggcccatgctcgccctggcatgctccccgtgcgggcagccgcagcggctcccagcatggtccctgacgaggccaagaggacgaccatgaacctgctgcttgccggatccgttggcctgcccgtggtggccatggccattcccttcttctccttcttcgtgcccgtcaagtgagcagcgtcggaggcctcgggccgttgtgagggatggaaagctaccttaatggttgcgtgagtaatctctagaaagggcatagaaggcgcagcgccgttcgccatcccaccccgtgatcgtgtctggagtctgatgttgttgcnnnnnnnnnnaggaacgttgctgcgacaacgtagggtaatcgcggatgctgaccgacaggtgatttgaagaataggtgtggattgggtctcccacggcgaatttgacccggggaccacgctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtatggctgcaatgagcctgacctcgctggcatcgccctgtgccttcaccaccgcccggcctaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatggttgcgtgagtaacctttagaaagggcatagaaggcgcagcgccgttagccatcccaccctgtgatcgtgtctggagtctgatgttgttgccccctcctgcaccatgggagctaccctgtctctcctcatatgctgcctccccctttaccttcccccctcttcccgactcccatctccagggctgctgggactggcgcgggcctggtggccaaggacgccctgnnnnnnnnnntcacactgcgtcctccttcaccttcccccctcctcccgactcccatccccagggctgccgggaccggcgcgggcctggtggccaaggacgccctgggcaacgacgtgaagaagtcggagtggctggccaagcaccagccgggggaccactccctggtccagggcctgaagggcgatgccacctacctcatcgtcaccagcgccggcgacgtggagaaatacggactgaacgcggtgtgcacccacctgggctgcgtggtgccctggaacgcggtggagaagaagttcatctgcccctgccacgggtcccagtacaacgcagagggattcaaggtgcgcggtcccgccccgctttccttggccctggcccacgtggacgtggtggaggacctggtgtccctcacaccctggaccgagaccgacttccgggatggcggcaagccgtggtggtcctgagcgccggcgggtacccctccctgcgccggggctagtgtccctctgacggggctggggggagctggcatgtacattcgtttgttgtgagaagaatttctagagaagccgggcacgccaggggagggggagaaggggggggggagataggaccctgcgcttgggtgagtgcatggcgggnnnnnnnnnntgtttgttgtgagaagaatttcttgagaagccgggcacgccgggggagggggaggggggagggacaagaccctgcgcttgggtgagtgcatggcgggtggcgaagtgcaaggctgcaagcaggttgattgtacgagggcgcaaggcaggggcagtacaggaggtgagtttcacacggagccatgtctcaggctggtacaccaggcagctccagggatgggtggatgcctgccttccgctgcaaggcatgcagcttggcgacgttggaggctaagagcccgctcagttcggccgccagggtatccctcgtgccggccaagtcctcggcatcttctgcgacggcgctgatgtccctgggggagagggcatacgagtgaaagggtcgacccttgggctggaacatggcgacaggtgtgggtgctgggactccgccctgctgatctggcatcctctcaagaacagaacccccagcacagcccaatcctgccctgcacctgcgcagcttgtgcaggcggttgagtaccaccagggggttgacctccgagtcccgatatctgctgctaaactcctgctccagccggtgcccgatttgatccagctcagcctgagcctggagaagggacgaggtcaaagactcgctgccctcgcgaagggataccattgaataggtaggaagcacttcaggttgtatcagatgtggagcgctcgtgagcgaaggtccacaagtccttgcgaacacgccgctgcatagtggtgacttcaaactttgccgcagcaggcacagctcgcctcgcacagtggatgatggtagccgggacttcggtcatcgtggcggaggctgctggtgaggtagacattgttgatagaaaaaacaatgtaggtgcactgtgatgatactcgtggccgtgagtcgtgctgatggctgcatgtccaacgggacctgtggaagagtgatctgaaggcggacgaagacgcgcgccaggatggccacgggagctaggagtgattttggggcggacacactggccatgagaaatgctctgcttggccagctcgtcgaaggcctcacaggggcgaaggtacattgcaagctggagggtggactggaatactgtgctgccactgctggcgatcgctcactctttgcctcaccaaccccgccctcagctcccatgtgctctggctcttattcctgcaggaaggctccagggcatggacgcgccttgtcagcaaggcaaccgctcacataactcaccaccaccaccctgacgtcaacctgtcggctacagccgccgagctcacacggtgtgctgtgcttggatagagacctctgggaggccatgagtggggcaagcagtaccgggccgtagagtaaggcctatgacctccatgtccatgtgcatgcctcggccgtccaagcacttgccaaagctcgggcgcacccattccgaacctgtcccnnnnnnnnnnatcaacccatcggctacagccgcggagctctcgcggtgtgctgtgcttggatcgagacctctgggaggccatgaatggggcaagcagtaccgagccgtagagtatgcctatgacttccatgtccgtgtgcacgcctcggccgtcccagcacttgccaaggctcgggcgcacccattccgaacctgtccccacacgaccaagcagggtggaggagcggctggaggaggatgccgacttcaaccggcttgtcgcgctgcgcatgctgcgcctagacatggcaccgggggcgagcgccccctggccggccatccaggccttcctcctggcgctcgcaggcgggggcggctctgcgcgccctgcctacaccccgcctcaggggctcctccagcgcggagcggatccgcccagcggacgaggcccccttgcgccggcgcaggaggctcagggggcctcgcggctgctggtctcctcggatgacgaggctgcatgtgacggcgatgccgaccacctctcccgctggtccagcagcagctctgagcatgaagagggggaggggccatgctgcacgctcgaccactcttcaaaccttgcagaggtgggacgcaccggcagcggcctcgccgtgtcccccccatccccggtgctcctgcagcagggcctgcaggcgctcaacctgacccgccgagctcagggcgtaggggaggggtcagggcgcacagagtcgccgctgggacccccggccagcttcaaggggtacccgccggatgcctgcgtggtgaggctggccctggcaggcgccccccctgggtcgaggggcgccgtcgacctggacccacgcctctgcttcaccgaggcggagctctgcgcccaggcgagtggccgccgcgccatggtcccctgcgctgggatgggtgcatgggatggaaggggttggagttgggggaccgcacatgctcctcgccctccattcacatggttggccttgcaccgcccacatttcgcagtgcgtgcgggccccccctgccccatcgcccaccgtcgggcctnnnnnnnnnngcttgccctccactcacatggttggccttgcgcccgcccacatctcgcagtgtgtgcgggaccccctgccccatcgcccaccgtcgggcctcgccccagctcactcatccgccggcccacccctcctcccaccctgccccaggctcaggcaaccctgcagggcgccaggcccggcggccccgccttctgcgtcagccccgccatgggcgcgctggccgtcgtccccggcgtgcacaccctgggcctgagccggggggcctgccgcggggcgctggcgcgctgcgcgcgctgcgcggacgccctgacccgctgcgcgcgctgggccgagcgcgccgcggactccgggggcgggcccggcgt

SEQ ID NO: 40396 - DNA, 336 bp, Chlorella protothecoides
  modified_base (100)..(268): a, c, t, g, unknown or other
agcacagtgcatgtgatacgcaggattgcactctggtacgcatcgctcttgtaaatccagacgcgctgtcttgccgcaggtgccggcgtactcgcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatctctactttccagctggtgagttgtgtttcggaatgtgggctggactcggcccgtgtgtcgagg

SEQ ID NO: 40397 - DNA, 68 bp, Chlorella protothecoides
ttgtacgacctgcgcctcagagacggggggtagagcccatcttgccattggattgccctgtccctgtg

SEQ ID NO: 40398 - DNA, 71 bp, Chlorella protothecoides
tgctctcgccggcggggacgaccacgttctcgaaccgcatctccgcgtgcccgtgcggcgcatcatcgaag

SEQ ID NO: 40399 - DNA, 3218 bp, Chlorella protothecoides
  modified_base (1233)..(1242): a, c, t, g, unknown or other
  modified_base (1854)..(1863): a, c, t, g, unknown or other
  modified_base (1947)..(1956): a, c, t, g, unknown or other
  modified_base (2051)..(2060): a, c, t, g, unknown or other
  modified_base (2223)..(2232): a, c, t, g, unknown or other
  modified_base (2961)..(3157): a, c, t, g, unknown or other
ccctcagctaccccagcctcttggtacccatgcaatgctgcccgattcaatcagggtattatgagtcaagcccttcaaacagcctgcagggtgcactctggtactgacacatctttctcattaatcgactggagtatgcagcgcggttatgtggtttccatgtggtctgacatccatatgtagggaataattactgccaccaatgctcgtgggtcctgcttaagctcctggcctgacttgcagcctggataacaaacatatatcacacatgcgtgatgcacgaggcttcacttgctgtacttgcgtgtgtgtgcttctgcctgcttggctttcacttacccagcgtgtgcagcaattttattcaacgatggagttctggtgattcttccgacggatctgaagggcctcagatcggttgtgctgcctgttaagagggatctcctcctgtgctcatcagagccatcagattctcttattgttaagaacctgtatgccgctggaggcttgaaacatcaatcaggctgaatatccgagcgataaatgctgaggcatgaggatgactaggatgaaagaagtgctgtgcttgaggattgatctggatcgcctcagcatcacaccagccacagatgtacctgtatctccccgtcatccccgagccggtgataccgatgtgctcgaaagattttgcaatcttcctctgaccaccttgtaagcgacacacacgcctactaattgatactatgcgccattcaaatgcctgccctagtttgtggcgggttggcacgagtagacaaggagcgttgcaatttcagccctgcgagtgccaatcaagcggatgttttactgcgatcaatgcgatcaaggggccgggaggcagggcagtatggtggtagaggaaagcaccgcaagatatctgccatttccattggtcagcgtcatcccaactggatttctttgagacctgatctcggcaacaggccccagaaccctcagcaagaactggaatcctatgaacatgctctctttcgaagcttgctgccctgcagagccttaatccatacgtccgtcaggtttccgacggggtgctcaacagacgacgacagggacagccagcttcaagcaaggaggatacccctgccggcggtatgctcctgcagcttcaaatccagttggacatggaagatattgagataagctgaaaacactacatatttccccctaggggcaaagcgnnnnnnnnnnttgccggaggtatgctcctgcagcttcgaatccagttggacatggaaaatattgagataagctgaaatcactacatatttccccctaggggcaaagcggggggaacattacgttgcgacaactgccgtgttggacattttgtacggacgctcatgtggtgcgcactcgcggcgtcctgttctaccgaaacatcgaatggtttttgtttttgaagtataaagagctgatttattctctgtggggagtcgacggcggataggcaagcagttgacataagcttagggccgcaacaaatcggaggggggatgtccgtgctcttcttccagtcctgtcggggctagcaatcgggcgagagtggagctaaggatgttggtttctactagcttaacgtcttcatcttccaggggagctggattatgtaaggtggtaggttctttttccggacattacctccggaccggcttcctggatagggaagtcagccgcgtaaaatggggggccggtagaggcaccatgcatacactgtaatatgttgaagggccttcctggatactgttggccgaatcagaagtaacgcttcatcccgatatttgtgcactgattggtggccgnnnnnnnnnngtttccggattttacctccggaccggcttccttgataggggagtcagccgcgcaaaatggggggccggtagaggcaccatgcannnnnnnnnngcctcagccccatcgccaagcagtttcccaccgaaacaacaggccgccataccctccccagcgtccatcaccaagacaagcaaccccacgccctnnnnnnnnnntagcgctcgtcttgtgctccatcatagtgcttcacacaagcctgacggtaaattggtgctgttgctgtgcagagaagtggtttggcgcagttgttgatgtttgtcgcattagagcgcagacatcgacgtcatcgcacccaaccctggcgccatttcgaaacgnnnnnnnnnnatgctgtgcagagaagtggtatggcgcggatgttgatgtttgtcgcgttagagcgcagacgtcgacgtcaccgcacccaaccctggcgccatttcgaaacgcagatgacgctcgctgtacctgtcccggaacagctctcggctccatcgccaagtagtatcccacctacacaacaggccgctataccctccccagcggccatcaccaagacaagcaaccccacgccctccacacctgcctcctctccccttcgcgcctccatccctgcctcatctcccagtccagcagcaaggcccgcttcctccccctctccagaagccagccctgcgtcctccacatccacggcggccagccctgcgtccttcccatctccagcagccagccctgcgtcctctccgtccccggcagctagccctgcatcctctccatcccatacccccagcccggcctcatctccgtcccaagcagccagccccaagacatccactcccactgcctcgactcccgccacctctccgtcccccacctccagccctgtgccctcacgctcgccggcagccagccctgcgtcctcaccctcgccggcagccagccctgtgacctctccgtccccggcaggcagccctgcgacctccccatccccggcggccagccctgcgtcctctccatcccctacctccagcccggcctcatctccgtccccagcagccagccccaagacatccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctccagccccattgcctccccgtcaccagcagccagccctgcgacctctccgtccccg

SEQ ID NO: 40400 - DNA, 99 bp, Chlorella protothecoides
cttgtctgtacgtaatatagcattgggtgcagcctggggcccgcggaggggcaggatggagttgcggtgtgcaggcaagtagagcccccggccgtcacg

SEQ ID NO: 40401 - DNA, 6007 bp, Chlorella protothecoides
  modified_base (1023)..(1032): a, c, t, g, unknown or other
  modified_base (3022)..(3031): a, c, t, g, unknown or other
  modified_base (3301)..(3310): a, c, t, g, unknown or other
  modified_base (3721)..(3730): a, c, t, g, unknown or other
  modified_base (4684)..(4693): a, c, t, g, unknown or other
  modified_base (4870)..(4879): a, c, t, g, unknown or other
  modified_base (5209)..(5218): a, c, t, g, unknown or other
  modified_base (5705)..(5913): a, c, t, g, unknown or other
cgggcggtggccgcgcgcggcgacgcgctgggcgccgagctcgtgagtcggacggcgggcgccggcgccggggcgggggcgccgggagccagcgcatcagagccatcggcaccagaagctctgcccgccgaggactcgctggcgagcgaggaggcgctggtgggcgtgcatgcgctcctggcctcctcccagctcatgctgggcctggtggccggggcgggggtgcccggcaccagggtccaggccatgctgcgctccaccgccatgcgccactgccgcgcgctgctggaaagcatgcacgcccgccaggtggcgcgcctggcgcgtgagtttggtggaggggagggggaggggctttgtctggccgcgcaagttggctgggactctgggatgtcttggggcatgcggtggatgagcatccctgcatcggccgtgttctgtctggcggcccagtgtacagaacttctttgggagcatgtcgaccaaaaggtgccacgttcatgcccttgcccaccgcaccacctgcgacaccggcgcccccaaaaaccgcagacctgctggatagggaggtctggtcccaggcggctgtcccgcccagcacccagcgcatcgtggagctgctggaaagcgaggcgcagcgcctgcagggcggcagcgagaggggcggtgccgagcaggatgggagggagcagtcggaaggcctggaggagctggccggcgagccacgcgagggtggcactggcgatgcgaccggtgccgatggctcccaagaagcctcagaatcgacggccgacgagcgccgggaaccacctggacccctcgaagcgacagtgcctgcgccagcagaagccagccccagcccttcccccccgctgcaacagcaccggagcccggcgacgcccccagcctccccgccgcggtccccgcccaccctcaccgggcttccaccccgcagcccgccctcgcccgccccccgcggcacgagcgacgcccagcgctcgccacgtgcgcagcgcacccagnnnnnnnnnncagcacgagcgacgcgcagcgctcgccacgtgcgcagcgctcgccacgtgcgcagcgcacccagatcgcgatccctggcctgccgctcagccccggcgccacggggcgctcccccgggtcggccaccgcctcgccacgcggccctgtgccgcgcaagttcaccatcaccgtgcccgacagccacactgcgctggcgggcgggcggggtgccgcggcgggtgccgaccccagcgccacacagccgccccccgccccgacgttggccgtgtctggcgaggccttcgcctgcgcgggcgcggcgctggcgctggtgcgcgcgctgggggagtacgcggaggtggctgccgcggcgccgggcatctgccccgaggccgggcagcgcgcgctggagctgctgtccctcttcaactcccgcgcctgccagctggtgctgggtgcgggggccatggcctccgccggcctgcgcagcatcaccgcgcgccacctggcgctggccgcgcgctccgtgggcgcgctggccgctctggccccggccctggcccacgtgctgggcgcgggggcggggggcggcccgcgcgcggcagcgctggccgcggggtttgcccgcgcggcgcgcgacatgcacctccacgccgacgaggtctgcgccaagttcgtgggcatcatgcgcgagcgggtggaggcaaacctggcgggcctgggcgagagcctgagggccgcggcgtccgggggcgggtggccaaacggcgagggcagcgtcggtgtgccgcgtgcctctgccggggacaatgtaggaggcccctcagacagcaacgagggcaccgacacgccctcgctgcgctgcttgccgccccccagcgcctttgcaacgaccaccgcccgccagttggcgatcctgagcggcgtgctgggcccgctgctcagcgcgcgccagctggacgccgtgttcggccgcgtggcgggcatggccgcggagcgctgcgccgaggccttcagcacgctggaggcgccgggggcgggcggggcgcggtggtcgctggccggtgcggcgcgcggggcgccggggcgggcgggagtgaccgccgcggccttcgaccgccaggtggaaagcgacgcgcgcgagctgctggcgtgcctgggggcgctgcccgtcgacccggtcgccctggatcaagccctggagccgctacggggctgggtggactggcagtttgtcaccaagccgcgcctggccgcggagcaggcgcagcaggcggagcaaaggtcgccggcggagcaaaggtcgccggcgggcacaaggggagggcaggagggcggcgatgcgcctggtcaggccctgtcagaggaggccaatgacttacaggaggccaacgcgccagaggaggggaggcctggcgcctccgatgagacgtcagtgcctgctccggagggggaccaagaggacaatgacctgtcctccccgtatccgagcagcagcggtgaggcgggtgaggacgagcggcaggacgaagacgaagggcagccaccggtcaaagaagagaaacctgggcaagacagccccactgctgatggtgtggagggcacgacttctgaccgcgaaccggacgcatccgtggcgccgaccagcaaagcaggagagcaggctcgataagcgatcaattcagaagccaggtgcctgggtcttggtggctgagtggctcccatttccattgtgatgggcacaccatgccgggcttgcccacgtccccgggcaccctctcatgtgtctgtgagccctcaccgccaggtgtcccttcctgcatccccctccatgtacttgctgctagcattgcaacgatggtcgtcagagtctcacagtggggtcagttgaagggaaggtggcgtgggaatgcacaggattgttgcccagcagggagtgcatatccagactcgagacggccggagcatcagacacgcacattttccctgagtggggcccgctggctggccnnnnnnnnnngggtggcgtgggaatgcacaagattgttgcccagcagggagtgcatagccatactcgagacggccggagcctcagacacgcatgttttccctgagtggggcccgctggctggccgcctttgacggcctgcaaaagtgaaggggtcacacaaggttggatcgtgccgagtccccttgcgagtagccatgcagcttggagcagccgtcaccgataacacacaacagaccctgtcctccacgcgcctggcctccgtgggcttgttcacggtgnnnnnnnnnngtggatcgtgccgagtccccttgcgagttgccatgcagcttggagcagccgtcaccgattacacacaacagaccctgtcctccactcgcctggcctccgtgggcttgttcacggtgcgggagacgttggacacgccgtccacaaacttggtgcggaagaggacgttggcgttgttgaacatgccctccttcagcgacacgacgatgaactgggactgagggaagtgggtcttgatcatgcgcccgatgttctgggtgtggctcaggtccagcgcggcatccacctgcgggatggtggccgtcgagtgaggggctgataggcaattgagcggcaagttgaacggtcctccttgcccgtgtgggcactcagggcgcagacagagccttcctcggactcggtcccccgcccacnnnnnnnnnngaggcggttgagcggcaagttgaacggtcctccttgtccgtgtgggcactcagggcacggacaaagccttcctcggactcggtcccccgcccacctcgtccaggatgtagatgggggcgggcttgaagaggagcatggccaggatgagggagagggccagcagggacttctgcccacccgagagctcgctgagggactccttccacacgccaccaaacgccacccggacctccaagcctgtatgtcagaggaggggaaggggagaaggtgggggaggtgaacattctaggaggtgttgccacagtgtttatgtgggcaacagaaaaagtcgtccggctgatcctcggaggcaggctaggcccttgatcgctggggtctggcacgtcacttcttctccttgtgtacaccccgtgctgcatgtacagccaggcccatcttagccctcccatcccaagtcccccctccgactcccaggatactcaccctgcaggaaggtctcgccctcgggcggctccagcttggcgctcgtccccggcagcagggtgctgaagatggccccaaagtcgccgttgaccttgtgccacgtcgtctccagcgccgcccgcttcttctcatccagctcctccatgacttcctggatcttgcgcttgtcgccctccaccacgtcccgcttgcgcttcagctccccgtactcggcctccgccttgtcaaacatggccatcaccttcttgttcacccgcttgttcatgctctccagggtcttgcatgccgcctcgtactccgcgtacgcctgggaggtggggtgttggtgggggcacaggtttgggtggttggatgaataatgaccgtgagggtgcgcgcctgctgaaaggtcctcattcccagaggatgagtctgagccgttgcacatcgcccgtgttctcatccggccggaatcagaaggctactcgtgcnnnnnnnnnnggtatgagtctgagccgtagcacatcacccctgttcttatccggccggaatcagaaggctactcgtgcaccgcgccgtcaaagcttcatacagagggcatgttctcacaaaaccaggccccttccacctcgccactcacctcctccgggtcgcgggccgcaaagtcatagtcggtgnnnnnnnnnntagagggcatgttcaaccaaagccaggtcccttccacctcgccactcacctcctctgggtcgcgggccgcaaagtcatagtcggtgcccggccgcccaaagtgctctcgctccgaggggatccaggggtactccttctccagccgctgctgcaggtcgccactctcccccatccgcttcttgtccgcatcaatcctggaggtgggaaggaggtttgcattgggatctgagcgcagtatagacatccctggaggggtatgcagggtggcgatcccaatcctggcacgctgcacctcccaccctcaacacagtatcccctcaccgtgccagnnnnnnnnnnggcatcaattctggaggtgggaaggaggttttcattgggatctgagcgcagtagagacaaccctggaggggcatgcagggttgcgatcacaatcctggcactctgcacctccctcctcaacacagtatcccctcaccgtgccaggagcttgcgcatcttcgtggatagctccgcaatctcctcctccaccagggcacgcgccttcttcgccgccgcgatctctgaatacaaggagcgcagttgaaaaaaagtttggggactgggttttgggcagtgtccaggtatccgaggggttccctagaatatccaagccactggcctatgcacattaccacgcctccagcagcccctcaagctccacctcaagtccgtaacccttccctcacagtatcactaactttcattgtaccaccctcccaccccacccccccgcccacggctccaaactctcccacccaaacatcaccacccacccgcccacggctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtcacgcgcggtctgcacccccgcccgcagcccctcgcgctcgccctcggccgcctcgcgctcggcggccactgccgccagcgcggcggc

SEQ ID NO: 40402 - DNA, 61 bp, Chlorella protothecoides
atggacagggcgccgtagatgcggcagccccccccccgactggccttgatctcctccaagt

SEQ ID NO: 40403 - DNA, 371 bp, Chlorella protothecoides
  modified_base (143)..(268): a, c, t, g, unknown or other
gccggcgcagaccggtcgccgcgcccgcggcgacctcgctcggcggcgcggagtgcgcggcctcgggcctcgaggtcggggcgctgcccgcccatgtgaccccgtgcttctcagcccagcccagcagctcctgcggcgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtgtgtgtgtggagcgagagggcagcgtgctgcgaccatgcgacgcctggccgtcggccaggcgtcgagcgccccttcttctctctttgaacaccccccc

SEQ ID NO: 40404 - DNA, 67 bp, Chlorella protothecoides
ctgcgccgttcgtgccctcccgcatgccgctcgccctgctcagtcgctcagtcccagccctgccgcc

SEQ ID NO: 40405 - DNA, 61 bp, Chlorella protothecoides
tcgaccaccaggtgcgagggccgtggcagccccgcttggtggcgatgatgatgatgggatg

SEQ ID NO: 40406 - DNA, 124 bp, Chlorella protothecoides
tccaccccgcagcctcaccaggaatcgggacacggagcgatggattttaaccagcagggcggcacgtggctccgcgtggtagtcgcagtacgcttcggccagggcgctgtactgccggcggctc

SEQ ID NO: 40407 - DNA, 168 bp, Chlorella protothecoides
cagggccaggcacgtcagcggctgcgcggacagcgacgcgcagcgcaccttgggatagggcggaacacggtgttagggttgggagggtggggttgattgaggtgggtggagcggcggcaggccaggaacaagggatcctgcccaccaaatcagcgcggggctgcagcg

SEQ ID NO: 40408 - DNA, 61 bp, Chlorella protothecoides
gaaagatgtttcggctggatgtggggggggggctgggagcacgtgggacacatgaagggtc

SEQ ID NO: 40409 - DNA, 8453 bp, Chlorella protothecoides
  modified_base (188)..(253): a, c, t, g, unknown or other
  modified_base (614)..(623): a, c, t, g, unknown or other
  modified_base (848)..(857): a, c, t, g, unknown or other
  modified_base (1322)..(1331): a, c, t, g, unknown or other
  modified_base (2156)..(2165): a, c, t, g, unknown or other
  modified_base (2856)..(2865): a, c, t, g, unknown or other
  modified_base (3736)..(3745): a, c, t, g, unknown or other
  modified_base (4336)..(4345): a, c, t, g, unknown or other
  modified_base (4410)..(4419): a, c, t, g, unknown or other
  modified_base (5483)..(5492): a, c, t, g, unknown or other
  modified_base (6242)..(6251): a, c, t, g, unknown or other
  modified_base (6999)..(7008): a, c, t, g, unknown or other
  modified_base (7677)..(7686): a, c, t, g, unknown or other
  modified_base (8027)..(8108): a, c, t, g, unknown or other
  modified_base (8178)..(8187): a, c, t, g, unknown or other
ccgcggcgtgccctcgccccccgcccgggccaggcgggagaggccggcgccggcgccagcgtgcgccggcgcgtacccgcccgcccccgcctcgggcgaggacgtgctgcgcggggtgtctggcgagtcgtgcgcgctgggcacgctgcgcaggagggagctgaggcccgagtcgtggcggggggggnnnnnnnnnnnnnnnnnnnnnnnnnnnnnnnnnnnnnnnnnnnnnnnnnnnnnnnnnnnnnnnnnntcctgcccgaactcgtcctccgagccctgctttccagccaggctggcaggggagcctccctggagcacggggacaaagccctggggcagcgagccgggggccggccggtagctgggcgcgtactccgtgcgctgggacttgtaggccgcggggcctgtcaccccggccgggctgtctggcctggcagatgcagccccctctgccgctggcatttctgagggtacagaggtggggagtgtgttggggggggggggggcgatgagcttggcaagggaccaatgctgctcaataggggaaccatgggtccactcccagaaaaggtccagaggaacaccggagcacctggccttcctgccacgcnnnnnnnnnngtgggcgggggccgatgagcttggcaagggacgaatgctgctcaataggggaatcatgggtccactcccagaaaaggtccaggggtacaccggagcacctggccttcctgccacgcttggtgaatcccatgcatgctgccccattccatggtagggcctaattttcccaccgcatgatccccactcccagcatacaggtacatacacacacacacacacacacannnnnnnnnncaggaccgtttcctgccaattcgactcggcacattgcggggatcctccccccgtccgccgccggcctcggcatgcggcgactccacgtccaggagcgccctccaccgcgggctgctgaataggaggctgtccagcctcgcgagcgcggggagctgtggcagggagtccaggagcgggcccaggtctgcagacaggaggctcatgcctcgctggccctgcccttcctcctgccgcggctccagcaggcccccaggacgaggggtggtgaaggatgctctgcgaacgcatgtgcagggagtcgggctcgctctcaaggccggggttcagttctggggtggtgaatggggacattttccatgctgggagtgtgcatgatgggggacacctgccgaggataattcttaccgataatctgccgatgagccagtcatttgaaatcagtcaatgggtaagctggagggattnnnnnnnnnnccccatgctcggagtgtgcatgatgggggacacttgccgtgtatgattcttaccgataatccgccgacgagccagtcatttaaaatcagtcaatgggtaagctggagggattccaggagggaccagcgcgtcctcgcaggcttcgctccccaggggccgtgacgaccttgagatccgggcctgcaaccgttctgcgagctgactgcccaggggaccttgaggcgccgagtctgctcaaaaaataacctggtgtgccattataagctcgttcgatgctttgcaatgcgaagagggtacccctgattcaagttttcgggagcagcccttgggcctcgggctcctcgagggggggtggagcccaacaatgtgacgactcaatctgcgatcaagtcagagtccacaggctgtcatgcatacccgctgcaattgattcgagcagggatgtcgacaagtgggtgtgcgcgaggtggttgagtgaggggtggtctcaaggcgcatgggggagctcatggcgcccggaactcgtctgtcggcaactgtcgaaagcaagggacccggatccggactcgaaaactccactgcaagcaggtgatcaagccagctgtatacggtagagagaagggaaacacaatacagtttgcatatggtatacaaaattgatgtccttggttgcaatggtcgagtcacgcatgcagagtatacagtctctgctgctcagggacctttcccacaagtgcatgagcagggacaaagctctgcctacccccaggtgtgcagacgcagcaccgacctgcccttggcaaagtttagacctgcctcccgtcnnnnnnnnnncacaagtgcatgagcatggacaaagctctccctagccccaggtgtgcagacgcagcaccgacctgtccttggcaaagtttagacctgcctcccgtccaggctctgtgattgctgacacaacatgtcattgtgcagatacattctctagcagaacggagggcttcaaaggaaacaaaaagattatgatggacggccccagggactccagggttggagctggcagatacctgcgcctgagcacccgtgcatcatcaggggacgcccagatcgaatgaagaaggacacacccctactccgccagctcgtcggcgcgggcagaggcagcggtgaccgcgttcatgaacgccgcccggatgccagccttctccagctcgtgcacaccagcgatggtcgtgcctgcgtcaaacgcgcggcgtggcaggcggtgctggatctggtgcatgcaactggctcagggtggtgctggtgcactcggccatctccctggtgccgtaaatccaaggagccctgtctgatccgccatgccttcccctccacagcgcagctacgggccgcctagggggaggcagcagccctgcaggcgaccaccttcacgtttgggaaccccgggccctgcccgcccccctggccgcctcggcaccctcatcatgcggacccgaacacccacctgccggcgaggtgaccatgtccnnnnnnnnnnctttgggacccccgggccctgcccgacccgctggccgcctcggcaccctcgccatgcggaccgcccgcccacccacctgccggcgaggtgaccatgtccttgagcgcgcccgggtgcttcccggtttccagcaccagcttggccgaccccagcacggtctgggcggccagggcctgcgccacatcgcgtggcagacccgcccgcaccccgccgtcggacagagcctcgatgaccaggaagatgtaggccgggcccgacccgctcagccccgtcactgcgctgagcagcttctcgtccacccggaagatgcggcccacagactcgaacaggcgctggaggaggtcggcgtcggcgctgcccgcgccgtggcccaggcacatggcggccgcggtctcgcccaccaggcagggcgtgttgggcatcacccggatgatcttggccttggggccggcagcctcctgccagggattttgagcgggggaaggggtcaacatgggaaggaggggccagctcaggctcgagatcacggggagctggggccgggcgcagggtgcgatggcgcagccgggatcagctgcccagatccaactcccctgtcctcaccgtgaggacagccagggtgaccccggcggcgatggagacgatgaggtgcttctcggtaagcttggggctgatctcgcgcagaaccaccggcacgtactggggcttgacggcgatgaagatgacctccgcggcctcggccacctgggcgcacgtggagcagaggcgggttgttgctctacccggcagatctccacgcatgcatatgcgagcgccgctgtgcaggaccggctgcatggtggcgtgctgggcaccttcgaacgcgcaagtnnnnnnnnnntgggtcgttcctctacccggcagatctccatgcatgcatatgcgagcgccgctgtgcaggcccggctgcatggaggcgtgctgggcaccttcgaacgcgcaagtgacgtacaaatcataaaccactgcgggactgcccacggcttggccgtcatgcactccgtcccaccgcgatgttgccgtcgacgggaacggtgccgaaggagcggaagacctccttgcgagcctccacggggtccgtgcagaagacatgctcggcttccaccatgttctggttgatgaagccacgcgccagggcttcggccatctggcccgcgccgatgaagccgatctttgtctcggtcggcatggcggtgatgcgctcaagggtcggacaagagtactcacgggcactgagataccaggactcaagaggtaaattatttttgcagtcagatgtgatacagaaacggactgtagtactctgcgaaacgaggtccactgagattagaaatttggggggatcaattggcaagttcgtgctagggtcgaacccacgtgacaagcgcgaatcgatggcaaaacgcaggatttcctccttctggtccatctnnnnnnnnnngagaggtaaattgtttttgcagttagatgtgatgcagaaacggactgtagtactctgcgaaacgnnnnnnnnnngccacgtgacaagtgcgaatcgatggccaacgcaggatttcctccttctggtccatctgcgtggtaaaagtacggatggagtccctgcgagagcagactgtgccgtcagcttcccagacacagtgttccccacagccaccactcggaactaggccagggcctccagagcgtatttctgatcaatgcctgtcagtcagttgcaattgcgatctgtccttgaaacaacatatggacatgttgacctgtatgtcgtgcgatcgtaggtgaagcccagcctctctgccggcaggcagacagccccactctcgacacactggcgacagcgtcggcgtccacggtatgcccatcctgtggacatgcccactcagaccctgcatcctgggaggactttggcgcctgcgatgcgtgcggccatgttctctcgggctccgactctgccctgttggcggagcttacatggtgtccgagggggcatggaccgctgggccagcacctacggccgggcgaggacggcaccaccgccacgcacatagtcccgccccagcatcgtgtcctcagcagtacaccgggccaggctgcccagaggacgcaggtattgcccttcttgggtgcatgctggggaacagtgcgtaggcaccctgacttgatgtgcagccacatcacatcaagccatctctgcagagcgtcctgtatccatcccatgcatgtggtgttgcccctcttccccacctgcaacccaggctaaagtcaggaagcggctggcccagctcgcccctctgctgaacctcccatccgccgtgaccatcaccgccgagggactggcggcgcgtgctgccaagctccacatccgcggtctgacctcgggcgccgggctggcagccctggtgtacgctgcctgccgcctggaggctcagccggtctccatcgccaccgtcgccggcgcagccggctccgactccacccgggtgggccactcgttcttggcgctctccagggtgaggcgcctagggatgggggggccggaagaccccctcatgctgcactgtgccgagtgagagtcatcnnnnnnnnnnaatggggggccggacgaccccgccatgctgcactgtgccgagtgagagtcatcggccaatgtatgaagcctggtatgcggccatttcacccggtcctcgccatgatccaccccacacaccccaagcctgcgctccgtgcgcaggccctggagctgcagcccccgcccatcagccccacgagtctgaccctcacagctctggaccggctggctgcggcacgcaggggggacgctgggcgcccgctgcccgccgacacgctgggcacgctgcgcagggacgtcacccgcctcctgccctggctggacgcgcaggtaccgaccggctgccgccccggcctggaggccggcgtggccctgttcctggcggcctccatggcccagctggatgtgcgcgtggatgaggtggccagcgcggccggcgtgggcgtaggccccctgctgaagcggctgggcgtcgtgcagggccacgtgcacctgctggcgcagcgcatgctgccctacgcctccagcgtcgcgcccgccagggtcgcgtcgcacctgcgcaccctcatgcgcctcaccaccgcgatggagagcgcggggggcgagggtcaggccgcctgacattggtggggaagggtcgttatgtcttctgcccagccgcaatccactcgcgattcaacggcaatactcgagtacgagtgatgctgaaaagtcctagacaaggagatgtcggctcagacggatgctgaagagaggtcctccatgagannnnnnnnnngatccactcgcgattcaatggcaacactcgagtacgagtgatgctgaaaagttctagacaaggagatgtcggctcatacggatgctgaagagaggtcctccatgagatgcaaagcaagaccccacagcagtaccatcctgtctctgatctcaggcactcgatcgggttgcaacactcctcgattaccgctccacgcgctgcacaccaatcacacccgcaatatggctgcaatggagggcgtggagacggcggggccgcaggccccgcccgaggcacctgggcgagagccactgtccgtgcccatccttgaaacggtgcgcaatgcgcagagcacccacggcctcaagcaccaggagttcagtcgttacaggtaatctatgcatcaatgtgatgtaatgccgggatggcctgatcgaatttcagcggacaggggctcacgcgcgtggtcatcaccaagccacgttttgagaacaatcttcatcgcaggcagtactgctcccgccgcctgcgccggatatacaagggtgtcaggttcctgcatgggcgcggcaggttccagaagaaggccctggagccggccaccgtcaaggatgcacggtccgtgaaaatccctgtggcctgatgtgcttggcatgggagtgatgccatggcagttgcactcctcacctcctgcagtagctcaacacagcctcgatgcattgctgcagccactaacatacctgggaaagggcattccttgctctgcagnnnnnnnnnnggctcaacacagcttcgacgcattgctgcagcctctgatacacctgggaaagggcattccttgctctgcaggtgacaccctactgcgtttcagtccccgtccccgatagcatgcagcctcgatccaacataccctcctaccccactcatcccctcgtctccttcccctccttggtcgcacagccacgtcatgatccccctggtggcctccgagcgtgcctgggcccacgccatggacctgaagaacgaggccgaatcgtccccggcgcccgggcccatgcgctcgcacctccagcgtcgcctggccaaggctgccgcacacgccgccgcgctgtgcacgctggcctccgcccgctgcgactcgcgcacctcgctggaggcccaggcctacgccctgctcatggccggcaccctggctcaggagcgcggccgcgactgggcggaggcgggggccgtgctggcacgctgccgggcgctgctcgccggcctcgcggcggcggggacctttgaccagcaggccgtctgccgctacttcctggaccaggtggagccggccatacggtattgccagtaccaggccgcgcgcgagggcggcggcacccatgctgccgccgtggcgggggccggggatgacgccgtggcggagcagctggccagccagctggcagcnnnnnnnnnnctgccagtaccaggctgcgcgcgagggcagcggcgcccatgctgccgccgcggcgggggccggggatgatgccgcggcggagcagctggccagccagctggcagccctgcaggccacgccgggtggcggcgacagcgtggcagcggctcatggaggtgcagccgcccccgccgccgacttcgagtggaggggcgcaaagttcccggtgcccgatgccaggacgcgaacggccctccaagcggcccaggtgcgatgatgtgtggtcacttttgagcgagaatgaagactgagggcggggttggcgatgagttgcccagtcgggtgggggcactccagtggtnnnnnnnnnnnnnnnnnnnnnnnnnnnnnnnnnnnnnnnnnnnnnnnnnnnnnnnnnnnnnnnnnnnnnnnnnnnnnnnnnngggggtcggtgaccttcacacgaccatgcccgcctctcgcaggagcgggagagggagctggtcgccggcnnnnnnnnnntggggtcgctgaccttcacatgaccatgcccgcctctcacaggagcgggagagggagctggtcgccggccaggcggacgccggcagcctggagaagagggtggccctgtccgaccgcgtcgccgccgcttatggtgacgcgctgtccggggtcaaggccgcgctggccctgggccagtccgggtcggtcgaggagctgcgggcgctggagcgggcggtgcggggccgggtgctggacctgacgctgcggcggtattcgctggtact

SEQ ID NO: 40410 - DNA, 100 bp, Chlorella protothecoides
gacccgttgctgcgaagcggtgctcagggtaaggctgcggggacggcagtctccgatgctgactgcttgtcggggcaatgttggggggggggggggtgtc

SEQ ID NO: 40411 - DNA, 61 bp, Chlorella protothecoides
ccagacacaccggaggcagtggagtggcgggctcggcgatcaatcatcgacagcatcgcct

SEQ ID NO: 40412 - DNA, 120 bp, Chlorella protothecoides
gcccgctgctcgtcgccgtgcgcctgctgcggtttgcgcggcgcaacgcgccggccgtcgccgtcacgcttgtcgccctcgcgctggcctccgccgactcgaccctgcgcctggtggccg

SEQ ID NO: 40413 - DNA, 159 bp, Chlorella protothecoides
tggcggtggcagctggagtggcggcggcgcccgcttgcggtgtgatgcgtccccaggaccccctgggaccccctgcccccctccgcatccacccctaccatacctcaccactccatcatccacccccaacccactcccaccccacccaccgccaggtgg

SEQ ID NO: 40414 - DNA, 3708 bp, Chlorella protothecoides
  modified_base (515)..(524): a, c, t, g, unknown or other
  modified_base (1142)..(1151): a, c, t, g, unknown or other
  modified_base (1633)..(1642): a, c, t, g, unknown or other
  modified_base (2322)..(2331): a, c, t, g, unknown or other
  modified_base (2653)..(2662): a, c, t, g, unknown or other
  modified_base (3464)..(3535): a, c, t, g, unknown or other
ccgggccggcgcccccgccccggccgccgggcgtcggcgccgttcacgacaccgcaggcgcgccgcccgcgcccgacccccggcccctgcagatgctggcggacctgacgccagcgcagcgccagcagctcctgctgcaccacgctatcctcatgcagcgccagcgccaggtggcgctgcaggcacagcaggctggcctgccggggcagcgtgggtccctgcctgcgcagggcccgctgcggctgcagcccacgggccccaggcagaccgcgcaggcgcaggcacagcaggcgcagcagcagcgacacgcagcgcagctgtttgccgcgcagcaagcgcgcatgtttgcccccggacaggcgcccgccgtggtgagcggccgcccgctgcccgggccccaccccgggcgtcaggggagcagcacgcttccccctgcagcggccgccccccgcccgcccgccggcggcaccgtctgggcgtcggcgcagcgacctggcgcgggcggctgcgccccnnnnnnnnnntccccaccccgtgcggcaggggagcagcacgcttccccctgcagcgtccgcccccctcccgcccgccggcggccccggctgggcgccggtgcagcgacctggcgcgggcggctgcgccccgcacgctttcctgggcttcccggcgccctacggggcggcggtgtcgtacggtgcgggccctccccaacagcacgcttacccgcagcaggcatacccccccccgcagcacctgcggggccaggtccggccctccgacccggcgccgtcggtccctgccgccgcgctgagctacggcgacctcattcggcgctgctcgcccactccggagctgtcagggacaccctccctgcccaatggtgcctcgccccacgcctcgggcgggggcgcggccgaagccgcgtcgccgttcctgccggcgacgggggagtggagcctgccccacttctcgcacgcctcgccctcgctcacgcagctcctgcgcggcgggtcgggggctcagcaatcccaggggccgctggtcttcgttcccgacatcagccccggcgcggggtgaagggtcctctgcgtgcccggtcctggtgcccaattgctgagccatgcgcgcacaccgtcacctgnnnnnnnnnntcgcagctcctgcgcggcgggtcggggactcagcaatcccaggggccgctggtcttcgttcccgacatcagccccggcgcggggtgaagggtcctctgcatgcccggtcctggtgcccaagtgctgagccatgcgcgcacaccgtcacctgcctgtgctcggcggcagacgcagctttccgtgcatgcaccatctggtctggcccaccctaccgcttgcaactccaaaaggagccgcgataaccggcagtgcaaaccttggttcagaccctgagaaaggctgccatgaaacggtacagacgggcagcaaatttcagtatcagcttgcactgcaatatctttgtattattacatagtgtgagcggatgcagtgacaagagagatgttatggtgtgtcttttacaagggaacctggtacacacttctgcacagcttcagcaatttccccacttccctcgctcgcgctcaggccttcaggtactnnnnnnnnnntcgtgcatgcaccatctggtctggccctccctaccgattgcaactccaaaaggagccgcagtaaccggcagtgcaagccttggttcagaccctgagaaaggctgccatgaaccggtacagacgggcagcaaatttcagcttgcactgcgttatcctagtattattacatagtgtgagcggatgcagggacaagagagatgtcatggtgtgtcttgtacaagggaaacctgttacacttctgcacagcttctgcaatttccccactcccctcgctcgcgctcaggccttcaggtactggcccaggtcctcgcccgacagcttctccagctcggcaaacagcgactgcgcggcggcctccacagccggctcgccatcctccagcagctccgccaggaagggcagcgcctccggcagcagcgccaggtactcctcgcccagcgcggagaccagcgcgcggagcgcacccagcgcggccaggcgcgtggcaccctcgcgcgcgcgcgtccgcatcagtaccttgtgctgcagcggcttccaggccgcgtccccgcctgcggagagcgccagctgggccagggcgccggcagccgagcgctccagcggggaaagcgtgggcgccccggcaccggcgccggcgccgctcgcggcacgctcctcggcgggcgcaaccagcgcttccnnnnnnnnnngcccggcaccggcgcctacgccgctcgtggcgcgctcctcggcgggcgcaaccagcgcttccacggcccacgcctcgtcccgcagcgcggcggcgacctccggcggggggtgcgcctgcagcaggtccaccagtggggtgagcacccgctccaccttggcctcgtccaggaagcgcggctccgccgtgtcgtactggaaggcacggtgcagcgcgcgcgtcgcctggaggcagtgtgtgaaaggggggcggtgaacgtgtcagatgagactcattcatgcatgggtgtaacatgttgcaggattgctgcgcacgcgaggccnnnnnnnnnntgcctggaggcagtgtgtgaaaggggggctgtgaacgtgtcagatgacactcattcatacatgggtgtaaaatgttgcaggattgctgcgcacgcgaggccactgagacgacgtgcactgccatctgtatggaggtgatagggctggcggcgagggttctcagtgtgcgcggcattgtgtgctctccaaaccctcaccccccccacaccgtccatccccctctcaaaccctcacttaccctgagggccagctgccagtccgcgggcgtggggtctgcagcaccttcccgctcggcggcgccgctcttgcgccgcttcttctccggcgcgccggcccgtgccgcgctgccgctgcccgacacgcggttcagcgcccggaccgcgtcgtccagcagcggcttgtagtagggcacgaagatggcgcgcagctgctcgaccagcgcgttgaccgcgccgaagaaggccagcaggcggtgcgttgggagggccgggtcggcggccgcctccgcggcggggacgtgggtggcccagtcgtgcaggcgcaggaacaggggcttgaaccgcgcctcggacaggcgcagtgccagcgcgcacagcaggtccagcgcggcggcctcgacctcggctgcggcgcggggcgtggccgcaaaccgcgcgcgcaggcccagtgcgcgcagcaagaaagcgaggagcggtgcgtggtgcgtggccacctcggacggcgtcatgcgcgccagcgtggcgcccagcgcgcgcagcaggcccagcgcggagcgcgggcctgcggccgccgccgcctccannnnnnnnnnnnnnnnnnnnnnnnnnnnnnnnnnnnnnnnnnnnnnnnnnnnnnnnnnnnnnnnnnnnnnnncgcgtccatggcgggctggaggaagaggcgcacaggcaccgcgcgggccagccggtccgtgaccccggcggccagccgctgcgcggccgtgggcggtggtgccgttgcagtcgctgcgctttcctcccctgcgccgccgccgccctgggccaccagcgcggggcgcagcagcg

SEQ ID NO: 40415 - DNA, 109 bp, Chlorella protothecoides
ggagttgggacggcggatggggtctgccagggccggcgacgcctcctgcggggggaaggggggagtggtgagcaaaacgcctcacgtgaggttctttgcgcagcaagcc

SEQ ID NO: 40416 - DNA, 70 bp, Chlorella protothecoides
gggcgatgaaggatagacttgggcctcacccgatggcggcagccaggaccccaaccattactctgacctg

SEQ ID NO: 40417 - DNA, 105 bp, Chlorella protothecoides
ttctggcatgtttgcactcgcctctgtgccatgctgcctcaagccagggtcgggcccttcctcctcagtcagccacatcgaccccaagccttccttccacaggtc

SEQ ID NO: 40418 - DNA, 370 bp, Chlorella protothecoides
gtatggcggggcccggtttttgtgtgttaaatgtcggcccggggggtcatgatcccagcccttgcgcactgtgtctgctcctcatgccctctggggcgccagaatgggtggggcggggcacccgcggatcggatgaagatgtcacctgcactcggtggcgccgcccgccggcgtcgccgacaccccggtgtcgctgccgccgcccgcttgctggctctgcatgcacacccgggccccgcccccgccgccgtgcaaaccctcaatcgcacctgaatccgcaccccgaccacccccccctccacaccaccaggagatggaggagcggagggtgcgcgccctgaccccgcgcgagcggccgggcgggaccccg

SEQ ID NO: 40419 - DNA, 61 bp, Chlorella protothecoides
gactcctcggggctgggagagggcgactccgcagggctcggagagggagactcctgcgggc

SEQ ID NO: 40420 - DNA, 76 bp, Chlorella protothecoides
agtgcgtgttcctttgtgcagggaaaacgggtggcagcagcaatcctgcaccgccgacagcgatgcaccgatccct

SEQ ID NO: 40421 - DNA, 61 bp, Chlorella protothecoides
cgctctggtggacggcgacgtgcgtgacgtcgtggtgggcgtcggcgccgcgctgggcgcc

SEQ ID NO: 40422 - DNA, 61 bp, Chlorella protothecoides
ggcgacatgacgactgcgagacgcgcatggacccgccatggacacacgtcattgtgcaagc

SEQ ID NO: 40423 - DNA, 65 bp, Chlorella protothecoides
ccgggggggcgtggaactgctctgcctgccggggaatggcccgctccctgccgacgtaggcatgg

SEQ ID NO: 40424 - DNA, 67 bp, Chlorella protothecoides
atggggtgccgggcggtgagtgggttacccacatgagctgtactgcttggtgggtcgccctaggcat

SEQ ID NO: 40425 - DNA, 129 bp, Chlorella protothecoides
tcacacccagtgcactctgtgcatgtcgtagcatcaaactcttggtgagaatattccacatcacatcgcctgctcccctgctgggaggtcacccaccctgttgccggtgttacaatggaaagaatgggt

SEQ ID NO: 40426 - DNA, 127 bp, Chlorella protothecoides
cctggcgctcgcaggcgggggcggctctgcacgcccatcctacacccctcctcaggggctcctccagcgcggagtggatccgcccagcggacgaggaccccttgcgccggcgcaggaggctcagggg

SEQ ID NO: 40427 - DNA, 76 bp, Chlorella protothecoides
gccgcacccgatccccggccccccgacgcccgccccccgacgccccacctcgcccgggctgcgcacaacccactcg

SEQ ID NO: 40428 - DNA, 67 bp, Chlorella protothecoides
actgccatcgcgtcccgcgctgagctgagaccagacggcgccatgtctggtgccttcttgctagact

SEQ ID NO: 40429 - DNA, 65 bp, Chlorella protothecoides
gtcaggtacagaggtgggaaggtgccatgtctccctggtgacccacatgtgcctgtatgaatatg

SEQ ID NO: 40430 - DNA, 127 bp, Chlorella protothecoides
tcccgcaccagggcgcctgcacgcagcgattgggagcaggagcgctgtttctttctttccttcttgagtaagagggggtaggttcgaggtggctacagaatgcacagaccaagggtctgtcggcctg

SEQ ID NO: 40431 - DNA, 71 bp, Chlorella protothecoides
atgtggagagctggcgagcaggagacctgtgtggaaggctgatgctggattgtgatcaggctgggcatggc

SEQ ID NO: 40432 - DNA, 61 bp, Chlorella protothecoides
tggtgcgatgcacattgtcggtgtggcagggcctcgagcacattgtgccgatgcaacaatg

SEQ ID NO: 40433 - DNA, 61 bp, Chlorella protothecoides
catcgtctacaactttgaccacccaccccatgtggtgccggcccacctggcggccgcgccg

SEQ ID NO: 40434 - DNA, 61 bp, Chlorella protothecoides
gagttcctgacctacggctggatccccgtcgtcgcacccctgtgcgggggagcggcggccg

SEQ ID NO: 40435 - DNA, 126 bp, Chlorella protothecoides
ctctgcgccgtgctcgaccagcatcgcgccatcgtcccaggagccggcgtcatcccccccctgactctcctccgtctccatttcctcctcatccagcagcaaggagtcgaatgcgtgcgaggacag

SEQ ID NO: 40436 - DNA, 61 bp, Chlorella protothecoides
acaggcacgtccctggtgctattggagcgacccctccgtcgcaagctggtccgatccccgt

SEQ ID NO: 40437 - DNA, 76 bp, Chlorella protothecoides
accccagctgatgcgtttgagagggcgaggggggcgcttccgtgaagaggttgccacccctgcccctcgcgccgcg

SEQ ID NO: 40438 - DNA, 94 bp, Chlorella protothecoides
ctggaggggagggggagggggatttccatcgacaccagcagattgggattgatgtctgttttggcgacggcgctggcttgcggacctcccgttt

SEQ ID NO: 40439 - DNA, 6618 bp, Chlorella protothecoides
  modified_base (342)..(351): a, c, t, g, unknown or other
  modified_base (1422)..(1431): a, c, t, g, unknown or other
  modified_base (4018)..(4027): a, c, t, g, unknown or other
  modified_base (4576)..(4585): a, c, t, g, unknown or other
  modified_base (5867)..(5887): a, c, t, g, unknown or other
  modified_base (6241)..(6250): a, c, t, g, unknown or other
cggccccgccgcccagcgcgcgccggagcgccgcagcgcaggcagcggcagcagcggcgccacggtgtccaggctgcgcgcgtagacggcgctggcgtcggtgacggggcgcagcgcacaggccagcgcgatgtactgcgccgcgtcggcaaaggcgcggcgcacgcggcgcacgcgccgcgccggctctggcacaacgtccagggtggcggagtcctcgtcggcggcggggtctcctggggcggtggggagcagggccggctgcgtagaggggggaacgagagatgggaggggaaggagtatgttttatggagggcagccaaaggacaaccgcagcatgannnnnnnnnnccgcacgcgacgcgccggctctggcagaacgtccagggtggcggggtcctcgtggacggcggggtctcctgggacggtggggagcagggccggctgcgtagagggggaatagagagatgggaggggaatgagtgtgttttgtagagggcagccaaaggacaaccgcagcatgagaggcgggagttggaaagcacaagacaacagacaatacagcggagcctctggcatccacattgcgccaagctaccacattgcagcagaaacacaaccatccaaccaaaccccggccgccatcccccccacctcctgctggaggaggtcggcagagtccacgccctcagccgcacggagcgcagcagcgagggagtagagcgcggtcccggcgttgtacagggcccggtggaagcccgggagggcgcgggccgccccgcggaaccgcgccaccgcctggcgcagcaggggccccgcctcggcgggcggcaggcccgacgccagctcctgcagcgccaggccactgttgttcagggcctgcggattagcggggtccagggccagcgccgcgccgtaccggtccagggcggcccgcagcgtggcccgcccatcgtcgccgtcgtcgttgtcgcccaggcggtacagatcggagagcgcgacgccatggttgtacagcgcggccacgtgggtgtgccccgccagccggctggcctcctggtaggcggtgcaggcggccagcaggctttccctctggagatccggggcctggcctgcggcctgctcctgcagggccagggcccgggtgtaggcctggacgaagggggactcctcggtgctggctccgtccgcgggctgggacaggcccccggcgagggtggcggaggccgcgcgcagctccgcaccgagcagctggtcctggatcagggtcatcgtgtaggcatcaccgcatccaggggcagccctggtgggaggctggcggaggtgcgacgacggccagactccgggaaactgctcccttacttccacccccgtacgcgctgcgtcctgtcaagggcgatgcagagccaggatagctggatnnnnnnnnnnccttacttccacccacgtacgcgctgcgtcttgtgaagggcgatgcagagccaggatagctggatggctggtgatcggacagacgcgcatcaggccatggcgggatcgagcatccatcggaatgcatgatcaagggtcgacagatcgccgtcacgcacgcgcgcgccaggtcgacgactgctgcaccaacatatcagagcagatgcaggaacgagacgcgcacgcaccatggctgtgcatgtttgcatctaaaacactgttctgactggttccggcggccgcacgaacggaccaggatgtgcggcatcctgtgtcttgtgggccgggacgggggccagggaggggggctgggcctcagcccaactgtgcgggctgagatgctggagtgcctccgaagacgaggcccagaccaccagagcgttcatgaggtggggtgattgagtgtttgatcttcaatcagcaccacccactggcaacaaaagggctcactgggcgcccagcacctctgcgcatgggcagactcggcctgactcgcccgtccacgcaggtcgccaccccctccggcgcgacgctggagatgcacgggtccctgctccagctgaggggcagcgccccctcccggagcccactccttgacccagcgacgggatccctgctctgcttcaacggcgaggtgtttggcggcctgccggtctgccccggcgccaacgatgcccaggcgctattttgcgccctgacacaagcgacctccagccccatggaagtgctgtcgagggtgcaggggccttgggccctcgtgtactggcacgctccctccggcaccctgtggtttggccgggatgccacaggtgaggggccgctcggcattgccggttgcacccgcagccctgcgacatctggcagacccacattctcctctgcgtgcgtcgacgcaaccacatgtctgtcctgttgtaaggcccattcgaaatgcagccccaacccaccctgcgcagggcgcaggagcctgctctgcagcctcgccatggatgaggcggagagtgctggttcaggcgaacaaccatcgctgcgccttgacatcaaaacgagcctgtcgtttcagcaacagcccggtgctcccttcatcctctgctccctggacacggacccagggtccgagggggccccgcccctacacgagcttccccccggcctctactccctaccgctggggcgaccgcaccccgccagcgctcaccagtttcaccctcagcgccacccctggccctgggtcgcccccctgcgccccagccacctcatcccggaaggcccgcagggccccacagcccggccctcgcccgaggccctgcggcgggcggacgagcgcgtgctgtgcgcgctgcgcgccgcagtcgccgcgcgctgccagctgcccgagtgcgcccggcctggccacctcaagaccgccgccccgtcaacccaggcccccctgatggtgctgttcagcggcggcgtggactccacgctgctggcggcgctggcgcaccaggcgctgccgccctgcacgcccatcgacctggtctccgtctgcttcgacgcggggcggtcgccggatcgcctgtcggcgctggacgcgctgcgcgagctccgcgcctgggccccgcgccggtgctggcgcctcgtgcgcatcgactgcggcctggccgacgtggacgcgcactcgccgcgcctcctgcgcctgctctcccccgccgcgacggtcatggacctgaacatcggggcggccctgtggctggcggcgcgcggcgcgggcagggcttgtcttggggatggtgaggcgcagggaggggcccccctggaggggcaaggggcgcaggcgggggacgaggcgggcatccagggggtgggcgtcgaggaggcgggcggccaggagtacacgtcggcggcacgggttgtgctgatgggacacggcgccgacgagctctgcggcggctacggtgaggctggaaaggcagaagaactgggaatgggggtgcatcgatgctcggtccatctcattcccaagcacttgtgaaattgccggactgagaatgcgcagccttttctacagggtttggggtgcagtgtgtccctgtcccacccattcctggagtgggctcggaaaggcatggtgctgggtccccctcgggcgccagctgatattaccatctggaagcatgcttgctcaatcagatgttccctcccacacggcatgctcgagttgccttacccccaaatcacccagatacaccgcacttcccaacaggccggcatcgcacaaagttccgggagggcggctgggagggactgaatgccgagatggcgctggacatgcagcgcctttggcttcggaacctgggcagggacgatcggctggtggccgaccatggacggtgcggggacgtggaaatttaagaagtgttttccagggcacaggcctgcatgtctgggtgggagggggggcggacacggttccagcaccagttcttgataggcagcacgcctcatgacacccaattacccacccaacaccacactctgccagggaggcccgccaccctttcctggnnnnnnnnnnttgggggggggcggatacggttccagcaccaattcttggtaggtagcatgcctcatgacaccctgttacccacccaacactacaccctgccagggaggcccgccaccctttcctggatgagggcgtggtggcagccgtgctggacagtcccttggcatgtgtcacagacctcaggctgcccagcgggcagggagacaagcgggtgctccgcgccgcgctgtgcgcgctgggcctgccccgggcggccgctcggccaaagcgggccatccagtttggcacccgcatcggcaggctgaacaacatccggcagtttggggggacccggaaggccaacatggcaaacgccggcagcgtgctcctctcagacctggcatgcctgccgcctgtggagagcgctgctgcaggccggggtgtgggacagcatggtctgctgtctgatcaaccagcatgctgccccgtccatagactcttccctggttaatggtgagagttgtccacacagagttccgggatgatttttactgcactaagctcaatcgttgtgacctnnnnnnnnnnaccgtccatagacttttccctggttaatggtgagagttgtacacacagagttccgagatgatttgttactgcactaagctcaatcgttgtgaccttgtcccaaattctcacggccttgacgcgcacgtgcacaccgaagtgatctaagagtcggcggcctttgtcccaggagcacatggcgcgcctacctcccgcaacggttgcacacggtgccggggcggcagtgttacgcaggctcttagcactgcccacccctcttcacctcggcacccgacctgaatacccatcaagcatatgctgagtccccaaatctgtgggaaagagaccccctggcactgcactgcggagggagcacgccaacaatctcaccaccgccgctggcccgcccctgagctctgagctcgcccgctgcatcctcgcggcgctgtaaatcatcgtgccgaccaaggtgagctgtcgatcacttcgggcggggtattgggctcctccgaggcggccactgctccggcagtggtgcgtgctgccggcaactgctgggggtcgctgccttcatggaacctcactggtctgtcgttaagacatgcatgactgctagctcagcccatgctggcccttctcaggcaatatgggtgtccccgaccaattttgcactttctcgcggccccgaggtttcgcggatcacaaagctgaaaccctccgcgctctccaattcatccttcccccccctccattcagcaaggtactcacactgcgccatgtacgttgcggagcatgtgttcgccgagcccctgaaggcgcactgcccccacctagagatccccagtcgggatgtgtcgagcctggcgacgacgcagtcggagggaggcacctccccctctgtgagcagcccggcaagcttcgcgcagcaccatgacaaggtcggctggggctcggggcaggggtgctttgggagtctgaggctttcagcgtggatctggtggatgtggcctgcccggcatgcccctctctgcacaggtttgaaggcctgccacccacactcagtgcatccctgcaccctctgccatcattcaggcatctttggccatgcaggaggccgtgttggcggacacgcagacagcctcttgggtcagcggcgggacagctgtccttgcgccagggtgagtcctggcgtgatggagcccaggcagccaggtgcccatgaggcactgatgagggcccaccctccccatgaccgtacctctccccctcccgacatggtcgcatgctgccgacacctcccgtnnnnnnnnnnnnnnnnnnnnngcatggctcacccatgcgcctcggccacgtggactgcccctgcctgcctcccctgcccccccacctcacctcgcgaggtttttttggcgagtcgaggcggaccagccccacgaccacccccgccaagcgggcaccccccgcgctgttcaaggcgcgcgagggcttggtctgcggagggtttggggggtgttgcggacagcagctcttccatgtggactgctcgtgccagcctgcactccaaccccaggccctgtactcccgcgggagccctcgtcccccgccgcgcatgcattcatccacactgcgcccgcattccccttcccaccaccgccagggtcccccgcccgccagcannnnnnnnnntgcgcgagggtttggtctgcggagggttcggggggtgttgcggacagcagctgttccatgtggactgcttgtgccagcccatactccaatcccaggccctgtactcccgtgggggccctcatcccccgccgcgcatgcatccatccacattaggcccccattccccttcctaccaccgccagggtcccccgcccgccagcagcaccctggtccctgcctggcgccccttggacaccccccagatccccccccagaatggcctgcacctcctgctgcgcgtgtgcgaggcgctggaccccgacggcgcctgctcctccgcgctgctgggcggcgcgcatgctgcggccgccgcggcgcggccgatgccg

SEQ ID NO: 40440 - DNA, 67 bp, Chlorella protothecoides
aaagaattgcctttctgactcgagttctgtatttttgatcatgaccggaatttggagtcaatcgtgc

SEQ ID NO: 40441 - DNA, 75 bp, Chlorella protothecoides
tcctcgatgctcatcaggttgccgccgccggcgctgccggcccctgcgccggccgaggtgtccaccacctgctgc

SEQ ID NO: 40442 - DNA, 79 bp, Chlorella protothecoides
gcaacacgacgcgcctcttccaggtgggttcctctttattattcgcccgcaaacctcgcccgcatccctcctccccaga

SEQ ID NO: 40443 - DNA, 61 bp, Chlorella protothecoides
gcatggacctgctgacggagcacgcgcaggggggccctgccagtcccctggccgcagcggc

SEQ ID NO: 40444 - DNA, 24805 bp, Chlorella protothecoides
  modified_base (648)..(657): a, c, t, g, unknown or other
  modified_base (3180)..(3189): a, c, t, g, unknown or other
  modified_base (3737)..(3746): a, c, t, g, unknown or other
  modified_base (4735)..(4744): a, c, t, g, unknown or other
  modified_base (5130)..(5139): a, c, t, g, unknown or other
  modified_base (5203)..(5212): a, c, t, g, unknown or other
  modified_base (6460)..(6469): a, c, t, g, unknown or other
  modified_base (6996)..(7005): a, c, t, g, unknown or other
  modified_base (7642)..(7651): a, c, t, g, unknown or other
  modified_base (8329)..(8338): a, c, t, g, unknown or other
  modified_base (8549)..(8558): a, c, t, g, unknown or other
  modified_base (8622)..(8631): a, c, t, g, unknown or other
  modified_base (8877)..(8886): a, c, t, g, unknown or other
  modified_base (10814)..(10823): a, c, t, g, unknown or other
  modified_base (11306)..(11424): a, c, t, g, unknown or other
  modified_base (11545)..(11554): a, c, t, g, unknown or other
  modified_base (11687)..(11696): a, c, t, g, unknown or other
  modified_base (11840)..(11938): a, c, t, g, unknown or other
  modified_base (12646)..(12655): a, c, t, g, unknown or other
  modified_base (13509)..(13518): a, c, t, g, unknown or other
  modified_base (14252)..(14261): a, c, t, g, unknown or other
  modified_base (14928)..(14937): a, c, t, g, unknown or other
  modified_base (15007)..(15016): a, c, t, g, unknown or other
  modified_base (15421)..(15430): a, c, t, g, unknown or other
  modified_base (15992)..(16001): a, c, t, g, unknown or other
  modified_base (17233)..(17242): a, c, t, g, unknown or other
  modified_base (17489)..(17498): a, c, t, g, unknown or other
  modified_base (17861)..(17870): a, c, t, g, unknown or other
  modified_base (17935)..(17944): a, c, t, g, unknown or other
  modified_base (18168)..(18177): a, c, t, g, unknown or other
  modified_base (18704)..(18713): a, c, t, g, unknown or other
  modified_base (19345)..(19354): a, c, t, g, unknown or other
  modified_base (20077)..(20157): a, c, t, g, unknown or other
  modified_base (20378)..(20387): a, c, t, g, unknown or other
  modified_base (20467)..(20476): a, c, t, g, unknown or other
  modified_base (20568)..(20763): a, c, t, g, unknown or other
  modified_base (20848)..(20857): a, c, t, g, unknown or other
  modified_base (21244)..(21324): a, c, t, g, unknown or other
  modified_base (22159)..(22168): a, c, t, g, unknown or other
  modified_base (22894)..(22903): a, c, t, g, unknown or other
  modified_base (23021)..(23030): a, c, t, g, unknown or other
  modified_base (23108)..(23117): a, c, t, g, unknown or other
  modified_base (23427)..(23436): a, c, t, g, unknown or other
  modified_base (24008)..(24017): a, c, t, g, unknown or other
cgccaggcgcggcagccgccccagcgccagcgccagggcctcggcgtcggccagcgcggccgcgtccccgcccgcggcgacgtatgactccagcgccgccgcctggtccggggtggggatgcagtgcagcagcgcgtccacatcctcgccggaggccaggaggcgcgggtcgaacgcggcggcggcggcggggaccgcgcgccagggcgcgcgcaggcgcgacatgcggatgccgatggccgtcgccagcttcaggtccagaaccgccagcgcctgggtgcggggactagagcccggggagggggtgggggccgaggcgcctggggtcgcgaggaagaggcgggaggagaggggaggagatgaagtggggtgagaaggccaggcggcatgtgtgccctgcaagtgtcgctgtgaggaggggacaccgacgacgtccgagcaccgcatgtgcaagaccgcctctgccgcccccggctcccaccagcaaacgcacgtcgcggctgcacggctccaaaggcctgctccaggctgagcaggtccagcgaatcataggccggtgggtgggtctcccagaacgtcccctccaccctgggtgcacggaggggcgtgggccaggttggagaaggagggctggaggggaggcgggcnnnnnnnnnncgcaggtccagcgagtcataggccggtgggtgggtctcccagaaggtcccctccaccctgggtggacggaggggcgtgggccaggctggagaaggagggctggaggggaggcgggccaacgggcttggcattcgagcctctcatcggatggagacgcagcactccgtacagtgccttctcaaccacaacatacacctctaccacacaccaccacacctctgctccgggatcttgtcccagaaaaaggcgcgcagcttgcgtccgggggtggggccagggtccaccgcagggtagcgtggggcctcaacgtccgagcccccaaccaccgccggctttgcaggggtggggcgcttgggcgtcgaccccgtgccccctcctgccctcctgggcgggggcggtggcggcggaggcccgggggggcccttccttccagaccccggccgcggtgggggcggcggcggcggcggtgacctggccgccgctcccttggcagtggcagatgctgcctgctggggtgggacggctggcacccgtggcgcctgcgtcgcgggcgatcggggcccctcctcttcctccccttcctttgtgtcgctaccggctggggtgagtatgctgagcacgctggccttcaggatctccagctcctgtgaggagtgcggtgcggtggttggatgggtgggtcagctgcagcactgcgaggtgtcactgcagtattgattgcaggtcccttgctgcaaccaccaggcgcacgcaaacatgtcgcggccgcagcgccacgacgacgacgatatagccatcggattcacaacctcctgcaactcaccgctgtgacaaaggcgttgccaaactctctcaggtctgccatggccttgaacaggcccagctccaccagctgcttcacgaagctgcggcgcagccggggattgtccccggcgtccccctcggggctggtgcacacgatgaccagcaggcgcaggcattggtcggtgaggtccaggtccagcgcgccgcccgccacttgaccctggatgatactcatgagcaggggcaccagcgggcgccggccgtgcgggccctccaggaaggtcagggccgggtcggcgtgggggctgggtgcagggggctcggcgcccaggctggtccccagggcctttgccatctggctcgacagcggctgtggagggggggcgggttccctggctgcggcaggagtgggggaggcaggctgcgaaccgggttccaggcctgtagacgactccaggacttgacggcctcctggtgactccccctctgtctgtgcgagaggtgtggtcggaatcgccactgcttctgcgactgccgtgccattgtcgagccgagggcgctcaagtagactgctcttgggagcgctcttgctcagagtagtgggactggcgcgcctctgtactccaggtggagggggcggcggcggcggtggagcttgtgggggcctcttgctgggcattcctccagccgaaggtggtggtggaggaggcggaggaggagtccatggtgggggcctgccttgtcccggtccagatgggaggggtggagggggcggaggagtgcgaggggtgcccctgccctgcctaccaccaggtggggggggaggtggggccggcggaggggctccacctcccgtccttgcaggcccggcagtgcccgcgtctggcgcgcgaggcatcgcgctcgccgaagcgcccccctttccacccgacgccggctcctgcgccctgcgagctccaccactgccctcggcctcccccggcgcccagacagcccagggcccgccgaccgcccccgtgccgaagcacctcagcagcgtgcgcagcgtgaggcggtagcccgtccccgagaagaggcacgcccgcgccaggagctgcatggacagctgcgtcgtgcccggtgcaccgggatccagcgaggcgcagaccgcagggaggaaggcggggcggtccaggcacgcgcacatgccgggcgcactgctcaccagggagtgcagcgcctggagggcggccgccatgctctccagtgccgccgcagtgaagaaggggtcgcactcggtccacaggcgcaggtgcaggagcagcgcctgcggggagcgggaagggggtcgaggtcgagcggggcaaagtcgggtggcctcggaagccgcaccgactctgcagtgaatccgatctgcatgatgtagtgcattgaagtccggcgcggggccttgcctcgagcggctggcggagtggtttgcatctgtgcgcacagaacaagtgccctcctccaggtccccgcccgcacctccagcaggaaggcggggccttgcaggcccacaaacacgcgcagccagttgggggtgctgaacaccaggcactcgttcaggtccagcaatgtggaggcggcgggggtttgccgcagcatcgagcatgccatctcggggctgtgtgggagggggtcaaggggccagcgaaggggttgactgtctcgagtttacctcatgctgcttccaccccnnnnnnnnnnctgccgcagcatcgagcacgccatctcggggctgtgtggtagggggtcgaggggccagcgaagggttttactgcctcgagtttacctcatgctgcttccaccccccgcctcgctcccacctcccccccgcccgcaggcacccccaccctcacctgaggtacaggacgccgtgctgggaccaggcgcaccagtccgggcgggcctgcgtgaggagtaccaggaacatggcctgggcggcagtggcctggccgtcccccctctccgccgccagctggcgccaggcctgcagcagctccagcgcgggccccgccagcgcgcaggcggggccctggacgaatgaggagccgcgctcaaactgctcggccagggagagggcgggcagggccgcccccagccccaccatcagcgcctccacgctgggcctgccgcgccccagtggcggcaggccggccgcgtagcggggcgcaccggaatcgtccccggtgccactcaccgcggcggggggggtgctggggatgccaacatgcgcggcgccggcctccccgcgnnnnnnnnnnttcgtccccggcgccactcaccgcggcggggggggtgttggggacgccaacatgcgcggcgccggcctccccgcgcctctccgccccgcgcctctccgcgccgcccttgccggcgccggactgggtggcggggagcagggcctccagccatgcggaggccacggcctgggtgggggcctgcaggtgccaggtggcgccgtccggcgactccacggtgaagcgggcgtcgtcgccgccgggtgagcggctgatgcgcgcgccgcgcaagtccaggcagccggatggggacccggggtctgacttgaagtagaggagcagcgggacggggcggggctgcagctggaagcgccggggccgccagctgggtaccacatcccctgcaaagggagttggaggtggtgttacaccgccaagctggactgactgggctcttgctcctgacgtgctgcctcagcagaggcttgggaccttacgctgtgcagagaatacgaatcaaacacctcagccatggctccctgagaatgcaactggtgtctccccacgcacacctcttttgtataatacgccctccatgtgccgtccttggcctcacatcacaatatccagccgcttgctaaatgcatgcgggttacggaagagacaggctgctggaactcgacgagcgtcatcaccctctgacagacgctcatagagcagtgcgcatcaacatgatacgtccgtaaaacgagtcacaggtgtctgggccagtttgctcagcgatcgtctacatcaatgggagaaacctccaccctcctggccgggcgtgcgcgcgcgcgaagtcacggagatcgcgccgaagtgatctagacctataccccccctcgacgcgacaccctctcaaacctgcacaccgcggggggcccactgtcgcccgctcgtgcggaatgttggtttaagggctgcccatgacacagaaaccggcataatgatggcggtcgagacctaccggnnnnnnnnnntagccgcttgctaaatgcatgcgggtttcggaagagacaggctgctagaactcgacgagcgtcatcaccctctcacagacgctcaaggagcagtgcgcatcaacatgatacgaccgtaccacgagtcacaggtgtctgggtcagtttgctcagcgttcgtctacatcaatgggaggaacctccaccctcctggccgggcgtgcgcgcgcgcgaagtcacggagatcgcgccgaagtgatctagacctgtaccccccttcgacgcgacaccctctaacacctgcacaccgcgggggccccactgtcgcccgctcgtgcgggatgttggtttcagggctgcccatgacacagaacctggcataatgatggcggtcgagacctaccggnnnnnnnnnntgaggggggacccaccgaagcatgcactctgaccgcgctccccatggacgccatgtcccgcatnnnnnnnnnnggaggggggatccaccgaagcatgcaccctgatcgcgctccccatggacgccatgtcccgcatcgccggcagtctctccctggcagacgccggcaagctggcccagacctgcaccaccctccgcgcctgcgtggagtccccggtcctccggggcgagctgctggaccgctgggtctcctgccagccgcgcgatgcggggtgcaccaaggacctcctgcgcaacctggcggggcccaggggcgacctggccctgttgcaccgcctgtcagcctggccggcggggctctgggtcgcccagtctggcgaccaggtggtggagagctgccggctgctggtgtgcaggcaccacccctcctccggcagcttcagcttcacccacctggccccggcgcgcggccggccgccggactcctccctgccctgggcgccggtgcccggccagcccctgtggaaccagctggaggtggggtcgtactccccacccgactccggcgcgccccgctggcgctggctccgcagccagcagaagtcgcccagcctggcccgcatccgccccagcggcctctccctcgacatggtcgcgcgctggccctggttccagaccgggttcaacccactcatgggggagcacggccgccgggtggccttccaccgggtcgccacccaccccgtgtcggcacgggacctggggctgggcccgcgctttcctcctccgccggacgccatcgcacgcatgcaggtgtgggacgtgggggacgcgaggggtctcgcggcctgctgtacaaccctccgcgcatggttgtcaggcgagggggcctgccgtcatgcttgctcggccgcgacggctcggccccccgctgccctgccagcagcccaccccctgtggcacccctcgcccccacccgccccagggtctcgtgacgggggcctactccacgcatgggaccgaggtcctgagcctgcggctgtgcgggcccagctccgcacccccctctgattcgggtatcactggcgtgaggctggaggccctcaagctcatcggcgacgtgaatgtgcctggcggacagtgagccgggcagggggtggggggaaggctggccccatgcccttaagattccaagagggtcccgtgtgtgcccagtgtcgtgggctcgtccccccaacagcggactggggtgatgctcctcgccggccgaaacacatgcaagccaccccccctgtcatgcaccaggctgtccttcgtggtgnnnnnnnnnnatgggattccacgagggtccagcgtgcgcccagtgtcgtgggcccgttcccccaacagcagactggcgtgatgctcctcgccggccgaaacaaatgcaagccaccccctctgtcatgcaccaggctgtccttcgtggtggatgccgagtcgggcgtcgctgggccgacgcggcacagccgcctgcacgactttgcggccgaggactcccggcccatctactccttcgccgacgggcggtcggctgtggtggacgtggagcggctccccatctgcgcccagttccgggctctgggtcagatcaacgagtttgagggtgtgctggtggaggtggagggggggggggcttggagggatcccctcgccacttgcctgcctccgcctggcgggattcagcatggtgcatgctgggtggacatcacccttaccaacagggtgtctgttctgcccgacatacaaactgattcaaaggtcacgaaacaccgcttcttcttcccataaaggcctctggcagccagagtgggtgccnnnnnnnnnncacagggtgcctgttctgccagacatacaaactaattcagaggtcacaaaacaccgcttccccttcccgtaaaggcctctggcagccagagtgggtgccagcggtgtttgttgtctactcccaagcccagccacatccagcggggcactcctgcgccatcgtgttctgtgatgaggaccgaccgtaccgccacatcattgagttcatgcccctgccgaatgatctgctggccaccttgaattcagagcgggacgacgacttctagccagcagccgctccaagaagcgcccagcctctgaacagggtacaagcagagcacggattgtagagccccaagctgtaccactgtcactgcctatctgcctaggcatctgtatgatgcgcttgcccctcctgccattgccatgagtgtatgacatatgcagcactcgccagtcttaattgtaactcccctgtacaaatttaccagagccacctgatgctgcggacatcgagcttggtaccgagtgcttgtggtgccctggtgcagtccaaaatctcgcctcagacactcgtggggatgtgagggatacctttactatctcgtctttgagccccgccccccctcatcactctacaacagatatgcagtgggccnnnnnnnnnngcgactcccagccagcagccgctccaagaagcgccgagcctctgaacagggtacaagcagagcactgattgtagagtcccaagctgtaccactggcactgcctatctacctaggcatctgtataatgcgcttacctctcctgccattgccgtgagtgtgtactacaagcagcacttggcagtcctacttgaaactccactgtacatacttaccagagccgcctgatgctgcggacagtaagcttgataccgagtgctcgtggtgccctggtgcagtccaaagtcttgcctcagacacctgcggggatgagaggggtacctttactatctcgtctttgagccccggccccccccatcactctacaacagatatgcagtgggcccctggtatcaatctgctccagatacccaatataacctggctgcatgcacaacctcactgctataccacccctgaatgctgggtctgtctacacgtgttagcatacaggggagggatgctgggggagctagcgcaggacccagagagtcatcaaagggagtcgtgcctcggggtgcaggatacaagaggggcgcaatgcgactcggacccaagcgcagcagccacattgtacagagttggcatggaaaatggggcaatgggattcatcagtgcgggtgggcggcaaatgggctgcgnnnnnnnnnncgcgcagcagctacattgtacagagttggcatggaaaaaggggcaatgagattcgtcagtgcgggtgggcggcaaatgggctgcgggcagggaggggtcacttcgcacgcttgctgatagagcaggcgggagtggcccggggttttacgtggcccgggtgggggggggagggggggaggcgtggacccgcggcgagaatacatgttcatgnnnnnnnnnnccaatctgctccagatatccggaataacctggttgcatgcacaacctcactgctataccacccnnnnnnnnnngcgcagacttttacaacttccagtgccgtatttgattgctaaggcagtcttctgtgcgcaaggaatttcctggggacagagagttcaagcggccagttcagaagatggggctgcgcttggggagcacgagcttccgcaggtgcgtgcggaaggtcagctggctctgcacggaattgggatgggattcttggcattcaacccaaagtgcacgggtactggccgcagtgcatgtgttcacaaatcgannnnnnnnnntcccagggttttaagtggcccgggtggggggggggaaggggggaggtgtggacccgcggcgagaatacatgttcatggaacaggctgaggttgccaggtcagcaaaagttaatggggagggtgacaggaagggggaggtttcattgtacagggagggtcccacagaggggaggggccctcacgcagatttctacaacttccagtgccgtatttgattgctataggcagtcttctgttcgcaaggaagttcctggggacagagagagttcaagcggccagtttagaagatggggctgcgctgggggagcacgagcttccgcaggtgcgtgcggaatgtcagctggctctgcgcggaattggggatgggattcttggcatccagcccgaagtgcacgggtcctggccgcagtgcatgtgttcacaaatcgagtagcccagacgctggctgacaggtggcccccccaccttgaccagcagcttgggcttgaccaggacgaccgggtcggtcaccgcctccaaggaggccccggagctcatggagtcgatggatgcatccctcagccgtctgcggcagcagaagcagagattccctcaggaaacgaatatcaagtagaagctgggggaagctcgtcctatatgctcccatcagcccatccggccggagagacttcaaaccagcttcacaccaacctccaacctccacgcgccagcgcttactttgaatcccgacgcgtcggccgcgctcgcagcagggcgggggccgagaccttgctcgctcgttgcttgatcataccacgcatcgccaggggctggtacccctccaggctgcgcttcacgaggtacctgcgagggacggatgtcggggatgaggctggggtttccggaacagctcatcacgataacaacggcgacatgcccctcccctagcccactgaaccgaccccagggcatcccatgatcgaaaacaagttgctggacgtccctagtcccacctgctgccgcaggcattgcagagtatcggcttcgatggtgggccccgacgccaacagtgcgactcggtggccttgcagtggcagcaaggtcctcctcttcccgatgatggcatgtctggggcgcgagttggggggttgcggtgctcgactttcggggggtgatggatcggggcttccgagggtgagcgtcgatggcgggcgtgaccgggttcagtactttgatgaaagtcgattgtgagcaatgaacaaccctgtttcatgtgagcacgagttctcactgaattttgggcgttccgggccaacttgaagatctaagttcggagtgggtcggaaacggttggtttgcgctcgcgcgctattgttatcttccacactgccacctggcgcccggccatggatgtcgaacatccaccaggttcctcaaagcgtcatccatgtcctggcctggcacccgagagcttctgaatcaataaacatctcatggtacaaaactgaacagctcagggccggccaatgcgcgagtcactgtggcttggacagggccagcttcacccccggcgcggctcgcagcttccgcttgggcgccggccctccaaaagcgtctgcggccttgatgcgcgcccgcgccgctttccagtccctctggaagccggcctcgccgccgggcccgccgccggccccgtaatccaccgctgcggcacgcagcgcatccgccctgctgcctggcaggaggcgcacgctggacggcaggcccagcgccctccgctgcgactcccgtgcgccctcgtccttcctcacgccgcgcagcgccctccgcaacgtcttgttggtctcgtagtcgtccctgcgaggcggtgtgggtcgggcttgcagggcgttgattgacagcagcatgtgggagacatcgctccgaggcagcgcactctcccaaacagnnnnnnnnnngcggtgtgggtcggggttgcagggcgtcgatcgacagcagcatgtgggagacaccgctccgaggcagcgcactctcccaaacaggactcgtgtgggggccccatgccccctcctcccctttcccaggatgaggcctagccggggatgtcacccccacggcactcacttgtatcgcgcggtgctgtcgcgacgcagggcgccgaccatggcccgcgcctccgaggcgcgggcctggtccagacccgcatgctccagtcgggcgagggggtcggccaggaccgcatgccgctccgccgcgctatccagctccagcgtccccgcagcctctgcgttgaagctctcgactttcctggcggggcagacggggggaggtgcgagtgtggatgagcatgtcatccagggaagatcatggcattcaggggggggagatgaggcaaaaaaagccatgacagtatgcttgtcacaaggtcaatcaagacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaaatgcctcgagtcaccatgccgacattcccaggcacccccatccgcacccccacgcacctgcgtgcccccgtcaccagctgatactccgcgttcttggggtctgtgtggacctcgnnnnnnnnnntccaaaatgccgcgagtcaccatgctgacatccccatgcacccccttccgcacccccttccgcacccccaagcacctgcgtgcccccgtcaccagctggtattccgcgttcttggggtctgtgtggacctcgnnnnnnnnnntggggggggagagacaaggcacaaatacccatgactatatgcttgtcacaaggtcaatcaagacaggacaagtggagggcagggtgaagaccaggtcgggagggcttcactccgcttgaaagcctcgcagagagcaggcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgctgctgacagcagggcgctcgcatggagaagctccacacccgggtggtgtggtacatccccacctgcttcttctccgcgttgaaccggacgcccttgccaatgaggtgaccacagcccgtgcaccacacattgaagggcatctcaaagcgtatcaccaggatgccctggtccagcttgcgcgcccggtctcccagcgcgccatgcgagttgttgaactgagagggcgcacggggaaagagggagggatgaggaggggcgaacctcagactcggcctgagagaacgcgcacaagactccgctcccgcatcactcgtaccataccttgttcaagtttcctttggaggggtcccatcccggtgggtagtagaagttgtccgcccgagccgctgctagagtcgacatggctcagtctcctcccaggagcgtacccgaaacaggccgctcgcggatttcgacgccaacaagacaagaccgtgaggatgttctcagtcaaatggtctaggatcaagctgccatggtaagacaaaactaagcggtctccgaatgttcatgtcttccctgtgcgcgcgcgcccaacgattactgcgacgatctcataaaccttgtaaacataaagggggcagtcgcatttccctgacctgacaatgtacaatactactgtattcttgaaattgtcagcagaatgggtgccaatatcacgannnnnnnnnntcgtgaggatgttctcagtcaaatggtctagaatcaagctgccatggtaagacgaaactgagcggtctccgaatgttcatgtcttccctgtacgcgcgcgcacaacgattacggcgacgatttcataatccttgtaaacataaatgggccagtcgcatttccctatcctgacaatgtacaacactactgtattcttaaatttgtcagcagaatgggtgccaatatcacgagtgacaccactctgaagaaacctgtcgctgggggagaattcgaggatgtgcgaatgggaagcctctgggccgacagtccggtcctgatcatcgtcatgcgtcgtcccggatgcagtgagttatgcattgatgagggactgaatgctcgtatccttcgcaaagccatttcccggcatttgcgtcctcttccagtggcatgtcaacactcctcaacttctctccacatgtcagtcctgtgccgtgagcagactcttgctgtctgggcggagcgcgagaagttcgagaagctgggcgtcaagctgatcctgaccgttcacgagtggaagcagcgcgagatcgacgcctttgctccggagtactggggtggagctgtgttctacgaccctgagcgcaccttctacgcagctgtccacggcggaagcgtcaagattgcttctaggctgagcctgctcaaccctttcagcacgtaagccgggtttttttttaggtttaacatggcaaaattgctctcacatgcgtcatatctgggtgaggtcgatcgaagagcaccggtggctgagcgcacaggaagcgtcttgcatctgctctgatatcatcagccctggtgaaccataggcccgactnnnnnnnnnncttgtttaaagtataacatggcaaaattgctctcacatgagtcatatttgggtggggtcgagcacagagcaccggtggctgagcgcacagcaagcgttttgcatctgctctaataccatcagccctaataccatcagccctggtgaaccataggcccgactctccctcacaccttcccacccattcactgcagcggattcaagaacggacgtgccgcatacaagcgcggagttgtgaaggattccaacttcaccggcaatggcaccgtgctggggggcgtcctggtattcaaggccggcggcgagctcgtgtacagtcacgccgagtctgactttggggtacacccccccatggaggatctcgtcgcaggcgcctccaaggccgccgcttgagtggcagcgttgcgcctctgaaaatgtcaggctgtggctgtttcggcctgcctgcgccccctgccggccacgttacactgacatgcagccgggggtcctaccctgatgacccaagacaatttatacctcttaccatgaaaagacaagggtattggcctacctgactgttgctcacagacctcgcgaggaggcagtgatctgtaagactctttgcgttatgatgtgctccatacctgcaccagtggatgccggccctgcaggagggcaccttctcggcacgcccttcttgacccctgccttctcgtgcatcactcaaccatggcggttcctccttgcaagttnnnnnnnnnnatacctcttaccatgagaagacaagggaaatggcctacctgactgttgctcacagagctcacgaggaggcagtgatctgtaagactctttaacttattatgggcgccagacctgcaccagtggatgccggccctgcaggagggtacctcctcggcacgccccttcttgacccctgccttctcgtgcatccctcaaccatggcggttcctccttgcaagttacagcgtgcagcaggggtaggacgcggccagcaaggcgtgcgccgcgcccgccctccatgggcacggtcagcggtaggacttctggaagcgggcacgggcgcccgggccaccgaacttcttgggctccgaccggcgcgggtcggcgaccagcagggtgcggtcgtaggtcagcaggacgtccttgatctggttcttggactgctcgtccacgtgcttctggtagaaggccacgatgcccttggcgatggcctggcggatagcgtagatctgggcgacgtggcctccaccgcgcacgcggatgcggacatccacattggagaagcgctgcttgcccagcaggagcacgggctccagcaccttcaggcgcatggtgtcgggctgcaggagctccaggggggcacctggatggagtaggtgttgaggggggggggggggggggggggggnnnnnnnnnngggatgtgccatgccaaacagtagggagccggagtactttgcagagtgagagcccctgcaggcgttgccnnnnnnnnnnaggatgtgccatgccgcacagtagggagccggagtgctctgcagagtgagagcccctgcaggcgttgcccacgattcatggagacaaggcaatgatcttcccagctgatcccaccggttacacgtcattccagcgggcattccccaccctagaccaggcctgcccaccattcaggcgcagctcgccctttccgcgcttcacgtgtgcgacggccacagcattcttctgcgcatcgatgaggagaatggaagtgtgaggaggagcgccatggatgcgacccgtggggacagccccgtccaccccgacccaatttcccctacgacatttccaagcaacacgagcgcgaggccctgccagggcataagagtccccaccccacgcaccttgcgcccgaaggtttgcacnnnnnnnnnntcctacgacatttccaagcagcacgagcgcgaggccctgccagggcctgagagtccccacccacgcaccttgcgcccgaaggtttgcacggactgcatccgatgaacatgcggggggaggggagaaaagcggggaaactgaggagacctgcggagcgccacccgggcgacgatgggcgcctccacaccctgcggcgcactcacctccgccatgttgacgcctccagacggtggttcgggcgtcagagataccggaaagagggcttccggcgagcgactcgctcctcaagccatggcgggacggtgactgctgggccctcagacagcgggaaccttgttagaaaggacggagcggacatcttccgctcgacagtcccagcttgtgtaccctataccctgttgctcccagaactcgtcgcgacggcacccaagctattgcattgatattagcacaagtctgtactcctgccccgcatcagtgcagtgtcagtgagagggcgctgggaatccacagcacaggacgactgtcccccggcctgcacgtatcaggagtaaaccccgcnnnnnnnnnncgcattgatatcagcacaaatctgtactcctctctcgcatcagtgcagtgtgagtgagagggcgctgggaatccacagcacacgacgactatccctcggcctgcacgtatcaggagtaaaccccgcccgagggcccactgcttgtggatcagcccctcgtgctacctggaatagactgtcataatggcagatgcagacgtccccctgcccacgtccgctgtactgacagcggtgtccaagcacgttggaatccggtgttccaaggtgaaccaggcctacatgcagtgcaaagcggagcacagcaatccagccgactgccttggcccaggaaacgaagtgacaggctgcctcgtggacttgtgagtgctggcatggggtttggaggattggcgaccgactttgggatctgtgctggtggggtgccccagttcaatctttcataggacctccctctgcccgattgcaggctcaaggaggtccacgcccaggctcctgccgaatttaagaagtactacgagtgtctcgattacaacaggtggggtgaatcgggaagctggtgctctcatctccctggacagccggctcttgttgtcgcctctccaaggattgccatgctcgcttgaaagtttatggaagcgcatacccctttgacccatctcttacccggctcttcccatcacacgatgctgcgcagcaacaagctgcacaagtgccgcacggagcagaaggcctttgaggcggccttcaagccaaaggcataaggatgcagagctcatgtaacacactcgcagacgcatgtggatgcagagttgggcggactccacacggtacatgcatgggtgtctgggctcgaggtcaccctcagcagccagtctcgtcgccgtgccgggagcacaaaccggggcccggtcagaggtcgtcggagttgtggtcgccccaccggacgccgtactttgccgccaggtagtgggcgcccacagggccgcggctgccgtaggggtactgctccggctgcaccctacgctcctcgatttcctggcgtgcgatgggtgtgcagcggtgatagactggcgaccaggcacacgatgcgtggtcggctgtggtgaatggtagacaaagcagcacgccccacccacccagcttcaggaggcatgtcagcacagcaaggcatcccacgccctattcccctttctttgtctcactgtcatgccacacctggagcacgggggtgnnnnnnnnnnggtgtcccacgccctattcccctttctttgcatcgctgtcatgccacacctggagcacgggggtgaacttctcccatgccacctccagctcgtcattccggataaagaggcggcggtcgccattgacgcagtccaggatcagacgctcatatgcgtctgtggcatgatgaggaggggggggagggcagattggccaggatgagtgcccataccacaatcagccattcacaaacgccatcctcaaagnnnnnnnnnncggggggggggagggcagattggcccggatgagtgcccataccacgatcagccattcacaaacgccatcctcaaagtgtgtcctgtttgcaccgaacattgcctcctcatgactgcctggccaagtcccgctcgcagcacttgctgactctgatgccggccccccgctttccaactgcccgctgacctggcagatgcgtttggtaccgagagccgtaggtcaggtccagtcgcgtgttctccacgcgcagacccagtcccggcaccttgttgttgatcttgaggtatatggattcgttgggttggatgcggattacctgagtcggggtgaacaggaggagggtgaggtgggaagttacccttnnnnnnnnnnggcaacacttgctgactctgaggccggggcccccctttccaactgcccgctgacctggcagatgnnnnnnnnnngggagcagcgcatgggcgaccacggtccgcggcggattcgatggcaggcaggcagtccgtactggaacactgcctgcggcgagcaaagctgacccgaggaagaactggccgcagaccaggcagcgccggggaggcacccctaaaacacaggtacgcacttgttggcacagcctcgcttccccaccaccaccaccaccaccaccccactcccctgctcacgagtnnnnnnnnnntggatcagcgcatgggcgaccacggtcagcggcggattcgatggcaggcaggcagtccatactggaacaatgcctgcgtcgagcaaagctgacccgaggaagaactggccgcagaccaggcggcgccggggaggcacccccaaaacacaggtaacgcttgtcggcacagcctcgcttccccactaccatcaccaccaccccactcccctgctcacgagttcgttggtggcggattcgctactcatgccagccgagaagcccagcttgtcccggtagaggctgccagggacgtggcggaactgcacccggatctcggccatgcgcccctccagcgctttccccgccttgagcaggaaagggacgccgtcccaccgcgcgttgttcaggaagacggcgcacgcggcaaatgtcggcgtcaggctgcagggcagggatgggggggtgttgggtgatgagcgggcgccgttgatctaggagggaggcgacacccatgcagctctcaacgcagtcacttgcacctgagggannnnnnnnnntcgcgcgttgttcaggaagacggcgcatgcggcaaacgtcggcgtcaggctgcagggcagggatgggtgggtgttgggtgatgagcaggcgccgttgatgtaggagggaggcgacacccatgaacctctcaacgcagtcacttgcacctgagggacgcaggggtgactcgacactgtgcatgccacagccggcagcatgagactcgacacccagggccccattccctcttcatccaaacccaacctgttgggcggtacggtggggtcctccagataccccggctggctcatgcccttgacacgccggccgcggtactgccccagtaccatgtcctccagccgcacggtctgcatgctgcgcaggaccttgaccttctcgtcgcggatgtcctccgcgcccatgctggcctgcggtgagagttatgttttggggggggtgctcgggaagtgagaccgtagaaaccaccccaccgcccacatgcttcacgaccgcccctcaccaaacagagtcccccaccaccaccccaacacccgcaccggctgctccatggcgaagagggccaggatctggaggaggtggttttggatgacgtcccgcactatgccgtactggtcaaagtagccgccacgcnnnnnnnnnnaagagttatgtttcggggggggtgctcgggaagtgagaccatggaaaccaccccaccgcccacatgcttcgcgaccacccctcgccaaacagagtcccccaccacacccccacacccgcaccggctgctccatggcaaagagggccaggatctggaggaggtggttctggatgacgtcccgcacgatgccgtactggtcaaagtagccgccacgcccctccgtgccaaagttctcagagaagatgacctgcacgttgcggatgtactgccggctccacagtggctcgaacaccagattggcaaagcgcagcacggtcaggttctcgatcagctccttgcccaggtagtggtcgatacggtagatctgctcctctgtcagatgcttgtacagttccgtcgccagctggcgcgaggactccaggtcccggccgaagggcttctccacgatcatgcgtgtccagccgctcctttaatcgtcaaggggagggcgcgtgtgtggggggtggggggtggggggggaggcagtgagcacatgggtggtgagtgggggggagcgttggtgggcgccctgtcatcacattgcagtccctgcgctgacaaggcatgctccaaggagggactgcccagagaatggaaatgtgaatggccatcgatgctcacttggaggaggctgcgctggaggccgaggcggccacggtggtgaagatgttgggcgggatggannnnnnnnnnnnnnnnnnnnnnnnnnnnnnnnnnnnnnnnnnnnnnnnnnnnnnnnnnnnnnnnnnnnnnnnnnnnnnnnngccgcgcacatgcgcttgtccagcgcgccgtagtcctccaggctgtcgtattgaccctggcgagggacaagcagggggaggaggggtgctaggtgcaggacgatctcgcaggggccaagaccaatgtgagggaatgcggagcctgctcccaacagccggcaggaggtgagtcgggattcaggtgcatttgccaccacttccccaactcccagtctcaccgnnnnnnnnnntctgctcccgacagctggcaggaggtgagtccggattcaggtgcatttaccaccacttccccaactcccagtctcaccgnnnnnnnnnncgtccctggtagcccagtcgtgcccactcctgacgactcccactcgcaccaagaggccccttcgtcctcccaactcacgcgtcagagaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgtttcatgtctggcatgggctgatcggcccagcaaacgattcatcgcgcccccaccatctgcatgcctcaccttgggcannnnnnnnnncctggtagtggcaccgcgaaaggaactcctccatcttggcaccgcagtcgcccctgccccagtgtgcgccagatgtcaaaggtaggagtgggcgcccacaaacattagcagatggctgacattcacggccaccacttgtccttggtagcccagtcgcgcccactcctgacgaatcccactcgcaccaagaggccccctcgtcctcccaactcacgcgtcagagaggcggcaggacaggttgccggcgatcatctcccgaaacttggcgtcatccagcttggtccgggcatacccaaagatcgtgaagtgctgcatcaacaaggcgaggtccaaggctggccaacgtgcttggttgggcaggtgcaggcgaggcggctggaggctggnnnnnnnnnnnnnnnnnnnnnnnnnnnnnnnnnnnnnnnnnnnnnnnnnnnnnnnnnnnnnnnnnnnnnnnnnnnnnnnnnggtgattgtcgtaatacagagcaaacagggcggggaagattttcttcttggccagatcgcccgaggccccaaccacgcagatggacagtgcagactgtgaccagtcctctaaaggcagatcataagcctggcgtttgtgggtgcagagtgcatggatcaggcaggggatcttgttgtcatgcagtctcagccccagcccgatacaatctcccctcctcacctggagggcatcagaatccagtggtcctgcacctggtgcatcttgctcgatcgctgcaagtccatgtcgggagcaggcaatcgatctcagacaggatgattgtgcgggcatgacagcgaggagtggcatgcagggtcctcaaggcgattcaggagacctaccagggggactactggctgcgtgaatggcgactcgtcccctgctaccttgtgctcgcctaaacgggataggcacaggaggggttaatgtgatatatgtctaaaagatatcaatgaatgcaacttgtggtcgccaccttgaccccccgcaccggccgctccagtgttgcacagccggaaccccagcagcgcctgtggctgccctccgcgaatcggccctcgccagtgacacggcatgaagcctcggtcggcccacgtctaccctggccgatgtgaaggatgccatgctgtgcgcctcgctgcgcgggggccaagggttgatgctcctgtttctggcaggacactgtgcaggctgtaatgcagtgttcggtcccaagcctgcacacgagggctagctggtagggaacgtatatctatatcgaataccagtatttcaggaatgggtgtccctttgagnnnnnnnnnntgaacgtatatctgtatcgaatttcagtatttcaggaatgggtgtccctttgagacagggaggcggggtgaggccgcggaaacgtgatcgagagggggggggagcgcaacaggagaaattctggaactggtctaatgtacagatctggtcagagtatacaatgcagattacgcgtcgaataggacagcaaggctacaacaagcttccaaagcttatgcaactctagctgtctgataattattaacacgcaccatgggagtctggaggggagagagcaagatagtaccttttgaggattgcctgtgatgacaattgagtattgctgttggtcgatgttctcccatctatccttgatgattgaaccatgaaggggatcgcagaagagcattcaatgatgaggctgagccgggagaccttggtaatactgttcagcaaggcgtccattctttggatggacatccaatgccacaatgacaacagctgatcgcaagtcgcgctgcagatgtgctgtgggcacatctccacaaaggtatggaggtaggggagggctgcgcatggccgtgtaacactggcaccaatcatcctccggcaggaggtgcccatgcttgactccatacgggtagttcgataagtgctcaagagcacaccaggctgatatcctaggatacgagctgtaccactgcggatgttggatcggagtgtgggtgcgtgcagcgccatcaactnnnnnnnnnntgcgctgcagatgtgctgcgggcacatctccacaaaggtatgaaggtaggggagggctgcgcatggccgtgcaacactggcaccaaccatcctccggcaggaggtgcccatgcttgannnnnnnnnncgcgctgctggatacccaggtatgtggcctttgccacatggtttcctgatccactgaatatgggtggaacgagggcannnnnnnnnntgcgctgctggatacccggcatgtggcctttgccacatggtttccagatccactgaatatgggtggaacgagggcagcatggcgtcagaacctatcatgctgtcttgagcctaattatgcttgatcaacacgttttttgcttgcaatgaaagcggcagagggcctgtgccatgccagatggagacttctgaaacactcatcattattggatatcaagtggatgatgccaccacctggacgtcattgctcatatttggtatcaggctatttccgtgactaccacttgctggttaagctcaagtgccgggtnnnnnnnnnncgcatcagaacctatcatgctgtcttgagcctaagtatgtttgatcaacatgttctttgcttgtaatgaaagcggcaaagggcctgtgccatgccagatggagacttcggaaacactcatcattattggatatcaagtggatgatgccaccacttggacgtcattgctcatacttggtatcaggctatctccgtgactcccacttgctggttaagctcaagtgccgggtgcttgatgcctgtcggcctgcttcgttcgtaggtgcttcactggaagaaatcgccaccctccccgatgcacgcgcaaagaaatccccacgccagtcccggggaagcggggtatgcgcatcccagacccagactggatgccggcaaacatccaccgcacggcagcataaccttttgatacaaccagctgtagtattggggaatcttctgttcgaatcagcttgcgaggtgcactgccaatcctgcacggcgtatcggtgcctcagtagtcactgggtggcccgaggaggcctcgggcacgcgcgcccagacgctgcatgcaccgactcggctgagggcacgggnnnnnnnnnnttatagtattggggactcttctgttcgaatcagcttgtgaggtgcactgccactcctgcacggcgtatcggtgcctcagtagtcagtgggtggccggaggaggcctcgggcacgcgcgcctagacggtgcatgcaccgactcggctgagggcacgggtttcctttccttgaagagtcatgatgtcgctgcgcggcgtcgcggggatggcaggtgcgggcaggggctggggagcaggggcagggagtcggcccccggcttttgcctgcgactgcgcagcctctggagggagaccacggggtcatgcagacaccagagaacccccctttacttccaatttcgaggacctgtaacccctcacactgctcctccccgctcccttcccctgcactgaaaggcatggacgcagcccccttggctccctcccccccgcacgcccccttcagcccctgggcccacgtcgccggggcgggcctgctgtgcctggccagcctggcgggcgtggcactgccccccgcgctgcgccgcggccgcctggcgcgcagcgcggccctggccacggccgtgcgcctgggcacctgcttcggcttcggcaccatcctggccacggctgtggtgcacatgctcccctccgccgtgcactgcctgacgctgggcacgggccaggccccgcccgcgctggcctactggctcatcctcgccgccctgctgggcatgcactttctggactgggcggtggccctggccgcccaggggctgtcccgccggcccggcacgcgcgcgacggccg

SEQ ID NO: 40445 - DNA, 1475 bp, Chlorella protothecoides
  modified_base (181)..(190): a, c, t, g, unknown or other
  modified_base (451)..(460): a, c, t, g, unknown or other
  modified_base (731)..(740): a, c, t, g, unknown or other
  modified_base (888)..(897): a, c, t, g, unknown or other
  modified_base (1227)..(1383): a, c, t, g, unknown or other
agcttcccgccgggtcccaggccctgggccgcctcccgcagcagcacctggagctgctcctccggcacgtcgggcggcgcctcaggctcgcgggtgggcgggcccccgccgcgcctgccccgcccccgcccctcctcgggcccgccgtcgcggcgggggggggggtcgtagcgcgcggagnnnnnnnnnngcgcggagaagtgggtgagcaccagcaggcgcgcgcccacctgcgcggcaaagcggccggcctccagtgcggtcgagtgcgtggcgatgcgggccttgctctgcatgcctgcgtggaccgagggtaaggggggaagggggtggttgaggacggaggagagggggcgaggggcaggctatgggggagtgtggcctccggcgttggaggagcgcacaccgctggcgggatctcacttgggctccttgagcgcgagccgttcgnnnnnnnnnnatggaccgagggtaaggggggaagtgggtggttgaggacgcaggagagggggcgatgggcaggctatggggcagtgtggcctccggcgctggaggagtgcacaccgctggcgggatcccacttgggctccttgagcgcgagccgttcgaccgcgcgcagctgcccctgtcgcaatcgacgtctcactgcagaggcaagcaacaccccctctccccggaaacctcgggaagctccccatgaactcacgggcgcagaaggtggcctcgtgcgnnnnnnnnnngacgcccggggtgtccaggggcgtggggccgggcccggagcccccggcgggcgccgaccccgcggccgccccgtccccaggaccctcgcgggccgccagcgcgctgcgctcccgcagcacgtatccccagcaggggacgcggtgcagnnnnnnnnnnccgtctcactccacaggcaagcaaaccccccctccccccggaaacctcgagaagctccccatggactcacgggcgcagaaggtggcctcgtgcgacacgaggtccgcgccccgcgccagggtggcgatggccgtcgactcggccgtgtcccccaggaggaccagcttcctgcccggccgcacaatgcccggggtgttaaggggcatggggccgggcccggagccctcggcgggtgccaaccccgcggccgccccctccccagggccctcgcgggccgccagcgcgctgcgttcccgcaacacgtatccccagcaggggacgcggtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaggcgctgcggcgccagcgcgggggcctgatccggcggctgcagacgcagggggacgacggcggcgccgccccgccccgcgccggcgc

SEQ ID NO: 40446 - DNA, 67 bp, Chlorella protothecoides
catatcttcggctcgcgcgaagcatacgccggtgtcaaccacggacccccattccaaatttgattgg

SEQ ID NO: 40447 - DNA, 1898 bp, Chlorella protothecoides
  modified_base (348)..(357): a, c, t, g, unknown or other
  modified_base (693)..(702): a, c, t, g, unknown or other
  modified_base (792)..(801): a, c, t, g, unknown or other
  modified_base (882)..(891): a, c, t, g, unknown or other
gctcgcgctccgcctccggcggctcggccgcctcctccgcctcgcgccccgcctccggcgccggcgcctcgctgggcggcctgcacgctgcgcacgctgcgctgtgccgcgaggtgggcctcgcgccctatgcgctggcggagctggccgccgcgctggccgtgctggccgaccaggggctcctggccctcggaccccggaggaggggcgaggcccagcagcgcgtggccctcaaggtgccgcggaactcttagacatgtctcaagggggggtgaagggtcggtgttggtatgaagaggtggagatcgagacctgggcgctgatacatgctggacggctgcggcgtcnnnnnnnnnntttagacatgtctctaggggggtgaagggtcggtgctggtatgaagaggtggagatcgagacctggtcgctgatacatgctggacggctgcggcgtcgtgttaccatggcggagagttcctggaggtgccgccaggcttccctgcagctcagcagcacgccacacccatgcaacgctcgactgcaccgggatcaagatccgttttatgatcctgtccagttccttctaaatacactctaccccacacaccacacaacaggtgccggaggtggacgtgctgaacgcgctgcgtagcctgccggtggtcggaactgtgctgcagggccgcatggcagnnnnnnnnnntaccgggatcaagatacgttttatgatcctgtccagttcctcctaaatacactctaccacacacaccacacaacaggtgccggaggtggnnnnnnnnnnccgggcacatcttcttttgggtagcaacaaaccccaccttgtgatcccgccctctgggccggctcactcctttcgtgaggnnnnnnnnnnacgggcacatcttcttttgggtagcaacaaaacccaccttgtgatcccgtcctctgggccggctcactcctttcgtgaggcagactggcggcaccatctaccccgagcattgcacctgccacccctcgagctcccagtggggctgcgaggaggggcagcacatgacacgccgcggagcgacagggccacggacgtcctgcgccagcgcagcggcggcttgtggtatcttgcccgcgggaatccttgccgacacgagagaccagacagcgaacgaccccccttcccttgacgtgcatgaagacgtgtatgatacaacgagtgcgccattccggcactcatgtctgtacactgagagcgacctctgcctccccaggaagctgaggcatcatgtggatgggatcggtggaaagggggaaggtactgcaggtttcatgttgcgactccgaggttgccgcccgccgaccagaaaccgcaatgtagctgccaccgccacccacctcgggcatcatttccccctgcattcatcctcgtaccaccaaggtcagacccccgaagtcttgagtatcgcgtgagctgccaagcagacgacaccggactgcccagccttagctccgtgccgcgttccgtcaccaagctggaaggccctttgaaaagtccttttgccagcagtatccatgatctcagatccagaaagtgatagtagacgctcctttagtgcttctagtctccgtggcagcgggtgctgttccggcaagttcgagccgcctttgcctcccattccagccgagctgcgccccggaggaatcgaccataccgcaggattcccagacgtgagtccagggtttgatggcggaggggtgtgtgcggagggaatggctgtcgcctctcaagtgagccttgccttcccaggctggcatggcacggtgggtttgactgtcagtactctgtggcatggtggtgcgccgggcgccgcccacccggcagcggctcggtgccatgccctcctc

SEQ ID NO: 40448 - DNA, 110 bp, Chlorella protothecoides
cccctgcgtggaggggcaaagggggttgaggacgaagaacctgcaagagcggagggcaaaacgagataccctgcctccgaagcccacctccataggtcttgctgatgtca

SEQ ID NO: 40449 - DNA, 69 bp, Chlorella protothecoides
cggtgctgctttgcccatctgctgtggggcagtgacagcttgagagtggcggctcctgctgcgctgttc

SEQ ID NO: 40450 - DNA, 117 bp, Chlorella protothecoides
gaatgccgcgatgagggccgtcacggagcatcccgtcgccgtgactttttgcaggagggggtgtccattcccgaccaggagggtgcgggtgccgtcggtgacgacatccactgcccc

SEQ ID NO: 40451 - DNA, 61 bp, Chlorella protothecoides
ggctggatggtggcgcgggagacccgcgggtgcctgccgatgggcggcatgctggcggatg

SEQ ID NO: 40452 - DNA, 15984 bp, Chlorella protothecoides
  modified_base (460)..(469): a, c, t, g, unknown or other
  modified_base (956)..(965): a, c, t, g, unknown or other
  modified_base (1413)..(1422): a, c, t, g, unknown or other
  modified_base (1975)..(1984): a, c, t, g, unknown or other
  modified_base (2335)..(2344): a, c, t, g, unknown or other
  modified_base (2551)..(2560): a, c, t, g, unknown or other
  modified_base (2813)..(2822): a, c, t, g, unknown or other
  modified_base (3261)..(3270): a, c, t, g, unknown or other
  modified_base (3636)..(3645): a, c, t, g, unknown or other
  modified_base (3832)..(3841): a, c, t, g, unknown or other
  modified_base (4273)..(4282): a, c, t, g, unknown or other
  modified_base (4960)..(4969): a, c, t, g, unknown or other
  modified_base (5409)..(5418): a, c, t, g, unknown or other
  modified_base (5752)..(5761): a, c, t, g, unknown or other
  modified_base (7942)..(7951): a, c, t, g, unknown or other
  modified_base (8440)..(8449): a, c, t, g, unknown or other
  modified_base (9162)..(9171): a, c, t, g, unknown or other
  modified_base (9442)..(9451): a, c, t, g, unknown or other
  modified_base (11282)..(11291): a, c, t, g, unknown or other
  modified_base (12351)..(12373): a, c, t, g, unknown or other
  modified_base (12603)..(12612): a, c, t, g, unknown or other
  modified_base (12693)..(12702): a, c, t, g, unknown or other
  modified_base (12783)..(12886): a, c, t, g, unknown or other
  modified_base (13339)..(13348): a, c, t, g, unknown or other
  modified_base (13848)..(13857): a, c, t, g, unknown or other
  modified_base (14951)..(14960): a, c, t, g, unknown or other
  modified_base (15245)..(15254): a, c, t, g, unknown or other
  modified_base (15652)..(15661): a, c, t, g, unknown or other
ccccgcccggccccacgcccgccgccgcgcgcggcgcccctgccgccggacttcctcgccggggacgcgccggccctggccctgccgcccagcgcgctggtgaagctgcccaccaggtcgccgcagggggagccggcgtgcacgccctgcacgcccaccgccttgctggcatacatcagccgctcccccgcccaccacgacaggggccgtgcgcgcaccctgccgttcctggacacctgccggggatgtgtgcaaggtgaaggatggcgtgagagggaggagggtgtgagagagcctgagctgcatctccaggcaggagcacctggcagcaggaaaggaggaggaaaccggcgcagatcacatcgccactcctcgagtgcatcctgccggccacgtacctccagccggcccccctcggtgtccacggcaccgtcggcggcgtgccgtggcaacgtgatgnnnnnnnnnntaggaaaggaggaggaaaacggcgcaaatcacatcgccactcctcgagcgcatcctgccggccacgcacctctagccggcccccctcggtgtccacggcgccgtcggcggcgtgccgtggcaacgtgatggagtccaggtcgccggggtacccgtccaggccaggggctcccagcaggcgccgcgcctccgccagcaggcgttcgtgctggctcctcctggcaggccggggtgccggtttgggggccggaccaggggctgttgccgcgaccgggtgggcggaggcttgactggccgcatccactggcgcagcgaggggcgcggagtcatggctcgcgccgggcgcctcgctcggtggtcggagaccctccgctgagcctgaactggggccctccgctgtcttgccggcatgatcgacaggaggatgctgcccgggcacaaccccttcgggcacgcctgagctgcctggtcgagggcctgggctaggnnnnnnnnnntatccactggcgcagcgaggggcgcggagtcgtggctcgcgccgggcgcctcgttaggtggttggagaccctccgctgagcctgaattggggccctccgctgtcctgccgggatgatcaacaggaggatgctgcccaggcacaaccccttcgggcacgcatgagctgcctggtcgagggcctgggctaggttgctcggtgaagtcgggggcttgcccgaggggtgcaggtatgccagcatcccaatcattggcggctgaagcattgttctgctcctgcacaggcggcgccgtgcttgtcgtgacgctgctgaactcaatcgccagtgtcggcttctggctgggaggaggtgcccctgtggtgtccgggtcaccatttgcagccacatcacggccgagagccctagagccctgtgtggctgccctctcaccatcacagggagggagggnnnnnnnnnnttcggcttctggttaggaggaggtgcccctgtggtgtccaggtcaccctttgcggccacaccatggccgagggccctagagccctgtgcgactgccctctcaccatcacagggagggagggatgtctgtgtggaaggaccaagagggagagggactagaagctctgaagccgcatcatgtcaatggggctacacccacacggggattgcccaaacacaaacacagatggctctcccagaccacagtgtcctaccatgcgcacggcttctatcctgaagtcgccgctcttcgcactgtcagggctatcatctggtctgccggcagccgggccggttgggagcctgcgcttgggtcgtacattggatggtaagcggccagatagtggggagaggagcacaagcactcgcacacgcacaccaggcgacccagcgcacatggatttgaaacgaatcgcgtccacacagctcggcgtggcctcgtcttgacgctggcacgcagggtcaggatcagagtcctttgcactgcgctccaagtcgagagtctcgtggctgtnnnnnnnnnnatcttgacgctggcgcgcagggtcagggtcagagtcctttgcaatgcgctccaagtcgagagtctcgtggctgtcgtccacggttgggcctgaagcctccatctcaggtgtgatgctactttatcaccgtcatattatatggtagcagaatgtatgtagacccgaagatgatgtctcgccccgacaccgcttccaactgcacatgcgctcattaatgttacatggaagtgggaggtcgcccctccggtctccgtctcgaacacattatgaacggtggaatatcgacgaggcgaaacctgtgcagaaccggcgacccagcgataacggctcgtaaatatctgcataaaattnnnnnnnnnntggcgaaatctgtgcagaactcgtgatccagcaataacggctcgtaaatatctgcataaaattatcaactgcatcatcggtggctcagaccctgccacccaacgccagcatggctccccagaaagcctcggaactgctggaggggcttggcaagcgcctagaatcagaggaggaactgaggaagagcctgtgtgcttctatcaaggnnnnnnnnnntcagcatggctccccagaaagcttcggaactgctggagggccttggcaagcgcctagaatcagaggaggaattgaggaagagcctgtgtgcttctatcaaggtaggcatgctgccgaaggaggagccacgatctgccagggagtcgccctgttgctaaacctgggagttcaaagaatccttctacccttgtgcttggcccccatcacctccgaattacgcacgccgcgcagtctgttgtcgtgttcgtcattnnnnnnnnnntggagcctcgatctgccagtgagtcgccctgttgctaaacctgggagtccaaagagtccttctacccttggcccccatcacctccgaatcacgcatgccgcgcagtctgttgtcgtgttcgtcattgacaaggaggagtggactctggacctgcggcctgggcagggctccctgtccaagggcagccccgctgagaaggcggacctgacactgaccatcaacggagccaactttgtgcaattgtgaggcggggaagagacagggagaaagatgagggaaattccagtgcgtcttgttgccttcatgtttacggggattcccagagggccattcgaccggagccagcacagtggcacactcaccttgccctccacatttgtgtgattaccccagcaacatgccatgatcctcgagcacaacccacgcagggtgaacggcnnnnnnnnnngattcgtgtgattatcccagcaacatgacatgattctcgagcacaacccacgcagggtgaacggcaagctgggcgcccagcaggccttcttcatgcgcaagctgaagatctctgggtccatgggcctcgccatgaagctgcagcccatcctggatgccgcggcagagcccagcgccaagctgtaggaacatgcgagcacgcctttggcccctggggcagccccgggccccagcatcatctgtttcatcgactagcattcgaacccagaccccagtccctttccccctgcatgagtcattcctctgatggtggtgcatggcttagacaaatcgcagtaatgttgtagcataggtgttcacgccgagnnnnnnnnnngtggtggtgcatggcctagatgaatcgcaataatgttgtagcataggtgttcacgccgagcggcaggtctacatgggtggtcgctccgactccaggacgtcccaggcaaagccttcctgggacacgctcccagcggcaggcttgggcaccttgggagctgctgcgatcgtcttctccgtcaccatcnnnnnnnnnngaagccttcctgggactcgctcccagcggaaggcttgggcaccttgggggctgctgcgatcgtcttctccgtcaccatctggacgtgcctgacctgggtcggcttgggcgtgggctcggcaacggtgcccgacatggcactcatcgaggggggaccgttggtgagaggggccaggggtgggatgcggacgctaccaaacgccactgccacctgctggctggctgggctgccagcaaagtcccgtctgtacttgcgctgtgcctgtcatggtcgtccagggtgatgccgacggggtgagatgtgagagtttgttgtgtcggcagggcacagagaatcccgcgccgccggccactgacgagaaggggcccacgtccagagggcgcgaggcatgcgcttgttcgccagcctcgcccatcatgcgccgggcctacnnnnnnnnnnccatggccagatggcgcgaggcatgcgcttgttcaccagcctcgcccatcatgcgccgggcctacccaccagcgtgaggatcttgagggcctcgtccacgatggcaggcttgatgctgtgttccgggacggccaccgccaggtgcaccgcctcctccagctgctgcagcgtggccccgaagcgcaggccctgcaggcgggttgaaagggggtcaaggctcacaacgtttcattgccattgagcggggcggagacggcctcgcaagccgacgctgggggtgcgccactcgacgccaggcgagctggctggaaatgccgatgtgcatgtctgcagaagattccatgggtccatgggtggacatggggcctgagacctatttcccaacagccaagcccttggagactcaccgcgatggcatgcccaaagagctggtccggcatgtcagccatggccaggttggagcagatgaggagctgcttgaggcgcaggggaatgccggggctgctgtatatgtctccatataggtgcgtcctgcagggtacattgaaagggtgacgggaccagctggacagtgggcggggagccggccctgcactctccttgcgtgccttgtcgtggagtcgacccaaacagagcctgcccctgtaatccagaagggttctttccaagcctccctcnnnnnnnnnnaggaccagctggacagtgggcggggagccagccctgcactctcctggcgtgccttgtcgtggagtcgacccacacagagcctgcccctgtgatccagaagggttctttccaagcctccctcacccaaaatccccaaactccagcacctttgtgtcctcaccggatccactctgcaagcacagggtcggcatcgtgcagcttggctcgcacggtgtccgtgaccgaggtgtagaccaactcaaatgcattccccggggggccgcccaccttgccggggacgtgctttggcataaactgcagtgcagggttggatgcggtactgctcatcccagcacgggcatggatggtggatgcgagcagcgtgtctcaatgccttgcggcaccgccatgatcacgctttgggccacatccttcaccttcaatccctcacagacacgcannnnnnnnnngaactgcagcgcagggttggatggggtactgcgcatcccagcacgggcatggatggtagatgcgagcagcgtgcctcaatgcctcgtggcaccgccatgatcacgctctgggccgcacccttcaccttcaatccctcacagacacgcaccccggccttgtgcagggttagggtggccttcagggctggaccgtacccaatcaatctgtggaggggggtagttttacaatggggcctcgccactgaatttaaacccatgagcgtcgcagcagttctggatgggcgcgctgagagcacccggggtcgccccccaaatgtccaagtcccactcacgnnnnnnnnnnagtagttttacagtggggcctcgccactgaatgtaaacccatgagcgtcgcaggagttctgggtgggcgcgccgagagcacccgggggcgccccccaaatgtccaagtcccactcacgtgacgaggaaacgggtcgtcgcgacgagctcctccaggctcccacccagatcatagaactcccgtgccaagggagcgaggcggtcccactggtggcatccagctgcattgaagagtcggatcaaacaggcctccttggggagcaggctcatctcccgggtgatagcctcctgacgactttgcaacgatgcggcaaggggtatcttcagaggcctgactccgccgctacgccccgagggtgccaggcgcgctccaaggaatgccctccctggtccgacaaccacacgccgggaaggagggcgtactcctatgacgcaaagggcgcgacacgcaaagctcagtgcatgcatgtatggcacccaacgttacatgggttagggtgcgcctggactctgccagtcgatgcctgtcgtctctacaattatggcctgtcggtcccggagttgagttcgcaacagcaggcacagcacgaccattaaggattggcgacaccagcccagcacacagacagtgcagatggttggtgaggctgtcaatgggttcactccactgatgtattatcccaacccttgagagcttgcaactgagtccctgccaatgaaaccccactgctccattctacattccgcgagtgcacagggtgacagtacctaatcacgcacgggcatggcagggctcgaactgcacatgtcagatacgctagggatgcggtgtgtgtcttcgtcttctcagaggcagcagagaaagagagctgccaccttagatcttgccctcctcggtcagagcctcgaacctcaggatgacaaagcctacggccagaccctgccagtcgtattgggttgactgatgtcagagtcgcaatttcaatgctattctgattcaagcaggaccgaatgcagtgcaacccgaaggatcgtgagcgtgacagaggggcacctcaaagatctggcttaggggtaaaaagctgctcaccagaagggtaatgccgaacatgacggaagctacccccgcgatgaaacctccttcgcccgccagctgggcgatctccgagggaatggcctgtgccctcacccgtcgcagctggcatggaacggtggtaatctgccttgctgggcggactgatgccgctgagcgtccatgaatgctgcgagtgaggcgaagggagggaggatgtgaatgacacgaacgccgtggaatgacgaagagcgaggctccggcgtgctgcacgcaccccctgaccgctgtcgctcgcaggggcagacggggtcccagggacgcagcagggatcagcgtcgcatgggcctgtagtgcttgcatagtcgctaaagttgtagcctcggtggtatgcgcacagctccacggttcacctgagtgggcatggcgctgctcggcgctcttaaatccggcccctctatcctagcctcgccacaccccatgctggacgatgaggcgcgctgtcccaatgccataaactgaggttcttcccctacagcaatcaccacaccgtccaggtgagtcccagacctcttcctaacttataaactttatatttatgggtatatgcgctgatagagaccctgtatcgcctggtgcgtgggcgtggcgggggtaaagcaggcgttccggcagcgtaccccgagcccagcgacgtcccatggcacgagatttccgcttgcacatgcctgcattgttccggagcggtccttaaagcgcatgccctcctcgattcgggccacatcgtcatcctgagtcgtcctttacctgtctcggcgctgcaacccctccccttccagagacatgtcccatagcgagaatggcgagactgcagagtgccccctgtgctgtgcagagctggacctcacagatcgtagcatacgatattgtgattgcggatgtgagctgcaggcggaggggggcttgtatcatggggtgggagaacagggtgcagcatgcaccggccagcgtgggccaaatgtttgcactctcgacggagtgggtctcaccaggccccactcggcagaaagcagacccaagcagttctccactggcgctggtatcctgccnnnnnnnnnnttgcagcatgcaccggcctgtgtgggccaaatgtttgcactcttgacggagtgggtctcactaggccccacacggcagaaagcagacccacgcagttctccactggcgctggtatcctgcccaccccccgtcggtacccatccgcagaccaaatgtgcctgtggtgttatcaccacatcctggaggaggcggggaaggcgagtttgccggcccgctgtcccaactgccggatgctgtatgaccagggcaagatccagatgcagcacatcgacgctgagcagtgagctgggggtgtgttggactggggagggagggactggcgcttttgggcaccatgcatcatgcatctcgacaccatcgtccgtgctgctcgcgccgtcgccttcccctcaccaccctgtgcacatctcaagcctctccccacggcaccctgcgcttgacgtacaggatgtgctacacccgcagtcaccctcttcccccacaagcatnnnnnnnnnntcgtgccgctcgcggcatcgccttcccttaccaccctgtgcacatcttgagcctctcccaacggcactctgcgcttgacgtacagaatgtgctgcccccgcagtcaccctcttcccccacaagcatccctcctcccccaacatcatgcgcaggctggcagaggagaaacggcgcatcaagggcagggagaagccgcgcgctgcgctacgctcccgcgccggcctggccaacatccgggtggtacagcccaacctggtgtacgcggtgggcctgcccatggacacctgccatgaggacgtgctgcgggagcaggagttcttcggccagttcggccgcatcgtcaaggtgtcggtcaaccgcgcgcagccgcacggcgcggggtcgacgccgccgcgccagggcgccacgggcagcgcctacgtcaccttccgccacgcagccgacgcgctgcgctgcatcaaggcgctggacggcggcagcctgcgcggcaagcccatcaaggcctgcttcggcaccaccaagtactgcaacgcgttcctgaagggcctgggctgcaacaacccagactgcctctacctccatgccgtgggtgagctcacgtggggtacctggacgaggcggggcgtgcggcggcgaggttgcgtgttggagattgtcctgccagcgtcaagggtgatggggtctcgggaggcgtgagggctgcagcacaccannnnnnnnnntgtggggtacctggacgaggctgggcgtgcggcggcgaggatgcgtgtcggagattgtcgtgccagcgtctagagtgatgggggctcgggaggcgtgagggctgcagcacaccatgttcacaggcgcgcggaacgcccagcaggccagcgttcgactccccaccgcatgtctggcgtgcgtcaccaatggcacccccacgccgggctcccgcacgtgcagtgcacccgctgcctcccggcgccccccggcccaagcccctgccctctcttnnnnnnnnnnacacgccgggctcctggacgtgcagtgcacccgctacctcccggtgccccccggcccaagcccctgccctctcttcctcgcgcagctgacgacgccgactgcctgaccaaggaggaggtggcagccgggcagctgccctcccgcttcatggccctgggcgcgcacaacaccttctgcccgcgcctgaccatccacccggtgggcagcagcggcgagcgcagcatcgccgtgctgccggtgccgcgcgccgcgggccgcgctgcggagggcgctgtgcctcaatgcgcgggggcgagggaaaccgtgggcggcgcgacggccgcagccacccgggacgcggtggggggcagcgcgccgctgccgggtcggtgcgagcccgcctcggccgtcgccgagccgccgccgcctccagcgagccggcgatcggcggcggtggcagcggcgccgcatgcgcagaagcaccaggaatggccggagctgggcggcgtggatcgagggaagggaggcgcagaggtgcctggcacgacaatatcgccggcggggtgcagcaacgggcagccggacgccccgctgccgggtgccctccccgcgccgccctcggcagggacttcgcagtgggccgccaccgtcgccgcgcctgcggaggccaaggccgccaagcgagcggcagccgtgaagaagccgcagctggtccccctgccctcccccgccaaggtcaagccggcgctgatcagtccgcgcctggccaccgccgtggtgcccctgtcggggcgcgcgtgcgcgccccgacagcccactgccgtgcagtcgggcgaaggggaggcgcagcctgccgagctcgccgccgcgcggtcgtctgaggccgcgccggcggctgaggctcccgcggggcccggtgtgccagggtcctcggcgccggcgcggcggctggtcgcccccccgggctttgaatcctgggacgcggtgcgggcgccctcccgctcagtgtcctccagcacgctcagcgagggcctggcggcccccttcccacggcttggggctgagggcgcggcattcgagctgcagggccccacgagtctgctggccaacggattccggaatgaggtgcgtgttcgctgtgtggagaggcaatttctcaatggagggaaggggggggggagggatgctcatccaatcgcgggggctgggcacccctgtagatgactgactccacgatgcgccgcaccacgacccccttcacttcccgcacggtcgcacaggatcggccgccccttgccctctcgaccacgggcctgggctcgggccgccgccagcagtcgcgcttcgcgtttgctcagggcgaggttggcgggcctcccatggtggcagaggagccagcccgcgcagtgcgcgccccgccgggcttctcaccccccgccccgccccacgtcgcccccggcctggcgctgctgcagcagctgcgagccggggtgccggcaggcctggcgcgcccgcagcagcccctgcagcagggcatggggcacctgccgttcccagacccggccgtcatggccgcccagccccagctgtcacggccggcgccgccggggttcgacctcaggacgtgactgccgcgtggctgtaaacgctgcgaagggcacagtgttcgtcagagggatgggtggctgtcaggcaagccagcgtctgaggcgttgtcaagggtcgacgctacgactccggcatggatgggcttgcttgaaactcacaagtaattgcatgtataaaatcagaggagggtggtagaagcaaatcgactcgcatagcctcacagcgtgcgggtcaggcaaacagnnnnnnnnnnccgacgctacgactctgacacggatgggcttgcttgaaactcacaagtaattgcatgtatcaaaacagaggacggtggtggaagcaaatcgattcgcagagcctcacagcgtgcgggtcaggcaaacaggcgtatgctgccgtcaaagctgctggtagccagctgcccgtcctccatccccaccagcgcccgcacggctgcgggcgtgtgcgcccgcagcactccgacgcactttccagtggccgcgtggaaggcgtggacggctccccccgcgccggcggcgcacaccacccccgcccccgcccagcccacgccccagttctggaagcggtccaggggcaggccgaacaggcggcgcagcgggcggagcgcgccggctgcgtccccgggacccatcagcagcacccgccccgcgtccgtggcgaccgccaggaagccaccgcagggcgaccaggccaggccgcgtgcggagaaggacaggtgggggtcgtcggggtcctcattcagcccgtgccggtttgcgatccgcagcgttgggtcggcgccgggcccggagcgctccaccaccagctccagcagcacggtgctgccccgcaccgcggcaaggaagcgaggcgctggggggtcgtcgacgtcgccttgcaccgtcgcgccgtcacctggaccccgccctggcgtgccgacgccggccccgcgccccgccgcgccgcccgagatcctgggccagaaaaccaggccctccacgtggccgtcgcagggcaggcggcacagcgtgctcagcgtgtgcgcctcggggtccgtggcgtgcagcgcggcgctctcgtcccagctgccgctgagcagcagcggcgcggcgccggcgggctgcggcgcccaggccagcgcggtcacgtacttcctgtgcgccccggcgcaggtggccagtatgggcagcgaggggggcgaggctgccagctcagcgcgcaccagcacgacggcgccgtccatgcagccggcggcgaccaggggacctgccctggaggaaaagagatggggcaatgagctggaaggacgagtcggnnnnnnnnnnnnnnnnnnnnnnnagcacagccaagctcagcacgccactgccggcaaccgaggaggaggccagcacggcccccgtggccacctccgtcgccgccaggcatccgtccgcgccgcccgacagcaccgcggctcccttgccggggatgcagaccgtggccaggcacgcgacgcagccggcatgagccccctggaccacatgggtgggctccaagggggcggggcccagcggcagcgcgtccagagnnnnnnnnnntgggtcggtcacgagccgtgaccctgctttgcacgtgtcgagcaaggcaatgcacggcccatgctcactcctggtcgggcnnnnnnnnnncgggtcggtcacgagccgtgaccctgccttgcacgtgtcgaacaaggcagtgcacggcccatgctcactcctggtcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcaccgcggctcccttgcctgggatgcagaccatggccaggcacgcgacgcagccggcgtgagcaccctggaccacttgggtgggctcgaagagggcggggcccagcggcagcgcgtccagagcccgcgtggcggcgcgccgggcggcccaatcggcgtcccctgtcctgtcctccgactcggcaatgacctcgtggcagaccaggtcgagcaggtgggagcccagggtgagccggcccgcatcatagctggtcccagtctctgactccagggcggccagggctgcattgggggggatccaggatcgcgctggctcacgccccagcatccgcatccatcgggatcaagcttgtatttccgacgaaaaccacattctcttgtgtagctaaactagcgggggttccgttcgcccttcccttcccccaacctccattcggcctacccttgctcnnnnnnnnnntcacattctcttgtgtagctaccctagcggggattcggttcgcccttccctttccccaacctccattcggcctacccttgctccacccatggtcggcaaggtattgcatgactgaggcaagggctctgatgtcgggatccaaaggcagtgacatcgcgctggacgtgcgggcggtcaggggtagcaatcgagggccgcaatgtcacccgggggtcatgtgcacgaacgcatgcaacagcgttgttcacgaatgcaggagtctctacttcatttgacggtaccaatcgatactcgagccccgctactagacatgtgtacaacgaaatcgtaatggtattttcgacgctgtgaaaccccgttgttgcttcgctggcgtgtggcgagccaagctgggcgcgcccagcctcgctggtgcaacaaaatgtttgctggtaaacattccggaaagatacagtcatctccgcgcggcaacaagtcagcatgaccatcgtgttcgcggnnnnnnnnnngtctttgctggtaaacattccggaaagatacattcatctccgcgcggtaacaagtcagcatgaccatcgtgttcgcgggcaaattttggtgctgaccaccggcgttgggctggtatattcgcttgtagacggaatccttgcgacaccaagcgagcggagaccctccctacaatgtcgaagagggaggattaaatggtatataactttgaaggcacttcatatccggacatatggggggaccggtgctgccgaatgggtacaggactcttgccccgtcgacaacccgttttcaaattgatgcaacttggcacctcgcggggatggtgcggatcttaccgaggcacctcgcatgagcatccagccagggtggaatctctcactgcttcagaccatagcgcatggaaaattggctcactcttgttgtaattacacattcatcactatctgagccactgaagtataccttctgtgctctgccctcaccctcccgaaagcaacctgtccatcatatccccaccgtcgtggatgtgatctgcactgctccatggcgacgctgaccctcgccggaacctccctgtcgcttttccatgcacgcacggcattgcctgccgagcggggccaccgcgctcgaccgaggctcgtgacccggtcgtcagcagggcgggatgtggagcccggacgcggcagcgtcgggcccagcaggcgcactgggaaggcagaagcacttccagcatgcgccccacaagcctcagtggtgcaccactccactctggaggaccagcgtcagagggtggagggcctggtgggcaggctgcacgcggcccccacgtacggagagaaggtgaggggtagcaggagcctcggctgggtgttggggaagcctaccagctttggcgatacccatcctcgttggggaagagggtgcatgcgaccctcaccttacgggaatggcagacgtccttgcattgcatgctgctgcattgttacccctagaccttttgatctgtcagccgcgctggctgcgcgacatggcggcgcgattcctgagctgccctgtccttggcactccgccatgacctcctgatccctctcannnnnnnnnnctaccctagatcttttgatctgtcggccgtgctggctgcgcgacatggcggcgcgatttctgagctgccctgtccttaacactccgccatgacctcctgatccctctcacttgcagttggagatcgtcatgggattggatgagacccaggactttcttcgaaacacgaggcgagtttgtgggagggtgaggtgccgggcctcgcgggaaggcacgcatcatctgcacgcatcgctccttgcgcctctttccgtatgctctgatggccgtgtgcccagtcagctgnnnnnnnnnnacatcatctgcacgcatcgctccctgcgcctctttccatctgctctgatggccgtgtgcccagtcagctgatcactgagtgcacacgctggccccctcctggtgagcagggagggcgcgacagtcgagcgccacctggccctgctgggggtgagggacgcgtacctgctgctcgtcctagtccccctgggccagcgtcacgtcctgaccaccatccccacgggtaaaggggaagagcaatgtgggggtctcgagctgcatgtggtggaggaggcagcggccgtggctgtgcacgaggcgtcagacctgggggctatgaggatgtattgctcataacatgctcttcactcgccacaatcgaccgtgctccgctgtgccggcatcgctgcggccttgacnnnnnnnnnncaacatgctcttcactcgccatgatcgaccgtgcaccgctgtgccggcatcgctgcggccttgacgtccattgagccgaccacccctcccaaccctcctccctgcaggtctggccctgaacgatgcgtttgccaagctgctggcctccctggccggcgtggagcgggcctacgacgccatcggcggcctggccggctaccagctgcagtgcctgcgcctgctgacggccgagtcgcgcgcgggcggcgcggcggccgagggcacgacgcgcacgacgctgcacgtcccgcgcgggctgcgcctgaacggctcccgcgccgcgg

SEQ ID NO: 40453 - DNA, 101 bp, Chlorella protothecoides
tcctcaatgctagccatgcaaattgcttcggcgggcaagtcgtcggcgctgcggtgaacgcacagatcagacacagccggatgggtggaacaggagctgcg

SEQ ID NO: 40454 - DNA, 85 bp, Chlorella protothecoides
cgccttctcaaagtcctgcccgcgcaccgcagcgtccttctcgcgcagcagcgcacgcagctccttgtccaggtcgcgcgcctcc

SEQ ID NO: 40455 - DNA, 70 bp, Chlorella protothecoides
ccttcccctccctcagccccctaacccctcccccccccctttacccaggtcgtcccgcgcgtgtctgtgt

SEQ ID NO: 40456 - DNA, 62 bp, Chlorella protothecoides
gatatcagggcaccatctcattatgtattcaagaaccccccccccccccccccccccccccc

SEQ ID NO: 40457 - DNA, 77 bp, Chlorella protothecoides
catccagttgggggaggagagatggcggggccccgagctctttttcgaccccggcgccttcaccaaaggtgacatgg

SEQ ID NO: 40458 - DNA, 114 bp, Chlorella protothecoides
catgcgctggtcacctggccgatggggtccgcatcctggagactgttcagcgtgtgcccaacatcccagctggcagagtgtcttgcgccggccaggtccggtgtctggcgcaag

SEQ ID NO: 40459 - DNA, 61 bp, Chlorella protothecoides
tggcgagggtggcgagggtggcggtggtggcgattgccgaggtggtgatggcgagggtggc

SEQ ID NO: 40460 - DNA, 74 bp, Chlorella protothecoides
cattgctgcccggcacggaggagtcagcggaagacctcactgcaacacgccaaccccataccccaactaacaaa

SEQ ID NO: 40461 - DNA, 97 bp, Chlorella protothecoides
ctcttgtgggtggtggtggtcaccacgtcggcgtagtcgaagggcgagggcaccacgcccgccgccaccaggcccgagatgtgggccatgtcggcca

SEQ ID NO: 40462 - DNA, 92 bp, Chlorella protothecoides
tcgcattgtcagcgtgcctcaaacacacgccaaccacatggtgagtgttcatttcctttggaatgtgggggaaggtgcctgcaggaaggact

SEQ ID NO: 40463 - DNA, 61 bp, Chlorella protothecoides
aagtttccctgcgtcttggtcatggcggggtacttgtaggacaggaagcgcttggcgccct

SEQ ID NO: 40464 - DNA, 61 bp, Chlorella protothecoides
gcagcctctgactcggcagagggcggcggggctccaacccccggcgatgcatggggcacag

SEQ ID NO: 40465 - DNA, 61 bp, Chlorella protothecoides
gccagacgtccccgaccgcatcgtggccacctcggtgaccgccacctggaagtacagcgca

SEQ ID NO: 40466 - DNA, 61 bp, Chlorella protothecoides
ctcatgattggggcggcgtgagtgagtcgactgcgggcggacagattgtgctctgccgaat

SEQ ID NO: 40467 - DNA, 93 bp, Chlorella protothecoides
gaaagccaagtacaagtaagaagcgagggaggagttgaccatcgtgcagggcgtcctaccatcgagggcccggcgacccacatccgtccacac

SEQ ID NO: 40468 - DNA, 61 bp, Chlorella protothecoides
gggccaggggaatgggatggtgggactgctccctgagggcaaccgacaccacatggctcag

SEQ ID NO: 40469 - DNA, 107 bp, Chlorella protothecoides
aggggtggtgagcgacccggggtggtgagccatgtgcttcccattgtctcagctgctgagcaccaactgggcacgcccagtcagatgtggatgcttggagcacagga

SEQ ID NO: 40470 - DNA, 61 bp, Chlorella protothecoides
cgcctcggtctctctcggcttcctcggggggctgagggtctgctgcagggcccagaagggc

SEQ ID NO: 40471 - DNA, 66 bp, Chlorella protothecoides
cgggctggtgggggagtactgagggctggttgggctgtactgcgggctggtgggggagtactgcgg

SEQ ID NO: 40472 - DNA, 62 bp, Chlorella protothecoides
cggacactcctttgggccgctcgacgggcgacggccccccgccccctggcggccagcgttct

SEQ ID NO: 40473 - DNA, 61 bp, Chlorella protothecoides
ctccaccaggtgccgccaggcgtccatctcgctggcgcggtccaggtcgaagccggcctgc

SEQ ID NO: 40474 - DNA, 119 bp, Chlorella protothecoides
gctcgccggcgagcgattcgccctctgcgccctgctccgcgcccaccctcgccccacgctggtggcggcacttgtggcgctggtgctccgcgccctccatgcggccggaagcggagctg

SEQ ID NO: 40475 - DNA, 73 bp, Chlorella protothecoides
taggcaagggaggggccttcccatcacgctgcacaacaagactcttcagtgcctgtggagtagttaattcagc

SEQ ID NO: 40476 - DNA, 69 bp, Chlorella protothecoides
ctctttatcaccagcatctttcaccccctccccccccttcccccccccaaccaactaaccccgtaggtc

SEQ ID NO: 40477 - DNA, 61 bp, Chlorella protothecoides
ggtgctggcaggccttggggctgcagcggccccaggaatccggtccccgccatggcttctg

SEQ ID NO: 40478 - DNA, 100 bp, Chlorella protothecoides
aagatcgtcgcaacgcatagccatcatggcagcctgatgcaggcatggttgcagagcataccaccagagcctccgctcctcaccgacataaaaccagccg

SEQ ID NO: 40479 - DNA, 61 bp, Chlorella protothecoides
ttccgcgcagggaccccgacttgctccacaagcaaagcttgagtgcgcggacgatatagat

SEQ ID NO: 40480 - DNA, 77 bp, Chlorella protothecoides
tgccgggagtgagaagaacttggaagtgcatgcgccctgtgggagggggtgggaggcttgccagagtcacacggcgg

SEQ ID NO: 40481 - DNA, 68 bp, Chlorella protothecoides
cacattgtgctggggatacatcggccgtaacccccccctcccccacgccttccccgacttcccccctt

SEQ ID NO: 40482 - DNA, 61 bp, Chlorella protothecoides
cgagaacagggcatgtaggggcttcagaggggccatgccatgcctaggcatggattgaaac

SEQ ID NO: 40483 - DNA, 61 bp, Chlorella protothecoides
cgactgcgatggcaccaccagcgtggtcgccctcctgcaggccagtggagttgcctgggga

SEQ ID NO: 40484 - DNA, 66 bp, Chlorella protothecoides
gcggacagggaagggagctatggtactgcaagaaccccactgccggctcagcaggcatccaaggga

SEQ ID NO: 40485 - DNA, 61 bp, Chlorella protothecoides
gtcgaccgcgcagcgcgccgtgagggaggcagagcaggaagctcagagggcggagtccgcc

SEQ ID NO: 40486 - DNA, 79 bp, Chlorella protothecoides
cagccttgatgtcctgtgggagtatcgtgcattcatttgcccagggtccgcatgccttcctgccaacgctgcacagacc

SEQ ID NO: 40487 - DNA, 68 bp, Chlorella protothecoides
cgggggcgtggcgcgccgccgcctccaccagggcgcggacgatgccggcgttgatcttgaacaggtcg

SEQ ID NO: 40488 - DNA, 114 bp, Chlorella protothecoides
ccaggcgcccatcgtctcatgtacaggccattcagccgcgacgcccgtcgtctgaggggttgcaccagcccaccctgcgcccgccgctctgctccggccacgacgccaactttc

SEQ ID NO: 40489 - DNA, 61 bp, Chlorella protothecoides
cgacaatgtgcataattgcggcacgggataccgcctgagcacattcgtgaccctcctcgac

SEQ ID NO: 40490 - DNA, 19313 bp, Chlorella protothecoides
  modified_base (128)..(198): a, c, t, g, unknown or other
  modified_base (272)..(281): a, c, t, g, unknown or other
  modified_base (346)..(355): a, c, t, g, unknown or other
  modified_base (651)..(748): a, c, t, g, unknown or other
  modified_base (934)..(1165): a, c, t, g, unknown or other
  modified_base (1310)..(1319): a, c, t, g, unknown or other
  modified_base (5187)..(5196): a, c, t, g, unknown or other
  modified_base (5335)..(5344): a, c, t, g, unknown or other
  modified_base (5489)..(5498): a, c, t, g, unknown or other
  modified_base (10839)..(10848): a, c, t, g, unknown or other
  modified_base (11121)..(11130): a, c, t, g, unknown or other
  modified_base (11778)..(11787): a, c, t, g, unknown or other
  modified_base (13011)..(13020): a, c, t, g, unknown or other
  modified_base (13427)..(13436): a, c, t, g, unknown or other
  modified_base (13835)..(13844): a, c, t, g, unknown or other
  modified_base (14809)..(14818): a, c, t, g, unknown or other
  modified_base (15224)..(15233): a, c, t, g, unknown or other
  modified_base (15578)..(15609): a, c, t, g, unknown or other
  modified_base (15835)..(15844): a, c, t, g, unknown or other
  modified_base (16439)..(16448): a, c, t, g, unknown or other
  modified_base (16994)..(17003): a, c, t, g, unknown or other
  modified_base (17207)..(17216): a, c, t, g, unknown or other
  modified_base (17545)..(17554): a, c, t, g, unknown or other
  modified_base (17721)..(17730): a, c, t, g, unknown or other
  modified_base (17883)..(17927): a, c, t, g, unknown or other
  modified_base (18594)..(18603): a, c, t, g, unknown or other
  modified_base (18859)..(18868): a, c, t, g, unknown or other
  modified_base (18934)..(18943): a, c, t, g, unknown or other
  modified_base (19125)..(19134): a, c, t, g, unknown or other
ctggcggcggccgccgggcgcacgcgctccgcggcgctcgacgcgacgctggaccttgcctccaaggccaccgccgcggtgtccgcgcagtacccccacgaccaccagcagtaccacatgcccgtggnnnnnnnnnnnnnnnnnnnnnnnnnnnnnnnnnnnnnnnnnnnnnnnnnnnnnnnnnnnnnnnnnnnnnnncggggaggtcgacaggcgcggcgcgagacccgcgcacgcgcgactccagcgcagacggggcgcctgcccccgcnnnnnnnnnngcgtgcgctggcagccgcgctggagcgccacgggttcagtcgcgccgtggtcatgggccactccnnnnnnnnnngggggaggtccacaggcgcggcgctcaggccgcgcacacgcgactccagcgcagacggggcgccagcccccgcgggccctggcgcgccagccgccgcgcttcccgcgctgcgcagcctgagcgcggcgcaactgcccatcgtcttcctgcacggcgtggggtttggggtgttgccctacctccacttcctccgcgccatcgtcaagtcccacccggggcacccgctgctgctggtcgaggtgccccacgtctccctccgcctctgctggcaggccgcggaggtggacgaggtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggcacctttgttgcctcgcgcttcacccagctcttccccaaggtgtgtgtgtgtgtgtgtgtgtgtgtgtgtgtgagagtggtggaaggggggttgcatgatcgggtgtgcgcacctgtgggccgccaagtgaccgtgcaagatggttcactgctgagtgacccatggagaggagcctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaggtgatcaagatggtgtgggcgctgtgtttgtgaggaggatagttgcacatcgtcgggctcggtgccgcaagcataccttctacctcagccctgggagtctcgactcctccacccatgaccaccccgaggccctaacctnnnnnnnnnnacgcgagtggtggaagggaggttgcatgatcggatgtgcgcacctgtgggccgccaagtgactgtgagagatgtttcaccgctgagtgacccatggagaggagcctgctcatcactcggtcctcttttcatcccaatctcacacacacccctcgctccgctgctcgcagatggtacactcccttgtcatcatggaccccgtgtgcatgctggtgtgctacccccagctcctgcacaacttcatctaccgccgcccctcgcgggagaacttcacctctgtgtcggggtcgctggacctcatccgcttcttctgcagccgggacctcaccatctcccaggtgcggcggtgcagggaaggggggggggggacaagatggtgtgggcgctgtacgtgtgaggagggatagttgcacatcgtcgggctcggtgccacaagcgtaccttctacctcatccctgggagtctcgactcccccacccatgaccaccccgaggccctaacctttgcttgcctgacagcatgctcaccctccctcctgattctgaccccctttttgagttccacaaaagttgcgatgccccccacctctcgaaacctcgcgcttcccaccacacgtggtcgcaggccttctgccgcaagttcaactgggcagagctcatgctgtggcccgacgacatccccgagcgctgcttggtggtggtttctgggctggacgacctcgtgccctctgccctggtggtgaggcagctgcaggcggccaagcatcccgccaagatcatgcaccacccgctgctgggccacggcggcatcctgctgctcaacaattggcagcgccaggtcatcgccagcatgggccagttcctgaaagaggtctgagaccggtgacttggcgagtgggaaaggactgtgcgaaatgcatgatgtagccccaggctcgtgcggtagtgttagtgagtagtgtgggcagcttgtcataggtttttatctttggactgtctttcttctccagaataaatcggtgtttgctgcaattgcagacttttttggtgtaaccttcagtgaaggcctggtcaaggggggattatcaggtggacagccccagtttttggacggcgatgctcagacccgcaatcatggcaagcatgaagatcggcagcaaggggaccgcgacccatgcatttcaccgagacgcgccaagcctggaaccagcgatcgatctgccaagcgagcctcactccaagcacactgcagaatgataaggaagcgactattaattctgtgtgcgacataattaaaggagtctcacgccgagctgccgcttgaaagcaagcttcattcagcagtgtcagccaagccgcctaccatgcccctggggcacatgacagggagctcgtgagcgcatggacctgatcaaccccagcccggtagtccatgagcggcgtgcaacgaggcagagggtgggtcttggggctttacaaggcgttgagttggtgatggggccaggtgcattctgcccacctttaaacacgtgtgccgtctggcccaactaaggggtccgcctggctcgcaggaacgcgtcactaatgccagaggtagagagctcatcgacaacattgaagtgtacgaggtgagggaccctccctgtgagtcttgggcatgggaatgtcccttgagggaaaggggtctgccacaatttggcagcctcccatacttcccagcctgccccccctcacatcctccaaaccctctcacccctgcgccgcacccactccaccccaccacagcatgtccgggacatcaaagacccggagcacccatactccctggagcagctgaatgttgtcagcgaggcagccatcgacgtagacgacgagcagggcagcgtcaggtgggatgccgccgttatatgtggtgatccctgaactgtctcagcgaggcgccacaagcagcgctgatcgcgtgcttcgctgctgtccaaccaggcacatattcaatgcgatgcctgccccaccaatgcccccccttacacagggtcaccttcacacccacggtggagcattgcagtatggccaccctcatcggcctctgcatccgcgtgaagcttctgcgtgtgctccccacccgcttcaaggcgaggctggggcgtgttgggggaatgtctgcgcatcttgcagccggcgaccttgtcagtgtggaggcaggttctgtggcgccctgacaatcctcgttccctgctgagaagagtccattccccactctccaaccccccccttactgaatcaccacaggtggacatcgtgctggcgccgggcagccacgactccgaggccgccgtgaacaagcagctgggagacaaggagcgtgtggccgccgcactggaaaaccccaacctgctagaaatggtgaatgcctgcatcgccggcgccgcgccggcctgaggtcctgttgtccggcgcaggggcgcaggatgcatgcgctctcgctcgccggatgcttgtttttttaacgctctcagatctatgtgatgccctatgctggcaaatgaatttcattacagctgtatccttcaaagttgatcatgaagcacagggtcagactgacgcaccggaccaggcaagccagggcaggaggatgagacgggggggggcgcccatctcaggaacccagtgtagggactgggcgggcagggcatgcatggacgacagtcctcctcctgggtagactgcctcattgtgccttgggcaaggggatgcagggcactccaggccgaccagaagaacacagacgtgaagaacaagggagtagcaaggggcttttgtgtgtgggtggggggggcgggggaaggccctgggcagcgcttcacgatgcacgaagaggggaggcgctgggagggacacggagcatggaggtcggagcaagtggcttcggcgaaggcgccagctcccggcacctcggggcagctcccaccgctcccccgcatgccagcggctgctccaccgcacaacccgcggccgctcccccagccactccgccaccgccttaggacacctcggcggtgccggcggtgaagcccggcagctcgtaccggtacctgccgtccggcgcgatgccaaagcccttggggtcggcaaacacgttctccagcagctggctcatgtcgggcttgggcgaggcgtcggcgtactccacgcagtcgtccacctcggccgccacggaggcgtgcagctccgcgaggtcggcctcgctggccagcccatgcttgagcatgtaggcgcggagctgggggatggggtcgcgcgccgcgtagtgctccttctcctcccgcgaccgcagctcgtcgggatcggccagggaatggccccggaagcggtaggtctctgcctcgatcagcgtggggccctcgccgcggcgcgcgcgcgcgacggcctccagcgccgcctcgcgcactgccagcacgtccatgccgtccacatgcactccgggcatgccaaaggcggggcccttcttgtggatccagggctcctcgtcgcccagggtggaccccgtggcgcgcaggtggttcatgccgatggcccaccggttgttctccaccacgaagatgcagggcagcttgtacagggaggccatgttcagggactcgtagaactggcccacgttgcaggtgccgtcgccaaagaagttgacggccacctggtcggcgccgtcgtcacccagcacgcggcgcttgtaggcgctggtgaaggccgcgccgaggcccacggggatgccctcgccgatgaaggcgtagccgcccagctgcaggcaggcggaggggtgttttgtttggcgggggtggggggtggtttcaagggagggtgggtgggtgggannnnnnnnnntggaggggtgtcttgtttggcggggggtgggagtggtttcaagggagggtgggtgggtgggaaggggatgggtgacgtggggcgatggcacggaccacgtccaggagcaaaatcggcctgcaatctcttcggccaggcnnnnnnnnnnatggggcgatggcacggagcacgtccgggaggaaaatcggcctgcaatctcttcggccaggcttcatacccattgcatgcagggaattccccatcactcattgtaaccccccccctctcctccaactcaccagtccgtactcggnnnnnnnnnncatacccattgcacgcagggagttccccaccactcattgttaacccccactctcctccaactcaccagtccgtactcggcgtcaaacatgtgcatggagccgccctggccgcggcacgtccccgtcttcttcccaaacagctcagacatgatcttgcgggcggagatgcccttgctcagggcgtgcacgtggtcgcggtaggtggaggagatgtagtcgtccttgcgcaggcaggccttgatcacacctggagatcaagggaagtggacccgggtaggtgagcggcgatcgccggccgggcacccacctcaatacgcatcgagaccccgaccgccctacctgtggagaccgcctcctggccagagtagaggtgcacgaacccgaacatcttgccgcggtagtacatctgggcgcacatctcctcgaactcgcggcccagcaccatgtcccggtacagctccttggccgtctcagagctgatgctggccgacttggacgcactagtactggcctccttcgtgggagtggcgaccgccttggcgaagacctggcgtgcggcccgggtcggccgctggggaccgcggctgggccggaacgcagcgagcctgtcggcccctgcgccccccgtacgggagcagctagacagtcggggcgtcatagcgatggaatacatggtgcacagttgtgggcatcgaccagggaatggcgtctagacctgcttttctggcatggacagattgagtcgatgcaccatcccgacccccccccgcagggagttgatgggctgaaactggaaaccgcgaaccggcagagatgcagctactggttgaggccgtgcattcccttgctgaagagaaatgaatgctatcactgacatctattcacgtcctcaaagctgacccactgttcctgattgggctcggtcctaaacttggcttgtactactcgtgcagtagtggttggaggcatgcatgccgcctgtgataaaaggctcggagcagaatgggatcccagggcacagaccgaggcccaggtttatttacagaacagggatgggttgatgttcggatcctgtatgtactgaagtgccacacccacactgcgctccaactctggcgagttcggacccattctggtgtgctgatcgccccaccatccgacgctgcccaggctcaagtgcgatctctgggcggatgggtgacgctggtcagcggtcgcagggaccccgtccaccgaagcttctgagtgatgccctcgtacctgcattgccggtgagcggtggttgcttggcagcagagtggggcaagggcccctggccagtgcagcacgcagtgagggacacacccagcaaggcacattgcaatcctcgtttgcattcaccaaggccgatgcacaggcccccccccaatctcccctcaccagtcctcgtccagggggtggcggttgatcataggtagcgcataccgcgaggcccggcacacgatggaggagtcgcgcagcatgcgcatagcgtggcgcccgtcgaacgaggccctgcaaggtggcaggaaaagcggctgggtgttttcagatgcgcgttctgtatgggcctgccagctccaggcgtagccagcgatggatcagcctttcattgccccaaagctctgctccagcgccctcccaccactggcccgtcgccctgcggtgtgtcctcgcatcacctcaacccatacagcccacccacgacaccccacatcatcgtctccgcaaacacaccggaagcatccccccacactcccacacctggcctgcgccctggaattgctgggcaggtgcacctcgatcaccgagttctccggcaccaccaggggccggaaagaaagggagtgcggcgccacgggggtgatgatggtgcagggcaccgagggcgcgaccatgggcccccccgccgacatgctgtacgcggtggagcccgagggcggcgcgatgatgaggccgtcggcctgcaccgtggtggcgtgccgcccgtccacaaagcactcgagcagcaccatggcgggggaggcgccgcggtccaccaggcactcattcagcaccatgtgcacccgctgcatgcgtccggccctttgagcgaagcgggaggggggaggatggcggcagcgctcaccgtgtcgacgagtgtgcctgttcaccatcacgatcaggggtgcgagaggtgcccaggcatctccaccctgtgcttgacgcagcctggctgtgaggcggatcaacctccctcatcccctcaccggtgccaagacagttgattccccccaacccctgtccgctcctcaccagtaaacctcgcactggcgccgggttctgagcgtgcagaagacgggctcggcctgccagggcggccagagcagcttggccagcacggcctccgcctcccccgccgagaagggcgtgaggaagcccagggtgcccatggcaaaggagatgacggggggaatgggccgagcgtcatcggcaaacaggctggccaggtgcaggaccgtgccgtcgcctgtgaagcggggggtgcgggcatgcgaatcggtgtggggcggagcaagggggcgagggggtccctcgtcgctcctcgacaggcgtgagtttggcgcaggtggacacaggggacagctgcctgctgcatgtggttgtgccggcccaggggtccgctcccaggcgatggggtgatgcagcaggtcacaacagtgcccccccaggtcattccacatcgccaccgcctcccacctcccagggtgatgcagaggtccacagaatgcacgtcatcgccgctgcatgcttcaaggtgggggaactctgcgaggacctgacgctccaccagcacctggacgccccgcccccgcagcctgcacagggggccatgcgcgggagtcgggaaggcggcgctcgccgcgacaggacaaccggacggcaggggcgggggcaagggattcagattcagggttctacgcaccagatggccagctgctccagcttctgcgaggcttctgtgtcccgatgcttcttcaccaacagcacggtggaggggccccccggcttgaagcgcaggagggcgcggcggtggaggcccaagctactatcgtccgcccaggcctgtataaggtggaagggtactgtcgtggtggaggaggcagacctgcaaacagcctttatggatcaaggcagcaggagcccccctagactttcccccttgccggaatccatggtgcttccgggcagaagggccgagctgtatgtatggcgccattcctcccctgatccttaccaagctcgctccagccaccacaccatcgtggtattccgcctccctgacgctggagtcatgctggaagcggaattgtggctgatatgacggaccaatctgagagagagcctctcgtccaccttctgccgccgatgccacacgaccccatcgcagggagatcctggctcgagatgcacactgcctcagcatcgctcgttcaggcgggaccggagtcctgcccagcgccatgagcggtcatcctcggtgctccacccccatgatcaaactcgaagataatgccttcttattctccagtgtttgtggactcgagggtgaagtatcgactctggcatgctgtcattctacccctaaaacgaccatcaatgcaaccccgtcttcaagccagagcgcgcggtgaaatcgcgcgccggcagcgccatgcgaggtgcgagctggggttcaacgccatgactgaccccagatagtgcatgtatgccttgcacttcatagagagagataaaaagtgaaactctgtatgtacgtgtgtcagggaaggaattgtgcaaaagcctttctgtgcttgtctatacccgctccgtataaccgagcctggacctacaccatgtgagttcaagatgatgaggctcaccttagtagatttcaaaatttataatgcttctaaacccacccgccgcgttcttctatgtctgcagtctatcaagtggcgcgggtcccacctgggcatgctcctccacctcccctcctttcctcttctcgcgcagcgattctatcaaacgtgcacagtcacagcaccatgtcgactgatgcagtggagaaggcggagcgcaagaggctgaagaaggagaagaaggccgctgcggctgccgctgccgccgccactggggcaggccccagtgccagcacagccgaggccgaccccacccccagcaagaaggagaagaaagagaagaagaagaagaagcgggaagagggatctgaggccgcccctgcccccaccggcaagaagagcaagaaggcagcacccccggccggccccgccccccttgccgaggtgggcgaccgcgagctcgtggccaagcgcccccccctggtcaaggccctgtacagcgaaactgcggaggtggcctctcagagtgacgcagaggtggcggcctggcgcgaggcacgggcaatcgtggtggagggctgctccctgcgtcccatcaccgcctttgcccagaccgggctgtcgtccacccagctgcacgccgtgcgtgctttctcggcgccctcccccatccaggcccagtgcctgcctatcgcactgtctgggcgcgacgctgtcggcatcgccgccacggggtcgggcaaaaccttagcctttggattgccagccctggcccacattgccgcccagatcggggcgggcgtggtgacggggaagaagcccatcgccctggtcatcgcccccacccgtgagcttgccatccagatcagcgtggtgctggaggaggcgggacagccctgcggcatcaggtgagggggccggcatggaagtatctgttgactttttacgtggggtctgactggggagcctggctgctgaggccggaggccggggtgtctcatcacagcgaataggcttggaggctgccagacgtcatgctggtatcacgcataccctggcaccacacgaatgccgtcccttggccagcaagacaccccggccctgctgcccctgaaccccacccacaatgccccctcaccacagctccgtgtgtgtgtacggcggagtgagcaagcgcgatcaggtgactgctctgcgcaagggcgctcagattgtggtggccactcctgggcgcctggaggacctgatccaggacaatgcctgcaggtggggcgaggttggtttttacgagtgggcaaagggtctcctgctttaccagcttgcaggagagctacaatgtcaagcgcgcgccatgctcatcatatctggtgatcagagcctggcattgtcccccccttgcaggctggacgacgtcagctatctagtgctggacgaggcgnnnnnnnnnncatctggagatcagaacctggcattgtccccccccttgcaggctggatgacgtcagctatctagtgctggacgaggcggatcgcatgctggatcttggtttcgagccccacatccgcgccatcgcctccaagacacgggcagaccgccaggtgaggcgagggaattgtgcgaagggggccatgttgagagcatgctctagtcaggcgtgcttgggggggtgtattatcagagcaaggaagcagggcacctcttggaccagtttgtagtgaggnnnnnnnnnncagggggccatgttgagagcatgctctgatcaggcgtgcttgggggtggtattatcagagcaaggaggctgggcacctcttggaccagtttgtagtgaggcgtgaggctcaaaccccgcccatcttcgattaacagcaagtccaggacgtccacccacggcctctgccaatcaaaacagccttgccctcctcagaagcctgcgccccgcacccgcaccatcccccccctccctcaccctgcaccagaccctcatgttttcggccacttggcccaacgtcatccgtaagctggcgtcggagttcctgtccaacccggcccgcgtcatcatcggctcccaggacctcgccgcctctcactctgtcaagcaggtgcatgtgttgatgtgtctggagtggaaagggaggaaagggggtgggttaaagtgctgtgtcagcatggaagcagggtgcctggcatgcgcgcagcgaccatctgctgctgcatcgcttgcttgctgtcctggacaagctgctgagctctgcagtggcaagtatgtgagctgtactattcccgttccactcatacacctcgctgcgatcacgagcgtggcaccagttccctgcccagacacctccctgcgccgctccccttccccaacctcccctcannnnnnnnnnagtatgtgagctgtactgttcccgctccactcatacacctcactgcgatcaagatcgtggcaccaggtccctgcccagacaccacaaagcgccgctccccttccccaacctcccctcaacccccccccctccccgctttttagatcgtggaggtgatcgacgcccccgcccgggacgcgcgcctgcatgccctgctgcagcagtaccacggctcccgcaccaaccgcgtgatcgtgtttgtgctgtacaaaaaggaggccacccgcgtggagtccctgctccagcgaaagggctggaaggcggcggccgtgcacggcgacatctcccaggcccagcgctctgctgccgtggacgccttcaaggccgggacggtgccggtgctggtggccaccgacgtcgcggcgcgcggtctggacatcccggacgtcgaggtggtgatcaactactcattccccctgaccacggaggactacgtgcaccgcatcgggcgaacggggcgggccggcaagaagggtgaggctgtggtggcaaggattcgttgtgtggggggtcactcatggagggggctgcggctcgagagctcgcgctggggtgtcatctggcccgcctcagagccgaggcgagcatgctcccgtgcagactccttgtcttgggcagggtccttctggccccacagcttcatgcctccacatcaccttaccgccccaaccatctcatgcctcacccctgaactccccaataatgacaccaggcctggcgcacaccatgtttgtgggggccaacgacaagccacgggcgggggagctgatcaacgtgctgaacgaggcaaagcaggaggtccctgccagcctgttccagttcgggacctcggtgaagaagaaggagagcaagatgtacggggcgcacttcaaggacgtggacctcacaaagaaggccagcaagatctcctttgacagcgacgacgagtgacctgctgatgctccgtggcggtggaggatggaggagaggggtggcgtgacacgccaagcgtccacggcagggccacgatgtggatgttcggcgtgcgacaccgatgtgcacgtgggcacacggttggctgagcactcccggttctccttgaagcattacttgctggctgcatggtacgagcaccgctgacactcgagcaagagtctgaggctgggctgatccacgaacaccccaagtaccaaacacaccttctgnnnnnnnnnngtggtaccagcaccgctgacacccgagcaagaggctgaggctgggctgatccttgaacaccccaagtaccaaacacaccttctggccatgccttgtgcctcccctgacaaagactgcacacactcgagggggcagcatctcctgcactcactgttagcaaggcacacacgagcagacctgttcagagtcatggatagactcccaatgcaatccaatagaatcattgctggtttgctctcgatgaaactctccgggaggaggtgatgcttggtgcacgcaagcgggttgcaggatcacaagattcttgactagcgatcctcaacccagctgtggctccttgctctccttgcctgatttggatcggagtgccgtccgcgcattggacagcatggtgggaaaggcagctnnnnnnnnnngtcatgactagcgatccttaacccagctgtggctccttgctctctttgcctgatttggatcggagtgccgtccgtgcattggacagcatggtgggaaaggcagctgccattcttccagtgttcctccaaagagcttgtagaggcatcggcttactgggacggtcctccacctcatccaacctgtcaggggggtggggatgtcaatgaagcggcagccaggggaagtgggttgctcacgggggaacaccggagatccacgatttggcatccatgcttgctcgaccacacgtaggcattgcggcgtagctgaaggacttgctgttctgcacatcccgcccctcctcactcactcagagaccgagacgcctgcgctgagtaactggatttccagggcctcannnnnnnnnnctgctcgaccacacgtaaggcattgcggcgtagctgaaggacttgcagttctgcacatcccgccctcctcactcactcagggaccgagacgcccgcgctgagtaactggatttccagggcctcaatggcagcaatcttctccaacagggcatcatccaccacggtcgactgggactccagctgggcttggcgccgtctgaggtcactggaacggatcggagtggcgaagaagccctgaggacctgaccaaagtgtgcaggccaatttccatgtttgaatgaggccccatggaggacatagcagctcagccttcgggcctacctcaagctctcttccttgagggcacactgctccagtctcttgttcaggaccagctgcacatgctgcatctcgtcgtcgagcttggacatcgcggccaggagcgcgtgcaacctgaccgtggcttggtccacggtactcccatgactcactccatgaagggcgaggtcggtcaacattggggtgtacgtgcgaggtttgagtctcaaaggagcgtccaactgcttattccagcctgtcggtgcactgtttgctcgagtctcgggcgtaggccatctcgcgagaatgagtcagcccgtgccccggccccttcctgctaaacatgtaccctgtacaccagcctaagcacgacacgtgaagtgccagaaataaagatcaaggggcaaggcttctgtgtgtaaatggaaagaggaaagtttcttttgtgcagtgcgtgagggtgcgcaatgagcctggtgaagggtgggggtacgtggggggaaagtaggacgaagatggcagaggggtactgatggatgggtttctgacgtggctcccggaaggggagcaggacggcgcgccgccctccgagcctccatcgcctcgtgttgcgcggggcggccgacggcgcggcccggggccctgcctccggcgcatcaggccttggnnnnnnnnnnaatcgcctcgtgttgcgcgggccggccgaaggtgcggccccgggccctgcctccggcgcatcaggccttggcgccctgagccgcgccggccgcgccctctgctgcgccggccgcgccctgggactcccccagctgctgcaccgcgccggccttggagtcgcccagcagggtctgcaccaggctccccaccgagttggtggacttgcgctctgggccagagtactcgccctgcgtgggaggcggctaacggagtgggtggggcggcaggcggcgtgagccctcctcaagagcctgccacccgccacgcactagccccggtcttgcgcaaagccggccggtgctggcattccaatgaaagttctcctcgaaaccaacccccccctcacctgctcgttggcccactccnnnnnnnnnncccagagtactcgccctgcgtgggaggcggtgaacggagcgggtggggcggcaggcggcgtgagacctcctcaagagcctgccacccgccatgcagtagccccggtcccgcggaaagccggccggtgctggcattccaatgacagttctcctcgaaaccaaccccccctcacctgctcgttggcccactccgcgttggcgtaggcacggaagtgcctgatgcggtggaaggagatggcgttggaattgtggttgttgaaaaactgcggcagcgcatccgacccgtcctcagaccaggggctgaaggaggcgcgggagacgatgaccaggtcggtgcctgggtggnnnnnnnnnnnnnnnnnnnnnnnnnnnnnnnnaggggcacatccctccaccaccaatgcggcgagggagtcaacaggtctccgaccagatccaggccacagcattcctccccacaagttcccagcccctcaccatccaaccccccaaaaaccactacggccccttctctcctggccgttgccctctatcaaccaacccctccccccccacatggatacaaatcaacgcaccgtcgaccatcatgtgggggtaggcaannnnnnnnnncccccccaaaaaacactacggccccttctctcccagccgttcccctctatcaagcaacccctcccccccccacatgaatacaaatcaacccaccgtcgaccatcatgtgggggtaggcaaagtggcgccccagcttgacgtggtaatcgacgacgcccgcgctggtccagtccaccaggttggacgagtagtagagcatgagcgtactacggtccacctcacacttggagaaggccgtgatgtgcaggttgggcgccagcaccgtgcccttgcccggctgcttccaggcgcgcaccgaatcgcgattggcgttggtggccatccagtacaggtccgagacggcgtcgtagaggatggaggggtgccccaccgccagccccgggatgttggtgtagcgcaggaagcgggagcgcagacgcccgggctcgctgtcgtcgtactccaccagcgcggccaggtcgcacatcaggtcgttgttcacacgcatgatgctcagaagcttgccgttgcctgcggagtttggggaggagggaggggtgatgaaagtcattgtgtgtgtggagaggtgaaattggacagaggcatggcggtgtgnnnnnnnnnnagagtttggggggaagggaggggcgatgaaaggcattgtgtgtgtggaggggtgaaattggacagaggcatggcggtgtgtacgacaaggcagggagcgatcttcaaacgactgcaccgtgccgtcgctttgcagccgggtgattgggctgccccactcgggcgtcctgcccaagaccacctgaattcaagtccacacgccccactcacacagcccccccctcacctccgtggcggtcctgcaggcgcgtcaccacgccctccatccagtacaggctgccgaaacccgcctcgaacgcctcctcattgtccttgatcccgtcgagcttcatgcccacaatggattcgcggacctgagggggtgattgaatgagcagcgggggaggggggggtgagattgtgccgggccacaccgagaacacagggtggagtggcggttgcccacattgagagccaacgagtgatgcttctcccgtatgaaagcgagagggcaaggagggcccgctgccactcataagcatccagggtgtcacgccttgcctcgatnnnnnnnnnnttgcccccattgagagccaacgtgtgatgttcctcccgtatgaaagcgagagggcacggagggcccgctgccactcatcagcatccagggtgtcacgccttgcctcgatttacggtgcacccccctcgtctccattgcagtccctccaaggcgccctccctctccccccctctcacacacccccttgtccggccggaaggcgannnnnnnnnngccgccccccctcctcgtctccattgtggtccctccaaggcgccccccctctaccccccccacacacccccttgtccggccggaaggcgacgtcgaagagcacccgcatctcgttggcgtaaacggaggccgggttccccagcggcgtgctcatcgtccacgactccggcagcgtcaggtcggcgccctcgtccccactcatggccatggccacccagtccacgccgccgtacacatttgaccctggcgggcgggaggcaggggggactggggatggcaaacaggtgcctggaggcttggcgcccaagggacactcggcgcccaagggnnnnnnnnnntactgaggatggcaaacaggtgcctggacgcgcggcgcccaagggacgcgcggcgcccaagggacggcgcggcgcccaagggacggcgcggcgccatgggggcgagcgggggcgtgatccccttgcccctctactgccgcgccgccgcagccctggcatgcccgccnnnnnnnnnngcgcagcgccatgggggcgagagggggcgtgatccccttgcccctctaccaccgcgccgccgcagccctggcatgcccgccccagattaggcttcccactgcatggcgcccccacttcttcctcccacattcacctccccccccccccccccnnnnnnnnnnnnnnnnnnnnnnnnnnnnnnnnnnnnnnnnnnnnncacacttggaactcacccgacccgacggtcacgttctggcccttggcgagcaggaccgggaccttggcccagtagtggttgaagcgctccagacgcaccgtcagcacccccgcctcggcgtcggcctccagaatgcggaagaagaaggggtggccctccggctccgcgcgcgcgacctggaccagggtgaagggcacgaagccagcggcgctggccacaggcagctccagcaccggcgcgtgctgccaggagtgggatcgcgggccgccgcggatgggcagcgtcacgtcctcccgcagcacgctggaggtcacggggacggccatggaggggatgacctcgaaggtcttggtcacccgcccgccgctcacgtccacgcccgtgttggcagacaccacgctccacccacttgtgatcttgctgggggcggaccaggtcgcgcctgcatgcggtgcatggggtagatgtgtgtggtggccggggggctggactgaggcgtattcttgttgttgccttgggggggacacgatgaaaatcgttgtattgcgtgacgagcaacggcccgatgggaagtggagaccaaggtgtggtagtgatttgccgcgagaattaatctggcctgggcactggctgccaatgcaggggggacccccttgacccccaacgnnnnnnnnnngacacgacgaaaatcgttgtactgcgtgacgggctacggcccgatgggaaatggcgaccaaggtgtggtagtgattcgccgccgagaatcaatctggcctgggcaccggctgccgatgcaggggggacccccttgacccccaacgaggctagcctctgcactctgtcaagacgctgctgagcgccactccgtcgggaccccacatctcaccgcacaacccccactctctcccgcacacccgtgtcgtccagcatgnnnnnnnnnnacaggggggggagcgtgtggtgtattgcagttcctccgcggacaggggctgggatgggcagggcannnnnnnnnngaggcgctgctgagcgccgctccgtcgggacccacatcccaccgcacacaccccaccctctcccgcacacccgtgtcgtccagcatgcgcgagatgatcagattgttgtcctgggagaagtggcgctccgtgcccacgacatacacgccgctcttgcacctgaaaatctgcatcggcggggnnnnnnnnnnccagggggggggagcgtgtggtggattgcagttccgccgcggacaggggctgggatgggcagggcagtgccaaagtcaatgcctggggcgccggcaggccatgccttgaggcatccacgaggaccgcctggcaccctccctgcaccattccagaaaccagcaaggagtgcactgccgtc

SEQ ID NO: 40491 - DNA, 113 bp, Chlorella protothecoides
aaccctctggccatccagtgggttgtgtacattgctctcttctggtgcgtctttctggaggggcggtgtatccgctgaaacaaaacatccagagaatcttgtcgtctgtgagc

SEQ ID NO: 40492 - DNA, 74 bp, Chlorella protothecoides
atgccacggactgtaggaaatggaaacatagacttcatttgaccaccagggtaagcaggagatacacacggcca

SEQ ID NO: 40493 - DNA, 61 bp, Chlorella protothecoides
gccgaggtggcggcgctggagggtcgcacgaagctcggcgcggccgaggccgagcagcgcg

SEQ ID NO: 40494 - DNA, 72 bp, Chlorella protothecoides
ccgtactgctgctgcccttgccgccgcaagccccggacccccggccgcggctgggggccctgccagagacca

SEQ ID NO: 40495 - DNA, 72 bp, Chlorella protothecoides
cggccttgcctcgtgggtggggggattgtcaagtgcagaggaggggggaggcgagcacaggcttggcccagc

SEQ ID NO: 40496 - DNA, 67 bp, Chlorella protothecoides
tgtgctgaaccacggaacacacgctcacacacccattggaaggtgccggctccgggagcctattcca

SEQ ID NO: 40497 - DNA, 14725 bp, Chlorella protothecoides
  modified_base (677)..(686): a, c, t, g, unknown or other
  modified_base (996)..(1005): a, c, t, g, unknown or other
  modified_base (1643)..(1652): a, c, t, g, unknown or other
  modified_base (1911)..(2002): a, c, t, g, unknown or other
  modified_base (2918)..(2927): a, c, t, g, unknown or other
  modified_base (3111)..(3120): a, c, t, g, unknown or other
  modified_base (3547)..(3556): a, c, t, g, unknown or other
  modified_base (3812)..(3821): a, c, t, g, unknown or other
  modified_base (4057)..(4066): a, c, t, g, unknown or other
  modified_base (4967)..(4976): a, c, t, g, unknown or other
  modified_base (5183)..(5192): a, c, t, g, unknown or other
  modified_base (6591)..(6600): a, c, t, g, unknown or other
  modified_base (6955)..(6964): a, c, t, g, unknown or other
  modified_base (7240)..(7249): a, c, t, g, unknown or other
  modified_base (7492)..(7501): a, c, t, g, unknown or other
  modified_base (7650)..(7659): a, c, t, g, unknown or other
  modified_base (8251)..(8260): a, c, t, g, unknown or other
  modified_base (8519)..(8528): a, c, t, g, unknown or other
  modified_base (9018)..(9027): a, c, t, g, unknown or other
  modified_base (9985)..(10037): a, c, t, g, unknown or other
  modified_base (10249)..(10258): a, c, t, g, unknown or other
  modified_base (10626)..(10635): a, c, t, g, unknown or other
  modified_base (11024)..(11033): a, c, t, g, unknown or other
  modified_base (11146)..(11155): a, c, t, g, unknown or other
  modified_base (11562)..(11571): a, c, t, g, unknown or other
  modified_base (12206)..(12215): a, c, t, g, unknown or other
  modified_base (13362)..(13371): a, c, t, g, unknown or other
  modified_base (13975)..(13984): a, c, t, g, unknown or other
  modified_base (14328)..(14337): a, c, t, g, unknown or other
ggccgccgcgccggcggccgcggcgccgcggtaccgtgcggggtccagccccaggcaggcggcgaggcgcgcggggtcggtgccctcgatgggggcgcagaggcgcgtgaccacgggcagcacctgggcggagaggtagtagagggcggaggggcgcagggagacacccgccgcgttcacctcctgcgggtggtacgcgcgctccgccagcgacctctccggcgcggcgacctgttggtgcgcctcgtcggctgcctcgtcgcagatcacgtacggcacggtttctccctgcagacagcgttgggagtggatccgaagatgtgcaaggtgctgtcgcgatggaatgggcaggctgaatggcgtcgaaaggcacccgacgccccacgtttgctcggacgcgcggcccttggatagaaagccctgggcgtcttgggggccggctacttggagcagccctcgaggcacctcctggagcccccactcgccatgtcacaacgctcagcatgcccaggctcgctcggaccctgctccgcgtacactccttcctcaaaccccagccgacacagccaaagcccccacctgggcgacgccatctcgctttccagccgccagccgacgcagggccacctggacgtggggctggttcttggcgtctgggtagtcgctgggctgcttgnnnnnnnnnngagccacagcccccacctgggcgacgccgtctcgctttccagtcgccagccggcgcagggccacctggacgtggggctggtttttggcgtctgggtagtcgctgggctgcttggtcagctgcttggtgatgatgaacttgttcaaaggcacggcctgtgcctcaacctgtgaatgtgtgatgtgtgtgtgtggtttgtgtgagagggcgaggaggtggagaggtggcggcccgagggctggtcagccaagtgcttggtgacctctcgaaagacttttgttgtgcctcggctcaccttgagccggacgtcnnnnnnnnnngggcacggcctgtgcctcaacctgtgattgtgtggtgtgtgtgtgtgtgtgtgtgttttgtgtgagagggcgaggaggtggagaggtggcggcctgagggctggtcagccgggtgcttggtgacccctcgaaagactttggtgtgcctcggctcaccttgagccggacgtcgtccaggtgggcatggacggcctggaccacctcctcccgcgccttgccgctcaggatctctacaagggcggcgtgcggtgtggtgggcagggagacgaggggcgaggggagcgtttcttggaccacgccagaatcccccggcaccatgttcagggtcacatgccgggagaacagcgcagggaagatcctgcacggcggtcgacagggtgcacagcaccccagcgctcccaccgcccctgccaggtgagtagctcacacctgtgaggacggcattccccacgtccttggccaggggacaccagtcacgccgaacgatgtccagccccttttgctccacgctctgcgtgacttgcaacgaggaaaagcatgtcggacagattgcagcaggcgtcctgcgcacaggcccacacaagtcggcgccccggccttcccctgttttcaccacgccacacacaaaccacccccannnnnnnnnnatcggcgccccagcccgccaccctccactgctttcaccacgccacacacaaaccacccccacccatcgcacctctgtgggagcctggtcgccgcgcgcctgctcgaccttgatggcggcgtactttttcttcttcagcaggagcatgcgcttgtacacgccatccacgtcgatctccagcaagcggtaccgcttgttcacctgggacaggaatgagggggttgcagtgagggggcgtatcaaggggtaggagggtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagggtggactctatcgcaaggctgtgtctggtgcctgcagcccggtccgaggtgcagctcacggtggagacacttgcactgtcatcctcccaaaagcctcgtttgagggcaccaaactcactgccccaccccccctcaccatcccccaacccacctccttcttgatggcgtggcccatacgcgtgaccgcctccaggtcggtgctggcggtgtggatcatgatggagtcggtgtcgccatagatgacctccgcgcccagggcaccctggaccagatccacggtgctctgcagaacctcacgcccctgggcggtcaccagctccgccaatgggcgggcatagaagcgggagtgggtgaaccccaggcagccatacatgctgttggccgtcagcttcagcgcctgctgccggatgtccagctgtgcgcggcgcacctggaggaagtagggattgggggggcagggacgatgttggcagggatgatgttggcaggggtgtggtacagtgacagtgctggtggcatacggcctctcatgtgccccgaccgagcgccagccccgcacaagtctgacgtttgcccggcggttccaccgcccacgatggccccagattggtacccccctcccactccccctatgaccccggcaggactcaccgcgtcccgctccgacttcagcaggtccttgaccgtgcgccggcgctgcaccagggtctgcagtaccttgggcagcaccgccagctcctcggagggcgggggcagcgccgggacggcgccgtcctgcaggggaaaggggggaagtttggggttctgtcaggtggattcattccaggccgaggcagccccgtcggcggccgaacgctcgagtgcctcgagcatgcctggggcctgcatgggccaaagcacccgcctcaccnnnnnnnnnncgccccgtcggcggccgaaagctcgagtgcctggagcatgcctggagcctgcatgggccaaagcacccgcctcaccatgtctggcgctggggactggactgcaatatcgccccctctccctcaggaccccacctcttcggcaccaccctcaaaccactgcccctaccttgggccgcacaacggnnnnnnnnnnttatcgcccctctccctcaggaccccacctcttcgacaccactctcaagccactgcccctaccttgggccgcacaacggtggtgaagcagatgttgtactcctggatgatggaggggtacagcgagttgaaatccaggaccaggacgtagcggtcgtacagcccgacccgcggctccagcaccaggccgccggcgtactgcggcccctttcccgacttcttcaccgccggcgcgtcgccctcgccctccgcctcctcggcggccgccgcctccagccgctccctctcctgcaagggcgtttgtgtgggtgtgtgtgtgggggggtgtaggtagtagtatgtatgaagaggattgggagcatgaaggcgttggggttccagcagggtggtttctatcaccccccctcagtgtgacaatgctcatggtnnnnnnnnnnggtttgtgtgggtgtgggtgtgggtgtggggggggtagtagtatgtatggagaggattgggagcatgaaggcgctggagttccagcagggtggtttctatttaccccccctcagtgtgacaatgctcatggtcggggagttttcgaacagactttgccgagacgctgcggtacctcctccccacaaccgtcgggtgcgcatgaagagtttgacgatgtcagggtcgagagcagcggcacctgcctcgtcctgatgnnnnnnnnnngcaccaccgtcgggtgcgcatgaagagtttgacgacgtcagggtggagagcagcggcacctgcctcgtcctgatgcggtgctcgctggatctacggcagcgatcagcctcctgatccttggtttgctctttgcagggagcatccttcactctctgtaccatgttgaaccccatcacaccgcccggcatccccctccaccaccccccacacaccttgccggagagcttgtccgggannnnnnnnnnccatccctcactctctaccccatgttgaaccccatcacaccgcccagcatccccgtccatcaccctcacacaccttgccggagagcttgtccgggagcaggaacttgcgcgcatagaattcgtgaaggagcaggctctcgatgcgctgcgcgcgctgccccgccagcgacctgctccaggcgctgcccgacagctgggccagcgcgcgggtgaggggcagcacgctgagccggaaggccaggcccagcgccagccacgcgtccgactcggtcagccggaccagggccaggaggcggtccgaggccgcgtagcgcgcggggacgtcgcccggggacacgtcgacgcgggcctcgcccagcaggctgcgcgccagcgtgcccagcgtgtagtccacctctcggaccaggtcgcgggccgccaggtaggtgtcgcacagcaggcggcccgccagcaccgccagcacgccgggggctgtggttgagatggaaggaggggcgtgagtgattgggggggtcctcgcagggtagggtggtcacgatgtgagtctggcggcgagggtgacacatcatcagcgtgcatggagccggggcgtggggcgcagggggggaagtgtgctgcatgtggcgaaatgacggcgcagcatcaccacgacaacgtagacagatgaaacaactctctgcatccttccccccccgtgtcacctgcaccgccgccaaactggtgcccgcccccggccaggctggggaacttgtggcgcttcagccggcccagtccgctccagtggggcacctgcatggggcaagccgtgccagcaggagtggaatgggggggctgtcaccacgctgggcgatcctgggccaaggccatctgtcatagggggtcgttgacgccccatgcacannnnnnnnnntcctcgcagagtaggggtggtcacgatgcaagtctggcggcgagggtgacacatcagcagcgtgcttggagcggggccgtggggcgcaggggggaaaatatgctgcatgtggcgaaaaatgacggcgcagcatcaccacgacaacatagacagatgaaacaactctctgcatcctcccccccccgtgtcacctgcaccgccgccaannnnnnnnnngaagccgtgccagcaggagtggaataggggggttgtcaccacgctgggcgaccttgggccaaggccatctttcatagggggtcgttgacgccccatgcacagcatcagatcctccccatccagacccctcatgggtatatgccccgtgaccgcccaggcatcgcgcatgggaggcccgccggcagtgcgcgccctcgagctcatcccctcgcaattgcgttcgtgcaccgaggccacgcccctcctttccagacctcgacccaggtaccgtaatcctgcagcccccctcccaccccctccaccgcacccacccaccttgtggtgctggaggcggtgcaggaggattggcagggcgaagcccgcaatgttgtgccccatcagcacgtctacgtccaacgcacgcaggcgggccaccagcatggccagcagggagcgctccgaggcctggcaggaaagcacggcgccgccattgcgccggcccacctcggacgcgttcaccgccttgacctgcgcctcgaagcctgcgtgggttggggaggccggagaggatgagcgaggagggagccatgggtttggaggtggcagcgtgatggatggcgcccttcacctaccccctttccccccacaaacacacgaaacaaagccacccccccagctctcataccgacagggaaaggggcgccgcccaggcgacagacggcagagaagtggcgcaggtcgcgcgcggacctccacccatcctgctgcgccgcctccacgtccacctccggcagatacaccacggaggcggccacgatctcggcggccgccccccccgtcaccagcgccgtctgcacgtgcaggctggccagggtgaggggcggcgcggggcgcacgccggccggggccgccgccacggccttgtgccccgccacctccacctccagcgcacaccaggagagctgggcgctgggcgcgacggcgcgcggcgcggccagggccagccacccgggccccatcaggcgccgcttcagcgtcagggcctccagcaggccctggttggcgccaaacacggcggcaaaggcggccccggtcaggccgggcggcagcgcggggcaggtggcggggtagcgcaccttgagcacccactggcgcccggggcgcacgccgcggttctcaaaagcgtaccgccgcagtacgggcttcatcaccatgctggtcacgccgtgggcctgcagcagagcccgcgtctcctccttcacccgcgtcagtgccgcctggtgaagggggaaggtggggggggaggatttgggaggggtgaggcaggaagggcctcagcgtgggcgaggcggtgcaaccacctccacgctgtcgtggcaagacacaacatgatgctgccctcgtgccgacgaagcaatcnnnnnnnnnntggcggtggaaccacctccacgctgtcgtggcgaaacacaatctgatgctgccctcgtgccgacgaagcaatcacccccgccgcgacccgccgcacgtggaggagggggatgagggcggcgcgcgccccggggtccgactccagccgctcctccagcgcggcgatctcgggggtggacacgtcctcgcggggcaccacaaagaggttgcgctgcaggccgtgcacgacggcgcagcaggaggcgtgcttgccgtcggcggtgggcacctgcggcgtgcggtggtgcaacagaaggtgatttcaagattggagctcattccaggcggtctacagcaatgaaactctcccatcactnnnnnnnnnnagcgcagcaggaggcgtgcttgccgttggcggtgggcacctgcggcgggcggtggtgcgacgtaaggtgatttcaagactggagcccattccaggtggtctacagcaatgaaactctcccatcactccacatccggtcagagcgtcggcccgggaggttgagggacgcagccgtcgagtacaaggaggcctcctgtccacaccgaccagtccatctcctgggcccacacaccatcacgctgacagactcccactcaccttgccaaagaggaagacnnnnnnnnnnaggagttttagggacgcagccgtcaagtacaaggaggcctcctgtccacaccttccagtacatctcctggccccacacactgtcacgcggacaaactcccactcaccttgccaaagaggaagacggtgccggcctgcgctggctcctcgtgcgcgtccagcaggtagaaagggagcgcgccgctggagtccaggggtagctccgccgcgtcaccggtgggagcgccggtcaacaccgcgccannnnnnnnnntgcgccgctagagtccaggggtagctgcgccgcgtcgccggtgggagcgccggtcaacaccgcgccatcgcccggcgccggtgtgggagccggggaggggcagtcgacgccggcagcgtacatgtcctgccagcccccagcagccacgnnnnnnnnnngggcgccggtgtgggagccggggaagggcagtcgacaccggcagcatacatgtcctgccagcccccagcagccacggccgtgtcgggggtggggggctgcacagggagggcccccgccggggtccgccagccgccaggctggggggtggccgccgcgccggcggacgcagcgggggtggggggcgggggcgccgcgccgtctggcatgcggatcccgccgccagctccggccggcgtcaagccggcagcttgctgccggcgctcgccacccggcctcgcgggcgtatcagcccccgcctgctctgttctgtccgccggcgggctcggggccatgagaggctctgcgtcctcctgtacctccatagcctctgggcggctgttaccctcggcacctgcagcctcctcagatgctgaacctgcggcgagaccctcatcctcgagcctgacaccaggctgcacctgcgggacctcctccttgaccactgcacttgcggccgcggccctgcccaggaaaggttgagttgctgaaggtcggtggtggcaggaaagatgcgtcgctactttcataaaagtgcacacaaccctgccacannnnnnnnnnagggacctcctcctcgaccactgcacttgcggccgcggccctgcacagggaaaggttgagttgctgaaggtcggtgatggcaggaaggatgcgtagctagtttcataaaagtgcacacaaccctgccacagcgggcaatggggttggcaggcagggagtcgggatgtgaagccagccttcgagagggcgggccatacaacctctgactgacctggctgggacctttgtcgcggcagcgagcgacagggaggtggtcccnnnnnnnnnncttgagagggcgggccatcaaacctctgactgacctggctgggaccttcgccgcggcagcgagcgacagggaggtggtcccggggtagcgcgctctccgagcaggggaggcggcggagggggagcacccggcagcggccacgccacccaggatgtcctccagcagggcttcggtggcggccgcatcgtggctggcgggtcggctgccggcgcgaggcttggcagccgcagaggcaaacatcttctgcatgcgggctcgctgggcgggaggggccggggcggggtcggccttgttcttgcgacctgtgggttccaggcatgggttgagagggggcaaaggttgacggagtggcatgggccaaggggtgcatctggataataggatcctctctaaaagaacattatcaacaattctgtccttggtaaactccatttcttcccacctttggcgagtgccttcgcagtgccggtgggcaggtcctcatgctccnnnnnnnnnngtgggagggggcaaaggttgacggagtgggaggggccaagggatgcatctggataggaggatcctctctaaaagaacactatcaaccattctgtccttgtaaaactccattgcttcccacctttggcgagtgcctttgcagtgccggtgggcaggtcctcatgctccccgtccccttccacgctccagtccacctcctcgccgatgtcggcgtaccccaggccattgcgatcgataacaaaggcccctgtagtatatttatgttcaatagctcctgattaattgacgctgtcacctccaggcaggcgcaccgaccgcagcactcgggttttaccctctgggggcgcacctccctcatcccgccgcttcttcacgatctgagcatactggtcctcgtcgacgacgtcgtagacaggctcttcctccttgacctcaaaagtatccacacgtcgagccccagacttgcgcagagcaataatctcggcaagtgcctgtttcgacttggctccgactcgtccctgcacgggccgctgccgcttcgttggttcagactccatgctgaccagagtttgagacgagcaacgatgcccggttctcgaaggcgctggctgtgagctcgctgttggcctctgaaagctatcgccatcggtgcgaagtttgaaagtttgggcgcatgatcacgtgccacttcgccccgacggggtttccgaaatcgcaggtctcggcgtaaccggcgcgggatctccgggaagttacattttcgatttccgactccgaattttcgagctgacatggcagtatcccacggggcctaggcacacccagcgcacggtgagaatggtgtaggcggcctaagcgagtgtggacataagcgcagcgtgtggaaaaggcaactggagtcagcaacaatacgttcacagcaacttaaagaggaggctttccattgaaagtgcaatggnnnnnnnnnnnnnnnnnnnnnnnnnnnnnnnnnnnnnnnnnnnnnnnnnnnnnagctgctcctcatgcgtagtatgcccccggccccaccctcttggccatccatgttgtttgttccggtgagcagattctggcaatctaatcttggccatgagcaagagctaggacctcagaaaatattcttggcagaattctagacagagtggggcttgaaccagcgctacttcacccagactcgggagcggtaccgcggctcccgttacagnnnnnnnnnnggctgctcctcatgcgttgtatgcccccggccccaccttcttggccatccatgttgtttgttccggtgagcaggttctggcaatctagtcttggccatgagcaagagctaggacctcaaaaaatagtcttggcagaattcttgacagagtggggcttgaaccagcgctacctcacccagagtcgggagcggtaccgcggctcccgttacagctaggccgcgactactaacgagcaccatccagattggcaacttgattgttcatgtgacccagcatccaaacatgatgcatggtgcgcccattgtcgatgctacatcatgatattatcatttttgtgtatggatgcagagtcaagctcttctcacggnnnnnnnnnncgctaacgagcaccatccagaatggcaacttgatagtccatgtgacccagcatccaaacatgatgcatggtgcgcccattctcgatgctacatcatggtattttcatttttgtatatggatgcagagtcaagctcttctcacggatgaaaccatgctgagtctcatgcgcgggcaagccgcgttcctccgcgtgcagaatcgttgctgccctcatcatgagccaagattgcttcttcatccgtgcacatgtcctgtacatgcatcgcattgagcacttcgcgtggtgccggaggaccatggggccatagccattgagcaggtgctcgtagcgtcgagagcacctagcactgacctgtaatgggagcaggggtactgcgcccaaactggnnnnnnnnnnactatagggtttgcattactgttctttgggctctgtcttttgttctcatccaaaagccatattgccagaatctgctagcggggacaacacgggtatggccgggagagcaaggnnnnnnnnnncctatagggtttgcattactgttcgttgggctctgtcttttgctctcatgcaaaagccataatgccagaatctgctagcggcgacaacacgggtatggccgggagagcaagggggtttgctgtgcgagggcagcaggccctgttacacgaacagccatcgagcagcagtcagaccccccccaccaatctataaggacatcggccgatgaacagctctcgccgcccttgtcccatctattatgaagaaagctgggatgctgatcaggaatcaacaacagggtggacgggcagggtagttcaaggtagtcagggagaacctctagtccggctgccgaggtggtatgaggatcaaggggaaatttcaacacttgcctcaaagctcccaggaggttggtattcaatacaannnnnnnnnnaggtatggggattaagggaaattccagcacttgcctcgaagctcccaggaggttggtattcaatacaaggcccatgccgggccacgtgcagaaggccagctctgtcaaggatgtgacagtgtgttggaggttggtcgcatgcacccctgatggcatttgtattgtctaatgatccctcagctcgaccacgtggcgagtggggtttcatctatacccctgtgtattcttgtccagagtcaacgccggtttaatgggtacctgctcatccaggctcttgcgttggcatgactacagcaccaagggctgacacgccaagcgcccgaaccttatagtcttgcccgtgcagtactacctggaagacaagggataattttaaacaaggtctagacaggagctgtgccacttgtgctgccggcattaatccatgggcatcatgtccagtgagcggcagctcatcggcgcagcatgttgcattcagtcatacacattgtggattccaaagaggaaccagaatcagtaaatacgaaggtgcagtccagggtttgtactcaactgctgtatattccatctcctcccatacaacgaaatgagcaggtagggcagtcgtgcaggcttcatgaatcccactgcggctnnnnnnnnnncccagtgagcagcaactcatcggcacagcatgttgcattcagtcatacacattgtggatcccaaaggggaaccagaatcagtaaatacgaaggtgccgtccagggtttgtactcaactgctgtacattccatctccccccatacaacgaaatgagcaggtagggcagccgtgcaggcttcatgaatcccactgcggctcaggtttgtttgaccaccctctactctctgatggctcgacggcgatgattgggttccaccgatgcgagcaatgtcgaattctcgatctcaaactcatgacttgactgttttcatgactgtcaataataccaacctgcgtcgcgcggtacatgcataccaccccgctcgcccgtgactagaaaaagcgacgcaggtgtgttcattgagccgctcttcagcaggttgagaagagtttcgactacttacagcatttaaaaatgaccaagtggagatagcggcggcttggtcggatgatttggcccgcggaaatggggcagggggggggggagccggccccgcagaagcttcgcacctcgtacctgaaattcggatgccttcctcagtatgactcctatacttttccttcgtaatactccaggcattgtactgccaatcctaagctttgcaaatcattgcttttatgttttgctccgttcacatggcggatctcctacctttgtttttgcaggtacggtgattagggctttcaccgcaggctgattgtgccgtcaaaatggaatattagtcctggtgcgacttcacgtgatgaagaatctccctcgcaacgtcttcatttttcttttcgcgtgaaaggagtgcgcaagtgcatgtcatcgaagccaaggccgtgatccaagggaaaccgagtcggcagcttgcgcgacgagcaatggggatcgagtacctcatccttgtggccacttgcgtcgtcgtgatgagcgggggcctcatcatgtggctagcacgggacctgaggctgcggcgatgctggcaacgaggcttcgtaccggccgccctgctcatgcgcgtgcatccgcgtgagtgccggacagtgcctccgcgcgtgcctgcggaaccttgggtaccctaacatgcttagctggaccgccctcctacaccagctttcaannnnnnnnnncaacctggggtactctaacatgcttggctggaccgccctcctacaccagctttcaagaacctcccacaccttcgttcctcactttcattcctcagagcaagttcccgaggggaccaccctggatgagtacgccgtggtggccaggacgcctgccaccctggcagatctgggcgagggcgcctgccccgtctgcctgggcaagtacctccgcaccgacgccagcctggtgctggggtgcaggcactccctgtgcacggcctgcctgcacaggatcctgctcacgcagcggctggaagcgcggtgccccctgtgccgccacgcccttgtcgagcgaggccatgcggccggggtcgcgacgggaggcaagcccggccatgcgggagccaagggcggggagggggcgaccgcgcagctgaccgttgtgccaccggcgtagtttgcaggccgaccgagaggccctaccttgaggcccttgcactcctgacgcaagccatgcgagcctgggcaccctccctggcggcgcctgcccaaccggccgcggcgacgagctgcatgcccccactcaccaaacaactccttgccgcccctccctgctgactcgttnnnnnnnnnntccgaccaggaggccctaccttgaggcccttgcacccccgacgcaagccatgcgagtctgggcaccctccctggcggcgcctgcctaaccgaccgcggcgacgagctgcgtgcccccactcaccaaaattctccttgccgcccctccctgctgactcgttcctgccttggcatcattgttcctgcgtaggtcggcccgcccattgcggcgccgcgtggctcccatgcccctcagcactcgccccctcgccagcattcccactgcgtgaaccgccgcagcgtgcagttgacctttcctacttgaatttcccccccgcgcatccggaccggctctcgtcgcatgtnnnnnnnnnnacagcgtgcagttgccctttcctacttgattcccccgcacgcgcatccggaccggctctcgtcgcatgtacagccagtgtagcatggccacgccacagcgcgcacacctggccacccacgcgcgccgcggccaggctgcagtcagagcagggcggtcccctttcctcccggccaaaggcctcaccccgcggcggccaggccctccagcacctccaggtcgcgctccgcgcggcgcagcacggcctgcacccccgccagcgccgccgtctgctgactcagcaggccgtacacgtcagccagcgtgtcgtcgtccagggctgggggcggcgcgccctgcgccggccccgccagcgcggcggcagcgccggcctccgccagtcgcgcggcg

SEQ ID NO: 40498 - DNA, 68 bp, Chlorella protothecoides
gaagcgtcgaggaccctggtcattgcaacaggacctcaagccaggtcgaggcccagactcagtgtgtc

SEQ ID NO: 40499 - DNA, 61 bp, Chlorella protothecoides
ttccaatgcggtgaaaaactgtgtggcagggaatgcctcgtctctcacacccacatacccc

SEQ ID NO: 40500 - DNA, 110 bp, Chlorella protothecoides
cgcccttttggcctggggctccatctcacgccccatcctggattcctattggttccatatttgtttaacaacaggaagtatgcatgaccaacctgagggcttcgaccttt

SEQ ID NO: 40501 - DNA, 141 bp, Chlorella protothecoides
tggagcggccactggatgcgggtccaggtcccctcggcgtacaccgcccggcgccaacaaagaatctcctcggctgtgccggccgcaggtggaggtccgggcgctgccggggtggcaggctgacgcatgctcctggcatgg

SEQ ID NO: 40502 - DNA, 80 bp, Chlorella protothecoides
gttcatcctcaacctcacaggtcgcgaggttcgctctcctccgtgcctgaggacgcagggctggcccctcgtcgttcagc

SEQ ID NO: 40503 - DNA, 75 bp, Chlorella protothecoides
ccaactgcgtccaatccatggagcgagcccggtccgctcccccaccagaagaagtggtggtacacattgcggaga

SEQ ID NO: 40504 - DNA, 144 bp, Chlorella protothecoides
atgcgcgcagccttacaatgggccgtgcgcatcgaatgtacatctaggcgctctgaggagtttcgatgggcgctgcagcctacaaggcatgcttctcagcgggatgcatgtcacatgcgcatggttggacatggaccggcctaa

SEQ ID NO: 40505 - DNA, 113 bp, Chlorella protothecoides
cagcatcccatcccaatgctctgggtcagcggacacagggtggttgcttccccctcccgctcctcctcctcatgcccaacaccccttttctctccacctccggaccccccccc

SEQ ID NO: 40506 - DNA, 142 bp, Chlorella protothecoides
ttgaggctggcgctgtatgcagccagaaggtagctatgggaagggggccagatctcgtcaagtccaggcactgggtagtttaaaaggtcattcgtgttggaagggctggggttgtcatggctcgctgggcatggcaagtccg

SEQ ID NO: 40507 - DNA, 61 bp, Chlorella protothecoides
gtcgtgtcgaggtgtgtgggtggggggggggggaggatgctgtttgtggcaccgctgagct

SEQ ID NO: 40508 - DNA, 61 bp, Chlorella protothecoides
gtcctgccatgtcaggttcaccagggtcccgctttccagctggggagtggcaggggggaat

SEQ ID NO: 40509 - DNA, 147 bp, Chlorella protothecoides
gaggaggttgatgaggtgaggtgggggtgtggtgggggtgatgtatgatgagacacatgctgtggcattctgcatcaggcatcttcccgaggaactgacatcaagccccccatccttattcaagggagtggatgcatatgagtatgc

SEQ ID NO: 40510 - DNA, 732 bp, Chlorella protothecoides
  modified_base (190)..(235): a, c, t, g, unknown or other
aggccgcggcggtgcgcaactaccgcgcggaggtcgtggcccacggcgacgcgctcaagcgcctggcggccgccgaggccgcgcgcgacgcgctggaggcgcgccgcgcggcgctggctgccgacctggacgccgcgctgctggccaaagtgagggggggggggggttgtcttggcaaggggcgggcggnnnnnnnnnnnnnnnnnnnnnnnnnnnnnnnnnnnnnnnnnnnnnntggcaaggggcgtgcggtcccggggcgtgaaatgtctggggtaggttctggtagaaaaggtgggcggaggagaggttgccgggggcgggacggtgccgcctcggccctcgcatgccgagcatcgcgccccccctgggccaggaaccagccccacaccctctcaccgacgctcacaccatgcccgaaacccagacgcggctggaggcggactgggagctggagcgcggggagctggcggacaaggtggctgccgcagggcgcgagagcgcggacctggcagcgcagcgcgacgcgcttcagcgccaggtggaggcgctggcgagcggcgaggacggcggcgagggcggcggcgcgcggcagccggacctggccgacatgctgcgcatgctgcgccgcgaccgcgaggtggcgcagatgggcctggagctggccaagcgcgaggcggcgcgcctgcgcgtggagagcgcggcggcgcagcgctccgcggaggaggcgcg

SEQ ID NO: 40511 - DNA, 95 bp, Chlorella protothecoides
tgacgatggcgtgggaggacggggggcggtgggcgctgccagtgggggtaagcgcaacagtcaccagctgagcactagctcctttcctgcccccc

SEQ ID NO: 40512 - DNA, 98 bp, Chlorella protothecoides
tgggaaacgagagctggggctgcggatgatgctggtgccagggagtcccctgacctgcaggcacagatgaccatgagccctccaagtcacaaggcaat

SEQ ID NO: 40513 - DNA, 61 bp, Chlorella protothecoides
gaggttggactctgtgccttgagacgtacactggtcaggtgttggcatgccatggagttac

SEQ ID NO: 40514 - DNA, 80 bp, Chlorella protothecoides
ccctcttcagcagggcacatcattgtctcgaggatgagtcgtgcaatctacacggagcaacccacggtcggagccagagg

SEQ ID NO: 40515 - DNA, 77 bp, Chlorella protothecoides
cgtgccgtgtccgtccctcgcccctgtactgcatttgatacattgttaaccgggttccctgacgagaggcgtgggtt

SEQ ID NO: 40516 - DNA, 84 bp, Chlorella protothecoides
tggcatggggtggaccgcctctccgaggcgtgggggttgaaggggtgtggggcgcggcagggagggggaagtggctgtgcaggg

SEQ ID NO: 40517 - DNA, 142 bp, Chlorella protothecoides
ccgtcgaagcgcagctccctgggaagaaagaaagagaaaattctgggggagatgaagcagttgctggacgggtatgtgttcgacgagcgccctcttgcgagctgaaggaaatctccagagccccagtgccatgcacgcacat

SEQ ID NO: 40518 - DNA, 61 bp, Chlorella protothecoides
ctgggcctgcccgcccctccgtgtgttcatcttgtccaaagacaccgcgcctgacgctcgg

SEQ ID NO: 40519 - DNA, 74 bp, Chlorella protothecoides
gtggtgggtgggacaccgagggcggctccatgggaggtggtattggtgaaggtggaggggccccaggactaggg

SEQ ID NO: 40520 - DNA, 267 bp, Chlorella protothecoides
  modified_base (114)..(123): a, c, t, g, unknown or other
catagatatgagccagccacggcggcaatcagagggtgcatggtctgtgtggcagcgacatactcaggcgcctgccacgcaacacccacctgtgccagcggatcatctggtggnnnnnnnnnngagaggttggggatggctcgaggttatatcatagatatgagccagccacggcggcaatcgaggggtgctgggtctgtgtggcagcgacatgcccaggcgcctgccacgcaacaaccacctgtgccagcggatcatctggtggta

SEQ ID NO: 40521 - DNA, 61 bp, Chlorella protothecoides
cagtttcaaagctacacacaggtgcactcacccttcatctatccctggcagactcacatgc

SEQ ID NO: 40522 - DNA, 61 bp, Chlorella protothecoides
cccgtcatcgtcttcagcttcagccgcaggtgcggcactcctggtgggaaatgcgcggcaa

SEQ ID NO: 40523 - DNA, 72 bp, Chlorella protothecoides
ggccgagggcggcgagggggccggggtgggtggcgagaaattgggctgcggcccggcccgcaacgcgggcga

SEQ ID NO: 40524 - DNA, 61 bp, Chlorella protothecoides
gctgccctggtgtcaagtgggaggaaggggtatgtccaagcgcgccgacaggtcacaggga

SEQ ID NO: 40525 - DNA, 78 bp, Chlorella protothecoides
ttccttcgtcgccttgcttcagacgagcacaatcaccttcatatctccaaaccactgatgatcacgcaggagggcagc

SEQ ID NO: 40526 - DNA, 72 bp, Chlorella protothecoides
tgctgccaaccctcgccgacccctcctactcctgcgcggtgtaggggccgcaagcgctggatcctgagtgtg

SEQ ID NO: 40527 - DNA, 61 bp, Chlorella protothecoides
gttggggagcagaggttgggcggtggcgggaagcgaagagggtgccacggcatcgcctgga

SEQ ID NO: 40528 - DNA, 97 bp, Chlorella protothecoides
tgtgacccctgagcaggcatgctttctttttttctttgggggttggagagggggcgttccatccacggggacagcctgccagtcagggcgctcgccc

SEQ ID NO: 40529 - DNA, 66 bp, Chlorella protothecoides
ctacatgcacaggtcggtgaccctgcaacggcagccgccgcagccgcagcagcagccgcagcagcc

SEQ ID NO: 40530 - DNA, 78 bp, Chlorella protothecoides
gctggcggtacactcggcgccaggccctctggctggcggcacactcggcgccaggccctctggctggcggtacactcg

SEQ ID NO: 40531 - DNA, 4122 bp, Chlorella protothecoides
  modified_base (1516)..(1525): a, c, t, g, unknown or other
  modified_base (1651)..(1660): a, c, t, g, unknown or other
  modified_base (1868)..(1923): a, c, t, g, unknown or other
  modified_base (3578)..(3587): a, c, t, g, unknown or other
aggccgccgacggccgggcggggaggcccgtgccatgcgcaggggcgggggcgggcgcgaccccggcgctgacctgcagcgccgccaggcgctcgcccagggtggggcccgcctcggcggcctgcgctgcctcgtcctcgctgccgcccagcgcctgggagggaggagcagggtggggcgggaatggttgaagaaaggaggcctgtgaccctgttggcgcgcggcgccagggtgggtctgcggatggagggccaatccttgtccgaaggcagcagaggcttccaagcggagcgtggtgatcaaggcgcgccgcaggagagaaccccaatcaaccgtcgtcttgtcctaccaaagcgcccctgccgccccctcacctcgggcatggactcgtcctcgtcatcggacgcctgcgcagcgccgcgcttgctgccggggccagacggggtggcgaccatggaccgcgcgacgtcagacacgcccacgatgctcacgcccttctttcctgggcccgcagcgggggccgtggaggcgatggctgctgtcgagctcaccagcaggctctgcgtgggggtggcggggggccaaagtagattcacgcgctacatgccagagcagatccgcgacgcacaccctgacttgaaccatgggcacgctggcaccactgcacccatgccctcggcactctgcgcacagcataggaccttgtgattcccagtacagaatgcgctggggtgtcagctggaaggcaccccagtccccgtgtaacatcccacccacctcgtcgctcatgatggggatgattgtgggtgcgctggcatctgtgctgaaggcaacatgctgcgtctggaagtggggcttggcagccggcccactcgcgagcaggagggtgcatcctgaggacagagatgtaaggaatggcgaggtcaagctctggtctagatggtcacctctggatccaaacacagcgccatcaaggaaactctgccacaccgttgagaacgccttcacgacactctctgtacgctgttcccatggtccagcccctcccagacgcccgccagccagtcactcgcattcccatcttccccgtgccaaaacacacacactcacccgaggcgtctgcggactttatcgtcgcgctcagcacccccgcgccctcgccagtgtttgcgacgcgggtcgcctgcaccgccggcagtccctttttcgtgggcagctcggcggcgacaaacacctccaggctgccgtcttgtagcagagcggcgacgaccacgcccccttcctggccctgcatgccggcggcgctcagtgcccgcgccgggacccggaggctcagggtggccgccgccgtgaagcgcatggccttgcccctgcgaccgggggccatccgccagacagtggcggagcgctcgcccttgccggcggtggccacatgagcctcgccggagacgatggcgagggcggcaaggggcgaggcatgcggcgtccaggtggccagctgggagccgctggccannnnnnnnnngtttgtagagcatactatgccaggaaggagtccatgcatggaggttttgagatgaaggatccagggggtgtcaaacttctgcctccccacgctccctcactctggcaagggcaggactctgagctnnnnnnnnnncgccggcggtggccacatgagcctcgccggggacgattgcgagggcggcaaggggcgaggcatgcgggatccaggtggccagctgggagccgctggccatgtctaccagggaggtggtggtgccgctgatgagggcgcgcccctcggacaggacgctcacccccgtcagcggccccttcgggccctgcatggggaatgcatgtgcgtnnnnnnnnnnnnnnnnnnnnnnnnnnnnnnnnnnnnnnnnnnnnnnnnnnnnnnnnggatgtttccccccccccccagtgcactccagaaccctcccactctccatgtctcctcattcctccactcaggcttccaccatccactcctgaaaccgatgcggtggacctcacctggaaagaggagacgcccgcccccgtggcagcgtccagcacggcagcaccgcccaccctgcccaccaccagcagctgcctggcatctggggagtgggcgaggcccgccacgccgccctccagaccggtgggggttgtgttccaggcctgggacgtcgatgcagagtccacagccttcacggttccggaggctgttccgacaacaatccgaccctgaaggtggtgggtttcgtgttgattgccgactgaaacgctgcccctggagagggatgcatgtgcaagtgctatcatccagtctccccaaagcctgtcgatttcgtacacgcagactactgcacccttgcagcctttggaacttcttagcttgcatacgaagtagttgaacacaacaaggcccaccttgttgccccaggagatgctggtgatgatgtcgacggatgccccgcttgcgccgatggcgccgctcactgccggggtaaggtctacggtcaggcgctgtgatgccacgccgaatattttgaggcgtccatcgcccgacacagtcgccagctgggactgggtggggtccagcagggggctgggtggagccatgacggacgcgaacagcccggcgccctggggtcgccgggcagagcgctagctgggtgctcccaggaaggggtgtcaggattgggtccacagcctaccacctacatatgtgagcagttctaatatgaatgcagggcgggaggtggggctgcatgcatgattggaagttcctgccggccggcactggaagggaggggggcccccagggcgcaacaattcgacctttctactgccccgctcgcgaccctcccacgatcgggcaacgatacgagatgggcatgcatgcgcgtggtcgtgcccacaggccgaccatcggtctctcgatttagtgttttcgaggcttccaagcttttgatatattttcaggatccgtgttcagtaagctttgcttcacatccaggacaccctccttccggtcatatagggcgaggccatctggggacatggctgcgtgccaaggcataggcgtgagccaacacaggtcgctcatcgggacatacggacggtttcctggtgacccattcgtgcgtcgctccggtgagcagcttctgtggggaagcgggaggtggaaccagtgcggaaatcaatcgcatgacatggggtgctgatgtcatgttctagcccgtggcatgctcttcaggaccatgtaatatgactgctcatcgcggctcccccacaaccatagcaggcggttcagcatggcgcatgcgacccaggctctcgcctgtgcgcgcccaccctggcacgccaccagtggatgacggggagctggtcacgccagaccccgccccggaggtccttcccctggaactgggggatgcagagctgagggaggccacgggcctgcaggacgggctggcggggtccgacttccccgcccaggacgccgccgacgagcgggcggaggaggccgccgccgccgcggctcaggacgtggacgccgcggccacgcnnnnnnnnnntgacgggctggcggggtccaacttccccgcccaggacgccgtcgacgagcggtcggaggaggccgccgccgccacggctcaggacgtggacgccgcggccacgcgccactgggtgtcgctgcccagcctgcccgcctcgctggcggagcggcccgcgctgcgctacgcggcactgggcctgggcggcttcctggcgctcaacgtggtgctggttggggtcaaggctctgcgcaaggcgctgagcccgcagcagcgccggcaccgcaccgtgaacaagaaccagctggtggtgaccacgctggcgcagtacctgccgtccaaccgcgcggggctggcggggagcatcctgggctccctccgcttccgcaccggtttcaacaatgtggagatcttcaggaagtacctctggtacctcctgcgcgagcgcgccttcaagcaggaggccgtggacgacctcctggccctgaaggccgccctccaactcacagactctgaggtagggcttggtgattgttttgggggcgggggggggtgg

SEQ ID NO: 40532 - DNA, 61 bp, Chlorella protothecoides
ggtccctgcaatggacacggcgaactctgcaagcccggaacgcataggtgctcgctccacc

SEQ ID NO: 40533 - DNA, 440 bp, Chlorella protothecoides
  modified_base (252)..(339): a, c, t, g, unknown or other
cccgcggcgccgcgccgcgccgcatcgggcgcggcgccggccccgctcggcgggcgggccagcagtgcatgcgtcacgctcgtggccagggccccgggccgcgtcagagcctgcgaggggggtgcagagggtggtcgagtgggtgggggtgcggggaggtgagtgcgggaaggcgaggacgatcgcgttgcatgatcattgcaaggcaggagaacgggggccaaaaggtgaagacgaagaagacaggttcannnnnnnnnnnnnnnnnnnnnnnnnnnnnnnnnnnnnnnnnnnnnnnnnnnnnnnnnnnnnnnnnnnnnnnnnnnnnnnnnnnnnnnncatgggtggccgactcgggcccacgccaccttcctcgatcgggcacggagcacaccaacatagtcctagtccgtcctaggcgctcggaaccccccccccct

SEQ ID NO: 40534 - DNA, 61 bp, Chlorella protothecoides
agagcctgcgaggggggtgcagagggtggtcgagtgggtgggggtgcggggaggtgagtgc

SEQ ID NO: 40535 - DNA, 79 bp, Chlorella protothecoides
ggtgtgcgtatgttggagggggttgtcggggggatggaggttgggaggaaaaggagggaagttgggcgcacgaggggcg

SEQ ID NO: 40536 - DNA, 61 bp, Chlorella protothecoides
ggagccggtgtgcctggacctgacggcggggggggccagcagggccttgaccccggtcaag

SEQ ID NO: 40537 - DNA, 89 bp, Chlorella protothecoides
catgcggtccgcctcgtccagcaccaggtaggtcacgcggcgcaggttagtggtccgcccctccaggaagtcgatgaggcggccggggg

SEQ ID NO: 40538 - DNA, 71 bp, Chlorella protothecoides
gtatatgaatttgtctcctatgattctctgctggacgagttgggggattcttccctttcgaagtgatcgag

SEQ ID NO: 40539 - DNA, 78 bp, Chlorella protothecoides
accgtcctcctcatctgaggaccccttccatacacccccccctcttctccagctcacgtccagcctatcgtcgacgat

SEQ ID NO: 40540 - DNA, 72 bp, Chlorella protothecoides
cgcggcgcggcccgggtcgggcccgtccccggcctcgcaggccgcgcagaaccagaggtcgtcctgggcggg

SEQ ID NO: 40541 - DNA, 71 bp, Chlorella protothecoides
cgaggaggtacccggcagccggcccatcgtcacacaatacacgcgctcccaccttggacacgttgctgcag

SEQ ID NO: 40542 - DNA, 83 bp, Chlorella protothecoides
tacggcgtgtactgatccgaaaattcggaggttggccatcctaaatactactgtgttcgggaaaagtgtacaatggaccgacg

SEQ ID NO: 40543 - DNA, 107 bp, Chlorella protothecoides
tggcgctgtgtgttggcactgcgtgcgaggaggggtggcggtaatggggttccacgcctgtggcggcctctgacgaggcccagacgccagcaccacggagcctccac

SEQ ID NO: 40544 - DNA, 61 bp, Chlorella protothecoides
gccaccctcgccatcaccacctcggcaatcaccaccaccgccaccctcgccaccctcgcca

SEQ ID NO: 40545 - DNA, 73 bp, Chlorella protothecoides
tacccaacccgctccctccccaacccactctctcaccaacccgctccctccccaacccgctccctctccaccc

SEQ ID NO: 40546 - DNA, 80 bp, Chlorella protothecoides
gcaacggggaggagggaggagggctgtgcctgttggtcgatgaaatttttagcctggcctcgaagcaagaggaggggggt

SEQ ID NO: 40547 - DNA, 61 bp, Chlorella protothecoides
cggcgccatgcactttgaactggtgtgcccagccaccggcgcccacacccacgcaggcctt

SEQ ID NO: 40548 - DNA, 127 bp, Chlorella protothecoides
cttgggcaaatgcaaggcagcggcttgcccacaagcggatggttcaaagaggaagcgtccaggggttgcaggggaagaactgaatggtcctgcagcgaccccaccgctgacagttcctgctaccccg

SEQ ID NO: 40549 - DNA, 67 bp, Chlorella protothecoides
gtcgaacagaatgttctccagcttcacgtcgcgatgaacgatgcccgcgccatggcagtgacccagc

SEQ ID NO: 40550 - DNA, 79 bp, Chlorella protothecoides
gggagtgggggaagagggcatgcattccggagccctgcctcacacctcgtgcacgtactgcttgctggccgcgtagtag

SEQ ID NO: 40551 - DNA, 136 bp, Chlorella protothecoides
ggtgatgctggacaggctgatcgggttggggtatgtccccggcgccatcgtgaaggccgagaagggcttgacgttggcggaggagccccccacagggaatacagttgccccggcgctggcatgcacgcccgcgttg

SEQ ID NO: 40552 - DNA, 200 bp, Chlorella protothecoides
ggggtacaggggcggaggacttgcttggtcgcctggatctgccaccccccctgcccagtccgccgagcacgacaacccacccccaacctctacttttgaagctcccacaccctggccccccgccttgcgcaggctggctggcccccctctccgccggcgctagcgtggtgttcccggcggaggggcgcttcgcggcgggg

SEQ ID NO: 40553 - DNA, 61 bp, Chlorella protothecoides
ccctgtcagtgcccccaacgcgcagtcctcaccagcctgtgcccgccacttcccaggttct

SEQ ID NO: 40554 - DNA, 135 bp, Chlorella protothecoides
cgcccgaggcactcttcctcctgaggtgcgggtgtgtgtttgtgtttgtactggcttcaatagaatgaagtggtacgctcttggcgggggaggggaactgacttggtagggatgactacatcaggagaagtgcat

SEQ ID NO: 40555 - DNA, 61 bp, Chlorella protothecoides
gcatcctcgtcctgtccgccagctgcgacgcggccgcgcgcccggcggcgctggcctacct

SEQ ID NO: 40556 - DNA, 78 bp, Chlorella protothecoides
cacagctggttgataggtgcgactgggtgcatggcgcatggctctcgaaaggggtgtgctgcatgcggacaaggtttt

SEQ ID NO: 40557 - DNA, 61 bp, Chlorella protothecoides
agccagtgttcagatctgccccccccctacacccgcctccttttccagccaggcccagagc

SEQ ID NO: 40558 - DNA, 61 bp, Chlorella protothecoides
gcggcaggcgccgggtttgcgtcggccggcatgttggttctggccgcgtagttgcggccac

SEQ ID NO: 40559 - DNA, 61 bp, Chlorella protothecoides
gcagcagccgcagtacgggcagcagcagcattacgggcagcagtacgggcagcagcagcag

SEQ ID NO: 40560 - DNA, 4015 bp, Chlorella protothecoides
  modified_base (604)..(613): a, c, t, g, unknown or other
  modified_base (1085)..(1163): a, c, t, g, unknown or other
  modified_base (1326)..(1335): a, c, t, g, unknown or other
  modified_base (1444)..(1453): a, c, t, g, unknown or other
  modified_base (1562)..(1660): a, c, t, g, unknown or other
  modified_base (2169)..(2178): a, c, t, g, unknown or other
  modified_base (2464)..(2473): a, c, t, g, unknown or other
  modified_base (3414)..(3423): a, c, t, g, unknown or other
  modified_base (3573)..(3582): a, c, t, g, unknown or other
  modified_base (3751)..(3760): a, c, t, g, unknown or other
atgcgcgtggcgggggcggccgccgccgcagcgggggagggcgaggagccggacgccgcggcggcgctgggcgcggcgcgcgggcgcctcgtctcccagctcatgcgcaagcacctggccgagagcgtggtgcccgtggtcatcgacctgcggcgcgtgctggagagcgcgcgcagcccgctgctggcggacctcatgctctgcgcccgcgtcatgctcaaggaccacaaggacgaggcgcgcgggggcgatggtgggggtgggtcactcgtgcatgtggggctggggaggggagggctgccaccctgcgccggcgcgtgacctgggaaggggtcggactgctcgacccctacacccccagctcgatggccgcggccgcctgacgcacggggaggaacacggtgtccaccctcccgctcaccaccatgctcagatcgaggacatcctggtggccgaccgccagctggccaaggagctgctgtacgacatgcgccaggccgagctggctgccaccaaggtgggcgggccctgcctgtgttgtgtgggctatccgccgagtggcgcggcggccttggtccttggcgacctcatttgaagatgcggnnnnnnnnnncgccgccaaggggggcggcccctgcctgtgttgtgggccgtccaccgagtggcgcggcggcctgggtccttggcgacctcatttgaagatgcggatcggtgtgtgctctggccctcctctcgctggacccctgcatccctgcctcacgatcccacccaccccacgaatgcgcccagagcacgcacgtggcggcggtcaaggcggagccgcgcaggacgcccgccgcgccgcgcggcacaccgccggggacgccggccgcggcgtcggccgcggcggagcgcacaatgccccgctgcgcgacgcccatcgccgacgaggtgttgcgcggcgcgcgggggagcggcgacgccggtacaccccacgtcgccgccggcacgcccccaggtggggctgggaggggtggagcgtgtggtgctgaggattccctcagtccctccccagccgcgccgcatgccagcgtgtggctccctcnnnnnnnnnnnnnnnnnnnnnnnnnnnnnnnnnnnnnnnnnnnnnnnnnnnnnnnnnnnnnnnnnnnnnnnnnnnnnnnattcggccaagtgtcaacaaatcatagaccttggagagggtgggcctggcctgctcggcttccatagtgcattgccagcccctacacacactgcccccccccccctacattgcaggatcgcactgctcctctggggctcgcgcctccggcatgactcccggannnnnnnnnnccttcaagccctcttacactgacccatcgcgtagcaggccacaagacacctgcccccggcacggcagtgaggctgctgtcgcgcctgggccgctcagacggtgcgtagnnnnnnnnnnacttcaagccctctcacactgacccatcgcgcagcaggccacaagacacctgcccctggcacggcagtgaggctgctatcgcgcctgggccgctcagacggtgcgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgccgcacccccccccgacccccacccctacattgcaggatcgcacggctcctccggggctcgcgcctccggcatgactcccggaacagaacctcggctagccagggcagcaagggagaagcaaatcattgtcaaggtgggggaccccccatcgcggtcgcatggggcctggggcagcgcttgccgggatctcgggagcctggcctcggcagatcgatgtggacagcatggggaggggaagcggtgccttgctcgcgaccggacacccgctcgtccccacacaaagttaacgacgggacaattgatcgagttggccacctccctgcccctcccatgcccaggacgagccggaggtggtgcaggcggaggagcaattgctggcgctcagtctgccgggggtcgcggggacccctttgcgacagtggaatcccacgttggtggaggagatgcaccccggcgggtccagcggaggggttcccaaagtttgcatggaaggcccgggcacnnnnnnnnnntttggcggaggagatgcaccccggcggggccgccggtgggggtcccaaagtttgcatggaaggcccgggcacgaacagggtcaaaggcggtgcccgcaagcgggggttgggcgggtgaattctgggccccaagcgaaaattgcgttgctttccccgacggttaaagaagcacaacataatgtggacatgtgtcccgccgacaatcgagttcaggggagcaaatggcagtgtcctgcggtggggaaacgaaatcccgggcgaatcttaccccgtgcgacctcacagnnnnnnnnnngtgtgcgggtgaattctgggcccccagccaaatttgcgttgctttccccgacggttaaaaaagcacaacataatgtggacatgtgtcccgctgacaatcgagctcaggggagcaaatagcggtgtcctgcggtggggaaacgaaatctcggggcgaatcttaccccgtgcgacctcacagcaggcggaacctaccggcacccatggcccaacgatgatccgtacccccaaagtgggaccattacacgccttggacatgataacaaacacatttttaagttaaagatgtcgcaaatatagaccgagaccctcctccgtgcccgtacccgccgagtgcgacgtttttgcggctttcccttggagcatcatctggctcccgtccgcattggtacagcatttcgtagagttatacaacacattatctctccttgtgcccgcttgtgagcccatcatggcgccgtctaattacaccgtcctctgctccaaggccctgacgcactctgacgtcaccacggagattgccaagtctgggcgcctcgtgctgcccagggcccaggtcgtgagctgtctgccacgcctgcttcacctggggggcgctgcgccagcctccgccaaggcccgcccgggcgggcccacccccgcgatacccctggtacgcgaccgtcaaacacggcgatggggtttcggcgccgggtgccccgtcgctcgttgtgttacataccgattcatcaccccccctcatcctcacagtttatgtatgacatgaccggcaagatgtggcgtttccagatgaagacctggcacaatgtggtggcctgcggtggccgagctacttacgttcttgaaaacaccggtgaggggcctgggatagatagcatgccccgtgcaggtggtgtggtgccaccttcacagtgtggggtgtgtgcaggatgcatgctgttnnnnnnnnnnaggtgaggggcctgggatagatagcatgcctcgtgcaggtggtgtggtggcaacttcactgtgtggggtgtgtgcaggatgcatgctgttgttggaatctcgacttgcgtcctttcgtcgggctgtggtgcatgagcgccctggccgccnnnnnnnnnnataatctcgatttgcgtcctttcgttgggctgtggtgcatgagcgccctggccgcctgcccctggatcgaggtactgcaccactgccggggccatccagatgttgtcagacacttgagacctcccgtcccacaatcctacgcaaatctccagcacccctctccccctcnnnnnnnnnntctggatcgaggtactgcaccactgccgggcccatttcagatgttgtcagacacttgcgacctcccgtcccacaatctcacgcaaatctccagcacccctctccccctctccccacgccatcctccagccggctttgtccaggagtttgggctgcagcctggggcctggctggccatctgcgagcaggaggggcggctggtgctgcgcaccgaccttggcggcgtgcgcacctcggcccgcgcgccgcccgcggc

SEQ ID NO: 40561 - DNA, 399 bp, Chlorella protothecoides
  modified_base (136)..(308): a, c, t, g, unknown or other
aggtggggcctgaggagccccgctcccagtagacgggggaggccgggcctgggggccagggggcgctgcggcggcggccaggcggctcaggctgcgggggtggtcctcgtgatgtgccgccgccgcctgtgaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggcccctgcgccgatgcgccgcgcgttgcgcagccaggccagcggcgcgcggctcagaaggcgggcggcgatcaggcctgccgccagc

SEQ ID NO: 40562 - DNA, 122 bp, Chlorella protothecoides
cgacccgcggatggcggcccaggacagtgcaccgcccggcgcaaccagggcggccgcgaagagcgggggccgggggttgcagggcgcgtgcgtgccgttgaggtgcgcagctggcacttctg

SEQ ID NO: 40563 - DNA, 76 bp, Chlorella protothecoides
tgggtgcagggacgggaagggagggtgggggtcaaggagggggtactgctggacgctggccatctgtgactccaca

SEQ ID NO: 40564 - DNA, 75 bp, Chlorella protothecoides
tggccttcatcaaaacgcacacacgcgcgcactcaaacaccccaaccccctggcccggccagggtggcggtggtg

SEQ ID NO: 40565 - DNA, 61 bp, Chlorella protothecoides
ctgccattcgccgacatccaatccaccgacaaccccggcactccccaggccgtccatcatc

SEQ ID NO: 40566 - DNA, 61 bp, Chlorella protothecoides
ccgcgtggcggcccgcgcgctgcggcggggggccggctacgactgacgacgtggtgcaggc

SEQ ID NO: 40567 - DNA, 190 bp, Chlorella protothecoides
gggaggggtggccagggcggtgcaggggggtgacgcagcggccggcagagcgatgcaggcggacggagcgtcagagtctgtcagcccagaaggagtcgccaaaggcaatggggacccgccaacagactcaagcacaccaccagcgggcccgccggctgcgcgccagtatccccccgtcaccgccacgctg

SEQ ID NO: 40568 - DNA, 79 bp, Chlorella protothecoides
aggtattgcgtctgccaggcccttcacaccgcctactcaccaccatacccccccccacccggatccctcgtgcccacct

SEQ ID NO: 40569 - DNA, 192 bp, Chlorella protothecoides
ggaaggggtccctgaggccagaagcatgtttttcacctccacaagctccactggtgtgcattgttacataaacatgatggtacatcatcaatgggcaccccctgggtgcattgatccgccggcggcatgcctcgccacccctgcgcatcatgcggcgcaacagccgcaggaggcccccgctcgactacccga

SEQ ID NO: 40570 - DNA, 81 bp, Chlorella protothecoides
catgccatccctctccagctggccgtcacacgccccccctctcgagccccctgaacacagccacgtacctgtgcatgccgt

SEQ ID NO: 40571 - DNA, 70 bp, Chlorella protothecoides
ccccccccccccccccccccccccccacatatcaattcaaccacagaggagggcaagatcttctcccccg

SEQ ID NO: 40572 - DNA, 112 bp, Chlorella protothecoides
cccctccttccccaccatgccccccaccccggcccctgcggcgcccacgactgtcgacaccacggccaccaccagtcagaccgccagcaccgcaacccctccggcgccggcg

SEQ ID NO: 40573 - DNA, 77 bp, Chlorella protothecoides
aggtattgcgtctgccaggcccttcacaccccctgctcaccatcatacccccccacccggatccctcgtgcccacct

SEQ ID NO: 40574 - DNA, 396 bp, Chlorella protothecoides
  modified_base (101)..(339): a, c, t, g, unknown or other
gcagggcacgccgcgcgacttgaagaaggctgtggccgaggcggggtcgccgccgtacaccgcacgcccacgcgcgaggaggtaggcccggtccaggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactgtgaaccatcccctcacacaaaccaaacgtttcccccacccctttcacacac

SEQ ID NO: 40575 - DNA, 61 bp, Chlorella protothecoides
gggcactccagacagtggcgtcgtggctgggagccagggatgatgccagtccacccacggc

SEQ ID NO: 40576 - DNA, 76 bp, Chlorella protothecoides
tacgtgcacacccttgcctgcagtgatgggagggagtgggggggactcaggtgattgaatgtcacacaccatgcac

SEQ ID NO: 40577 - DNA, 105 bp, Chlorella protothecoides
gatggggccggtgaggggaccggcaggcacgggggtagatgctggcccaggcggcctggcatggattcgacgagcggcgcggcaagggggtggcagagggcgtcc

SEQ ID NO: 40578 - DNA, 61 bp, Chlorella protothecoides
ggtcatgctgggagccctgctccaggtgctcgtcaagggggccaagttctcgctgttcaag

SEQ ID NO: 40579 - DNA, 79 bp, Chlorella protothecoides
agtgttgaaaataatctactgggcccctgcgcctgcagcatgtataggcgcaggggagtatgagcggcgcccttgatgc

SEQ ID NO: 40580 - DNA, 3079 bp, Chlorella protothecoides
  modified_base (371)..(380): a, c, t, g, unknown or other
  modified_base (1312)..(1321): a, c, t, g, unknown or other
  modified_base (1865)..(1874): a, c, t, g, unknown or other
  modified_base (1927)..(1936): a, c, t, g, unknown or other
  modified_base (2753)..(2762): a, c, t, g, unknown or other
ccgcccccgcccccgcccccgccgccactgccgtcaggggtgctggcatcgaatgcagactccgactctggcggtgattctgatggcggcgcgcttccgagcgcagatgccatcaggagagcaaaggagacccgggagaggctgaggtcggcccaccttgcaccggactatgtgcctttggcggcgggtatgggaggaggcactgatctcaggtgcggcggggcaaggacgtgcatatgcgggcatcgcaagacaatgctgtgtgcctgtgtgttgatgggtgttgtcgagaaagacaatgtaatactctgatgtcaccctgtcttcatcaaaagatctagaacatgcagttcaaagtctgaagcgctggnnnnnnnnnncgtgttgatgggtgtcgtcgagaaagacaatgtaatactctgaagtcatcctgtcttcatcaaaagatcttgaacatgcagttcaaagtctgaagcgctggtgctccgagcccgcctgaccgactgcgcctcactgccgacgccaccccgcagggcgcgtgacaggaagctgaccgaagagggcgctgcccccagtgggtcggacgccgaggcggacgacgaggaccggggacgaatggtgtttggcctgggcacgcggagcgatgccccaggacaactcggtccacaggtgagcccgttgtcagcatcgcagtgcacctgagattgtaaagatgggaagagggtgtctgcctccaggagtgggcatgtcgaaagggtctggtgctgcggcaggccctggtcggccctgccgcagcaccagcagcccaggtgatcgcctgcagcttgcctcttcgacccctatcaagccacgccccaccttgcgacacctccgacgctcgcttctctccaccaggacctggacgaggaggaggccgcctgggcggaggagcagatcaccaagggcatgggcgggctgacccaccgggcggcgctggtccccggccccgcaggggcagcgccgccggcagcggcacgctccgcgccccgcgcgatgcgcccccccggccaccccggaggcgcggaggatgtgggagcggcgctggccgccgcgggcgccacggcgctggcctcgctcagggcggcggtggatgatggccgcgcgcgcgcgctggcggcagctaagcagcgcgaccggaccgccgccgcgctgcgcaccgccgtcgccagcgtggagaccctgcgcgccgacctggaccgcgcctcggagaagtatgtggacgcgcagcgcatgcgcgcctatgccgccgacctgtgcgccatgctgcaggcgnnnnnnnnnnaaagtacgtggacgtgcagcgcatgcgcgcctacgccgccgacctgtgcgccatgctgcaggcgaggagggtttgtgtcggggtggggtgggggggtggtcctgacgcagatcgaggggccgggatgagtgaggccatggagtgcatctgagtgggcggtaatggctccctgtgggggtgatctagcggggaaacctctgcagagcaatacatgccccgctgacgagacaagcagccgcctcctacttcagccttcgcctcaatgccatctgcaggagaaggctcccgtggtggaggtgatggaggagcagctgggggcggcggcggcggagcggcacgccgcccacgccgctcgccgcgccgcacgctgggcgagactgtcggcgcaagccgcggcctcggcggcggccgctggatctgtgctgagcgccggcggcgaccttgctgccgcccgcacggaggctgaggcggcggcggcctccgctggcgccgcgtcaccggcggccaatggccccccgccggccgccgagctggacgaattcgnnnnnnnnnntcatggggccacctccagcgaatccgagggggacgtggacgagtatcggaacnnnnnnnnnncgcccgcgcggaggctgaggcggcggcggccttcgctggcgccgcgtcgccggcggccaatggcgccccgccggccgccgagctggacgaattcgggaggaatgcgggggcctgggcgcggcaggaggcgcagcgcaaggccgaggccggcgacgccgcgctggagcgactcgttgccgcgctgccgggctccggtgtgagggaagcagggtcgacaggcagccccgaccccgagctggagttccacggggcgacctccagcgagtccgagggggacgtggacgagtatcggaacacgcgcgacaagatcctgcaggcaggcttcggccttgactttcatgtttttgatgaggacatcggggagctcgtggtgcatgtttgacgcagtgtagtgtgagcctgtgcttggtctcgagcaatgggagccgggcgtcgactgccgcaatccttttgctttctgtcgctgcagaccgtctccccccatctgatcatccctcccccccctgcgtccgcccgcaggccgcagacacgctcttcctggatgctgcagagccgtacggcacgctgcgcgcggtccgcgccgagctggacggctggcggcggcgccagccggccgcctaccgcgatgcctacgtcgccgctgccgcgcccgcgctcttcgcgccctgggtccgactggagctgctggcctgggaacccctggacgcgcgcacgcccttcaccgacctggcctggtacccccagctctttaccttcgggcagggggatgaacaggagggggcggctggggagggtgggcccgcggcgacgacgacgnnnnnnnnnngcgcccttcaccgacctggcctggtactcccagctcttcaccttcgggcagggggatgaacaggacggggcggcgggggagggtgggcccgcggcgacgacgacgagcaacgaggacgacctcacagtcccccgccttgtgtccagcctcgtgctgccggctgcgcgacgtgcgctggcgcccggcgcctggtcgccgctgagcgtgcgccagtcacgtggcgcggctgcgctgctggccgcgctggaggaccacctgccgggggaggaggcggcggtggccgaactgaacgccggcgtgcgggcggcggtcgagga

SEQ ID NO: 40581 - DNA, 133 bp, Chlorella protothecoides
cgggggcgggctcttcttcgggctagggggtggggacttctgcgcagggtttggggtggcagctggcagtgagggttcgggtgcaggacccgaggatggggtggggccggggctcgggccagagggggtcggc

SEQ ID NO: 40582 - DNA, 61 bp, Chlorella protothecoides
tcttgataccactaagttcgtgatagaattaacttccggctcgcaaatgccagtgcgattt

SEQ ID NO: 40583 - DNA, 80 bp, Chlorella protothecoides
ggcaccctgctctgagcccccacccagccgggcattgttgatccgcggacccatacacaccgtcgtgcccatgcggatgg

SEQ ID NO: 40584 - DNA, 131 bp, Chlorella protothecoides
ggttgtgtgagcgtcaggaagttgcttcaagggactcggtcagcaacccaggcggcaatggtctggtgctccgcacctggggtagggtgccactgtgctcctgcctgctcctggcactctttctctccgcc

SEQ ID NO: 40585 - DNA, 106 bp, Chlorella protothecoides
tttgggcccagcgtcaagctacatgacgacatgcccccttttccgccgcccacccccaacccctgacgccacactaacctggtactcgcagatgtatgttgcagct

SEQ ID NO: 40586 - DNA, 139 bp, Chlorella protothecoides
ggcgctgggacggaagcatgatggaggtatcgcccggcgggtcccccttgccaccaccctccaggtgttacccctgcctggagtcgcagtcaccccaactccttccccccctccgcctcctgacggccaggtctgcagc

SEQ ID NO: 40587 - DNA, 61 bp, Chlorella protothecoides
cgcccgctcggcgtccccagccgcccagcaagcccgctcggcgtccccagccgcccagcat

SEQ ID NO: 40588 - DNA, 482 bp, Chlorella protothecoides
  modified_base (259)..(401): a, c, t, g, unknown or other
cgcgaggccttcgaaatcgccgcacacatatatcacgacgggctcttactgaccatattgcatttttacaacggaacgatactctgatagctattataacctcacagagtgtaccaacaagtaggaatggcggaggacatggtgagcagcgatcacatactcaagagacctgacaatcccttcagaatggacgcataatatccattgccatacacatccatatgcaggctacgtggaggcccgaaggtcgcctggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgacctacaaagaggtgcgctcacggatttattatgtatagatgtaattgggtgtcgaaagattggagcgctgcatgca

SEQ ID NO: 40589 - DNA, 61 bp, Chlorella protothecoides
cacaccctgtgctacctaatcaaccccgcaacaggacgtctgcgaggagtgctgccagaag

SEQ ID NO: 40590 - DNA, 61 bp, Chlorella protothecoides
aggggctgccggcgtggctgagatgacaggggggtgttggcaaggggcatgttgggctggg

SEQ ID NO: 40591 - DNA, 61 bp, Chlorella protothecoides
agtgacagtcatcgtgcagctccttcccttgcccagccaattcaccatcacaagcccacag

SEQ ID NO: 40592 - DNA, 109 bp, Chlorella protothecoides
gcgatggggccttggattgtaagggtgccttactcgccccgtcgccgctgttcctcccccaccacactcccccaatctcagactgcgtttgcttatgtatgcctgtgct

SEQ ID NO: 40593 - DNA, 75 bp, Chlorella protothecoides
gtgccttgcagcgatgttgaggggacggcgtgttcaaagaaagtgagcatgcacagcatgccagggcgcaaaaac

SEQ ID NO: 40594 - DNA, 72 bp, Chlorella protothecoides
ctggggcatgggctctgcaggagcgcacgcatgcgggaagggaggggccgggcgtgtcgggcctgggtgggg

SEQ ID NO: 40595 - DNA, 3236 bp, Chlorella protothecoides
  modified_base (282)..(291): a, c, t, g, unknown or other
  modified_base (647)..(767): a, c, t, g, unknown or other
  modified_base (825)..(834): a, c, t, g, unknown or other
  modified_base (2708)..(2717): a, c, t, g, unknown or other
ccgcgccgccgcggaggccgaagcccgcgctgccgaggctgccgcgagggaggcggaggccgccgcccaggcggccatcgaggcgcggcgtgctgcagacctcgcgcagctgcaggtgtgggggccgcggcgcggtgttgtctgggacgggaatgggggtggggtgtttgcgcggggatgagcgggtcaccctcgtccggggcctttggaccctctcgctggggaatgcagtcggcccctctcctctctcgatccctcaccccgacccctcacctgtgcccnnnnnnnnnnaggtcacctcgtctggggcctttggaccctctcgctggggaacgcagtcggcccctcttctctctcaatccctcaccccgacccctcacctgtgccccccctcacatcgccagtcgctggaggagggttcgaccaaggagcgggacgtcctgctcggccccggccaggtggtcgtgggccagggcgccgacctcaccgccctgggcatcgcgccgcggcaggtagaaaggagaggatggggcctgtgtgggggagccgatcacagggagaagctcctgtgtgcgatgccgtctggggcctgcacgcctgtgagtgttcgaccaaaggggaatcccgctgcccttccctccaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgtgccgcgtgctcggcccgctggggcgcaggggccggcgcgccggtgctcctgnnnnnnnnnntgccctgggcatcgcgccgcggcaggtagagaggaggggatggggcctgtgagggggggagccgatcacagggaggagggcctgtgtgcgatgccgtctgcggcctgcacgcctgtgagtgttcgaccaacggggaatcccgctgcccttccctccaagcaggacgagggcggggacgaggaggacggcgaggacatggaggagttgtgagggcgccgccggccaccggggtccgtgccgcgtggttggcccgctgcggcgcaggggccggcgcgccggtgctcctggtcccgtgctcggcgggctgcctccagagtactgcagctggcacggcgtcgtgcggttgggtgggacgctgcaacgttcgtggacgcggccctgtgcagtggatgacgggattgtgacgagacatgacaggacgacagcaaagtgcgagagtggggcttgaagacctgtcgattataggaaggtagaacgtgtgagagctggtgtgcgggaggatcccgttccctgtgggccgagagactgctgtggcaaaggatctggccgtgttccgctgggagtgagatccggtagatccgggccgcggtaccgttctccggcggtggggggaactgggcgggaaggcaaagagaaggctttggcacaaagtctgcttcccaggcctcagagacgcaaaactatcacgttgcaattgttagaccttaacataacagccctttagcaggctacaggcgactgaagaggtgcaaatccaaggtgggctccggagatgcaacaccagatgcgaggcggtggggcggtgagaaatgcactagcatttcaccacagccccggaaaagctcaccatatgcaccaaatacgtgtttgaggccctctgtacacccatgttctgtgatgctggctcctgccgaggtggtgggacgagatcgagggagatgcttcgcccctgcgacacagataccatctccccccgccccgacgaacccacatttacatccacacctatcgaaagatcgcagtcagggccactcagtttgccgactcctcctcccatcgccccacccacagatcccgccatcccagtcagcagacgcttgtgaagacaacggcttcatcgggagctgagcctcccagactcttggaaatgggcgcatcaaggacatcggtgaggttgcgagactatgggagtcgtggacggctgcccgctgcggcacgcatgcgcatgcgcctgtcacatggagggccgggcaccggctgattgctcgcctccaattcccatctgcggaacagctcgcctgccagctcaaacccacccgcctctcacccgcaggtggtgttgcttctgcttgcactcagcctcacagcgaccgcgcacacgaccccccgtcgcctccagtcgtcctgcgcggcagaggctgggtgcttggccacatcgtgctccgatgccttcgataccacaaacctaccctacaccgccttctacacaaccagcgccagcgcagacagcacaacgttcaccattctggcctgctcggaggggtgctcccaatcctcctccgggtgcgctccactccagaccttgagcatcaggctggccgactccctcctcgccaaccccggtgcgattgtcgcccagcccactggcactgcggcaagccgctgcagtgatgcgggcaaaggataccggtggactggcgctgccctaggcaagctgcacaccctaacccctttggaggtgagtgggacagggtctggtcttgatgctgtacatgccttcacaccagacaaacctgcaatacatgtatcagggcaatggaactctagcacaccatacccacccagctcacaaaccttgcaatgtacgctgaaannnnnnnnnngtgctgtacatgctttcacaccagatacagctgcaatacatgtaccaggccaatggaactctagcacaccatacccaccaagctcacaaaccttgcaatgtacgctgaaacccctcatcaccaccctctgtaagcaggcggctttctgtgccagcttccaactaaccatagccaacacggtgactggcacgccactcggtctcgctgacatttgtcaggcaaatttgaacgtactggccaacaccgggacactcctgtttaacagtacagccaatccaggaacatgcctgatgaatctcgcaaccaccagcggggcggcggggtacatcttgctcacagatgccgagggcccacaagcctcacccccagcgggccccagccctcctttgagtccgtcaacatcgccccagccatactccccaaggacaccgccgtctagtgtgccaccaccctccccctatagcccctcacctttaccatcgcccagagccagcccctcccccaagacgccgccctcca

SEQ ID NO: 40596 - DNA, 61 bp, Chlorella protothecoides
tgaaggctgagtgtgtggagcgcctggggacgccatgatcacacctgagccgcggtcgttc

SEQ ID NO: 40597 - DNA, 66 bp, Chlorella protothecoides
ccccccccccccccccaaaaaaaaaaaccatcgacccgtggcaggcacggccgacatgtcctcctt

SEQ ID NO: 40598 - DNA, 106 bp, Chlorella protothecoides
ggccatcagagtctggcctggcccatgcattgccacatcatgacatcccaaacagcagcatcgtcgttgtgcaggcatcccctgcttaacgtctgccctgccctcc

SEQ ID NO: 40599 - DNA, 71 bp, Chlorella protothecoides
cccctgcagacctggcgggaccccagctgggcatccagaccctccgccctgttggcgccggcccctgctct

SEQ ID NO: 40600 - DNA, 73 bp, Chlorella protothecoides
cgaggaggagggggggtctggagtggggcggacaggcccggggctgctcgcaggaccctgaggctgcgtggag

SEQ ID NO: 40601 - DNA, 71 bp, Chlorella protothecoides
tgaggtactgcctggagccgtgggtcgcccgacacgccggcctcgtcagcctggcgcagtggcgagcgggg

SEQ ID NO: 40602 - DNA, 61 bp, Chlorella protothecoides
ctggctgtaccagacgcactgatgtggaggtatgcgccgggaagacgactggtgggaggac

SEQ ID NO: 40603 - DNA, 156 bp, Chlorella protothecoides
gccaaacaccctcctccacacacgaccccactcagctccctgctcccacattcgacatgcttccgcccctcccccggcaccatgcacgaaccccctgccccaccccctcccttcccatcgacaacataccgctccaggaggtaggtggagatggag

SEQ ID NO: 40604 - DNA, 61 bp, Chlorella protothecoides
ctccgccgccacctccacgcccacgttccccgtctcgtgcagggccagctcggcgcggtcc

SEQ ID NO: 40605 - DNA, 118 bp, Chlorella protothecoides
tttcgacctcagttgacacatcctgttcatgcccacccggagaattcatggcaggggtgccctgccttgggcccagcctgttgacgcggacctcgatctcgtcgcacccacgtgtgct

SEQ ID NO: 40606 - DNA, 79 bp, Chlorella protothecoides
gcgcagcgggtgaaagggtgtgactgcggcgttcgaagatctggtgtcaaagtgggaccatgtaccaacacgaaccgcc

SEQ ID NO: 40607 - DNA, 82 bp, Chlorella protothecoides
ttggccaggactctcccgcaggcgtcctgcgtcccccgggggaatgaggggcccctgtgtggccagggctccaggcacacgc

SEQ ID NO: 40608 - DNA, 61 bp, Chlorella protothecoides
acccatacatcctgtcggatgtggctggccacctcggcatctattgtcaatggtcctgctg

SEQ ID NO: 40609 - DNA, 97 bp, Chlorella protothecoides
ctgggcgactttgggtttgccaaggcgagcagctggttgggggagttgtggagggtcgaggatggaagtggcctgaaggtcttgggcatggattact

SEQ ID NO: 40610 - DNA, 61 bp, Chlorella protothecoides
aaatgtcctgaatactttgtagcctgacccagggctgattgcttcctcgtgcagattgggc

SEQ ID NO: 40611 - DNA, 7934 bp, Chlorella protothecoides
  modified_base (1217)..(1226): a, c, t, g, unknown or other
  modified_base (2036)..(2045): a, c, t, g, unknown or other
  modified_base (2284)..(2293): a, c, t, g, unknown or other
  modified_base (4275)..(4284): a, c, t, g, unknown or other
  modified_base (4714)..(4723): a, c, t, g, unknown or other
  modified_base (5471)..(5480): a, c, t, g, unknown or other
  modified_base (7114)..(7123): a, c, t, g, unknown or other
  modified_base (7294)..(7303): a, c, t, g, unknown or other
gcggcggcgcgcctggagtgcgccatctgcctggagcgcgtgctgggcaaggcggaggcgggcgcgcgccgctttggcctgctggcctgcgaccacgtcttctgcctggcctgcatccggtcctggcgccaggagggcgaggtggacgtcgacacagtgaggggggggaggggggtgcttcggcatgcgggccggtggggacggcggagggagagtggggtcgggggcatgctggagctggccagggcatggaggcgcggtgcagggaccgccgcgagggcatgccaggagtggcgatctgctgccggccccggagacacgccgccacggcccccctacaggcgctgcggacctgtccggtgtgccggcagacagccttcttcgtgacgcccagcacggtgtggccggagagcgcggagcagaagcaggccatcgtggaggggtaccgagccaagctggcctccattgactgcatgcactttgacaagggcaggggtgaggggggattgggcggggcaccggcgggcaggcgtgtttcaggcatgcgtgagaggactgagcgggcggcacggggtgcagttgggtgtgcacagaacagggccacctctgcactgaccatcagcactgccgcattgccgacaggagcgtgcccctttggtgcaagctgccactacaaacatgcctacgaggatgggacagtggaggtaggcccattgaggggatgcggttgcagaggagtaggccagatgcatgcagctcgctcttggaggcatgctgaaggcctgcaagctcgtgctgcaagcgtgctgtgctctatgcctggatggcagcagcagcctgcgctgctggctttaaactcaaagggacaaggctcctgtcgacatgcagagtgcaagtcctccctttgcaggtgccctcaaaccgcctggccgccgatgaggagggcgaggtgcgcatgctgcagcccatgcgtctctcggatttcatcacgataacagaccgaagatcgcggcggcggtaaaagcacttgcactacaggagtcacattagcttgtgggtgggcaatgatgaggaggaagggcggtggcctttagagaggcccagcaatgttcagcacatgggatcgtgcaggtgcaaccaaaaccccacgcagcggacccctcagccatgcgagggtttgcggatttcacagaggtcgctgcctcgtcacgacctcnnnnnnnnnnatgcaggtgcagccaatgccccacgcagcagacccctcagccatgcgaggggtttgcggatctcacagaggtcgctgcctcgtcacgacctcccaccacagcctgagatcgcccatgaggctatacatgggatgcttaaaggtcgccgggcggttgtgctcgaagaagaagtggcctgtccatgcaaagccgtagccaatcagaggcacgaaggggagcactttgaggctcagggtcagcagcgccagggtgtcgagggccaggacgatggtggtgcccaggatgtgcaggcgccggcatgtgcgattcgcatgctcccctttgggatgagagggtttgtggttggttggttgggaggggggggcagggtttgattgcagcggggcccatgggacgtagcgcctggtgattcaccacaaaccagcgtagcaatctatcgatccgacctcaccaaggtagaatgggtagaagtccgcgaagcttccgaagccaaacgctggcaaggggagacgcttgtagttgggattggcgacgaccatggcaaccgatgcaggccaagttgaaggaaatccttgcacaaaattggaaacctatgctttcactcgacagcctgttgtgctatggagaggaagtttcccgtgcatgcgtgtcggaaccgggttccgtctgaatcagcacaaagatcttcgagttcccgaaacagcgcatgaccagtaccagattataaggcactttgcacagctgaatatccttacatcctaactctgtgttgttcaggaggccggggtcattttaacgatggatggcatnnnnnnnnnnaatcctcacatcccaactctgtgttgttcaggtggccggggtcattttaacgatggatggcattttcaataagaccctgctggtcaaagcaattgctcacatcagaaagcaggcagtggccatgtgctgcacaatactggcgtgcaaaagtatggaaggtggttctgggcttgttcagagagattgtttatgcgcagagcttattggggtgcagtctaggtgtagactctgttggggtnnnnnnnnnncggttctgagcttgtccagagggattgtttatgcgcagagcttattggagtgcagtctaggtgtagactctgttggggtgcaacctggcaaatgcgagttcattggtatatgcaagggtcttgttcctcattggtgggagatctgaatagggaacacaggggactgtgggcgggtgctcatgcggggcggagccctccattcaaatgtcagcgttgaagatgaccccggagtagacctgtgcgctagtcctggccgtgcagtacgcacccaacaagcccgtgaaaacgctcagcgtggagcccacgatcttgagggcgtcgatgcccaagagcactcccagctcgacggccaggagaccggccaggcctgttgggaacacgccgccccacctggcgagcatggcattgggagaaggggggttactggatgctccacacgccgcatggtcatcatgcaaagggtatctagtttagctgtgtgttactgtgccatgtccttgccaaactttctgctgactatcgctcagtagcctcaagcactggattcacagccgccaacctcccactctccaggcaacacccgcgcgccccagccggtggtgaaggggatgcccttgttcttgatggcggtggccaggcacaccagcatgccaaaggtcaggaaccagatgcagctgcccaggaacatgaaggcgaccactgtcaggcacgagagcaggcctggattggcaaactgcaatggagaggttggcgtgggaggctgggaagctgtctacatgggtttgaggctcgttaaagggccacagggcggctgcagggttgcaacgtcaaccatgattaatgcctcacttctctcacaccagcacgtgcccacaaacactcctcgtccagccactctactcacgtcaaggaagggcgcatgccggagctctggtgggaatatcttggtggacaccaccccgagctgaaggaaggtgaggccaaagagggccatgggagcagctgggagaaagacagagacgatgaagtgcacaggagggagacctggcacgcagggcgggggtagggtgtggtggggcgggttggggcggggaagtgacgtgatatggcggcaggtggagaaccagagctgggtctgcatcggacctggaagtcaacatgtatgcagagtaaaggagtgcaagttgcagttgccccatccgcccatccagctgccagcgctcacccatgaagaagaagcgtgccaggagcatgccgagcgtcacgaggaccagggggagcgctgcgcccaacagtaggtaggtcatgtagaggatgtgccgagcttgactgcagggacagggaggggtaggggtggcagtgatatgcctttccgccggcacagcacaggtgacctcaacacatgaggggctgctgaggcaaagtgcctcggtgggcgcatgataaagtgttgggtctggcatgacgctgtggactccctcgctacatgcctgttcccaggcagacccccattcttccccacgcacgagatactgggaatagcggctgcaaggactggacctgccaccccaatcacgactccggggaacatggcgagcagccagagggtcgacagctcggcaaagctgcaagacatgtttggcaggggagggggagggattggcgaggctgaggatgctgagcgccagggcaggggtgcgcagggaagtcacctggccacagcaccaagcaccaccttatccagcttagggacgctatcaggtgaaggcacgcaggacactcacgtgcggctgtggtagtaggccaggtagaaggggatcaggatgttggcaatgtgcgacaagaccgctgtaatccactgtggggagagatggtggaggactatctactggcttcctctgctggggtttgtcgagcaatgaccgaagcccatgtccaacgacagatgccgttgctgctattcatgaattcatcctcacccnnnnnnnnnnatggcttcctctgctgcggtttgtcaagcaatgaccgaagcccatgtccaacggcagatgccggtttgctgctattcatgaattcatcctcacccagaagacgatggcgacggtgtagaagccggagccaatgtaatgtgggcagtaccgcacgaacccctccaccaggatgccaaaagaaatgaggatgtagccagcaaagaagagatcgaaggagtggttcttgggcaggatggcaattgtctcccagtggaggatgcacctgcacagcagtgcatggtttgggtggactgattggcgtgcaaagggtgcatttgtcacaactcttagccaccttccttcacaggtggcaatgccatggttgacaactatacatttgtagtcacccggcccgcagcgcccacctgagggacaccatggtcaggcagannnnnnnnnngtggttgacaactatgcatttgtagtcacccggcccgcagcaccccacctgagggacaccatggtcaggcagatgaggaagagggcgacgctgagccaccagaaggcgaaagcaagaggggtcgaccagcttgtggacaggtaggggttgacgctgaagagcagcccgatcagaccggtgcaagtggatagcaagaacatgctcggcgagaatttcctgcatgagatacaatgcggcaacagggttggaggtccgcgggctgagcagggagcccttaaagtgaactccgtggctcctaatggcgcaatgtggttccatcctgtcacaattgtgtacactttgacgtcattgggtactctgtgcaagtcagacacccctcaccttattaagttgcgcttgtcgtccaattgtgaaaagggtttgaggatgcgccagccggtttgctgtccaaccggcgctcgggcggtcttttcaccagtctccagatccattgccggtatgttgtgcacaactttatctggcattggctcaggtgcaacctgtgcgtccatggcaagcaagtacactcgagtatgcgacgccttcgcccaccgagatgccgccgcaactgctcgaaaacctcttagacaacctccgaaacaattgtggaatagtatacactgttcgagcgacaaccataacaatgcagcccctctgcttgtcaaccctattatatataaatgccgcttatcaaacggtgagccccaannnnnnnnnncgacaacctccgaaacaattgtggaatagtttacactgttcgagcgacaagcataacaatgcagctcctctgtttgtcaaccctattatataaaaatgccgcttatcaaacggtgagccccaacccacgtgattatggcgcggtgtgtgagctgctcaccgattgcgcggtctcggcatttggcttttggcgctgaaaggtttcagttggattcggcgtccagatgaaagccaaggagcggatggtaataggcctcgagccaaaatggtgctcgccatgatgaatgcgtgtaccacacacaatgacgacgcgatcggcaatacgcgacggcccaaggcaacatgaaatcctgccatcgatgtacaggccatcctctggacagccgatgaggatgggcattgtgggtctccctcgcgaccagtatacattcatgacatgactcgtcgagagcccttgcggcgagcagctcgtcagcacacgcgcccagatccgccccgcccatgatcttggcaatactctcatgctgagagggactggatccctgcaggagctgctgggacgtgaggttggacgacggcgtgtggtgcccaagcaggtcgacagggcaaccccagccgggactggccagggcgaggagaggccaagggtcattgatggacgtgttgccgaccccccagcgccgggcaccgccctctgtcccttgtgccagtccaccctgagcaaagacccccaggccattgacgctcacattggtggggcctgccctttggatgcaccagggtggtccagatgcatgcaagctgccttctgagattggaatggatccgacatcccttcatgagcgctgtgctcttggatgcctcataccatttgtggccctctgcaacacaaggccctcctcccccaaacactcacacgcagagaagtgtctgttcaaggaggcggctcggcgggggcgcacccagtccagcatcaagtcgttcgcggcggcccgggtaccagcgggaagtgatgctgcggctggggcaggcactgcgccagcaagcaccccgcccggcccagcgccgtccggcgcccccgacctcacccagtcctgcagccaaagccagaccgcctgctccttcacgtgtcgcatcgtgggccgctccttccagtcgccccacgcctgcgactgtggccaggtggcgtgctgtccgtgttgggagcgaggtgcagggggaaatgaggcgccggcttgagtcctgggccgtccccgactggcacaatcatgcccccgagtcatgtgttccacgaaccccacgcagtcccaaccccttgcctcccacccaggcggtgtgcctggagctggaggccgacaaccccagggacaaacacgcgacgctggtgctggacgccgggtcgggcgctgctctggggcacgtcccgcgcgaggtggcacgcctgctggggcccctgctggccgcccagctggtggcggtggaggggtgtgtgttggaggccccggcctccagccgtgcctccgtaccggtggagttccaggtgggggcggccgggcgttgggtagcgtgtttgtgtcgtggtggatgtgtgtgtgaggacgggagggggtgatgagggccggctgccagagccannnnnnnnnncgcgtgtttgtatcgtggtggatgtgtgggtgaggtcggaaggggggtgatgagggccggctgccagagccaccacgatcctgtggtgggagggaactccccctcaccatcttcacccttggcaggatcacaccatcccaaagcacaccctggatcaaacccttgcaatcnnnnnnnnnnacaccatccccacccttgacaggatcacactatccccaagcacaccctggatcaaacccttgcaatccccaggtgcagctgctgtccgaccaggaggcggatgtgcaggccgtggccgccgcggcgctgcgcctccaggccgccatgcagccggccgccagcggcgaccgcctgcgcgccaactttgaccgcgtgctggaggcggtgtggcgggaggacgcgcggctcctggaccgggaggagcgagacttccgcgagactttcagcgtgagtgtgtgtgtgtgtgttggtggggcccctgagagctgggtgggtgggtgtgatgacaaggcgggactgtgcatcaggcggggtgtcgtgatctctagaccggatctccggccccggccgcccttgggatcgcccccaccatgcacacacacacaccgcacccacacgcaggcgctgacggcggcggccgccgccctcttcctgcgcctcttcctgcgcaagggcccctggttccggctccagcgcctcgcctaccccgaggtccccgacgcggccgccgcggtgggggagctgtgcgctgcgggcctggcgcacacctgcgcgtcgccggcctcggccggcgacgccggcgccttccacg

SEQ ID NO: 40612 - DNA, 61 bp, Chlorella protothecoides
tccccatcttgaagcaggctgtcacaatagagtgcttgattagtcggtggactggcgagag

SEQ ID NO: 40613 - DNA, 76 bp, Chlorella protothecoides
agtggtgaccgcggggccaggcgcttccggctccgttccatccccactcgcagcagccaccctgcccagcagcatc

SEQ ID NO: 40614 - DNA, 63 bp, Chlorella protothecoides
ccctcctgcacactttcctcacctccccgcccaccccccccccagcgctggcgcggatcttct

SEQ ID NO: 40615 - DNA, 115 bp, Chlorella protothecoides
ccgccggccgcggcttgagttttgccctccgccgacaggccggggtttgctgggtccccttgtcccacctttttcttgcggggggctgggcggtgcggtgccgacctctcctcgc

SEQ ID NO: 40616 - DNA, 69 bp, Chlorella protothecoides
gaggcgctggaggaggtgagggcagggttgcgtgatgttgtttttggagcacagaggtcggcggcaaat

SEQ ID NO: 40617 - DNA, 61 bp, Chlorella protothecoides
tcaagaccttcatggcaggggcgttggagggtatcacgcacatgcacacatcctcgcaagc

SEQ ID NO: 40618 - DNA, 61 bp, Chlorella protothecoides
ctgcgcgacaccctcgagggcctgatgcagaccgaccttgatcacgccacgctgggcctgc

SEQ ID NO: 40619 - DNA, 61 bp, Chlorella protothecoides
ggcaccaaacccggacgatccactgaacaaagaggcggcagaggccatgcagaatgcgccg

SEQ ID NO: 40620 - DNA, 61 bp, Chlorella protothecoides
tacctcatgacagttgacgacgccgacgccgtctgcaggtgggcagcatgagaggggttat

SEQ ID NO: 40621 - DNA, 206 bp, Chlorella protothecoides
tcgtgggcgggtgagggaacgccgtgtgtgtgtgggtgggaggggcgggggggagcaactccttggggaggagcggagcgtggatggtcggtggagagcgggtgcgcggggggccctccagcgagcgggggcacggcgacagccgcgccttccggcgcgcgtggcgctgggtggggcggcgcccgggcccaggattcccatgctgc

SEQ ID NO: 40622 - DNA, 127 bp, Chlorella protothecoides
tgttcacccgctctgctcctcggccccagtatgtgagtacatgttggccagtttcctcttcccctagacacggcgtcacaccgccccctcccccccctccaatgcgcattgcttgcaggacctgcag

SEQ ID NO: 40623 - DNA, 61 bp, Chlorella protothecoides
ctccccgccaatgacctcctcgacgccttgcccggaccgcaaaatcacggcgcggagggag

SEQ ID NO: 40624 - DNA, 100 bp, Chlorella protothecoides
gtggggggtggggggaggggctggactgcgccgccccgcgagcagagaacaatggcatgggattagagctcggcagtcagcctcatatagacatggtgtt

SEQ ID NO: 40625 - DNA, 66 bp, Chlorella protothecoides
aaggagccgtccagctggctttcggaggccccgtcaccatcatcccccgccgcccccccctcgcca

SEQ ID NO: 40626 - DNA, 61 bp, Chlorella protothecoides
cccagtctccccgacacacatacctcaaacaccccccccccacacacacacacacccatgc

SEQ ID NO: 40627 - DNA, 61 bp, Chlorella protothecoides
gggggaagtgagaggggggaggaggccttcgaggaaaagggggaagtgagaggggggagga

SEQ ID NO: 40628 - DNA, 6170 bp, Chlorella protothecoides
  modified_base (1230)..(1260): a, c, t, g, unknown or other
  modified_base (1482)..(1491): a, c, t, g, unknown or other
  modified_base (1582)..(1591): a, c, t, g, unknown or other
  modified_base (2016)..(2025): a, c, t, g, unknown or other
  modified_base (2383)..(2392): a, c, t, g, unknown or other
  modified_base (3620)..(3629): a, c, t, g, unknown or other
  modified_base (4286)..(4295): a, c, t, g, unknown or other
  modified_base (4558)..(4567): a, c, t, g, unknown or other
  modified_base (5244)..(5253): a, c, t, g, unknown or other
  modified_base (5489)..(5498): a, c, t, g, unknown or other
  modified_base (5768)..(5777): a, c, t, g, unknown or other
cgccgcccgccgacctcaaggcgcgctccgcggccaagaagcgcgcggcggcgctgctcgcgcgcgtcgccgcgcccgaggtccgggtcatggcggccgatgggcccgccgactgggcggcgctggtgcgccacctggcggacgccgcgcccgccgtgcccggctggaggcagcaccgcccgcagctgctggtggagggcgccgagctggcgggcgaggggggtggctcggacggcaccgtgaccctcctgctcaggtggagtacacggaagggtgtggtccgtgtgcagggcgttgggagggaggcagttgctgctcctgcgcaggcgcccgggacatgaaaggctgactccccgtacattgtcgcccccctccatcctctgccctgcgccgacagcctcccactgccacttgacagggggtatgtccgcaacctgggcctgtcggttcgccaggccgtgcacgtccccggcgcaggcgactttgcgctgagtcagatcgacgcgctgccggagccggggcgggggcgggacgggatggacgccgaccctgcggtcctggccaccgcggggccagaggagagggcgaatctggaccgggagaatgtgcccgaccctctggccggcgagcagacctggccgaccgaggaggtgggtgtgggtgttggggggcggtgctgctctggagggcgccggaagtggcgaggggccatcgtcccaccagcccggaagtctgctgcatggtatcgagccatcctgagctgccacccctccaacactctttgcccctccctcgtcaaccacaggagctggtggaggcggaggcggagcgtcgcgccgccgccaagctgaagaagcggcggctgccggccggcacctcagagtaccaggccgcctggatcctggacgaagacgaagggagcgagacggggagcgaggcaggggcgggctcggacgaggccatggaggaaggcgcgccggcgggcgtaccgctggcggaagacgatgtcgactccctgctgaacgggggggcggagggcacggaggccgacatggacgtgagcacagggggaattggcgggatggacgtggcttttctggctttcttggggtatgaaggccctgaggcagggtttacagggttctaacactctctgtgaccttcccttggggtgggggtgagtctttttttttgcaccacggctcccatggctgagtattccagccggcnnnnnnnnnnnnnnnnnnnnnnnnnnnnnnncctgccacacaccgatgccctcctttcctcctgcagtacgccgaggacgaggaggaggaggaggatgacctggcggcccggcggcacatggtccaggacgatcaggagtacccggacgaggttgggggagcagggttggcggtgtgggagggagtgaggggtctgaagggaaaaaatggcggcgtacatccgcacaacatgggtgaccctctgcaagtttcnnnnnnnnnntctgccactcaccgatgccctcctttcctcccgcagtacgccgaggacgaggaggaggacgaggatgacctggcggcccggcggcacatgnnnnnnnnnntgagtgagggatctgacggggagaaatggcggcgtgcatctgcacaacatgggtgaccctctgcaagtttcaggcatggaaaggactgaatcattgcacatggcagagcattcgttgaaaaccaatctcaacccccctttcccccctcctccaggtggagaccccctccggcgttctggctcgtgagcgctttggcaagtaccgtgggctgaagagcatgaggaccagtccgtgggacccgcgcgagtcgctgccgctggagtacgcgcgcgtctttgcctttgacaactttgtccggtgagggacggggaactggtgcacgggtgaagtgtgggggagacacgggcgtgcgacgcaacagcagccgtccccctgggcgcccctgccgctctcatcgtccgcatcaccagcaacccgcatttctnnnnnnnnnnaggtgagggacgggggactggtgcacgggtgaagtgtgggggagatacgggtgtgcgacgcaacagcagccaccccccttaggcacccctgccgctctcgtcgtccgcatcaccagcaacccgcatttctttccttcctttcttcctcaacccagaacgcaaaaaagggcgctggccgcggcgagctccgggcaggaggcggcggcccccgccggcacctatgtccagctgcacgtggtggcggtccccgccgacgccgccaagcgagtgcaggagcgcgtgggcgcctggagcgcggtgagtcagcgggattgctgcgaggtggaaggggcggacggaggctgcgcgccactgcaannnnnnnnnnacgcgtgggcgcctggaacgcggtgggtcagcgggtttgctgcgaggtggagggggcggacggaggctgcgcgccactgcaatcaccactcctgcttgccagacacctcgatgccgggccagctacatgtgctacgtccgcccacctctccccaatcgaccaatcacactcgcagggactggccagccccctcaccctcttcggcctgctccagcacgagaccaagctgtcggtgggccactttgccttgaccctggtgcccgaggcgcccgccccgttggcaaacaaggaggagctgctgctggtgactggggtcagggccttccgcgcttgccccgtcttctccagcgacgagcacggcgcggataaacacaagatggagcgcttcctgcaccctggcaggtgagcgctggttgtggtttaaaaaatgagggaaggggttcaccggggagggacgctgctgtgcaggggtaatctggcgcgtctggaggatgggactctggtcactacactcctccccgagacccccagccaggctgggtctgtgccctccactccccctttcccaaccatctcccgcccaccacctactcaccccctcaaacacgaccactccctgccgcaggccgtcggtggcgaccgtgtacgcccccatctcctaccccccgctccccctgctggccttcaggctggagggaggggccaggcccgtgctggcggccacggggtcggcgcgccgccccgaccccgatcgcgtggtgctgaaaaagatcgtgctgaccgggtaccccgtgcgcacgcacaagtccaaggcggtggtgcgccacatgttccacgacgcagatgacatccgctggttcaggccggtggacctgtggacgcgcagcgggcggcgcgggcggatcagggagccgctgggaacccacggcgccatgaagaccatcttcgacgggcccatcacccaggcagacgccgtgtgcatgtccctctacaagagggtgttccccaagtggcccctggacatggcctttgccgcgtgctgaggggtgaggtctgtttctgacccgatgccctgcagatcggtgcggcatgctgcgcgtgctgccacatgacgggaagatgttgtggaggacacgcacctcctcagatacggaaatatacacagccatgcagctagaattttacgtggaattcacggtcgacacacatcgggatgcagctcgcacannnnnnnnnnaatggtgtggaggacacgcacctcctcagatatggaaatatacacagccatgcagctagatttttacgtggatttcacagtcgacacacatcgggatgcagctcgcacagtcagcaatgcgctccgcggcgctcaacaccggcagcgtccgcccattcgtcacgggaccaccggggcaggtacgcccgcccacatcgccatatgtgacgcagccatgcgcacggaggtggcaatgcagcaagacgactgccagccaatctgtgcgccacgtcgaccccagagtctcgagtggtgagaagtgcatgaggagcggtgtcgaaacgcagaaccttgccctgcttgaggaggagggcgaaactcagttttatcacgcgctgctttaaaccctcccgatgcacagtggatgtaccagcggaggagcaggctgcccccatggtcgcgatgcagggggacgtggtcaccctgcgctggacgtgtcggggagaggatggcgaggtgcgtggaccccctggggatgggtgcatcaaggctgtctggcagtaaatgtctgcacgatggctgtttgggtcgtgattgtagcatgaaaagggtatggtacaacactcagcttcccaaccctgaaggtaatggactccagcgatgcccatgacgccccgnnnnnnnnnnaattgtagcatgaaaagggtatggtacaatactcagcttcccgatcctgaaggtgatggactccagcgatgcccatgacgccccggccacatttgaagtaggtatcagtgatgttgccgcaaacccactcatagaggtgagtgtgtggcaacttgtgttctatcagggtcagtttggaaatctggatggaaattgtgctcagtgttgggggtcatctgttgtatgcaaccattgtggggttggcaggaagttgggtctgaccnnnnnnnnnntccactcatagaggtgagtatgtggcaacttgtgttctatcagggtcagcttgcaaatctggatggaaactgtgctcagtgtttgggggtcatctgttgtatgcaaccagtgtggggttggcaggaagttgggtctgacctcctgcagcacgctgtcgggactgcctggtcacccttagacccccatacatttcccgagcaggcctttgactctgctgtacgaggaatggctgtgggcgacaagacctccatccaggtatatattagacttaaggttctgtttgcgagtggggtgataggtttcactgcactttctgtaaaggtgccttgccaccaaggccccagtctttggcacaggtagggatagtgcatggaattgagctgcgatttggtgacatcttgcattactcagcgttctgaacatccccagtcatcccctggttcgcccttgtcaggtggagggtgcagaatggaaccccgagctcctgttcagagtgccttgggaccatccggagatggagcgcctcaaaggacgctacaagaagtgagcgccagggctgttggctggatgggacggtgtgatgaactattggcccagtgcacgatgagtagctcaactctccaaaggattgccctgcccaacatgcacctgtacacgactgtgcacaccccctatnnnnnnnnnnacagtgcacgatgagtagctcaactctccgagggattgccctgcccaatattcacctgtacacgactgtgcacaccccctatccaacctgtgcgcaacaccgaccctttttcatctcctgcctcaaatgcagcatggggggcgtgaaggaggggctggtggtggagttgagcaacggcggtcgcgcggtggtgacggcgacgaccggcgacgatgtgatcctcgacgccaacgccnnnnnnnnnnccgcgcggtggtgacggcgacgactggcgacgatgtgatcctcgacgccaacgccatgctggcggggcagagcgtggccatggaccttcacctgacccacatcgtgcgacccacctgatctggcggtgatcaaagtgcactcgagtccttttcccacgtctctctggcccctgcatccctcgtcgttgttgctcagccgctggccctgtactccccagaacttctgccccattggcctcgtcaggccatgcgcgtgtttcatggcacgcnnnnnnnnnnattgtcgtcagtcgctggccctgtattccccagaacttctgccccattggcgttgtcaggccatgcgcgtgtttcatggcacgctctgtaatcacgacgtcactgcatcaagacccgaggcacgccagcatgcgggcgcagggcccccccggctgcaccagcagcgtatgtatccgccgctccacgccctccgccacgtccccgcccttcccgcccagcgcccagcgccggagggcggcgtcgccctccccgtcgccgcgtgccagcgccgcaagcaggcgctcgcgctgggtcccacgcagctccgccgcggcggaggcgacgtcggcgtcccccggcgccagcctggcagccgcctcggccagcgtgcccgtgtccagccaggcctgggcg

SEQ ID NO: 40629 - DNA, 68 bp, Chlorella protothecoides
caggcatggggcgtcatcgagtgctctccccgcatggaccccccctacgacctccatgtcgatcatgc

SEQ ID NO: 40630 - DNA, 101 bp, Chlorella protothecoides
cagaagagttttgcaggcaccatgtcttgtattaatgccatgctggttcgaccgtgcactcacagaatgacaccaaccagcaaggatagccaccagaggcc

SEQ ID NO: 40631 - DNA, 61 bp, Chlorella protothecoides
cacaggtttccgatgcgatggatgtggctggtgcgaaagctcgcttggctccattcccaca

SEQ ID NO: 40632 - DNA, 61 bp, Chlorella protothecoides
gggggaccacacctgatggcaagcggctggtgcaggcgtgccgggccttaagcatccagtg

SEQ ID NO: 40633 - DNA, 2346 bp, Chlorella protothecoides
  modified_base (926)..(935): a, c, t, g, unknown or other
  modified_base (1207)..(1216): a, c, t, g, unknown or other
  modified_base (1433)..(1442): a, c, t, g, unknown or other
ctccccgcccaccccctccgcccactcccgcctgcgcatcttctccggcaccgccaacccccagctgagccaggaggtggtgtgctacctgggcctggagctgggcgccatctccatcaagcgcttcgccgacggcgagatatactgccaggtgggcgagtccatccgcggctgcgacgtcttcctcatccagcccaccgccccccccgtcaacgacgcgctggtggagctgctgatcaccatcgacgcctgccgccgcgcctccgcccgctccatcaccgcggtgctgccctactttggctacgcgcgcgcggatcgcaagactgcggggcgcgaatccatcgccgccaagctgacggccaacatcatcaccgaggccggggcggaccgggtgctgaccatggacctgcacagcgggcagtgcgtgggctactttgacatccccgtggaccacgtctacggcgactccgtcatcctggactacctcgcctccaagcgcatctccaccggcgacctggtcgtcgtctcgcccgacgtcggcggcgtggcccgcgcccgcgcctttgccaagaagctgaacgacgcgccgctggccatcgtggacaagcgccgctccgcgcacaacgtctcccaggtcatgaacgtgatcggggacgtgcgcgggaaggtggcagtgctggtggacgacatgatcgacaccgcgggcaccatcaccaacgccgcgcgcgtgctgcacgcggagggcgcgcgcgaggtctacgcctgcgccacgcacgccgtcttctccccgcccgccgtcgagcgcctgtcctcgggcgtcttcaccgaggtcatcgtcaccaacaccatccccgtgcccccggcccacaacttccccgagctcaccgtgctgtctgtggcaaacctcatgggggaggccatctggnnnnnnnnnnacacaacttccccgagctcaccgtgctgtccgtggcaaacctcatgggggaggccatctggagggtctacaactccgcctcggtgcagagcatacgggagtgaggtgcgcgtgtcggcgcggggaggggtgccggcgaggtgccaggcgcggcgcccatgtgcgagagcgatgtcggaaggtcgacctgggcgacgctgcctgctgccagcgcactgtcccctggggaccaggcagcgagcccccggcgcggcgaagctcgctcgcgccggnnnnnnnnnnccgacctgggcgatgctgcctgctgccagcgcaccgacccctggggaccaggcagcgaggccccggcgcggcgaagctcgctcgcgccggacgcggcgtgctgtgtgcggccgacaatcccccgccgctgtgctggcgccgcacgctggggactgcacatgccagagcgcacgagtgcacggcccaggcgtcaagccctggcctgcatgcagaatgnnnnnnnnnnttgcggccgacaatcccccgccgctttgctggcgccgcacgctggggattgcacgagccagagcgcatgagtgcacggcccgggcgtcaagccctggcctgcatgcagaatgactacacttgactcaattctttgacactcgatcactgcaagctcatttcaaggacacaggggaagcgctcagattggggaaccaggggggggggtcccagggggaactcgccggcgactctgcaccacgcccaggatttcagcaggtgagagatcacaggactctggcatccctccgagggccccacccacacacattacacggccccatcagacctcaaagtcccaggcgatgcagagggcctggcggtccaggagcaggcggttggtcaggcctatctgcagcgccagccccccaaccaacggctgcaggctcgaggcgtgctgcagcaggcgctggcaggcagcgcggaagcgggcctcggccaggccgtcctcgcggaccaggcggcgcagcctcagccggcgctccacctggcgggcgaggcccgccagcgcagcgtcggcctgccggcgtcgcgctgcgccttgcgcggcggagcgtcccagcgcgcccagcgtggcgatgagtgatgcggcggggaggtcggcggggagctcgaccgcgccgctggcggcgtccaccccctgggctgaccccggcgcgcccacgcgcaggctcacgcccgcatagtcgccacggcgcggtctgcgtgcatcacgtgcgaccgccactgcgcggtccaggaactcgcggtaggctggatcggcggtcgcgatgccgcggccgcgcaccacggcgtccacgcccagcgcggcggccgcgctttcctccaggcgccgcacgtcgcggcccagagcgcgcagcgcggcg

SEQ ID NO: 40634 - DNA, 61 bp, Chlorella protothecoides
tatggtcttgatgatgtaatggctggggaaatacttgagtttcaagacggtactgtgggta

SEQ ID NO: 40635 - DNA, 61 bp, Chlorella protothecoides
aaggagatcctgtcataccagtgagttgggaatgaagctgcacacagggtttgtggactgg

SEQ ID NO: 40636 - DNA, 69 bp, Chlorella protothecoides
ctggtcagtggcgagggtggatgcgggtctctaactttgaagcagggttggcatggatgacctgtgcag

SEQ ID NO: 40637 - DNA, 1086 bp, Chlorella protothecoides
  modified_base (103)..(112): a, c, t, g, unknown or other
cccggcacgggcctccgggtgctggcggggaccccgctgccggccgtgcagggcgaggcgcccgcgccggggtgcctgctggagagcctgtctgatggcgacnnnnnnnnnntcgggtgctggcggggaccccgctgccaaccgtgcagggcgaggcgcccgcgccgggatgcctgctggagagcctgtctgatggcgacgtggcgcggctcatccgcggggtgagtgcggcggccgagaggggtcagaggctttcagtgccgtgccgctgctgctgtgcatcgctgcccaggctgcgcagctgagggggggcgctggtgtgtttcagctcacattccaacacacgatcatggaggagaggctttccatctgccttcccactcaaacccgacagatggccatgtaccccacccttgcgctgcctggccctgaagtggaggaaggcgtcctggggagcctggaggcggagccaccggcaggcctggagggcgccgaggacggcgccgcaggcgcggaggcgacagactcagcggccacggcccccgatccaggcgccaccgcgcgcaggacggccatcgagtggctgcgccgccaggcgccgggcgtcgcggaggggagtggggccctcgccagcgtgccctggccctttggcgggcctgcagatgcacccggcgcaggggctccgcaggcggccgagtcttccggagaggctggcaaaccgacggccgaccctgcgacacccccggcgtcgtcgctgctgccctccggcgcgacgcgccacccctacacacgcctcctgctgcaggcgcccacccccgcccacgtacaggcctcggcccacaccgtgccagcgcccgacggcgcaggcgggggagcaccgcaggctgcagcacccctctccggcagcgccaagcctgaggccgaggagggcccagcctcagggaccagcacaccctcaatgcgtcccagcagccccgggccgggcgacggcgggagggcacggggcgcggcggccgccggcaagcggcaggggatgcgggctggaggcctggcccgtgacgcggccgcaggcgctccgagcgctgc

SEQ ID NO: 40638 - DNA, 61 bp, Chlorella protothecoides
tgccggcgcccagcacgcgcggggcgtcggcgccccacctggtgccgcatgccgtcgacga

SEQ ID NO: 40639 - DNA, 61 bp, Chlorella protothecoides
ggacagccatgggaactcaaggtgtatggggtccagcagcaacgggaaggtcaccgccttg

SEQ ID NO: 40640 - DNA, 152 bp, Chlorella protothecoides
ctctgtgaagggagggcatgtgagaccagcgcgcctgtgggccctgggaattcaaacaggagagccgctacacccagcacccagcaggcactcgcatgggatgagcactctttggagcgagggcccgccgccatgctcacctggtgcgcgat

SEQ ID NO: 40641 - DNA, 81 bp, Chlorella protothecoides
agcctgcctcctggggaaggtaggtgcacaaggggcaagggggggtcgcggggtgcccggcgccgcggcgccgccgccccg

SEQ ID NO: 40642 - DNA, 69 bp, Chlorella protothecoides
cagccgagtgctgtgtgggttgccggtgggccggggcgtgatgaggcagtgcgtcagcacgcaccgtgc

SEQ ID NO: 40643 - DNA, 61 bp, Chlorella protothecoides
ctgctgcctggaccccagctccttctccaggtcatcgcacagagcccttagggcccggcag

SEQ ID NO: 40644 - DNA, 80 bp, Chlorella protothecoides
tgtttggtggacggtgtcgccccactgccccgcccccctggagtgccctcgccccagatgcgagacatcagcgccctctt

SEQ ID NO: 40645 - DNA, 91 bp, Chlorella protothecoides
cagcggcgcactgactcagattgccagccatgcgctgcctgccaaggtgcagatcgacttggaccccgccgcggtcgccttcctggcgggg

SEQ ID NO: 40646 - DNA, 189 bp, Chlorella protothecoides
tggacgtgcgctgggcgtatggcgggctcgaggggcctggccagggggtgcggaatgaagatgtggcgggacgcagggcactgctgtgtgcctgcgcgggcgcgctcacttccaccgcgtgcacatcctactcagctgatctctccatccccccaatcaacactctcgcaggtgcgcaaggggctggcc

SEQ ID NO: 40647 - DNA, 30737 bp, Chlorella protothecoides
  modified_base (269)..(278): a, c, t, g, unknown or other
  modified_base (413)..(422): a, c, t, g, unknown or other
  modified_base (1280)..(1289): a, c, t, g, unknown or other
  modified_base (1739)..(1748): a, c, t, g, unknown or other
  modified_base (2486)..(2495): a, c, t, g, unknown or other
  modified_base (2906)..(2915): a, c, t, g, unknown or other
  modified_base (3016)..(3025): a, c, t, g, unknown or other
  modified_base (3152)..(3161): a, c, t, g, unknown or other
  modified_base (4019)..(4028): a, c, t, g, unknown or other
  modified_base (5383)..(5392): a, c, t, g, unknown or other
  modified_base (5462)..(5471): a, c, t, g, unknown or other
  modified_base (6662)..(6671): a, c, t, g, unknown or other
  modified_base (8014)..(8023): a, c, t, g, unknown or other
  modified_base (8812)..(8821): a, c, t, g, unknown or other
  modified_base (11219)..(11228): a, c, t, g, unknown or other
  modified_base (11945)..(11954): a, c, t, g, unknown or other
  modified_base (13390)..(13399): a, c, t, g, unknown or other
  modified_base (14363)..(14372): a, c, t, g, unknown or other
  modified_base (14618)..(14627): a, c, t, g, unknown or other
  modified_base (15204)..(15213): a, c, t, g, unknown or other
  modified_base (15491)..(15617): a, c, t, g, unknown or other
  modified_base (16261)..(16270): a, c, t, g, unknown or other
  modified_base (16860)..(16869): a, c, t, g, unknown or other
  modified_base (17174)..(17183): a, c, t, g, unknown or other
  modified_base (17738)..(17747): a, c, t, g, unknown or other
  modified_base (18294)..(18303): a, c, t, g, unknown or other
  modified_base (18532)..(18541): a, c, t, g, unknown or other
  modified_base (19119)..(19128): a, c, t, g, unknown or other
  modified_base (19382)..(19391): a, c, t, g, unknown or other
  modified_base (20192)..(20201): a, c, t, g, unknown or other
  modified_base (20263)..(20272): a, c, t, g, unknown or other
  modified_base (20385)..(20394): a, c, t, g, unknown or other
  modified_base (20772)..(20781): a, c, t, g, unknown or other
  modified_base (21573)..(21582): a, c, t, g, unknown or other
  modified_base (23746)..(23755): a, c, t, g, unknown or other
  modified_base (23874)..(23883): a, c, t, g, unknown or other
  modified_base (24538)..(24547): a, c, t, g, unknown or other
  modified_base (24900)..(24909): a, c, t, g, unknown or other
  modified_base (25151)..(25160): a, c, t, g, unknown or other
  modified_base (25285)..(25294): a, c, t, g, unknown or other
  modified_base (25961)..(25970): a, c, t, g, unknown or other
  modified_base (26548)..(26557): a, c, t, g, unknown or other
  modified_base (26978)..(26987): a, c, t, g, unknown or other
  modified_base (27852)..(27861): a, c, t, g, unknown or other
  modified_base (28153)..(28162): a, c, t, g, unknown or other
  modified_base (28750)..(28759): a, c, t, g, unknown or other
  modified_base (29535)..(29544): a, c, t, g, unknown or other
aggttccatgtcaccagcagccgtgccaccagctagacacgacttcgcaaggctgcctcggtacagatgggtttggtggtggcattgaggcggagaatgagctcctcaggagcgccgcacatggtctggaagcacgtcatgcacgcctccccatcgctggcggatgaccgagcctcctgacggtgtgtgaggcagcatggcacccctgtccccaggtccccgtcgagaagaaagcacttgctgtgggcgagaaccacatgctgtgccannnnnnnnnngagtgaagggattgggtcgcagagtggcatctcaacgatgaaaggtgcaccactaagcctttgcgatcgagtgtcaatcccgcacattgctgcacacggctcttgttcccccagctgcgaaaactttgcaacctnnnnnnnnnncggtggcattgaggcgaagaatgagctccccaggagcgccgcacatggtctggaagcacaccatgcacgcctccccatcgctggcggatgaccgagcctcctgacggtgcgtgaggcagcatgacacccctgtccccaggtcaccgtcgagaagaaagcacctgctgtgggcgagaaccacatgctgtgccaggttcaggggcatcaaaggcgccacactacactgccgggatccacagcgcaagggcttgacacgcagatgccaccagcatcttgcggggtgaccactgcacagggaggcaaagggaagggattggctcgcagagtggcatctcaatgatgaaaggtgcaccactaagcctttgtgatcgagtgtcaaccccgcacattgctgcacacggctctggttcccccagctgcgaaaactttgcaacctgcactgcacatgtttagcgtcacccccccgtgcacaaccctctcaatcccgatgcacacgccccgggaggcccctggcatccgttcctggcctaccttgagacatgtggggaccccagcatggcccttccactcagagaccacagagccatcggcgacgctccaggccctcaccgcgcggtcagcgcaccccgacaggacatacttgccgtcggcggtgaggcaggcctccagggccgtgccgccctcgggaatattgctgtggacctgcgtggatgccaggggggatgcccggtcggccagattgaaaggacaggctcgccccccctcagctggggtcagatcggttgtggaacgagatcagggtcccaggctgctgaccctggctctgtctggcactgccatggcctgcatctgcactgnnnnnnnnnnacctcagctggggtcagatcggtcgtggaacgagatgtggggtccaggctgctgaccctggctctggctggcactgccatggcctgcatctgcactgcggtgccctcggcccatgcagctcccttccgcatggccagtcttgaggaacccgcaaccccacacaccttgcgctccactgtgccctcaaacgcgtccatgacgtagatcctgccctccaccaccgccagcaggtacttgccatccagcgagaatcgcagcacggcaaatacggcggccccattcttctcgtccgcgacctggggtgtgtgggaatggcatgctgagcgtaaggctgcgacgaggatggcacagcgatcaggtgccccacgcatgactgcagcaagcgtccccctacgagggcccatcgcgtgactcagccacccgccactgctcttctgcttgcagcatacnnnnnnnnnnagcgaggacggcacagcgatcaggtgccctacgcatgactgcagcaagcgacccgctgcgggggcccatcgcgcgactcagccgcccgccactgctcttctgcttgcagcatacccaccaggcacagccgtccagccctggcagcttttgcgccccctctgtgccctcaccgtgaaggctgcaaatggcccctgcccgtagttccgggcgtcgtagagcttgaccaccccgctctcggcgcccacgcagaagaccaggccctgctcatcgtaggccactgtcggcaggcctggcgtctgcagcatggcctggcagtggggctggcgcaggtcccagagccgcacctgcttgtcttccgccgcgctcaggaagttgtccgactttggggacatgcacagcgtggtgaccttggccccatgtcctctgaagtaacgtacatatcggttgctgtggaggtcatggtaccgcagcgcatagtccgcgccctgtacggcagatgcgtgtgggaggttaggggagagggaagtagattgagctactgcagtagctgccaattgcatagcgcagcactccagcgagcaagggcgcgctcaatggctgcccgcgtcatgcctttgggatctgatcccaatcctggacttcacaggacccaaactccctctacatatgacattcttcagacccgcagctctacacatgggacctttgcagggaacaccaccgctggtgccctgtcannnnnnnnnngggacttcacaggacccaaactccctctccatatgacatttttcagaccagcagctctacacatgggaccttcgcagggaacaccaccgctggtgccctgtcaccttgttgctgctgtatatgacggagctgggatcgtgtgtgaagcacaccgacttcactccatacttcttgctgagcagcgcctgaagggcggtgccggtctctgtgtcatacagccggatggcatcgtcgtctccacccgtcaccagcaggtcgtgggtgcggtggaagtccaaggagttgatacggtcggtactttcctgcaaggtaaaaagatgcacttggctgagcattgattcgtggggccgcaggtggaaggggcccttccctaccccgtcgcccagcccaccttgaacactttccctatcnnnnnnnnnncaaagagatgcacttggctgagcactgattcgtggggccgcaggtggaaggggctcttccctaccccattgcccagcccaccttgaacactttccctatcnnnnnnnnnngccatactcgtataatgtgttgttttatgctgcgataattgagcatcgacgttgtgttgtcgttggacgaacaatggggaaactcgagggagcgcacgcgcgctagaccctcctcaagaggacttgnnnnnnnnnnccgaaagaggacagcacttccggcgtgatctccattcccacgccattaccgatccatacttgtataatgtgttgttttatgctgcgataactgagcatcgacgttgtgttgtcgtttgacgaacaacggggaaactcgagggagcgcgcgcgcgctagaccctcctcaagaggacttggttgtacatctttgcgggtgaaaggatcgcatgcgctcgggaaatatcatctcggcaggagcgttaagcacaaattggtggggtacatggattctagagaacgatgtgtgcagttgctggatgctgagctccgtcgttgctgcgactccacagctcttgaggccgagcattggcacctcacacgccaaaggggaactggtcactgggatcgctgttggggtcctttggatcccactgcaaggcaaggaagtcagagtgagaggaccaaagcacactgggcatgcaactctccttgaaagggtactggagcgcatgccaagcccccacgccatcagagcttgaagcgctacaaaaaggccacccgaactgtccccccttaccttgacaatgatcttcccatcctctgaggtatcaacccccccaatcctccgagatttgacgcgacgaacaggaacagccacagaatagatggtgccaagctctgggtcggtggacaggttcacctcaatctcctcctctgtctctatgtccacatatgctgacactgcctggacgatgctttcccgcatgcccgtcagactgtctggggtgatgccacacctacaaagcggaattaggtcgcttgctgaggcatgaaagacgctgcatctcgtcacgccggcccatgggctgaagaactnnnnnnnnnngggggtgatgccacacctacaaagcggaactaggtcgcttgctgaggcatgaaagatgctgcatttcgtcacgccggcccatgggctgaagaacttgcatggacgggattgacgtgcactcccgcaaggcccactccttgtcctcacgcccatcccacctgtctgccacgaggatcatcctgagcctgttctttccctcgtccttgggggtcaagaccggaggcttctcgggaaagaaaatctgccaggccgctttcagctttgctacgaagccttgcaggccaggggcctcgggcacggggtgccccgcattccgcagatgggccaggtgtgcatccgacaccggccctgcaccggccttggagctattcctcacatgtagacgattcaaagtcggcttggaaacacgccgagtgccctgacgatcatggtgagggaccaggaagtgagagggtggccctggaaccccatctgcagggctcggaatcagccgaagacaatgccacgcaccttcaggccggaccaggatctatgtggggcgaaggtaccctgttgcaggagggtagccatctgaagatcgagtgaagagcgcccgcagggccctcgctcccgtcaggtaacaccctgtctcggtcagccccactccgctggcggtccttggggcttctcggtcacaggctgcgcggcttgatgggggagtaaatcacagagctgaacggctgcttgctcatgtggcgcctcatgtacctgcttcgcgtgatttacagaatcgcatgcgtttcaaaaaatctggggagtgccagcgtggcgcgagtcgtccaggttgcacggtaagcattgtcccaaggcatacatcgctcctcattcagcacaaaccctgcgcagagaactaagattcttgtaactctgaaatagtattcgcgatgccggtgcgggagcgggaagtgctcggggcgctcattctgcttgcatcttcggtaggcatacatgcttgtgcaacactgtagggaatactcaaccctcatgctgttacaggtcttcactctgagcatcaaggcagacctggagaacatagaaagtatcagtttgcccgaggattcgtcgtacactctcacggtgagctctggtgagacacttgcatgggccgggtggcagtatgttgcaactcgggcactagtggagggtgcccatcggcagggcctgctcttcatgctcggtatcttgcaagggcagctgggtgctgtgcaatcacagaagtcaacatctcccccctgcccccaaccttcctcgcccaccccatgtccaggtcaaggacagtgccggtgatgaccagcgggaaggcgtcgtggtgtcannnnnnnnnnttgcagcatatcaagggtgttacccgagccctcaccgcggcggatgctggcaagtttgtgcccatcgtgnnnnnnnnnncagtggagggtgcccaccgacagggcccactcttcatgctcggtatcttgcaagggaagctgggtgctgtgcaatcaggagacaacatctaccccctgcccccaaccttcctcgcgcacccaagtccaggtcaaggacagtgccggggatgaccagcgggaaggcgtcgtggtgtcacccttggaagagcaggagctctccgggagtcgcggcacggcccactttgcgctcaagtggtcgcgcgacgcccggcacgaggcgagcctgagcgtgcagcacatcaagggtgtcactcgagccctcgccgcagcggatgctggcaagtttgtgcccatcgtggcgtttgagtgcaggggtctggaccccatcgcctggcagcctcaggcgagtggtgaggggtggtgctgcatgcttcgggcctgggcctgggtgccagggcgtcccagaaattccgcccgcccctgcccgtaccagtataccactgagcgcgcacatgctcccacccctgcaggacggcttcgtcataagggcgccgagcggcatggtgtgggaggacgtggacctttccagtggggagtgggcagagtatgacgagaagtctggggaggccgtgagcgtgatggagctggagtggagatttgacacgtaccgccccaagaagtgatggcgggcggagcaggggagccagggctgcaagacgagtggctatcccgagggggtggctcagaaccagcagatacagcttgtggccttgcatgcgggactgcaaggtccccctggagctgtcgctcacccggagggcgcgcggatgcgggcagcctcaacatggcagttgccccacagaccaaaatgccggggcggttcctctgctaccgctgccctcagaacacggctttccaatggagtcgtgtccctgtcacgcggctcttgggctccctctattacatgagcgtgactctcggagctcagctgggctgagtgggatatcatccgaccatgctcccaaaattgctgcctggctggggctctgcttcccacatgctcaaaatgatcctgtcttgcacccagcagaatgcataagagcatgcgatgccggatcccaacttctactaaagaggctaagacaaggtgacccggcttggcatgggtggattcctcaagtaactgagagagatccaaaacgatcaccgnnnnnnnnnnaccggatcccaacttctactacagaggccaaggcaaggtgacccggcttggcatgggtggatttctcatgtaactgagagagatccaaaacgatcaccgcatggtgtcggagccgtgggcgcgcgcggaaactccacctccagggttctcccactccacgcaatgccttcgatcctatccctgcacgccatgcccacagtctgcggtctcgccgtgccatgatcctacagagatggccatgaatatattaccttagcgtggaccccattcccccgccgctcgggtcgaggtccacccgatcagcgcacccgggatgcgtgggcccgtcagcgcccgcgggcgtggcgatgtgcgcaaggtggtcatccggcccctgaagcgcctcgccaccggtcttccatctgggtacgaggagggcgcctgggcccagctggagaccgcggtgctggctgtgcagagtggcacccccacctccaccagtctggaggagctgtaccacgccgtggagttcctgtgcaaggacgggggcggggccggcctgtacggccgcctgtccgtcctgatccgcgcccacgccgcggcggtggtgcagggcctggcctcggcgccgccctcagcccccgtcttccttgagcaggtggggtctgcctggcgggcctacacctcccagctcctgctcacccgccagatcttcatgtacctggactgcggctacctcaaggcctccgccaacgtgcccggggtccgctccctgtacgagctgggcctgtcggactttggcgccgagctcgccgcccgccctgccctcgtggaccgcgtcgtgcgcggcctggtggacctggtggaggccgaccggaacggggcggcggtggatgggaagctggccgcgggcctgctccaggccctgaccctgctgcatctctacggccccgccttccagcggccactgctggcggccacgctggcctactacaccgcggagggcacgcgtctcgctcaggagctggacgtgccggcctacctcctgcacgccgagcgccggctggcggaggaggaggcgcgctgcgaggcctacctcggccagcagagcagggacctgctcatggccaccctgaaggccagcctgctggaggagcacatgggtgaggaagggaggggctactgtagaaaagagtgaaaaggggggggagggcgtgcacactcgcgacacctgctcccgagctgatgccctcgggagtggacaagggagcatctcctggcacgaaggagcatccagccgcgcataacagccgcacgatgccccactcacacgccgcacctgcacaccgcaccacagcctcccnnnnnnnnnnacatcttttggcacggaggaccatccaacagcgcataaaagccgcatgatgccccactcacacccgcacctgcacaccgcaccacagcctccctgctgcagcgtgggctggacgcgctgatcgaggagggcagggtggaggacctgtcccgcgcattccgcctgtcggagcgcatcgatgcgttggacggcctgcgcgcagccttcaagggccacgtccggcgcgtgggcctggcgcgggtgggcgatctggagcgggagggcactctggtcagcgacctgctgacctggcgcagccgcctggagtcgtacgtggcgacggccttcgcacgcagcgaggcctttgcgcaggcgctgaaggaggccttcgagtacttcatcaaccagcggcagaacaagccggcggagctgatcgccaagtacatcgacggcgtgatgcggggcggcgtcaagggcctggcccaggacgacatcgactcggccctggacgccgtgctcgtcctcttccgatacatccaggtattcattgttctccacgggagccatgtatggcaggggggttatgtggtggtcaggcaaggaggagggggaggggggcttgggaggggaggagggacggagagtgaggaggaggacgctcctgcccaggtgcaaaacagcgaccggcggcaggcttggtggcctgaggaggcagagtgctggattgccttggctcgcagccctgctgggcttgcaagtggattgcaggcagactgtggtgatcagcagcgttgcaagcttcccactcacnnnnnnnnnntagagtgaggaggaggacactcctggccaggtgcaaaatagcgaccggcggcaggcttggtggcttgaggaggcagaatgctggattgccttggctcgcagccctgctgggctttcacgtggattgcaggcggactgtggcgatcagcagcgttgcaagcttcccactcaccctcctacccgcccacacccacacccaccgcagggcaaggacgtgttcgaggccttttacaaaaaggatctggccaagcggctgctcctggggcgcagctcttccatcgacgcagagaaggcgtgcatcagcaagctgaaggcggagtgcggggcgcagttcaccaccaagctggagggcatgttcaaggatgtggagctgtcccacgacgtcgtggcggggttccgggcctccctggcgggcccgggagcggggcagctggcggtggggggcgccgcggtgcaggagatgggcgtgcacgtcctgactctgggcttctggccctcctaccctgccgacgagtgctccctgcccgaggtcctcaccgccagccagcaggtgtgtgcccgtgttggtgtgtgtcggtgggggcagggcgttttggggggcgggcgctgtcgggggatgaggtggaaggtggtgcatggcggactggccttggacaccacgccacctcacccccccgctccaccatcatcctctccagacattcaaggacttttacctgaaaaagcactcggggcggcgactcgtctggtacaactcgctgggcacctgcgtcttgcgggccagcttccgcgcagggtccaaggagctgtccgtgtcgctcttccaggcgaccgtgctcatgcagtttgagcgaggcacagacacgctgagcctggaggagctggcggccgccaccaacatcgaagaccgggagctgcgaagaaccctgcagtcgctggcgtgtgggaaggagaggtgcgggagagcatgcggggggtcccagcggctggattgtctgggcaaaggtgggcgatggccaggggtggagcttgcggcttgctggtcagccacctgggagactggttttcataccacactgcgcccttggctgctcggacatacgtacccttccttgggtcatgacgaggcaaagcaggatccctctcacagcaggatcggatgcatgcagcacagatccctcccctacagagcaggggctgcattccctcctccacattctcttggccaccctctcaaccccttcacaccccacctgcagggtgctgctcaaggagcccaaggggcgcgaggtggaggacggcgatcgcttcacctacaacgagggctacaccagccgcctgttccgcgtgaagatcaactccatccagctgcgcgagagcgcggaggagagcgccaagaccaacgaccaggtgctgcaggaccggcagtaccaggtggacgccgccgtggtgcgcatcatgaagacgcggcgcacgctgtcgcacaagctgctggtgaacgagctcatggtacagctcaagttccccatcaaggcggtgagcggggaggggggtgccccttgggcacggggaagggggactgtgcagctcgcgcagcgacctgcatcgccatccctgggccgcggcgggagggacatgcagcaaataagccctcccgctcctacagtcgttacccctccctccccccctcccacagtctttttacccccgtcctaaccccaccgctgcagagcgacctgaagaagcggatcgagtcgctgatcgagcgcgagtacttggaacgcgacgtgcgtgacgctcagatctacaactacctcgcatagcgggctcgtcctcccctccccggccgtctttccctcccctctccttgttccctggctgcttaggctgtgagtatgcttacgacacctttcaaggttctcagcacgggaaggagggagcaaagggggaaagcgcagaacgcagcaatgaagcaaatagacaggggggaggctggggcgacgggagcatggacaggggcgaccgccttgggctcgctcaagcgccgactccctggaccccaccgaccaacaccgctgctcagtcgacctcctcgatcttggggcctgggccggtgccctcgggggcgccggggccggcgggggcgccgcctgcgggggcgccgccggccgcgtacagcttggagatgatggggctgcacacgccctccagctcctcgcgctggtgggagatctcctcctcctcggccagctggttgtggtccagccactcgatggccttgtcgatggcggcctccatggcggccttgtcgctggcctccagcttctcggccacagacccctccttcagcgtgttgcgcatggagtacgcgtagttctccagcccgttgcgcgcctccnnnnnnnnnntttctcggccaccgagccctccttgagcgtgttgcgcatggagtaggcgtagttctccagcccgttgcgcgcctccaccttcttggagtgcgcctcgtcctcgcccttgtacttctccgcctcctgcaccatgcgctcgatctcctccttggacaggcgccccttgtcgttggtgatggtgatcttgttcttgatccccgtcgtcttgtcctccgcgctgacgttcaggatgccgttggcgtccacgtcaaaggtgacggtgatctggggcacgccgcgcggcgcgggagggatgcccgtcagctcgaacttgcccagcaggttgttgtccttggtgcgcgtgcgctcaccctcgtacacctgaatcagcacgccgggctggttgtcagagtaggtggagaacacctgctccttcttggtggggatggtggtgttgcgcgcgatcagcgtcgtcatcacgccgcctgcggtctccaggcccagggagagggggatgacgtccaggagcagcaggtcctgcaccttctcatgcgtctcgccgttcaggatggccgcctgcaagtgagtaggaacgagtgggggggatttgggagtcaggatgtagggttggaagttgcaggcaaagggtacacaagaaggatcgatgtgtggagtccagcagatcaagcccaggaccgtgcagacttggatccccacccccctgcacacctggacggnnnnnnnnnngcaagaaggatcgatgtgtcgagtccagcagatcaagcccaggaccgggcagactcggatccccacccccctgcacacctggacggcggcgccgtaggcgacggcctcgtcggggttgatgctcttgcacagctccttgccgttgaaaaagtcctggagcagggtctggaccttggggatacgggtggagccgccgaccagcaccacctcgtggatctggcccttgtccatcttggcgtcgcggatgaccttctccaccgggtccatgcacttgcggaacaggtccatgttcagctcctcgaagcgggcgcgggtgatggcggagtagaagtcgatgccctcgtacagggagtcgatctcgatggaggcctgggtggaggaggagagctggcgcttggcgcgctcgcaggcagtgcgcaggcggcgcagcgcgcgcgggttgccgctgatgtccttcttgttcttgcgcttgaactcctggacgaagaagctgaccagacggttgtcaaagtcctcgccgcccaggtgggtgtcgcccgcggtggccttcacctcgaagatgccctcctcgatcgtcagcagggacacatcaaaggtgccgccgcccaggtcaaagatgagcacgttctgctcgccggtggtggcgtgcttcttgtccaggccgtacgcaatggcggcggcggtgggctcgttgatgatgcgcatgacgtccaggcccgcaatcacgccggcgtccttggtcgcctggcgctgggagtcgttgaagtaggcgggcacggtgaccaccgccttcttcacctccttgtcggcgcccacaaaggactgggccacctccttcatcttcaccagcaccatggaggagatctcctcgggggcaaaggtcttggtctcgcccttgtactcgactgcatagaagggagggagggaggtgggtggtgaatggaccgaaggcaggaggtggcggcgtgttggcgcactgtcagtgcgagacgacaggtggcatgtagacaggatcgcgcaacaaccatggttgttgatgcatgccatgcactcacagcatgccaccaaagagccttcaccacaggggaacccccccttctttcctcacgacataactcaccctggatcatgggcttctcgccagcaccagacacgaccttgaagggccagtgggagatgtcgtgctggatgttgccgtcgttgaacttgcggccgatcaggcgcttggcatcgaacacagtgttgatggggttcatggcgacctggttcttggcggcatcgccgatcaggcgctccgtgtcagtgaaggccacgtacgagggcgtggtacggttaccctgctcgttctgtaagatacggggagagaaggggggggacgttgagtggatcaagtctggcatgctggattaccatagaaggctccagaaatcccagcnnnnnnnnnnggtgaaggccacatacgagggggtggtacggttaccctgctcgttctggaagatacggggagagaaggggggaggcgttgagttgatcaagtctggcatgctgaattaccatagaaggctccagaaatcccagccgccacagcctggcccatgctgcactggctctcctcctaacgcgaagggatcactcacggggatgatctccacacggtcatgctgcctgcgaagagaagggagaaggcgaccatgaggaaatggaacgaagcaagggtcgctggtcagggagcgaggtgcagcggcgggaggatcggcaaagtaagtattactcaccagatgccgacgcaggagtaggttgtgcccaggtcactgcaggagtgttgaggagaggctatgtcagcatacgaggagaagtaacacgatgcaaagcgggtggccgtcagtgcaggcaggggacttacatgccgatggcaggtccgttcgacatgtttgcgatgtgtgattgaaaataggggtattactgagggtacgcagaagagttaattgtgtgcagaatggtgcccaggacgtgctcgagcgaggttgtcaaccccagcgaacagaagcttccatcgaccagcgcagggggagtcgccggggcgcaggcacttgtccccggagaatttgacctggagcctgctgggtctttctagactcgggggccagcgtcgggagccaaccttggtgctgtatcgcgctgagagctttgggcgagtattcttgttctgatcccatcgatcgctgcatgcgggcttttggtgctcatgggtcggacgaagtgcatgagtgggtcgagctgcatggcgttgtttccctctccaggccgacccaacattggacgatgggcatacaacattcttttcatcaggacgagtgtcacccaccctccatgatccaattccatgcattggattgaggtttacctgannnnnnnnnntggccgacccaacattggacgatgggcatataacattcttttcatcaggacgagtgtcatccaccctccatgatcccattccatgcattggattgaggtttacctgacattggatgctatcctgggcgtcagctcacaggtggttgcaggggggacatgggaacgggggaggcccaggcacgagcagggcacgcaggcaagtggaggtcaaggctgtcgacgggcccgccccgtcccaggaccccnnnnnnnnnngtcacaggtggttgcaggggaggcatggggacgggggagtcccaggcacgagtagggcaagcaggcaagtggaggtcaaggccgtcgacgggcccgccccgtcccaggacccccccgggcccccacgccgcggccatcactcctcggtcagcaggtgctgaatgaagcggatgcgccgcatgccgatggcggccaggttctcggcggcggcgcccaggccccgcgccgcggcgtcgcccaacccgccccccgccgcatgcatctcgcggggcaggggcgggaacatgacctccgccagcaccaccgccagcgcggcgggggccaggccgttgcgctccgcgcggcgcggtgccagcgcggcgcgcagcagtcccagcacgcgctcgaacagctccagccgcggcccgctcagggagccgcgcacgacgcccatggccgtggcggcctggcgggttgagcaatgggggggaaaggggttccttgggtcgggaaagcacgtgcgagccagaatgcacaagaggggtgtccagctcccgcgcccaggccccccccaggcgccccatgccctgcacgcacnnnnnnnnnntggggtgtgcagctcccgcgccctggccccccaggcgccccatgccctgcacgcacgcacgccgccccagcatgcgcacggtggtgtgggacgcgacgtcgcacagcgccttggcgccctccggcagcaccggctccggcagcgccgccagcgcggccagcagtgcggcggccaggtcgcacgggcccacgccgcgtggccaggccgccgcgccgcggtccagcgcctcgcggatggccgccaagggctcggggtcggccgtccccggggccagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgtccaccatgaagaggccgggggtgcccagcgcctcctcctcctccagcgcctcgatcaggcgcgccagctccagcgggacgccgggcgtgcgctcgggcggggggccgctgccgctccccgccgccgcggcgcccgcgtgcgctgcacctgagctctcggcctccgagtccccggcctctgcgccctcgtccccggcctctgcgccctcgtcccctgcggccccgtcctcggaacccgttcccacatcttcgcctgcctgccacagcttggacatggggtaggggccccgctccgccagggtgcggggccgaaggcccatccaggagggccggtaggcgccgcccacggccaaaaacatgtcgttcccgcgcgcgacgcgcagcaccagcaccgcatccagcgagcaggcccgggaggagagcagggcgtccgcgcagccgcctggcccaccagacacctgcgcgcgcagcgtgacggtgcggcggccgccggctggaacagagccctgcagcagcgcgtgtgggagggagggggggatcctcaggtacgcacgtcccctccagacaagcgcagagatgatcggaacccgcgcatgaggaccaaggtaagggccgcaggcgcacctgggagggcacgannnnnnnnnntgtgtgggaggggaggggggatcctcaggtacgcacgtccccttcagacaagcgtagagacgatcagaacccgcgcatgaggagcaaggtgagggccgcaggcgcacctgggagggcacgacctccagccaggggcagctctggccgccgggcgtagggaccacctggaaaatggctggggcctggccctcgttccgcagcgtcagctccacttcctggggcatttgaagtcgagggggagtgcgtgttcctttgtgcagggaaaacgggtggcagcagcaatcctgcaccgccgacagcgatgcaccgatccctgagtaccatggtcaaccaccattgacctcgagaagcatcacaccttggcctcattgtagcccaggacccccaggtccacggacgtcggcgacagctggcagtgcggcgtggccgccatctccttggcgtccaccagccgccgcgcgacgtcgatcgctgcctcaatctgtgaagagggcgagggtcgttcaacagtatgggtaagggtttgaggtgggaggctcctggggaccgggtctccgacacatcccaccaagcctaccgggccctcgcgnnnnnnnnnnaagggttgtttaaacagtatgggtaagggtttgagttgggaggctcctggggaccgggtatccgatacatcccaccaagcctaccgggccctcgcggacacagggaggcccccctgttcctgccttctataagcgcacgcacctcgtgccgcagatactcgtgagcgacgaggaggtaggcggcgctgacgggcctgtggtctgacagctggatgccctgcgccgacctatcggtggggaggggaggaataccgttggggcacctcatcacgtcgtgtctcccagggctggcgtccattattttnnnnnnnnnncgggaggggaggaatgtcgttggggcacctcatcacgctgtgtctcccagggctggcgtccattattttcattggcgccgctccaccgccgcccctccccccccccatattaaatctagagtgcagtccaccctccagatacagtgcctcacatgtaagctgtctgcttgatgaggtgcggggtctggctcttgaacaggatgcgatccgtccaggccggcgctcgtggcctctccggtggggtcccagccttgccagcctggggtgaggagcgcacaggggatggtctggccgcagcacagttggatgattggttctgaaggagatctgcacggcccaggatgctatgcatgcttgcaaaggcgcccacttcactgcggtgcagtggcaccggagtggacatcgagggcacgaccagctcaacacatcacccctcccttcagcccattcctcaagcccaccccccccaaaataatcagccctgcacctcgttgagaggggggacggaagccacaccctcctctgctgccctgcttgccaggtttgctgccgtgnnnnnnnnnnacccagggtgctatgcatgcttgcaaaggcacccacttcactgctgtgcagtggcaccggagtggacatcgagggcacggccagctcaacacacaacccctcccttcagcccgatcctcaagcccaaccccccccaaaataatcagccccatacctcgttgagaggggggatggaggccacaccctcctccgctgccctgcttgccaggtttgctgccgtgccgaggccagggctggcgctgccctcgccctcctgccccagatatcgcggcgacccgcgcttgaacttgaaggtcggggggaaccggatgggggcttcctgccagccggcaaaggccgcgccgctgcgcatggcatgcagcagctggtccctggccagcagggactcgagctcgcctggcgagggtgtggtggaaaggatggcgagtgaatgcaggaggaggactgagctttgttaaactttgggaaagaggatgctgtgacagccaggcacagcctcctcctcagtacagcctgagcaataccagcgcaatgtggaggtggggannnnnnnnnntagtttgggaaagaggatgttctgacaaccagccacggcctcctcctcagtacagcctaagcaataccagcgcaatgtggaggtggggacgacaatacaccgctccctgccatggccggtgaaacgagactgtcaaccccatctccctctctcacccccctttccacaaccacatacagtaagaacacaccttcagcaatggctttgaggatggtcgtgctccccgccnnnnnnnnnnatgtcaaccccatctccctctctcacctccccttccacatccacatacagtaagaacacaccttccgctatggctttgaggatggtcgtgctccccgccccacccccatgcaggcggtagttcaggtcccccatccagaagacgtgctgcgtggccatcatgtgcgacagggcgggcccccagtgcccgccccgggctgcagggcccgccacccgctgcacgtctggggtcagggacccggtggctgcgcccagggtgggcctcgcgaccgaggcggtggtggcgtcgccaaagtagccccgcctcaggatctccgcgtggtcgtagtggcgctttgcctcatcgccagggttctcgcctgtgagggcagggttcggggagcaggatgggaggtggggtccagcaaggtcgcacccttggacttcagcggcggccccagcatctcacggcttcgccaagatcgggctcgcatacagatcttgttgacccgggctggcctcggtcagccctgcgtctgtactcaaaacatccccaagggcacagcagtcggtgaccctgcacgtgcactcacccgaggnnnnnnnnnntgggctcgcacacaggtcttgttgacccgtgctggccttggtcagccctgcgtctatacctaaaacatccccaagggcacagcagacggtgaccctgcacgtgcactcacccgaggccaggtgggagctgacaaagcacacaccggtgtcgtacagccgcattcggatggccaccgcgcctgcaggggggaggggcagccacttgacttttgtctccatgggtcggcaagggcggttcagactccacagcgccnnnnnnnnnnaggggggaagccacttgacttttgtctccatggggcggcaagggcggttcagactccacagcgccaaagccgaatctggaaggaggcaggcgcccgtcctgcaccgctcagacggcaccaggcgccttcattggccgcctcccccagttcgcccgttgcgcccccttccgatggtaggtccccttccaccctgcgcgtacccttgtttcccaggtagcccatcatgcctgtcgccaccgacaggatctggatgccatgcacgtgaggcagcagggaggctcgcacccagatggagaggtagatgcccaccagctgccgcgcggcaacctggggtgggccagggaggggtcgctcgagcgctcagctgcggagcccgagctggcgacgctgcagcagcctcaccaatcccgagccggttactgtggcccgtctccctgcaatgaccagcccccaaagggaggagaagacctgaccaccaaggcatcctcatgccacccaccatcacaccacaggccagcggacctgcacaaaggcggcagggtcgccatcgatgcgcgtgtccaaggattcgtccccggactggtactcctggtcagatgtggaggaggtgccgggggagaggaaggcagggctgctcacgctcggctcgggcggggtgtactccacgccatcctctgccgcaggagacggatcggtgccgttggtgagcgcggcgctggggtccgctgccgcccagcgcgcaccagccgcgggggcggctgcgtcggcattcgcctcccggtcaagcgtgctttcgccacnnnnnnnnnntcgccagccgtgggggcggcggcgtcggcgctcgcctcccggtcaagcgtgctttcgccacnnnnnnnnnntcggccatcgtcgggcaccggtttggcccgaggtggtgagaggccagcgttcagcgtatcggccacgagggcgtcccagcgggcgacgttctcgccgctgccacccaggaccnnnnnnnnnncagattcagctgcgtctgtgagccggacatcgctaaggcgtgccgacaggtcccgcgcctgggactgcctgccctcccggccatcgtcgggcgccggtttggcccgaggtggtgagagcccagcgttcagtgtgtcggccacgagggcgtcccagcgagcgacgttctcgccgctgccacccaggaccacatttgaggcgttaagagggacgacttcctgcgggcagcggagccggagggattgtcatggcgcgatgttatggtcgggctcagccatggtttgggggctggcacggcatggccggggcgacttagtacagcacaccacatcatgacaaggcgaccttacacggcatactacaagcgaagccgattctnnnnnnnnnnggccggaggggttgccatggcgcgatgttatggtcgggctcagccctggtttgggggctggcatggcatggccggggcgactaagtacagcacaccacatcattatgacgcaacctcacacggcatactacaagcgaagccgattctcgcccattccagaggggcccgactgccaggaccggccttcgccgccaggctgcccacttgcctggaaggcgactgcaaccagatcggcatgccgacctccacccagccactcggtcaaactcagatccgtgctgggagtctgtccattcacattataggtacttgcctgcgcggatggaatgtgcattaggtggtggcaccgatcacagcactccctcctgggcccctctccccttcggcggctaaggggggaagagcttgtccatcattggcacgatatccctgcccgccgactcgcccttaccaggatcttgatctcgtggtcagcggtgtaagtctccgctggcaagcgcaggaactcgtcccgcacagcagtggaccgtgcgttgtggagaaggtccagaaggagggggtccttatggtcacgtccctcatcgctcaccctgggactaggttccatggcagcattgttcagtgacgactctgccatgcgtcaggagtcacagagagagggacgatgagttttgtgtcctccatgtgagttcaaaggccgtttctttgccccacccagatgcccatgccgtgtacagcagtatatcgaaaccctgcacagttccgtaccgctggctcgccgacgcaactgcnnnnnnnnnngccccacccagatgcccatgccgtggacagcggtatatccaaaccctgcacagctccgtaccgctggctcgccgacgcaactgctgcagctggccaactccttcattgacctgagatggcacatacaacacaaaagggatgtgatcgcgatggagaggcagcagggccccagtctcgcccagaccgcaggtttcccaaacctgactcccaaacacccctccacaaacaacacaccgctcgggatatggattgcctcatgtgtggccatgcccctctggccgtcacaccatctcgatcggatggtttctggggcctgatcacccgagcgcagtgctcgagggtggggagggagggtaccgtcgtgtgagggtacccctggggaaggcacagtctttactcgcccacgatcgatacatgaggctaattggccggaacctcctgggctcgactggtcgcttggtgccgccatcattggatctctggcgaataatcacacactctcatctgcctgagtgttctgcatcgaagctcgagttcgaggaggggtggtctcaccctccatcccggccagtccgggtcttttccgcggcgagggcaggtctctgctccccgcgtcctccaaaatggcatcatccaccgctgcgaccagcaaaaacctggacgcctggctggagaaggttcagaaagcccaataccttgcagaggaggagctcaagtctctttgcgacacggttaaggaaatcctggtggaggagtccaatgtgcagcctgtgaacacccccgtcacggtcagtgtgtctcctaggtttggcgtatggcttgcgcagggctgtgggaggctggaggatcccaccatgtgtgtatgtgcaagggggagggggggccagcaccctgtggtgaaggtggcctggagtctgccaaccacgcagctccctggtgatcttctctgcccagcgcgatggcatgcctaccaaacaactgctgcccaataggtgtgcggcgacatccatggccagctgcacgacctgctgaagctgtttgagacggggggccaggtccccgccaccaactacatcttcatgggcgattttgtggaccgcggctacaactccctggaggtcttcacgctgctcatgctgctcaaggcgcgctggcccgcccacgtcaccctgctgcgggggaaccacgagtcgcggcagatcacccaagtgtgagttgctgcggggcggctggtcctgggcctgacctgggtgccaccatgggtctggctggagggctggggcggtgggcaggggatcagaacgtgtgctccagacggtgccccatctgaggacgctgccccccgacacccatgcctgcaggtacggcttctatgacgaatgccaaagaaagtacgggaacgccaatgcctggcggtactgcacggaggtctttgacttcctgacgctgtcggtgggtgaccgagggagggctcatcaggggagggcccgggagctgtgggcccgggacaagctctccccatgttctgttcttttgaccatgtatggtgggccttctcatcctgtggatctgccagcatggaagtatcagccgcaccgtcgggctgcgtggcccagtccattgctgacgtcctgtaccttccctgcctggggtgacgcacatgtgatgccaagactcccattcttcccctctcgccctttggccatgcctcttccagcgaccccccccttgctccgtctgccacacccgcaggccatcatcgacgggcgtgtgctgtgtgtgcacgccggcctctcgcccgacatccgcacgcttgaccaggtacgcgtcatcgacagggtgtgtgaaatcccgcacgaggggcccttctgcgacctgatgtggtcagaccctgaggacatcgacacatgggctgtgtcccccagaggggcaggtgtgcagggcatttagttcgtttttgggggggggggaggggggagatcgtggggtttgttgagggcctgtgatgggcggttttgctcccattctgtgaggggcaaggggggggtgtggggaggccttgtaggccgtggccaagctgggtgcccatgtcctatggatggcgccaccgcagttgtgcaccccggtgcctaggagtatgcagcacagtctgccgcccctacannnnnnnnnntttgtcgagggcctgtgatgggcggggctgctcccattctgtgaggggcaagggggatgtgtggggaggccttgtaggccgtggtcacgctgggtgcccatgtcctatggatggcgccnnnnnnnnnnccaccccctcccttgaccctgcaggctggctctttggcggcaaggtcacctctgaattcaaccagatcaatggtttggagctcatctgccgcgcgcatcaactggtccaggtgcgaaaccagggctcgagcatcttggctggcctgttggcttggtaatgggtcgaggcctcgatgggaaggtcccagccctcgtgctaggtttgctaggatgcagccgagttcgttgactatgtggccgggagtgcaagccagagttctgggcctccgcagtccctgtggccaggcggcatgcatcttgcctgcatgccaccccacctgcccccttgctcaaacctctgcacaggagggactcaagtacatgttcaatgacaagtcgctggtcactgtgtggtccgcgcccaactactgctaccgctgcgggaatgtggccagcatcctctcctttgatgaaaatctggagagggtggtcaagtatttcacggaaacggaggagaacagctccatgatggccccccgggccgcggtgccctactttctgtaaaagggggagcattcactccctgtaggggagcaccaggggagacgcaaaatgagagcagaggtgccatgcagaagccacatacatacctattgggcttgcactggctgccaannnnnnnnnntactccctgtaggggagctccaggggagacgcaaaatgagagcagagatgccatgcagaagccacatgcatacctattgggcttgcactggctgtcaaggtatttccaatgatgtgcccttctgcgcacttggaacccaaagacctatctgggggggtaaggacaacgggtaaaaggagagggaagccagggcaaggggccgccgaagactgtgggacgcaatatgacagtcaaagaaacatgtgccaacatcatggtattgactactccagtcacgatgcgttttgcagcggagacgttggagtccctgtttgcccactgattggtccaccaatgcaacactgagcttctcnnnnnnnnnnaatttgccaacatcatgatatcgactgctccagtcacgttgcgttttgcagcggagacattgcagtccctgtttgcccactgcttggtccaccaatgcaacactgagcttctcaacacccttgctgacctaccagtttttgtgggcatgcagggcggtgtgattgccacagcacaaatttggcatgttgtgctcgtttagcaccgcgaccctgcccgccctccgcaggcggcgcaggaaccnnnnnnnnnntacaaatttggcgtcttgtgctcgtctagcaccgcgaccttgcccgccctccgcaggcggcgcagggacctcatgcatgggaccggcggctgtctccacatgaccggctcccgatcctgtgccgnnnnnnnnnncttgaatcgcattgattgctcgctgccggggggcatgagtttgcaagagcagcttatggaaaggcttccatatcgctcactcctgctcgaccacaatggcagccaatgcgctcgtctcagctgagctgcaaccgggcattgtggaggatgcagcacagtaaactatgctgatcgaagaacttgactgtcatattaatgcggcctgtcgcctactccaggaagtgacggtggtgccgaaggttcggcggctgggggttgctgtactgactggcgagcgaggtgcgtgctgccacggagtgcatgttgcagccgggggccggttcgaagtacgctgttgtaaatcgagtctggggtcatctgtttcatccctcaaattaccatcctgtgctggaggactcgaaacgtccccgcaaattggggttccggtgacgagccgacccgcggctgacatagctgccaatcaggcggcgatcgatgccgcggtcaacaattagcctcaggagccaatgactggtatgaaggatttggtcccataaggaggcgaaggaggtgtttacgtgcatcgtaatcattacgaatgccttcgcggcctcccaattcctccgattggcgtgtgctcaaagcacccactgctgtcccccatacaggatatcgtctacaccatgannnnnnnnnncgtcatctgtttcatccctcaaatcaccatcctgtgctggaggaccctgaaaggtccccgcaaatttgggttccggtaacgagccgacccgcggctgacatagctgccaatcaggcggcgatcgatgccgcggtcaacaattagcctcaggagccaaagactggtatgaagaatttggtcccataaggaggcaaaggaggtgtttacgtgcatcgtaaccactacgaatgccttcgcggcctcccaattcctccgattgccgtgtgttctaagcacccactgcggccccccatacaggatatcgtctacaccatgaaggtcgtcatgatcttcagcagctcttggctcaactccacgtcatcaaaacgatgaaggggttctggacaatgaaggaatctgttcacgagccgctgaaaaaccatgctgtagacgatgtactgtatagcagccctcagcgagcccatggcgccctctcatttcgagagaatttgtaggccgcgatggaaatcgtcgtggttaggatgcacgtaaacacctcgcccaccaccttggacagtccgtactagcctttcttgtcnnnnnnnnnnattcacgagccgctgaagaacaatgaggtagacgatgtactgtatggtagccctcagcgggcccatggagccctctcattcggagggaactgggaggccgcgaaggaaatcgtcatggttaggatgcacgtatacacctcgcccaccaacttggacagtccgtactagcctttcttgtaggccagcttcctctcgttggactcgttgaccccgccaccactttctgcctgtgaggcagctacgtcagccgcggtgggctcatttcgggcagcccattccatgggagacgattcaaagttctggggtaatggactaccaggaccaggggtgagacataagacccggatctcgactgcaatggcggactcgagcactagcccaagagtattggcggaacacacaagctccgggctggccaggnnnnnnnnnnagactaccaggaccagggttgagacataagacccggacctcgactgcaacggcggactcgagcacgggcccaagagtatatgcggaacacacaagctccgggctggccaggcaccataaaaacatgtccatcaagtcgcaataccagtttcacccgacacgcaggagcaatgcctattgaggtcgatacaccgcgataggggtcgttcatcgccttatctcctgaatctgagcacttctggctacatgccacacgctgcaacccacagtacgactgtccctccctcgaggatgctgcatgaggtacgcggcaatttatggtgagctgtagcctcaccttccagacagtgttcatatgatccacgacgctgccattcaaccacgctaacagccgagtgcccaaggctatacagaggaaatgcctggatcccggctctcagccctaccaaggcacacctcaaatccagctgtgcaagccgtgcacaccttcgtcaatggtgagcaacagcctgtgccaaacaagctcgctgtcagtacgctcgatcgtatcccaccgcgcttccatccccgtgaagcatatgaagccgtggcagcgcttgatctctgctgggaggctgggcgcaaacccaagggtgatagtacacagtttgattctagctcttctgtgactgctggagtgattgatttgaatgcatgtcccagctcttatatttacaaagaatctattgggtacagcaaatgttgctacgtttggaagtatcagcatttgctttcaaccttccttcggctcgttcttttataattctcactctgtcacgtatttcttgcttacgttgtcttgtcgcctcgcagtctgtatatgttgnnnnnnnnnntgaagtattagcatttgctcttaaccttgcttcggctcgttctttcaaaactctcactctttcatatatttcttgcttacgtcgtcttgtcgcctcgcagtctgtatatgttgtgattctgttgtactcttggatgagtctatcaagttcatcactgtcagcctgaggttggttgtccaccctcacaaaaggcgacgaggcaccgtaggcaaacatactcttcttgtatatgatatgaagtgtttatcaaggccctcaaaatcaaacggtctggctcatcctgtcagatggnnnnnnnnnnctcaacttcatccctgtcagcctgagattggctgttcaccctcacaaaggacgacgaggcaccataggcaaacatactccttctgtatatgatatgaagtgtctatcaaggccctcaaagtcaaacggtctggctcatcctgtcagatggaatggggaggggtcctggtgacattcgatgagggtctcttgacgatggtccggccaaaggatgccgggcagcctgttgcctgaacaccagtgcagtcattgtaacctgagcaggatcaccccacctagccccccaacccggacctgtctacccagaaacgctgcggtttgtccttcaagcgcatgctgggactcaccaaaacgttggatggggctgggatggccgatggcggtcgggtggggatgcggaaacattcaaagggtggagggagcgcagacgggcagatgttggtcgagacaacagctgaaattggcgattgctttgttcagcacgggaaagctcgtaaacgataaacgtgctgtcaaatctcggtttcgcggtcttaggtcttctccgtgagggggccgtgcgccctgggtcgtcaggaatggctatgcnnnnnnnnnngtgcggaaaccttcaaagggtggagggagcgcagacgggcaaatgttggtcgagaccacagctgaaattagggattgctttgttcagcacgggaaagctcgtaaacgataaatgtgctgtagaatctcggtttcgcggtcttaggtcttctcagtgagggggccatgcgccctgggtcgtcaggaatggctatgctgctgcctctgctttgctccgagtgccatccggtcacaggctgtcagtctcgacccgatgtcaataccgccttttcttgctggacgttacgactgccgtacttggacaacctgcgcacacctgccatgtagggtgtgatttaaagaggagtacaaggggtgggaggaggtgagggagaatgtccgggctacgaagtaatcgctgaaatactttggtgcagtgtacatcacccagataatttcatgtctaatataatcagtcttatggcggccttttgtgctacacctgaccaacagcggtgatctggccatcacgagggccaggaggaacatgtctgctcgctgcaagtcagatgcagcgatcccgacagcagacaatgcggccccgcacaacaaacccctcgtctgatcagtgtggcaggtgcaatccctgtaccgactcaggtttgagccctacaggctgaccccgagtggtgggcatttgttcctgccaggatttatgcatgcatcagctatgcatgcatgggcatcaagatcaagcatacaatgcacccagatgatgtccaacaccaattgcaatgnnnnnnnnnnttacaggctgaccccaagtggtgggggtttgtccatgccaggatctatgcatgcatcagctgtgcaagcatggcatcaagatcaagcatacaatgcgcccagatgatgtccaacaccaattgcaatgcttcttggggttcataccttgctccattaagggtggcctcaacagcaggtgagcagctgtgcacgaggacagggaggctgccgtatgcagaggtgagctttgcgactcacacagaagctcagttcagctgtcggtgtcgccgagtcactccaacacttgtcgttgccttcgagctgccgcatcaatcaaggagttgcatacagacacagcactcattgcagcatccgagtccaccaccggcaggaggcatggcaagggggtcagtgtcagatgcgccaccttgatacctctcatgacctggcattgacatacacacacctacggagctgcgtcgtaacagcacattcgtggaagaggatagatgccgtcctggctgatcctcatcgctcagtctcctctatggctcccagctgatggctcatagatgctgggcgaagtgtcaacatttcaacgggtgcctgagagtcaatgcgcatgctccactttgtagcatgcattcactcactatgcctcagggatcgcttatcaatgcctctgtgcatgcggatgctggacccaaatctcattgtatttgtgccgtgcacaaccgccaaaggcgtcaggcataggtgctcgttattcaggcgcggtgcaatgccagcctgatctgtgaagactgcttctacgatgaaaagtgggtaaagactaccaggtttctattcctgtctttggtatacaagtgtcaagcacgactgctcaaggtcatcctgggcggcacacggcaaggtaagagggtccaaatgtgcagataagcagtgtgggataccccacttcagtgcacacactagaggcagtcgatttgtagggacgtgtccactccgatacgtcggatggaagtgttgaggtaaagacggcagtagggacatcattccttgagcaaatagttgtgtaaacttgcgcagcgcaagtggatttggccaccacgggtgcacctaaacattcatccgatgggggtgggggtggcggaggaggggattgtggagggctgggaggaggcgatggtggtggagggctgggtggtcgggat

SEQ ID NO: 40648 - DNA, 70 bp, Chlorella protothecoides
agcgagcgcccccgggctgcagaaggaggaaagggcgcttgaggcacggagcgctcagcaggacgagctg

SEQ ID NO: 40649 - DNA, 61 bp, Chlorella protothecoides
catcttctgtgacagcggtgcgtgtggcggtgcgcatcgcatccatcacttgggctcctcg

SEQ ID NO: 40650 - DNA, 79 bp, Chlorella protothecoides
tgcgacctgccgtcccttcccacacgcttccactccatccttgcccgcgtccctgcagcgtgtcacccatgggcgctcc

SEQ ID NO: 40651 - DNA, 16520 bp, Chlorella protothecoides
  modified_base (489)..(498): a, c, t, g, unknown or other
  modified_base (814)..(823): a, c, t, g, unknown or other
  modified_base (1265)..(1274): a, c, t, g, unknown or other
  modified_base (1840)..(1849): a, c, t, g, unknown or other
  modified_base (2446)..(2455): a, c, t, g, unknown or other
  modified_base (2946)..(2955): a, c, t, g, unknown or other
  modified_base (3687)..(3696): a, c, t, g, unknown or other
  modified_base (3936)..(3977): a, c, t, g, unknown or other
  modified_base (4623)..(4632): a, c, t, g, unknown or other
  modified_base (4968)..(4977): a, c, t, g, unknown or other
  modified_base (5299)..(5308): a, c, t, g, unknown or other
  modified_base (5723)..(5732): a, c, t, g, unknown or other
  modified_base (6377)..(6386): a, c, t, g, unknown or other
  modified_base (7071)..(7080): a, c, t, g, unknown or other
  modified_base (7694)..(7703): a, c, t, g, unknown or other
  modified_base (8424)..(8433): a, c, t, g, unknown or other
  modified_base (9395)..(9404): a, c, t, g, unknown or other
  modified_base (10633)..(10642): a, c, t, g, unknown or other
  modified_base (11762)..(11771): a, c, t, g, unknown or other
  modified_base (11965)..(11974): a, c, t, g, unknown or other
  modified_base (12947)..(12956): a, c, t, g, unknown or other
  modified_base (13493)..(13502): a, c, t, g, unknown or other
  modified_base (14133)..(14142): a, c, t, g, unknown or other
  modified_base (14582)..(14591): a, c, t, g, unknown or other
  modified_base (14997)..(15006): a, c, t, g, unknown or other
  modified_base (15242)..(15251): a, c, t, g, unknown or other
  modified_base (15668)..(15677): a, c, t, g, unknown or other
  modified_base (15858)..(15867): a, c, t, g, unknown or other
  modified_base (16399)..(16408): a, c, t, g, unknown or other
cgggggagggcgagctccccgtctgcgccgcctcgggccgctgcctggcctgctgggaggagggcgggggcgacggcgaggtgggcgcggccgaggcggcggccgccgcgctcgcagggcgctgggccgacgccgggtcggccgaggactggaacgcggaggaggggatgggcgggcgcctgggccgcgctttcttcgcgggctacaacgccgccaacgcggacgagctcatgctgcggttcggggtccggctgtgagggctggctagaacatccgtgatccccgtgtccagacagatggcaggggcgcccccagttttgtgcagtgactcggccatgcgcccctcctgagcgttcctccgccttgcacccttccaccatgctcctggcatccccatcgtgtgccgttctcgccacagggccttcacctccctgtacacgagctccgctcacttgatcgggtccggagcgccagctctgccccttggcnnnnnnnnnngctccctgtacacgagctctgctcacttgatggggtccggagcgccagctctgccccttggcaggaggctcggcaaacacaccctgttgaagtcgtacatgactcgtgagcgccccactaccctcgaatgaggaattcacgagctgggtcacagggtgccatggagttggacatttgggctgagcagcgacagagctggctgatgctggtgtcattgggatcaacagattcagcacacgtgtgaaagcatgcgtggcaggtcacatacggggcccgctggctcaggcgctcccactccggagcccacagtcggatnnnnnnnnnnggattcagcacccgtgtgaaagcatgcgtggcaggtcacatatggggcccgctgggtcatgcgctcccactccggagcccacagtcggattcgtgccgcaaccgcgcgccgcccaggcccctgcgcgcgccgcaccgccgctcaggcggggccgggcccgggcgctcgccggcgcgttcggtcctccacctcccgcacgaagcggcgcagcaccaggttcagcccccccgccgccctccagaagttgtacagggccttggcggcccagatgcccaccaggctgggccagacccagagctccagggccaaggccggagcaaagaccagcacaaagcccagggccatgtagtcgcggacgtacgcgaaattgtgggaggcgtacatcaacttagttgttttggggggaaggcaaggggggtgagggttggagcaggggacgacnnnnnnnnnnctagttattttggggggaaaggcgaggggggtgagggttggagcaggggacgacatgcctgccggcatccatgcccagcacgagcgggtggggaagggtgaagcgccacaacacacgcgcgtcgcatggcactcctttcactcctgcccagggtgccaaggtatcaccccgcctgcatccacaactgcctcacccgtccagaacaaagaccaggccgttgcagggctgcatggcggccaccaggatccaggtgctgccccccagcagggctgcgacctccgcatccccggtgaacaggcggatgaggggccggtggaagaggaggtacgtcgcccccgtggccgccccaaaggcggtccccgccatgcagcagcggcggatgagccggcgcagcgacctgcgggggcggggaggggggatgtgggggaaaggggtgggttgggggaaaggggaaatgatggtggcctgcatggcggggcgtgcccactccgcctactccgtctgcacccaccacaccctcaggcccgagcacatgcgcagtgggcaacaccccgcgccacccagcnnnnnnnnnncgcccactccgcgtcctccgactgcactcaccacgccctcaggcctgagcacatacgcagtgggcaacaccccgcgccacccagctcccccgccacccacttgagcgcggcgtcgcccccttggtcggagtcgtctgcggcgcccgccaggcgtgaccccagcacgatgcccgcggcggcgaagccgtccacggcgtaggcgctgagcatccagagctgggcgacgacggagtgcgctgccagggcggcggtgccgagccgcgaggcggcgaccagggctgcgaagaaggtggcctgcagcgtgatggagcgcagcagcatgttgacgccgtcgtccaggaacgcgcgggacgctgatgcgggggcggtgggcggttgctggtggttggcgggggagggcgcgctggcgtgggcgtctgtgccgtctgcggcagcgtcgggcgggagcgtgcccgatccgcctgcgtccgacaacagcggtggcgcggtgctggcggggaggaagtcggcgcaggcgggccaaagcgcgggctcgtcttcccccgcctcctcctccagcagcggccgtcgtggcccggtctcccccgcccaggcccnnnnnnnnnntgaaccgcctgcgtccgacaccagcagtggcgcggtgctggcggggaggaagtcggcgcaggggggccgaagcgcgggctcatcttcccccgcctcctcctccaacagcggctgtcgtggcccggtctcccccgcccaggccccgcgcaggctgccgtgctggtgcggcagcgcagcgtgcacagcgatgaggcaggcgaccagctgcgcggcctgggtcagcagcgaggcccagcccatggagaccagggcgccggcgcccaggaagcgcaccccgcccagcaggacagcggcgctgaggcacgactccgccaccgcctggcccgtgttcagcgccgcgcagagtgtcacgcggtgcaggccctggattagggttggaaagaggagggtttggggggggtggagaggaagggagagtgccttgggagtgcaccggagagaggagcggggtggattgagccgggcaggcaacttggtggtcgtgggtgtgnnnnnnnnnngcgcctggcccgtgttcagcgccgcgcagagcgtcacgcggtgcaggccctggattagggtttcgaaagaggagggtttggggggggtggaggaggaagggagagtgccttgggagtgcatcggagtgaggagcggggtggattgaggcgggcaggcaacttggtggtcgtgggtgtggagaggccgcggggtgcaggggctgggagaagtcgtgtctccacacgtccctccctcacggcagttggcgaccagcaacacctggccactgctcccacccgcaccccagcccacccaatcacaccacccgccgcttcacctcctgacgtcccccgccatccaccagtttgaccgaacccttggaccccgccctcccacctgcaggacgcccgtgcaggccatgttggtcatggccaggggcactgcggcggcgcgcaccgtccagtaggcagccacgacggccagcacccgtggctccagatccaggacgtggtggatgaccaggggtttgagcaggagcaggacgcaggccgccgccgtgcccaaggacgccgaccttagggttaggttttggagtgggacagggtggggtcgcggggtggagggcagtgcggtgggttgtcgctgtggattggcttggcatggtgcggaaacatgggacccacatcactgctggtgcacggtgcctgcctctgagcatggctgctgacccccaatcgctcaccagagaaggnnnnnnnnnnagattggcttggcatggtgcgaaaacatgggacccacatcactgttggtgcgcggcccctgccgctgagcatggatgctgacccccaatcgctcaccagagaagggacaagaggacggtgacgaagaggccgtgccagtctttttggcccaccaggtttcccacctgctccaagatttggaaggatgtgtgtgaattcgatcgcatggccatgcccttcagccaacgccaggtggcaaannnnnnnnnnnnnnnnnnnnnnnnnnnnnnnnnnnnnnnnnnctctgggcatgcaacctgtggcgcatgcgaggccccatccacgatacctactttggcagagacgccgtcaccgaaaaatacaaagatcttgagggcaaaggtcgcactggtgttcacagccgcatatgctgcaagggcaggggacccatacaggcccagccaggcagtctggagggtgctggtgagcggtgcggccactgtgcatgggtgtatgggggttgcgtcatccttggaggagctggccagcaggctgggaagttccagaatgagtgcaggccaggacacacccccaagaaagcacctagacgtggctcacagctctggatgaccgcgggggcagcgacacccaggatcgaagcccaagagctgtactctggtactgagtcgtccatgtctccagggcaagcgccgccctgccgattgtacgccgagccggtgtgcaggagtccggagggcacctgtcaccgaccgcagtacagggaccgaggtctcatcatgacattctcaggagtcgcaagttgatgaaaagtcgatcttatatatctaaactgacattgaagcgccccagtacggtgataggaagcgtcccatcagaatcgctcctctgtcgacgagggacagccgtcgcgccctggaaacacctccnnnnnnnnnnccgccccagtacggtgatgggaagcgtcccatcagaatcgcccctctgtcgacgaaggacagccgtcgcgccctggaaacacctccgtgcctaatggcccccaacatgcatgcattgcgcgctgcatacttcgattcacaatttgagctcgaaagttcacatatgtaacacggagtagtatttggcggtttgcctttaatgggcattcgcgaggcgttcgagtagggttgaagcgtactgaagaaccactgtcgcaatccggctagagatccaaaacgaagtgacaaccaagtcgggcaatcaaacggggccgcggcgtgttccccaggatggcannnnnnnnnnagctagatatccaaaacgaagtgacaaccaagtcggacaatcaagcggggccgcggcgtgttccccaggatggcagcgcccgaagctcctggcgtagggcctccggcacaggacgaaagcataattcgcgaggggtcccgcatcattctggacgtgaatggtgatcgccacgtcttcgtcgtggtcaaaggacggaagtacgttgtcatggaggaagaaggggatggagggggtgcgcatgctgtcggaatgcacgaccatctcacaagtgttgatggggctgggccatgtagtggtctgtgcctgcaacagctgccatggnnnnnnnnnnttcacaagtgttgatgggggctgggccgtgcagtggtctgtgcctgcaacagctgccatggccaggggtcctcccctcacaggccacatccctggtccacctcccttgcagcaaggtgaagcttgggcaagccttctgctccatccagcccctcattgggtgcccctacggctcaacctttggcgtggcccccgatgggaagacgctgcagcagatcccaccgtgcgtcctgggtttggactgtgtcgcgcatggggttgggcgaggagcagtgctgcttgcaggagggttgggttgggccctccatctctgctgtggccccccatgtctccaggaaccctggagctggcctgcttccggacccctacacccccctttcctccctgcgtgcacagcgccgtcgcggctgactggnnnnnnnnnntccatatctccaggaacccttgagctggcctgcttccggacccctatacccgcctttcctctttgcgtgcacagcgccgtcgcggctgactggctggaggaggcggcgctggaggtgacaaagaacaacagccggctgatcgacgcaggggacgccaaccagcaggtgggagtgctgagcatggcgcagcgtgcacagcaggggccctggcccctggccgtccgcggcctgtggccgcgccatggttctcagggatccctccccagcgcacccagcagcccctccccgtgcttccctcccgcgaacagctcaccagtgagaggatcgcggacctgcggtcccagggggtccatggctcggccatcgtggaggccctggcggcccacagcgccacctttgacgccaagaccgagttctcgcaggccaagtacaggtgagtggccggtggttgggggacgcgagagggggggagggggtccgcctctgcacaggtgcccttggcatcggacggggccttctgctgccatgcgacgatcggcgcgcaggctccctgccggcattgcctacgtgcccacctccccccgccatggggcgcgtcggcgccatcggacccagtgcacgacgcacatgcagcaccacagcccnnnnnnnnnnagggggactcgagaggggggaagggggtccgcctctgcacaggtgccgctggcatcggacggggccctctgctgccctgggacgatcggcgcgcaggctccctgccggcattgcccacgtgcccacctcccccccgccgtggggcgcgtcggcgccatcggacccggtgcacgacgcacatgcagcaccacagcccacggcgcccccacctccccacgcgcccatggcaggaagaagaaggccaagaagtacgtgatcacggcggtggcgcggcgcgccaccgccgccgccatcgcggaggcctacttcctgcgccagccggcgcgcatcgggcacctgcgactggacgcgctggccctgctgctcagcctggcgggcctctccgcccacgcccggcccctggtccttgatgcctgcggcggcctggtgctgggggcggccgcggagcgactggccggcttcggcacggtcaccggggtctacctgggcggcgcaccgcccttgcgcgaggccctggcccagttcgacgcgggccgggtgcagagcggcgtgaggcatgccagcctggcgtcgctccttcgccgggtcgcggcaggcggggagcaggccacgccgattggtgtgcctggggcgctcgagccggcggggggcggggcgggggtgggcgatgctggcaaggcggggnnnnnnnnnngggcggggagcaggccacgccgatttgtgtgcctggggtggtcgagccggcggggggcggagcgggggtgggcgatgctggcaaggcggggactggaacgactggcgagccagagactggagcgacgggcgaggcaggattcggtgcagccggcgatgcgggcaccagcgcagccggcgaggcggaggccagcgggccatcgagatgcggggacgcaacaaccgccgcgcctcccccgccacagcggccgttcaacgcgtgcatcgtggccgcgccggggcttgaacccggcgcggcgctgcgggccctgctgccgctcttggccccctccaccccctttgcggtgtactcgccgtggatgcagccgctggccgaagccatgcacgccctgcgcgctgagcacgccgccgtgggcctggcgctgcaggagtcatggtggcgcgagcagcaggtgcggggccggcagggccgtgtgggtgggtccccagcagctgagcgtcgatggtttaagaagggttggagtccaacgggtgggcccctgcagctgtctttgtcctccccctctagttatgggcgccctgtaggaggtgctctgcgcctggtcgccgacacannnnnnnnnnggctgggcgtcgatgctttaagaaggcatggagtccgacgggtgggcccctgcacctgtcttcgtcctccccctctagttgtgggccccctgtgggaggtgctctgcgcctggtcgccgacacaagcatgctgccatgtgtccgcatgcacgcgcatggacctcctctccccaccgccccgcatctccaggtgctgccgagcaggacgcaccccaagatgcagatgaaccatggcggcggcttcgtgctcagcggcacgacggtcgccccgccgacgcggaacgcaggtgccacgctggcgtgaggtgcccgggatccaccagctcttaccagatgccgtcggcgacctttgagaaccgcacggccaggacggctgtcccctgcgtcgctcctgcagcttgcgcaggtgctgtcatcttgataaacacattgccaagcgcagacaagggcaagcacagcgagtttcgatgtcatcctgcaaagggaagagggactgcggagcggggacacaagatacatgctttgcctgagggatcttttattcagtgacgtggttcccgagctcaaccagcgggcatgccatgctggtcgcgcgggaacatactgcccccggctgctcggtccatggcggcattcttccccgagccggtggccgccgcagccgccgccgcgcgcgtcaggggtggcacaggtctcatgcaggaggggaggctccgtgccnnnnnnnnnnaaacataccgcccccggccgctcggtccatggcggcattcttccccgaaccggtggccgccgcagccgccgctgcgcgcgtcaggggtggcacgggtctcatgcaggaggggaggctccgtgccagcccgggggccttgctgccaagcggctgctgcgcccctgccatcctctcccagaacggtatggcggtgggcgggagtgacctcgccgtctgctgcagcatgcggcggatgagtgttgcctggtggacgaaaatggggggaggctgccctgagatgtgcatggagagcagagcagaggcacaggagcgggtgcatgcccaggcagagggttgaggaaggaggacaggccaggggcagagtgtgcacattggcagggcaccgtttcggcacacgccgccgccgcataccctatggaggttgctggtgccgggctgcatgtcactgggcgagatgggcaggcgctcctccaggcagatggaggagtgggggaatcgagctggtcctgcctgaggctgggcgccccctggccctcccttctggggtgttcggtagctgttggacgcagggggcgtgctgcccgtggatgactggcatgcatcgtctgttcctggaaactgcaggcgttgcaaatcgctggcaatcgcctgcacggatcgggccgggaaggggtggtgggaaggctgcctttgcatccgtgccgagcatggaccctgcatggcatggacacgcaattccgtccaggagccccccgatgccgacgcacatccgctgcaaatctcttgtgggcaaacatgttgtccagcaggtcgtcatcgtggtgctcccagcctctcttcgtcccggcgcagtagccgggatgcatccgaaaggcaccggctcccggcaacagggtcgggggtcggtcgctttcgacgccaataaagggctttaatgtcaggggagacggagtgatgtccannnnnnnnnntcccggcaacagggtcaggggtcggtcgccttcgacgccaataaagggccttaatgtcaggggagacggagtgatgtccatcatcctgccatatgtactatcctgatcgcgtcggtcaatgcctgctagttcgaatccgggtgctcacgtggagggggagggtgtatcccgtggaatccctgcgactccgatgcgactcaggcaggaagcccgagaagacgcgtccacaagcgctcatacactctccagacacgtgggccaatcgagcagggaccagcacattccgcggtcccgtcgatcagtgggtgtgtgggagcgatgcaggcccgcgtggccggcttcattggctctgtgcagctgcagatcaagatcgcagaggccacctcctccagtgatgaggtcacgccgggtgcgaggggtgcaggcatgctgcctatggcggatgtgtcggtgtcggaggacaccttggggagggagaattacccgatctctgacttgcatcccggccaccatgcaccggcccccctcccacccagtctacatcctggatgaggtcttgtcgctcgtgggcagcaaccgcgatgccatcgacaccgccaccaatgccatcgtgcagcgactcaaggctcgcagcgccaccgtgaagcaaaaggtatgcgcctgtgaggaaaggcgggggaacgcaggcgctcatggggttgccacccctgtctagggtcaaaaggttactcccacctcgccctgctcctggactgacagctccagtggtccagcagtgtccggctctgcactcccccgtcgagctaccacccgccgcatcatgcaggcgctgcgcctgacacggcacgcctgcctgaagggcgatgccgcgctgcgcagccgcctgacccacctggcctctcccgccgtgcgagacctgctcagctaccggtgcgaccctgaccccttcaagggcgacatcccctggaagagggtgcaggagctggccaaggacaccctcactgccatgcacgccgggcccgaggccgccgtgggcggcgcctcgcacgcgctgcaggtaattatttgcgtgtgtgtcgggagaggaacgcacgtgtcgccggtgaggactcgctgtgctgcacctggcagtgcccggcagtcgcgggggcacgccacgagcgcaggtgtttggggcgtcaggcaccgaccactgacaccttcaggaacccgcacgcccctccccaccnnnnnnnnnnggtgcccggcagtcgcgggggcacgccatgggcgcaggtgttgtggcgtcaggcaccgacaactgacgccttcaggaacccgcacgcccctccccacccccagggccgcatccagggcatgggcagcggcgatgctggcggcggcggggcggccttcagcgcctcctccagcaggatggttggctttggcagcggggcggcggggccccagggcacaggccccaccagcggcggcgcaggtctctgggcgggcggcggcagcgagcttggcggcgccccgacgcacgccggtgccccaccccagcgagccccgggcggcgggggcctgctgcagcagggcgccatgggcggcggtgggcccacggcggcgctgccacactcgccgtccccggccagcgcggaggagagggtcgtggcccggctggcggggccggggggcgtgcgcgccacgccgagcgccgaggacctgcgcagcttcctcacggccgccatggggctggacggcgccagggtggcggcggcgctgtggggccacctggaggtgcgacaggcgccggggcggtgtggggaaggctgtcgtctcgcttgggccgtggggaatcgcgcgcccgcgcgcccagcggcgccggggagagaccccgcgcgtcgagggctggggctcagcgtgcggagcgctcgtctgggggactcggcatggaatagcgccgctccgcgaccctcgccaaccggtgccacgggcgtctccagcccctcagggcccaccgaaatccccacccccgagcccatgtgacacccctctcacagaaccccgcgctgacctggcagtcgcggctgcgcgtgctgtgtggcatcgaggcggcgctggaggagcgggccggcacgcccctggcggcggccgtttgcacccagtttcagtcccgcgccagcggcctgcgtgcggcggcggcccagccgcaggccagcgtgcgcgagagggcggcccacgtcttgaccctggtgggcgccggcccggcgcgggtggcggagggtggacgcgctgggagaggggccgacgggcccggcggcgcggcgccaggtcgggggagagcgccggaggtcttgggtgggagggggtggaggnnnnnnnnnnctggcggagggcggacgcgctgggagaggggccgacgggggcggcgacgcggcgccaggtccgggaagagcaccggaggtcttgggtgggagggggtggaggatcaggccggctgcggctcatcgatgcaggggcgtcgacagtgctttgggagaggcagcgcgcagcggcgacgcggcgatgacgccggtacnnnnnnnnnnatgtcgacagtgcttagggagaggcagcgtgcagcggcgacgcggcgatgacgccggtacaaaaccagtaccccctgccctgtgatccacgtactgtgcctgcccatcctcgcagacgtcccagacctactgggggacctcccgagcagcgccatggcagccccgagcgaggctctcccggccggtgcagtcccgcacccctcggcctcggcctccccaatcccagacctcatggacaacctggaggggccgaccgacggcaacctctgtcagccctcacgagtactgcagagcgccactcaaggcagcaatagcaacgtcatggatctgttggcagggctggacatagggcccccggcccgcgccccgtccgccctgccccacctctctgcgccggccctggcccagccagcagacgacgactggctggggttcgcatcggcggggagcacggggacggcaggggacgttgctgccgcaccctccctgccaccgcaatccgcgggacctcagccaggcccacccgctccgcaccccgcggccgcgccgttggacatgggcttcctcggcgcggcggcacccggcccatggccacctgctgccaacctgacggctgcagggctggacctgtcgggcgcctcctccgagctccaggccaggtcctcttccactggctccaggggcagccagccggctgggagctctcccaagggaagcagccggccgcctgctctcaacggtgcgccgagctttggggcaggggagcaccctgtgagccttgccggcacatgtcagggaccccttgcacctcaccctctcccctcgacatgcccgtcccccctcgtgccctgtgcaggcagggtagaggcagtgggggcacgcaaggacggcgcctttgactttgtatcgtcgctgttgacccagcgctgaaactggggcgtgtggagcaaggattgcatcgatcctgtgctcnnnnnnnnnncgcacctcaccctctccgctcgacatgcccgttccccctcgtgccctgcgcaggcagggtggaggcagtgggggcacgcaaggacggcgccttcgattttgtatcgtcgctgttgacccaacgctgaaactggggcgtctggagcaaggattgcatcgatcctgtgctctgtaaggggaagccaggcacctccaaggaacgctagcagccaatgcgcgcctcccagtatcggcattcgcgcgcgcatgctgctggccacgaagcaacgatgtcagcttatcctcgacgagttcgccataatggctggcgaccgacggtgtccttgacgtcaaactggtgatcggtcatattgttcaacgctgtgaaggacacatcgagcatcatggcctctgtcctgtgtgctcagatgggcaacctatctctcgctaggaacttggtgagggggcgagtgggtgaggcaaggcggagggtcacacctaaagaaattatcattctgataaatattttgtaccaacgctccatgtccgcagacccaannnnnnnnnnaaggcaaggcggagggccacacctgagaaaactatcattctgatacatattatgtaccaacgctccatgtccgcagacccaacgtcacagccaggcattccgtggtgccgcgcccttcaccccatccctacgcccgtgccgaccactggtgagtgcggggccctggctgtccgggcagttcgatgcctgaaatcttgattcagtccccaatgtgttcgtttcgctcgatggctggtgccgcgtcggtgtccacctcggggtacacctcacagcctgcacccttgtgggtgcctctctcctggtgagctcacgggatccccgccccgcttccccccgcccagacgctgacgcagcctcgccgggaggtcatccgtgcggctcgtatcgctggggtggaggtccccaaccagaagtacatcgagtactcgctgcagtacgtgtatggcatcggccacaccaccgccaaggccatcctcgcctccaccgtgagccgtgttgggggatctcacccgtgcctgccatgaccagggggcttggctggggtctacccgactgggcattgtgccacccccggtcgaccactgggcctcgggtgacggtgcccgccccgccgccccgccgcaggaggtcnnnnnnnnnntgccatgaccagggtgcatggctggggtctgcgcgactgggcattgtgccacccccggccgaccaccgggcctcgggcgacggcgcccgccccgccgccccgccgcaggaggtcccgaacaagcgcacccgggagctgacggaggaggagctgaccattctgcgcgacgaggtggagaagtacatgacggagggggacctgcgccgcttcaacgcgctcaacatcaagcggctgaaggacatcggctgctaccgaggccggcgacacatcgcggtgggtggggtggggtcgctaccctgtgccctctgcctggaggccctggctgcgatcgtgatgctagcccaggcaggttgctgtctgagaccctgtagagcggacaccccagcctcgcccgtggcctcatcttgccctcgcagggtctgcctgtgcgaggccagagnnnnnnnnnntgatcgggacgctagcccaggcaggttgctggctgagactctgtagagcgtacaccccagcctcgcccctggccccatctttttctcgcagggtctgcctgtgcgaggccagaggacccgcaccaacgcgcgcacccgcaagggcaagcgggcggggcccatcaccgggaagaaggtggcgaaaaagtaggggctctcctggcctggcccggggtgtcgccggctgcatcgaaggccagcggggggggcaggaaaaggtggctgagcatccccacagcccccttgccatcccccggacctcactcaagctggctctccttgccccagcagccgatgtcctgggtctcccagagccctctcagcccactgtcagggtctctgcccactcattcccttggcgatgtannnnnnnnnntcgtcatctcatgtttgccgtgagtacacatgtggcgcatattcccagggcgatgattgagagagtaccgggatggaatacacggcgctgtgtgtcggctggcaggcgagcccgccccctcgccacacctcgagccagaattgcagtggcaccgtggccccatgccattgtctctactacacagctgcggagggggtgggggaaaagggcgtggccgctgtggagccacttaccannnnnnnnnnacgtcatctcatgtttgccgtgagtacacacgtggcgcatatctccgatgcgatgattgagtgagtaccgggatggaattcacggcgctgtgtgtcggctggcaggcgggccggccccctcgcccacacctcgagccagaattgcagtggcaccgtgtccccatgccattgcctctactgcacagctgcggagggggtggaggggagggcgtggccgctgtggagccacttaccatggtgcgcgcgtggcctggtcgccacagcgccatgccctcaccacccgatgatgggcaccagactgcaggtggctgcagccagcattgggtggcggctgggcctggaccggccatgcatctgcatgcggcggcgacgggacatcctggcagggccgacagggcacccgccagcctgcaaacnnnnnnnnnncctgctatgcatgctgtgggggcgggtgcccatggtccgggtccgctgcgaggcgtttggccgcccaggccagcctcatgggtcgcacaccatctcagaggcacgcgactgagatgggggaccgactcggcctcgctctgcttcagaccgctctgggctacagagcctatgcaatgctcgnnnnnnnnnnaatgggggaccgacttcgcctcgctctgcttcagactactctgggctacagagcctatgcaatgctcgatgacagggtggcacacacatcgtttcgggggaggcatacatcaggggtgccaagcggggagggtcatgccgagtggcgcccaggcaccgtcttaccacccggcaagccagggagcaggtgttcctggacgcagggctttggacgcagccgagcttcccagccgggcgtggatgggccgatgggctcctggccgcaggcggcgcgacgaggaggggtcgggcccggcttggggctggctcatggcgtctcagcctgcacagagcctgcgccggcactgcactggctggtggtgttgggggatgtaggtccccggggggttgaacgatgaggacagggacgagggcggcagattgccccctaacccccaccgcaagggaaggtgcgccggccggcgtgtccacaagtggggggggtggggcggcagtgcggaacgaggacggcccctgggggcctattcctgcgnnnnnnnnnncccccccctaacccccaccgcaaaggaaggtgcgccggccggcgtgtccactagtgggggggatggggcagcagtgcggattgaggacggcccctgggggcctattcctgcg

SEQ ID NO: 40652 - DNA, 161 bp, Chlorella protothecoides
caacccgtccatcaccccctccaggcctccaaacgccagcccccctctacctcaaccctctccactccttccccaccccccctctgttccttcatattccttccccccctcccgcccaggcacctgactgcgcgacgctgacggcggccaccaggtcaggg

SEQ ID NO: 40653 - DNA, 61 bp, Chlorella protothecoides
tgtgcgaaaggtggacgaccgcctcttcccgccgcccgccgaggccgcactccccgattcc

SEQ ID NO: 40654 - DNA, 64 bp, Chlorella protothecoides
caaggtctggaccccggccacgggcttctgctttgtcaccttccgcgaccacgccgcgcccgtc

SEQ ID NO: 40655 - DNA, 61 bp, Chlorella protothecoides
aagctggtacggggcaaggcgtggaaggggggatgatgcggggactcgggcatcttgacga

SEQ ID NO: 40656 - DNA, 6051 bp, Chlorella protothecoides
  modified_base (805)..(838): a, c, t, g, unknown or other
  modified_base (1137)..(1192): a, c, t, g, unknown or other
  modified_base (4143)..(4152): a, c, t, g, unknown or other
  modified_base (5198)..(5207): a, c, t, g, unknown or other
  modified_base (5330)..(5339): a, c, t, g, unknown or other
  modified_base (5716)..(5752): a, c, t, g, unknown or other
aggagggccggggggtgggcggggggtggactgcacggagcagcctcgccacgagatgaacgccgccgacgccgcaccccgacacccccaaaccacgccgggaagggggcgcggtgccgctcacgaccgaccccacacccaatcgcatccgggtccccacctcgtctccctctcggggacccccctcgaagacactctacagacctggactgccgcgccgtaggccacggcctcgtcggggttgacgcccttgttgggctccttgccgttgaagtagtccttgatcatggactggaccttggggatgcgggtggagccgcccaccagcacgatctcgtcgatgtcctccttcttcaggcctgcgtcctccagcgccttgcgcaccggtcccatggtcttcttgaacaggtcggcgttcagctcctcgaagcgtgcgcgcgtcaggggctctgcgaggttgtggtgtgggcaggggggccatgtgagagaggggaggagagggggtggagcagatggggcgagggggtgggggtgagcgtcgactgacggtgggggagtggaagcccatacggcgctggtctgcaccgatggctggatgcacaacaggttgaggggccagtatcgctgtgctgcaacagcccccctggtcccttgctgcacgcgagccagatgcgggtcgcctcctgccgcacggtccccactccacagacgcccccacgcgccgctccatcaagacactcgtgtcatcccctggctgccaggttccctcggactcccccccccccccccccccctcccccccccnnnnnnnnnnnnnnnnnnnnnnnnnnnnnnnnnntaccgcacaacgcacccgacaggtcaacgccgtccactaggctctcgatctccacgcggacctgatgctgggaggaaagcgcacgcttggcgcgctccgcctcgcgcctcagcttctgcagcgcgcggctgtcccccgacacgtccttcttgtacttgcgcttgatcagcttgatgaagtactccatgacgcgctggtcaaagtcctcgccgcccaggtgggtgtcgcccgatgtgctcagcacctcaaacacgccgccgtcgatggtcaggatggacacgtcaaaggtgccgccgccnnnnnnnnnnnnnnnnnnnnnnnnnnnnnnnnnnnnnnnnnnnnnnnnnnnnnnnnttctgctccttggacttcttgtccagcccgtacgcgatggcagcggcggtgggttcgttaatgatgcgctccacggtcagacccgcgatcacgcccgcatccttggtcgcctggcgctgcgcatcgttgaagtaggcggggacggtgaccacggcgcgggagacggggcggcccaggtacccctcagccgtctccttcatcttggtcaggatcatggcgctgatctcctccgcggagaaggacttggggccgtcaggcaggtccacggagatgtggggcttggaggccttgtccaccacatcaaaggacaccagcttggcgtcgcgctgcacctcgcggtcgctaaacctgggggggtcaaaggggggcggggaaaggtggggcgagggtggggttgaagggtgtgggagttgtcaaggggtaactctcccatttcttcgttcgggagagaataggagggggggcctggagtggggttccaggcatggacagcgcagaaggggaagcattcaacagggaacggcctcacagggaccctcctcccccagaacatgaaatcaacaaactcacttgcggccgatcaggcgcttgacgtcgtagatggtgcgcttggggttgacggtggcctggttcttggccgcatctcccaccaggcgctcggtgtcggtgaaggcgacgtaggagggggtgatgcggttgccctggtcgttagcgatgatctccaccttgccgttcttgtacacacccacacacgagtaggtggtacccaggtcgataccgatcacggggccctccttcttcttctcctctttcttctcctcctttgccttgcccagggcggggctcaggcacagcgccaacactgcggggtggttgcggggtgaggtgcgatcagcgcgtcggtgcctccccggcacaggcagtcagtgcggcagcatcagaaaacatgtccaaagagctcacatgcgagcgcgagagcgccgcggtactgcatcgtggctcgagggcctcggatctggcgcacacaggaggggggcaacaggtgatggctgcggcttcaccaagccgattcgcaaacgggtttcctccggggtgttagcctgggcgaataatgcagcaccgttctggagttgcgtactgggagtctgagcacgcgggggacgggtaagagggcaggaggaggaaccttcgcggcgtttgagtgagtcacggtggaaagagcgcccaaacacctgtcccccgcttcgaaccggacatgagctgccacaccgtgctgcagcgatcggatacgcaattgaagcaataacaagagatccatctgagcctgacgaacatggggagggtgcggtggaccgccgttctcttgcttttctgcgcgatcacggccggctggcagggtgaggatgggtgcgcatgttcctcgcgaggcgatatgagtatgccatgctatgtacaacgtgctcacatcaatgcttttgttcattgcagggtgccatgccgaggatgacgccactccagctaggtgagtgctcccatctggagccggggggaaggagtcgcaccccgcctctgtgtcccgtttgatggagttactttggtggcttactgacttacactggctctcacaattgcagcaacgcgaccgaggccgccgctccggtgcacgccttccgcaagggcgccgagaccatgcagttccaggtgggtggtaagaacagggagccgggggttattcctcaatgctagccatgcaaattgcttcgacgggcaagtcgtcggcgctgcggtgaatgcacagatcaggcacagccggatgggtggaacaggagctgcgtttgggtacccgccattcacaccctgcgcagctctcgaaacaagcgccatgcattctacaaatatgccagcagccttcctccagggtcctcccattggtgcctgcccataagatgcatcacctccccacccttcccccccgctcacccccccaaaaatcacactcactcccaggccgaggtgaacaggctgatggacatcctgatcaactccctgtactccaacaaggacatcttcctgcgcgagctcatttccaacgctgccgacgcgctggacaagatccgcttcctggccctgaccgacaagtcccagctgggtgacaccgaggagtcccaggccctgggcatccgcatctgggtggacgaggagaggcgcgtgctgtccatccgcgactccggcgtgggcatgacgcgccaggacctggtgaacaacctgggcaccgtggcgcgctctggcacctcggccttcctggagcaggcccagcgcggcggcgacctctccctcatcggccagtttggtgtcggcttctactccgtttacctcgtcgccgactacgtggaggtggtgaccaagcacaacaacgacagccagtgggtgtgggagagccgcgcctcgggcgactacgcgctgtcggccgacgaagacgggccgcagctgggccgcggcacgcagatcaacatccacctcaagcccgcctgcgaggagtacgcgcgcccggacaagctgcgcgagctggtccagcgctactccgagttcatctccttccccatcagcctccaggtggagaaaaccgttaccaaggaggtgaggagtgtgggggggggtggaaggggactgggggctggaagtggagggaagctgccatcgacaggacgggcccgtggcagcgacgcatgttgtggcaccctcgcaagctcaaaacggctcacgccctcgtgccttgctccccacgctgccaggtgccgctggatgatgactcccctgctcctgacagcaaggacgccgacgacaaggacgccgacgtcgtggacgaaggtgggctgggtggggggctgagcatggtgtgtgaggaagtcgggccacgagtaaggtacctgggcgctgggtgcctgggtcgnnnnnnnnnncctgcgcacagtgtgtgaggaagtcgggccacgggcaaggtacctgggcgctgggtgcctgggtcggcaaggagcgtctgtgagggtaccgcatgccggccctcgtcgcagcttttcagccgagcagaggggacggttgggcgtgtgcctgatcctgagcttctctctccgagcctgaaagccccgcaccccataaactcacctccacccccccaacccccgcgctgcagacgaggaggaggccaaggagaagacgaagaccgtcactgaaaaggtcaaggagtgggaggtgctgaacgatgcgcaggcgctctggctccgcgccccgggcgacgtcaccgacgaggactacgacaagttcttccaggtcctcagcaaggtgggcgacgcgggtggggggtgggtgggtgtgtggaggctgtgcggcttgggtggcgctggcaggggcccctggcgccttggcacgcaggagatctcacctcggcgacttgtcgctgcccgcctcgttccatgcccaattcgacccagccccagcccccgccaacacgtcgcccgcccgccccgacccgcagggccagtccaatccgctggcgcacacccacttccgcgccgagggcgacgtcgagttcaaggccatcctgtacgtgccccgcacgccgccacctggtgaggctccctgctgcggggctgggaggggtcgtttggggggtaccatgggggtgtgggggttgaggcagggaaagggaacgcagggcggccagaggatgcatggagagcatgcgtgctgctcgatgcccggccagccccagggtgccgtcctcgtcacgaccggcccctcgcacgaccacgtccccaccccgccccctccggcgcagacatgtaccaggactactacagccgcaagccgagcctgaagctgtacgtgcgccgcgtcttcatctccgacacctttgaggacctgctgcccaagtgcgcgcggggtactgcccgcacatgtgtcgtcgagtctctgcccttgtgtgcgcggaatcaagctgggtgcaggnnnnnnnnnntggttggggggtaccatgggggagtgggggttgaggcagggaaaaggaacgcagggcggccagaggatgcatggcgagcatgcgtgctgcctgatgcccggccagccccagggtgccgtcctnnnnnnnnnncgaggacctgctgcccaagtgcgcgcgtggtcctgcccgcacatgtgttgtcgagtctctacctttgtgtgcgcggaatcaagctgggtgcaggtcctggttccccgaccgtgtgccgtgggcggccgcgtgccgtgtcgcagtccgtcgccgatgagggtatctctgaagcccccgccgtaatcccataccctatcaacccccccccacacacacacacccgcaggtggctcagcttcctggtgggcctggtggactctgactccatgccactcaacgtctcgcgcgagatgctgcagctgcacgagggtgagcgggctgcctccagtcggttcccgtggatgtggagaggatgtgtggcgtggagggcgcttgcnnnnnnnnnnnnnnnnnnnnnnnnnnnnnnnnnnnnngagcgctcggcggtgaaggagctggaggagctcggccccgcgcccgaggacgagggcgaggcggcggcggcgcggcgcgcggagctgacggcggcgcgcgacaagtaccccgccttctggaaggccttccacaaggcggtgaagatgggggtgatcgaggagaaggcgcaccgcaagcgcatgctgcccctgctccgcttccccacctcgtcctccaacggctccgacaccacgctggacgagtacctggcgcgcatgaaggaggggcagaagcacatctactaccacattggtgagtt

SEQ ID NO: 40657 - DNA, 61 bp, Chlorella protothecoides
gtgtgcacccccctccccctaaccctccccccccctgttgagtgtcgttgagtgtgcaccc

SEQ ID NO: 40658 - DNA, 77 bp, Chlorella protothecoides
tgacacgatgcaccgcccgtgtcatcgtcctgccccatgaccccctcctcctgctgctccctccatcccctcgttct

SEQ ID NO: 40659 - DNA, 15059 bp, Chlorella protothecoides
  modified_base (186)..(272): a, c, t, g, unknown or other
  modified_base (598)..(607): a, c, t, g, unknown or other
  modified_base (2495)..(2514): a, c, t, g, unknown or other
  modified_base (3065)..(3074): a, c, t, g, unknown or other
  modified_base (3128)..(3386): a, c, t, g, unknown or other
  modified_base (4583)..(4644): a, c, t, g, unknown or other
  modified_base (4758)..(4767): a, c, t, g, unknown or other
  modified_base (5397)..(5406): a, c, t, g, unknown or other
  modified_base (5493)..(5502): a, c, t, g, unknown or other
  modified_base (6841)..(6850): a, c, t, g, unknown or other
  modified_base (7486)..(7495): a, c, t, g, unknown or other
  modified_base (9641)..(9650): a, c, t, g, unknown or other
  modified_base (11271)..(11280): a, c, t, g, unknown or other
  modified_base (13397)..(13406): a, c, t, g, unknown or other
  modified_base (13604)..(13683): a, c, t, g, unknown or other
  modified_base (13765)..(13774): a, c, t, g, unknown or other
  modified_base (14353)..(14362): a, c, t, g, unknown or other
gccgcctgcgggcgcgggcggcgcgaagggcgggggagggccgatgggctgtgactgggtgttcagcagctgcatgaaggcctgcgccagctcggccagcgacccgggctcgcccggcgcatcgcccgcgccgacgcccccgtgcacgatcatgcgctggtcgtggcggggggcgccgccgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggagtcggcgccggcagtggaggtgctgctggcggcgccctgccccgccacgctgtcctccacggagccctcgctgtcggagtcggcgcccgccgcccgcgcgcgcccgccccgccgcttcttgcgccctggggggtgatggggtgggggggtccgtgggtgttggggccaggactgcgagctcgggtctgatgcagcacgggaacccagggcgcacccaaggctcgcagccgccgaggccccagggctgggctgatggggacacacacaggccaacacacacacacaccacaccctccataaaccccaaaagatgtcacannnnnnnnnngttggggccaggattccgagctcgggtctgatgcaacacgggaacccggggcgcacccaaggctcgcagccgccgagcccccagggctgggctgatggacacacacacagaccaacacacacacacaccaccctccataaaccccaaaagatgtcacaccactgcactcactcctcccgtcgtcgatgcgttgcagggcgggggcgccccccatgaactgctggaccagggccgggtggtgcatggcctttgccaggaagcccaccatctgctgttgccgcgcctcggtgacgtccaggcggtgttgcaggccgtgcagcgtggcctcggtccccgcctgagcctggcgcaggcggatgacctcggtgaccagcaggcgcttgtcgcgctgcagggtctccacctccgcggccaggccgccgtaggagcccagctccaccgctgacagcgcgccggcgtcgcggccgggagcgctgccgccgggacggccgacgtcagcggcgggcttgcgccggacgatgccgcccagcaggtggcgctggccgcgcaggaagagctcgttggcaaactcccagcggtccgggtccaccttgcggaagccgtaggtgttcagctggcgcacgaagctggagaaattgctgtgcttgaagtggaggtgtagcaggtcgcgcgcaaactccgcgttcttccacacgatgaagctggtgggaggggaggggggggtgaggcatcagcggaaggaggcagggcggggtgaggaggagggaggggcagacagggcacagtatgggggaggcgaggcatgcgcgggaagggacaggacatgcatgatactcacagcacaggcgcaggggcagtgaggcgtcaacacacccgcctcgcggtctaccaacacacctagtgccatcctcgttccaggagatgatctcgtcggtggaggggtcctcgatgagctcataccttgtgagcagagggtggaggagcagggtcaggtgtggacagcctccaggcgggaggagccctgagcaggaggacatgctacactgatcaaactcccacacatacaccaggcgcttacgtctttataatgaagggagcggggggattgggagcccgggcgggctccctctgggcctgcccgcccctccgtgtgttcattttgtccaaagacaccgcgcctgacgctcggctgacagtttatgtacagaataatcgagtgtacgtcccgagggggctcagtttggctgtgggaaccgagcacgagacagcaagaggtccgcggaaattttgcaaccatgcatgacttttacgcgggaatgcaatactcgggtctcggttctcatgaatggatgtgaacaaaacagcgaccacccaactcgggatcaagtctgcacaataaatatagaattcgaataagagcattgtaggatccggagatttatccaatggcggggctgtgtctacgtcacggagtgatcgggagggtagtcttcctcggtctgctgtgcgttggggctgcctcggcataccgtgccgcccacccagagcgtctgagcatgcaacccatatcactaccgatgggccgccccaccaagggcctgggtgtcgggaaggagcctgaacgctacagtggctactacgacctcaacaggtgtggggacaggcgacgttcatgatcgggcctgggagggtgacaggagtctgtacagcaccctgcgagtccccatcctccaaaggatctccccacctgcagaacaacggatgggcacatgttctttttctactttcaggccagggaggatcctgagaatgcaccactcgttctgtggatgacaggtaggggtgggacagcaagggtgtggtggggcgatgttttgacctgccacgnnnnnnnnnnnnnnnnnnnnacctccacttgatgatcttgtggaagatgggaatgcaaaacccagattctgcctggacgcttcccactaggtaccatcaacactggctttgttgcaccctgccactgccccaaagcgcatgagatttaaaacccactgcccttgattgcccccttgcctgatccccaggcggcccaggttgctccagcgagctggccgtcttcttcgagaacggcccttaccgcctctcgcccaaccagacggtggaggagacgacctatggctgggacgtgtcggccaacatgatctttgtggaccagcccctatacaccggcttttcctactccacctcggacgacgaccgctgtttcgacgagaagtgcgtgtcaaatgatatgctggacttcttcctcgccctttatgaggtccggccggagctggcgggcaaggacctgttcatcacgggcgagagctatgcaggtgggcggggaagtgcggttcttgcagggcatggcagggtgtcgaggggatggagttgctgtgctccgctggcatacacaccccgcctgtgnnnnnnnnnngccaaagcgcatgagattttaaacccttgattgcccccttgcctgatccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagagcggttcttgcagggcatggcagggtgttgaggggatggagatgctgtgctccgctggcatacaccacccgcctgtgtcccctgggccctgtctgttaccgcgagtgccacgctgctgctcctcctgccatcctgtgtcagcctcacagcggagtcgtcaccatcacaggccactacgtcccggccgttgccagccgcctcttccgcgcatccaaatcgggggaggttgcgacgccctttcccctcaagggcctggccatcggcaatggcctcaccaaccctgcgatccaggcaggctggtggagagtagggaacgagggcaggccagggagagcctgctatggccaggagggccagtcgccgctcctgcaataagagctgctgttgttgggcagataatctaggttgaatgcatgccttgcagaaccaaaatcaacgctcagcagcccctgcttcatcctcccacgcagtatggcgcctatgcagactacctgctcgccaacgggaagatagggcgcacgctgtacagctacgtgtctctggtgcgtgcctcacctccaaggggtggctggtgggtgcggtgtgaccttttggttgcgacgggcacctgccggtgtctgcccccagcccacttgccccccccctcctcccctcccaactccccagatcaaccccctgtgccgctggtcgctgggcgtgtgcgaccagttcaagtggcagtgggagtgcctgctggcagtcaacttctgccaggccgtcacctttgttcccctcatggcgggtgtgtaggtgctgaaggggtcccggcctgtggctggaccgtgggcgccctgggtgtcgggattgcttgcacatcttggtggacttgtagccgagactgtcttgcaaggctctctggtcgcaggatgatcgctgtgcgggcatgtgagctgccatgaagtgatcaacaccggcagcgggcctgtccacctgccctggcccaggacctcagtcacattcatgccagccccctgaacacctccccctgtgccgctcgcagccaacccgggcatgaacgtgtatgacatccgcaagccatgcgtgggccccctgtgctacgccgagtttgaggtgctggacacctacctgaacctgcccgaggtgcaggagggtctgggcgtcaacaggaagtgcgtcgggagggggggggnnnnnnnnnnnnnnnnnnnnnnnnnnnnnnnnnnnnnnnnnnnnnnnnnnnnnnnnnnnnnnattcgtcagcatgctgcaggttccttgccaagcatggtgcaggtcggtcgataacccgtggccgcgtctggtcctggctcgccctccaatccgcttccccaccctttgccgacnnnnnnnnnntttcgtcagcatgctgcagattccttgccaagcatggtgcgggtcggtcgacaacccgtggcagcgtttggtcctggctcgctctccaatccgcttccccaccctttgccgacaaacacaagccaaacctccctgcccttccctacccctgaaccccccgctcactctcctccctgaaaggtggaagtcgtgcaacatgcgggtgcacgcggagatgatggaggactggccccacgacttcagccacgtgctccccgagctgctggcgggcggcgtgcgtgccctcatctacgccggcgaccaggacttcatctgcaactggctgggcaaccggcgctgggtggacgcgctgccctgggcgggggcgggcgactggcgcaccgcccgcgacgcgcgctggaccgtggacggtgagcaggccggcgtcttccgcgccgctggcccgctgaccttcctcaaggtggggggcgccgggcacatggtgcccatggaccagcccaagcacgggctggacatgatcacccgcttcatccgggacgagccctttgggccccagccggaggaggacgaggacgatgtcgtgctgggacagcccatctctcgcgcgcgggccgtgtcccgccgccaggnnnnnnnnnntggcaatctcgtcgcggactccctcctgaaacaagcgatatcgtcgcggctccacgccgaacccagagcagaatacctcaatacccnnnnnnnnnngtttgggccccagccggaggaggacgacgacgatttcgtgctgggacagcccatccctcgcgcgcgggccgtgtcccgccgccagggggagtctggcctgcatgttgtccagtgacggaggccctacacctggggttgcatgcgcctgcaggtgtgtcgcccgggtctgggccctgtgtcagctatcaactccactactgtacttctgaccgcctgctgtaactctactgtatgtaccgtggtatccacggactccatgggaggtgtgaggtttccttgcaaggtgagaaccctggggtttcggacgccaagcacggaagcggcgatttcgtcgcggactccctcctagaacaagcgatatcgtcgcggctccacaccgaacccagagcagaatacctcaataccctcagattcatttccttcaaagcatggcgcggtactaagcctagcccgggctgcacggcgatgagctccccgtcgcacacccagtcgtcggtggcctccaccgtcttcgccgtggggctgggggtgggggtggcggccgtcgctggcgtggctgtgggcgccatgttcggggcaagcgccctaagtatcgccgcggccagtaagcagcaggcccgcccccctctgaccgccaaggacctccggcgggacgaggagggacgcatcctcaactggcgcagcgccctgcgcatcatccagcagggggtgaggaaaccggagggatcgccgatgtgctggtcccgtggcgacatgcacatctcccggttgggaggtcattcccagccaccaggcgctgaccatgcaatcctcacacccctcgcatcaatccaaccccccccccatcagggcatctcccccgagctgcgtggcaccctctggcccttcctcctgggtgtcttttcccccgactccacggagcaggcccgggcccgggagctggtgcgcctgcgcggcgtctacgcccagctcctccgcgtctgcgagcggctggaggccgaggcgcgagccgccgcagccgccgccgccgcgcctggccaccccgactcccccagcaaggccgcacgagcggcggtggcctttggcgaggcgcaccgcatcatcgtcatggacggtctgcgcaccgatctgcgcggcggtgcaggccgcggcgtcgacccgggcgcggggctcagcgtccttcccatctctctggatggcggcgcaccggacatcctgcttgtccggcgcgaggaggatgaaggggatgcggcggcgcgcggcgcggcgggggcgggggaggcgtgggacggcgcctcagagtgcgatggcggggggacggcggcccacgccgctgcannnnnnnnnnaggatgcggaggcgcgcggcgcggcgggggcggggggggcctgggacggcgcctcagagtgcgacggcggggggacggcggcccacgccgctgcaggtccggcagggtcggggtccccgccctccgctccagagcctcggcgctgggacagccgcgccgcgcgcgacgcgctggccgcgatgccggagggcgcggcgcacgcgccccgcacgctgcgcctgatccgcctgctgtcggcctacagcgtgcacgaccctgagacggggtactgccagggcatgtcagacctggcggcggtggtggtcatgctcgtccccgacgaggccctggcctttgcctgcttcgagcgggtcatgcgccacgcgcgcaggaacttccggcacgacgagaccggcatcaagtgcgtgggtgggggggtgggagggtgggggtaatgcataggcaaggtggctgtgcgccagatctggcctgaggctggggcctgggcgcagtgggttgctcggccctgcgtgacgagatgctcatctaggctggttggccgcccgcccaggtcccgacggccatgccctcgacaagactatctacctcgcttcgcctcaacttacccaatcccgcccgccacaggcaccagctgcnnnnnnnnnnctgcgtgacatgatgcctatctaggctggttggccacccgcccaggtcctgacggccatgcccttgacaagactatccacctcgcttcgcctcaacttatccaatcccgcccgccacaggcaccagctgctgcagctggcgcacatactgtcggataccgacccgccgctctacgcgcggcttcgggcgctggactccggggactgcatgtttgcctaccgcatggtggtggtgatgctgcgccgggagctgcccctcccgcgtgtgctcctggtctgggaggcggcgtgggcgcatgcggccgcggccggccggggagacggtgtgccggtcgcggcggggggatgggggcggggagaggcgccatgcgacggcgccgaccaatcgagggggctctccgatgtggaagccacggacgcagctctgggcgccagtttgctgagggatggtggcaaagtggcaggcggtggcgaggccaggcacgctgcagatggggccatcagtggttcacaagccgccagcgtggaagctgcggccctgccagccgaagcgccaggcccccccctgactgccggggctgggcaggcagcagacaagaccactgcaggtgggcagccgccggctatcgcgaagcgcaccccttcccagaccggctccgctgccgcgtacgccggcggcacgtccatcccgcctccagactttgtgctgcagttcattgcggcggtggtccgaggccagcggcgccaggtgatgagctgctgccacggcacggacgatgtgctgcgcctcttctccggcgtgcagatcgatttctggctgaccctggcccaggcgcagaagcagtacaaggcgtacagccagggagggcgggtgccgagggctggcgcgcagtaagagattcaacccaccagttgttgccggtcctgttcatttttccgagcccatcccaacgctgacctataaaaaccaagtaagacaatcaccttcttcaaacagtataccctgcctgactcatcttgtgcatgtaaccactcactccagcacttgggctgctcgatgaattatagtgaagccatttgctgtgtctctgggtgacacctcatttgcggctccggcgcactgtcgccgtcgcagatccggtggcggcgttgaccgatgccgggacgacacccacttcgaacttactcagtgcacgaatcatagacagccatcaaaatgcactcatcaggtgctgcagccagctcatggtgctcattacggaggcactgctgcgccagcgggctctacccgccggcgacgtgggcttctcggaggtccgggagatcgccctgcacgggctcggcatagaacgcatcgacttgctggggcatcgatgccgagagctacgcgtcctcatgctccagaacaacgtcatacctcgcatcgaaaacctccatcgcctcaaggttggtcttgctgcagaaccttttgcgaggccctcaccctccccttgcttcgccgaccctcctcattgcaggttccaccacccacccatggccgtttacaggtgctagagtacgtcaatctggccatcaataacatcaccacgatcgaggggctgcaccgctgcgagtcattgcagagggtggatctcactctcaacttcatccctgccagtgccctcccaggcctcagcaacctcaggcacctcccagacctgcggcacctgagcctgctggggaacccatgcacgcggtggccagattggaggctgtatgtgataagtaaactgccgcagctcactcacctggtgaggtgcaattgcgcaggttgtacaggaaagttgagttgttgcagaacctccccagcgcagcgccgacagcgaccccttcagaatgcccatgcacattccctgcgccattctcgacaggatggggtagaggtgacggaggacgagcgagacggggctgcctgtactgccaaggatctggaagcagcgctggacctctgggtgctgcaagttgagggccaggcagggaccgtacaggaggacgctgaagacacccaggaacacgatcggctgccgtggagcccagagcaaaggttgcaagacttcaggtatgctttacagcttgggtagttccaagggaaagggtcagaagggagnnnnnnnnnngaggttacgagacttcaggtatgcattacagcttgagtagttccaagggaaagggtcagaagggagtgcctgacgggagtgcctgcacttgaacagcaaactcgccacttctggcggggcgcctttgcatcccatcccactctgcaccaccctcccatcctgcagggaaagagaacacctccaggaggagctcagggaacggcgtgcaacaagcagcgctgcatctcccttccgacagcgtcgctgtgccctgccccaggagccccgaacgctgcccattctctcccgggacgggtcggtgctccagaaaaacgaaggcaaggggtgcggtggtggggctgcagggcccacgaagcactctcacaacccatgaccaaggcgtctctcaccagccccaccttccccacccagcacgcaggcggctggcgcttcagcatggatgactcggacccacatgtgctagcgctggaggtgcacatcggcaaacacctggccaccaccgagatagagacggaggtcctgccgcgtgcggtccagctcctcatctcaggacgcctgctgagcctgcaccttcccgacgaggtctgccccgatgcctgcagggctgtacggagcagggccacaggaactctggtcctcacccttccccgggagggcaatggcagggtggcggcatcgaagcaagcagggatatcatcagggcgcggaaagtccgcgggaaacaatgcggcggttgttggcgccgcgcaggccacgcccgccatgactgctgccgtggtggcctgcggagacggattcccacccctgtagcccttccattgcttacggaactcctgtgctgatgtgtggactggcttcacaaaaagaagcgtgcagaagggggagcggaaaggaggtagagcggggagaggggaatggcagtgtacaggatgacggcgggggtgggtgggatatcgagcaacccaggcgccgtgccgccgccaaagtaagatacagcgtgatgaaaatgagaaatcagcttggctcacacgaggaggacggcgttgatgcagccgtcgttctcggggttgttagtgacctgggcgtacttgccccacaccaccttgccgccaggggtcaccaggcccagctccgacacattcacctcgatgatggtgccgcgcgtgatcacgcccaggctcgtgtacgcctggccgttggggttcttcttgatgccgatgatggccagctggaaggtggccttcagctcggggtgggtcacatgcgccttgttcatgcgcagaccggtgggccggatgaagcgctcgtacttgggcggcttgcgcgtgaacccgggtggcacaaaggtcacctggaaagacgttgtttggggggaggaggggggagatgttgggtgcgaggtgctgacagcggtggtgtaacctgggggaggggaccaggctgcgagctgccaagtatggccgggagggggaaagggcggcgcacacccctcccccaaccgccacacactgcgatcagagggtctgcaaggcctgtcatactccaaacaagcaactcgcacaccaaaatagtctacccacgccccccccctgcctcaccttggtgaccatacgcttccacnnnnnnnnnnggctgacagcggtggtgtcacctgggggaggggaccaggatgcgagctgccaagcatggccgggagggggaaagggcggcgcacaccccttcccccaaccgccacacactgcgaccagagggtctgcaaggcctgtcatacaccaaacaagcaacccgcacaccaagatagtctacccacgccccccccttgcctcaccttggtgaccatacgcttccactccttcttcttccgcttgccggttcggagcaccttgaacatttcctcttcggccacggggcggaccttgggcaggggaacctcccacttcccggccttctccttccgcttctgcttgatggtgttgctcagcaccttggccctgtcgacctgcgtggtggcgtgattgagaaggggatgagggtttggtaggccaggcacgtgcagcgtccatacattgggagacagctccttgcacaaccacacgcagcgtgtcgcagcaaaaagtgcgagcatgcacactaccatgaaccttagagccaccgcaactgcagcggaagcacgccccctcacccatgccacccccacatcccactcctcccacctggtcacgctccagcaggtaggccggcatggccgaaccctcgtccgcgtccttgacccgccggttcttgtccttctcctcgtgcattgcgatggtcttcttcatcaccgccttctcctggtaccgctgcttggcgaacatcttgcccttcaggccaatggccttctgagcatacgccgccctcttcttcacggagcgcgcctccttcttgcgcgtgcgctcctcatgatccagctgccgtccataccgtttccggtgcagctcgatgtggtcgccctgcggcatgcctgcaagtcctgcagagaaccgctacgaggctggagcccgggacttggcggcgagccacagcgtcgacgggaacgggagcggtatgtacactcaaagtactgctcagagatatccgccagttcttgtcgcacaggcgaacgaagcgacttgatggtcgggggagggggcgtcccggtttcgggggcgccagcgctcaaactggaaagatggaattcatgagatccaggcccttctccctgtgaatgcagtcgtgcaacccccgcgtggaacgccttgcattgctctaggggctttgggcacagttttgacatgtctgtggcctcgagcctgcacagagtgggcctccggtgctgctccggcgctctcgcctcctcctgcttcgggacaaggaggcccgcccgagtccacacacgattgcactcttctgcagtgcaatgccatgcgcttgggagctcagacggtgcggatgagattcagcctgtttccagcaggtccactgcggggaagggattcgggaaggcgcctcctgccagcgaggccctgcgcagcaccctcggaggtgaggtgatgtgcactgattgagcgcccaataattatgtaatgacattttggtttccatgcacaatcaatgcgccaaaacttccacgtcccatgcatcgccgcagagctgtctgacagggtcggcagggtagctcagaccaacaatgtggtgttggggactggtgacgagtcggagtggcgagaactggatgctcaggtgggcagcctgaatcatcgtttgctggtgtctttgcccaatgatggttgtgccctgttgacgactttgaagtttgattggattatgtcaccaagctgcgcgcatgtcgcccatgatttgacggtaccatccaggctgcaccccgaagatttgcatctgaagtaggtcttatcaggattacacctttcccctaccaccaataccccctgcactgacctcttcaggtgaatgcataccccgctgatcgaaccttcaaggctatcggctctggcggcgacgacttcgtggcctccatgaccagctgcgtggagcgggtggttggcgtgcggctgccctcctcccgggtcacccaccgcctctcggcggggggcaagtacgttagcgtgaccatcgggcctgtcctcgtggagacgccagaccaggtgcgggagttctgagggtgttgaacaatggatgaggggcggtggattctctgaggcagtggatggnnnnnnnnnnaccctgttggcgactgtgaagtttgattggattatgtcaccaagctacgcgcatgtcgcccatgatttgacggtaccatgcaggctgcaccccaaacatttgcatctgcagtagatcttatcaggattacacctttctactaccaccaacaccccctgcactgaccccttcaggtgaatgcataccccgctgatcgannnnnnnnnnnnnnnnnnnnnnnnnnnnnnnnnnnnnnnnnnnnnnnnnnnnnnnnnnnnnnnnnnnnnnnnnnnnnnnncatatcatgcagacgtagtgtcctgcgaagggtactgcgtggcactgcatcccatcagggtgcagcatgtagcgccgtgcannnnnnnnnntgtggagacgccggaccaggtgcgggagttctgagggtgtttaacaatggatgatgggcggtggattctctgaggcagtggatggcaaaagagatgcttctgggtgatacccgggcaaacatctcccactcctggtgcccccaggtactcgcgatcttcaacggaatgaaggcagatgggcgactgaaattttacatctgacgtaatgcaaggctaagacgttgtgtcctgcgaagggtaccgcgtggcactgcatgccatcagggtgcagcatgtagcgccgtgcaaggacgacgtctagcatctccaggtcaccgacagactcttcctgaggctgctcaaatgcaagaggcacccgggcaataactcgtcacctcaccttgagcccacgctcctgtaacaccgctgggacaagctctcagatcaacacatgatgttacaaggtgggtagacggggttacactacaggatgaaccgtccctttgggacatgttgggatggcaagagcatgcaggtgcactggatgagtgactgggggtttgcggggtcgatgcttgaggtgccgacgacggcggagcnnnnnnnnnnttgatgttacaaggtgggtagacgggtttacactacaggatcaaccggacccccgggacatgttgggatggcaggagcatgcaggtgcactggatgagtgacttagggtttgcgaggccgatgcttgaggtgccgacgacggcggagcgcctgccctggaggtgccgagggcctgcaacttgggcagaccatccaggcctcgatggccagcggcccgccagctcagtacacgttcatgatgtagctctggatgggttcccggcacatggggcagtttcgcacgttctggtccttcaggtgctgcgcacaggagcggcagcagcaccggtgcaccctgcggcatgaggtgcaggggaggaagcggatgggcgatgggtgaacgaagtgagtggccggcaggagggcctcctccgcatagaatcaatgtttgtggagcaggcagcatgcaatccagatatccacttgccccccctccacgacggccatgcatgcccacggccactggtccagtggcatcaggcccgccccccctccacacacacactcacgagtctccgtgcaggaagccggccgtggcgggggcctccaggcagacgacgcagatgccgtcgtcctcaccgtcgccgccccccgcgcccggcgacgcgacgggcgggcggggcgcatcgctcgccgaggcggcggccgtggcggctgg

SEQ ID NO: 40660 - DNA, 15517 bp, Chlorella protothecoides
  modified_base (959)..(968): a, c, t, g, unknown or other
  modified_base (1272)..(1308): a, c, t, g, unknown or other
  modified_base (3472)..(3481): a, c, t, g, unknown or other
  modified_base (3933)..(3942): a, c, t, g, unknown or other
  modified_base (4517)..(4526): a, c, t, g, unknown or other
  modified_base (4817)..(4826): a, c, t, g, unknown or other
  modified_base (5912)..(5921): a, c, t, g, unknown or other
  modified_base (7480)..(7489): a, c, t, g, unknown or other
  modified_base (8018)..(8027): a, c, t, g, unknown or other
  modified_base (8508)..(8517): a, c, t, g, unknown or other
  modified_base (8839)..(8848): a, c, t, g, unknown or other
  modified_base (8969)..(8978): a, c, t, g, unknown or other
  modified_base (10669)..(10678): a, c, t, g, unknown or other
  modified_base (11176)..(11305): a, c, t, g, unknown or other
  modified_base (11538)..(11547): a, c, t, g, unknown or other
  modified_base (12729)..(12794): a, c, t, g, unknown or other
  modified_base (12920)..(12929): a, c, t, g, unknown or other
  modified_base (13006)..(13015): a, c, t, g, unknown or other
  modified_base (13300)..(13309): a, c, t, g, unknown or other
  modified_base (14052)..(14061): a, c, t, g, unknown or other
  modified_base (14331)..(14340): a, c, t, g, unknown or other
  modified_base (14770)..(14779): a, c, t, g, unknown or other
  modified_base (15240)..(15249): a, c, t, g, unknown or other
gaaggggacggtgcggttggatcctcgaaccagattcatgccaaacttctgggacagggggggatgtttcacaggtggtggggcgtggcatgcaactgcgccgacccactgctggtgccgcgctgccgcgtgtgaggccatgaatacccaggcaagccacacatctggaggcttgcaccttgataggggtcccccatatgactggcacatttccctctgtggaaatggcagcagcactcagcccctgcctcagcgtcacagccatctcccacctgagagggcctgccccagggtcgtaagcgcgtcgcccaggcgagccatggggtgcgccgccagctccatgtgctgcagcgtgaagttatcggcggccaggagctcgaagcgccgccccgccagcgggatgactgcgcccacccagatgtccttctcggagatgagtgtctgcgagggcaagaggtggtagctggacagccgggcatggagcgggcggggcgccccgcacgccggcgtcctggagctaaccgttccccggccgccctttctcaccgcagtttggccggggacccaatatgccctggtccgctccaggaacttgctgcccgcccccccagcagccgccgcgggcggctcaaacacggagagggtgtcgtccgcggcaaagaaggagatcacgaacctgcggggcctgtggagcgatgagtacgggttagggagagggtctggccccatgtactcagcacatgccaggaggggcaagtggggtcactctttggccatgcatgtgggcaaaggagggaactgtgtccttgcacgcggtgagccgagataaacttgagagctgtgtgtgtgcagtaatgaggaagggaagggggggggttgaaagggcatgcacaagcacttgttactacattctttcccaccgcaatatccccctgccttctccaagcctccacccactnnnnnnnnnntcgtgtccttgcacgcggtgagcctagataaacttgagagctgtgtgtgtgtgcagcaatgaggaagggaagggggtgttgaaagggcatgcacgagcacttgtcactccattcttgcccaccgcaatcccccctgccttctccaagcctccacccactcgtcgatctcggacacgggcggggcaaaacaggcctggaacctaaggatgatgcccccgctgttcatgagcttgtactggtcgcgtttgggaggggtcgggacctgggcgtgcgcgcggtgttgggggggggggggggggggggnnnnnnnnnnnnnnnnnnnnnnnnnnnnnnnnnnnnnctgggtactcatcttgccgccggcacacattgctggagccatgcacagcgccccgttccagcctgcccgcaggcccacctccagcgctcaccaggcgcaggcaactctgcagggaatcctccgggtccccgatcctgttgtgcggcggcggcggcggcggcaggggcttcgccggcggcggcgagggaagccgcaccggctgcaggtccgcctcacttgcgccagcatgctcctttgcgacaggatcatgtggattggtgagctggttgctggggtgcggccaggcagtgaagcagtgacccacacatcactgtatccacagaaagcctccaacatcaacatttctcccctcccctccaagggagaggacaccgcggtgtatcttagggcttgccttgagccaggtcttggtgtaggcgtcggcatctcgcagcaggattggcctgccatgcacgaccaccttgcggccgatcccaaggtcctgggtggtcaggctgagtggcagcagtgctcccccgaggcaggccaccccctcgcccttgctccccgcctgcaagggccaggagactcaggtgggcgcttgagggtgaggcaggtgcacagcatgcacagagtgcagcgctggccagacgccccaacccagactgcaccggcgcccccatgccaagctaccgacccttcccgggctcaccggtgtgcgtcgcaggaagacatggtttccagcttcaccctcctccacgatctccacctgagccacggcaaggggggcaggagaactataacgccgcgatcagccaggtcacgacgcactcgactcaagcacaccagcaactgcatgcagcctttccagagccttggcatgaccaggacccctgtccccaccgcacacattgcaaccgtacttcgaccccgggctcgcaccgtgtcatcctcgagatagtagcggagctgcaggcggtgaacgtccccacacagcctgcccgtatcattccacaccgcgaagaagcggaggacctgggctgggcatgggggtgcagaggatggagaaggcatgcaaaggtgtcagtccaggggcccagccgcatgctggggccaagggcaccagctcctggggagctgaaaagtcagcctcatccagtctggtagccccgcacctggttgctgaactttagaaactgctgtgtgtgtctggaaggggcagccttccccagcgcaacctcggcataccgggtgggcgactctgccggggcctcacgccggtctgcacagggtggcaggcagaggcgtgggccggcctccgtccagcacacgtcttggcaaggtggcctggccccagcacaggacggtcccatcagcaccacacacacctgtcgagccggggcgcgacactgccccaccgtcggttggcgcctcgggcagggcaaggtcctcgcccaagtgcaggcctcgatcggagaagaaagtgcgggtgtaggtatccgcagaacacaggtggtactgtgttttccgaacacagatcgtgctcccaatgctgaagtcctccaggccaagaccacatctgtgccgagccaccagggttccctgcaagtgagcagggagcgattacaggctggggggcggcctggcttcagcttgtgccacacctgcacccttgagagcagcgcaggggccatctttgccacctcgcaatgatgtaccacccaccacaccacaccgccaaacctgcatgagtcccgagttggggaggcgaggctcggcaatggccagactgcaatcctccggccagaagctgacgactgccttgcgtatgtactccccctcatccaggatgccgggcaggacctccttaaaccatgccaagaagcgcagcacgcagtgctcgtactgaacgaacgccgggacaaaaggccgggtcgcctggctgagctcgatccgtgagggtgcaggagggaaagcgacatggtcggcgggcccacatgccggcttgagcgatgccacgggaacgtcagccacagcgtatccgttcttgaatgacaaggtctgggtgcgaggataccgggcgtccaagggaacctgtccgatgaggggcccatgtgcacatgtcaggtcagaggtcggcactttaaaacctcgcgccaggagcgacacactcaccggctctcgnnnnnnnnnntaaggtctgggtgcgaggataccgcgcgtccaagggaacctgtccgatgagggccatgtgcacatgtcaggtcagaggtcagcacttcaaaacctctcgccaggagcgacacactcaccggctctcgaaccgtgtatcctggtagaaatggaatgccagagtgggcgatgcctcctccctcacgcgacattgtcacggtgggtcagtcgtcgtgacctcgagcactactacatttcttgcgaaggaatgtccttgttttatacttgaattaattaatggatgtatgttattattttcatgatgctgagcccggtcgcagtccactgcgagggtttcgtagtggacatcggacctcaagatcgtctgccttcaaaggcgacgcacccacccatacccacccatgatcggacaccgtgatgaccttacatgctctgaagcagagccttctgagnnnnnnnnnnacgacattgtcacggtgggtcagtcgacgagagagcgtcgtgacctcgggccactcttgcgacacaagtccttgtttgattaaatattcaatggatgtatgttattgtcaatctagcttcatgatggtgagcccggtcgcagtccacggcattgcccatgaaaaagggtttcgtatcggacctcaggatcgtctgccttcaaatgcgacgcacccacccacacccacccatgatcggacaccgtgatgagcttacatgctctgaagcagagccttctgagatcagaatatcaatcagtgtgcctgggactctacatgcttcttgtacgcattggcatccagaagggagtcggcctcggaggggtcgctgagcttgatcttggccagccagccaccctcaaatggctctgcattgatctgcaggggcagcagcagcgggtgacaggagtcaaagacaagggtaaagacggtctccgttgagcatatttttcctcatccattgtttcaatgaggaggtaacaggcaaatcagcccccttcccctgaccatgcgccccaccttggcggggtcatccannnnnnnnnnatcaaagacaaggataaagacggtctccattgcgcattattttactcatccattgtttcattgaggaggtaacaggcaaatcagccccccttcccctggccatgcgccccaccttggcggggtcatccaccagggcagaattgacctcgatcacctcgccgctgaggggagagtagatgtcgctggccgcctgtgggaagggtccgaagaagggttaagaggtgggtcaaagaataacactggggcgcgcaggctaggaatccccggcacatgacgttcatgtgttcgcannnnnnnnnnaaagaaaggttgagaggtgggtcagagaataacactggggcgcgcaggctaggagtccccggcacatgacgttcatgtgttcgcaccttgacggattccacgacacccaggttggctcccttggacaggctggcgcccacctcggggacctcgacgtaaacaacatctcccagctcgctctgaattgatattggtggagggggggccttcggtgccccggtacctcctggcactgagaggcagaggtgatcatccccatcccgatccacgggatgcttcatgtcaggtgcagacctcatcatcagagactgaaaagggtccacatgtccgtacctgggcgaagtcggtgatgcccagagtggcaacatcgccctcgatcttggcgtactcgtggctctcggcatacttcaggccatcgatgactggggcgggggcacggaacgcggaattggtaccgggtacggaggtgtagcaggcggcaaagcgcagcttaccctaccacaacttcactaaacgactcacgcatggcctcacccgtggagtacgaccggaaaagggcagcctgcagcaaccccacaggggactgggtgagggccaggctcggcgcggtgcaccgaaggccgagaccgctcgcggcctgggatgccagctgccgaagagccatgctggacggttgggagtacagatctgggagtcgtgtggatgatggtgtgcctggccgggtgcacaccggcgcccctaagacgctgtcttctgatggtagggaaaccgagaggcgcgctcgcgctttccatccagattcccaaaattgttcgcaaaataaggacatacctgtcccgctccatcccagaccccactctcagcagcatgcctgacgagcccttagaatccggctggttctacgccacagtgccgcggagtggcggcctcccggccttcctgtcgttcgggagggggagcctggagaagacgacgcagagccgaataggcaccctcctcaggtggggccatgacctgacccatgcgatcctgttcctggtttgacatgcatatgaagccttgcccccttggtccccaacccaattnnnnnnnnnnatgttcctggttttatatgcatatgcagccttgcccccttggtccccaacccaattcccggacacgtctcatcacactcgctccccaccaggtccgcccccgtgcctccgccggtgcatgcattgagggggcagaccttcaacccctctcccgaggtctaccgctttggcgccggcacggccatcgtggtgtgccagtccccctcctcgggctccggccccggccccgcctaccaggagccggccctggcctccgaccccaccggcctctgcatcctggcccccggctcctacatctccaacctggaggagctggcggagcggtacgaggacgcccccgcgccccgcggcgcgccccaggacccgcgcgccgcggcggcggccctcatcctgcgcctctacgcccgcgaccccgaccccctcctcgtcctgtccgagctccagggcgagtacgccttcctgctgtacgactcggagcggcgcacggccttcgcggcgcgcgacgcctcgggcgcgctgcccctgcactacgagatcgatgccgacggcggcgtgagcgtggccagcgcgccgctccccgtccccgccgaggtgggcctgacgcactgggaggtggtgcccccgggccacttcctggcggggcgcagcccccgcctgcaccagttcgcgctcacccaggaccagctggcggcgcgggaggcgctggaggtcagcctggaggaggagtgcgtgtcaccgcgcgcctcgcgtgcttccctggactggcagagctcccagcaactggccttttgaagggagcctggagccctgggttgcgggacgtacgcgtcacaggcttggcccaggggtaggtgcatgcatacctgcctgcaggagcgggctcgagagccggcccttacattcttcacttgcccccccatgattcatgtgcgcccccacatcgtgcatttgacccatcacctcacccgtgtacactaggcgtccacatggtacatagcagtgcattccaagtcatgaaaagaggcggcggcattcctcagccgcgggagcagagagtcaaggtacatggacggtgcagggaggggtttcaaagtcccggccggaacaagaacaatagtggcacagggcctttggggaagggggggggaggggacaggaggcccatgccatgcacgggcgctgggagcaacgggccttgctggtcgggggaagggcaggcgagagactcgagcgggaacactgggaggccatgggattctgcactggaagcatggggatggctgcttcaccgacgtgcgccgcgccgtctcacgcctcctcctcgccctcccggatggcctcggccgagatggccagggcgcccgccagcgagctctttgccctgcgtgatgtatgcagggcgtggtgtgtggtggcgcgtagggtggtcgggatgcaagcgcgtagggtggtcgggatgcaagcgcgagggcagggcagaggcctctcgcgggaaggcatggcatcggcagaccccccccaccccccaccgacgacgcacctcacggcgatgagctcggnnnnnnnnnntgcgcgaggggcagaggcctctcgcgggaaggcatgggatcggcaagaccccccaccccccaacgacgacgcacctcacggcgatgagctcggtgacaaagcgctccagcttggccacggtgatgttgggcatgacgacgacgtgcgcgatgtcgccctggcaggccagctgccagcggcgcacaaagtcctcgtcggcggggcgctcgaacacgacggtggaggacagctcgttcaggctggtcaccaccccggcccgctccagcatggaccggagcaggtgcgcgttgcgcaggcagcgctccacgtccttgcgcaggccctcgtaacccttgcgcgtgaaggtgtaccacatgtagatgggggcgtgcccgttgcgcgaccccatgatggtggcgtcgcgggagttcaggtactccacgtctgggagggaggtgcggcggggatggggcgggtggtgttcagggtgtgtaaaggtgagggacgggggggattcagcttctggagtcctcaggaaccagggcaaggnnnnnnnnnntggggggggtggtgttcagggtgtgtaaaggtgaaagagggggggaattcatcttctggagtcctcaggaaccagggcaaggcccctgaagtcccttgtccagttgacaacagcatttgaacggcccaccaacaaggtgcaggggcaaggatactgtgcacatgaggtgtgcgtcgcgaatgaggaccgatgggcgtggtttgaaagaacacgacatcccggccagacaaagcggccctgtttcctgtgcgcagcgtagagtcacatcccagccacgacgcggggcgggccctgaagaaagggtcaccgccccggctcggcttggcatgccggcttatgtactgcgcatccctccccatgcacgggaatccccttgggctgagccctggaggccagacgccccggggtcaacaggctccccctctgaaagttcccccaatccaacccctggagagaaagtcccaatccacgccatcccctnnnnnnnnnnaccccggggtcgacaggctccccccctgaaagttcccccaatccaacccctacagagagaaagtcccaatccacgccatcccctggcctacgcgccgcacctgtggacagtgcctggatgtgcttcaggcgggtcatgaccacgccacaaggcacaggcgcgcccacgaacttgtgccccgacaccgacacgctcccgatgggcttcttgaaggtcaccatgggcgcccgcttgacaaaggggatctgcagaatgttgtgggtgggtggggttggggggccggagggaacgtacaggtgtatgcacacgcaagcatcatcgnnnnnnnnnntttggggggccggagggaacatacaggtgtatgcacacgcaagcatcatcgtcagcgacctccgcccgtgctgccctgctgccgtcagtgcctggttcaacatcccctacacacctttacnnnnnnnnnnccccgtgctgctctgctgccgtcactacctggttcaacatcccctacacacctttacacacccctgcaatctgcccatccctccctggggtttaggccccttctcaattcgccccccaacctctcccttatccccctcaacgtcacccccaacccccccccaaaaaacctcaccatcatgccgaagagcgcgccgtcgcagtggatgtaaaacctgtcctcgccgaagcccaggtcggccaggatggccagcacacggtcgacgtcgtccaccgcgccgcgcacggtggtgccgatgttcaggttcaggatggcgggcttgtccgcgttggcggccaggcatgcgcggagatggtcgtagtcgatctcccccgtgcccagcacgcccaccttgaccgcctccatgcggtacatgcgcgcggccttgaagacggagtagtgcgactccgcggagctgtacagcacgccgtcgggcagcgtctcgcggcccaccaggatgccgtgcaggttgccctccgtcccgcagttggtcacgtatccccagaactcatcctcctcgatctcccacagccgcgcaaaccactggagcacgccgatctcgaactcgcggctgtgcacgccatagtttgactcgatgaaggggtcgcccaggttgttgatgcagaacttctgcaggccctccagcgggccgtagtcaaagtccaggttgtacggatacctggttgtgttaggtcaggggggggaggatgtgatgtgagatgatggagtcaagggaggggcttggaacagcgtgtgcggggggagggtaggcaggacagggtcaggtgctgaggcacggtgagcggtgctgccctggggaggacccaccccagctccttgtgattcctttcatgaaactgcccagctcaacacagtggacccaacagcacccggcaactgcatgcacccgtctgcagcccagcacagcttcatacatcatgccgacgcaccccatgtggtgatccgtgcggtcctccagcttctgtcggtagtcctcgatgacctgtcgcacccgggcctccagctcctgcggggagccgctcgggacggacgtcacaccgtgtgccctgatcgcattggcactccaagctcccagtaaacccctcgcacctcctggcccagctccccgacctccatgaccggcagggcagcggtgaggttgtgcgtgatgacggcggaggtcacaggcctggcctggtatggcacggtgggctcatctggttgccgggaggtgaccgaggtgctgcttgctttccggagcttggaggggctccgatcggtgccagcgggctggccgacgggggtgggcagggtgccgctggaggacagcgccaccacaacctgtcccagggtgtcagccatgatgcagaaatgcaaagtcgctggttgcaatggatcacatgtacagtggggggggggcgctgtacatgatgatcgcagaggttccccgggggagcgtcaggacgtagaagaaagtcagacgcggtaacagctttaaatggtacgattctcctgcaacagaacttctacacaagtccaccctccctccggcgagactactggactgtcctccactgcattgcaacatgcataacgaggaccttcagcagcaagtcgatgtattccaaggtgcaggaaggggccacatgcttnnnnnnnnnnattcattagcaagtcaatgtgttccaaggtgcaggaaggggccacatgcttcagatgcacgcacccgagtgccaggcatcctgtggaggactgggatgtggcccaatgtttgactttgccccatgagtgatttgagttgcgtggcagatactccaggttgacaggcaggggcatgccccagaagcttccatgcatactttggtgcagagagagctagccacggagcctgtctttgtgcagttttttacgtatttcggcaacatctctggatgtacgtaagacacgcaggtaaatgcgcgtgctgcgctgtaccgtatgttggccctgggagtgggtccagagctggtggcccggcgcgtccgtttcagcaagcgaagcctgcgcacgagacggagagtttccctcagtcaaaagatcatagtgacaagagaacgggcgtacgggtgtgaggaaacgaccaacaggtgtcgccaattaatcatggaggccaaccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagggcaggacaaatattctgtgttcaggccacgcatcgcacaggtacggaaatttttctgggagattgcgtgcagcctggttccccatgtactcatcgaactatcggacaatttcaagcgcccttgcgtctcatacacaccccccggtcgcaatcccttctatccgcattttgcacacatcgatgtcgttgccttgaggcagctacggatccttccaccaccatttgacnnnnnnnnnncagtgacaagagaacgggcgtaagagtgtaaggaaacgaccaacaggtctcgccaattaatcatggaggccaaccccaaatcctctttccattcgcggtatcaacggaacgcaaggggcatacatacaccattatcggatcgaacacggatctttcacaagtaatttctgaacccaacaaggtgtatgtcgttgtgagggcaggacaaatattttgtgttaggccacgcatcgcacaggtacggaaaatttctgggagattgcgtgcagcctggttcctcatgtactcatcgaataatcggataatttcaagcgcccttgcgtctcatacacgccccccggtcgcaatcccttctatcagcattttgcacacatcgatgtcgttccctcgagacagctacggatccttccaccaccatttgaccctgggatccgtgtcggacttttcgatgtctgctgctggggcccctgctggtctgacaggctgctagtgagctcgaccaggtaaggagggaatgcggtggaagatgcacatttggaaagccgagatctttgctttgattcgcaccacccgcggcccgtcgccctctgacgcagcttcttactgggtgcgagaacctgcacgtatctcggccgattttgtcctccgattccccgtcgggcggaaagatatttgcccgcgcgagtctgtcgaagaacagtatagaagcacccgtccgcgaactggatctccactctcgcagtctacacgcaatgctcaaacgttccgtccagtgggccagtcctctcatcagcgacaccttcgttatgcccggccagacctcaggagctccacggaccttggtagctgcatatcagggccaagacaggctaggaatgccctccataggcctctccgcacgcgcagcctcaggtaatcggcgctttcgcgacatgtacacacacgcggcaggggccgatgaattgttttggtagggacggcgcacgcgattaccctctgacctagctcgtttacctccttgcagcgttcatcctgccgaggcctgcgtccgagactctgaagggagtgaacctgtcaccggccccggacgtggacgtcacgagcccccccggggtttcgcccgcgaattccccgacctcggtcagcagctctgacgacttcctggcctgtgggctgttggcnnnnnnnnnnnnnnnnnnnnnnnnnnnnnnnnnnnnnnnnnnnnnnnnnnnnnnnnnnnnnnnnnngggtcctgctaattgcggggtctgtccctgcatggagcactgtgtgcacattacagagtaggtcgcactttgttcacgaccaccatccctctccgtcctttgcaggtggatcgccatgcgttcaannnnnnnnnnggaggagctcgccgacctccacgagctcgaacggacgttatcgagctcgaagactgtcagcatgagcatccaggtgnnnnnnnnnnaagtaggtcgtactttgctcacgaccaccatccctccccttcctttgcaggtggatcgccatgcgttcaagtaggctagatagacaaggccaccaggcaatccacacacgcagttctgcccttttccccgatcttcctccttgaggatcacccttcaatgcatctcttcttgcagttgccttcaaaacaggctgggacatgcctgtacagcacggcatacaatgaacataccatcaggctctccaccttgcctgagcactgtgcttgcaaacctcaccgaacctnnnnnnnnnngggcagttctgcccttttccccggtcttgctccttgagggtggtcacccttcaatgcatctcttctcgcagttgccttcaaaacaggctgggacatgcctgcacatcacggcatacaatgaacatatcatcaggctctccaccttgcctcagcactgtgcttgcaaacctcaccgaacctcccttgtcagatgttggttgtcttagatagttacctgtttccttacatgcacctcaccctgtggactacagtgttgtgcacagttttatgtggccttgagtgcctcaatactatgtaaataagcactgtagaagtgagtgaaggggacatcgtggcaggttaagaggaagggaacccaggttgatacgaggacgcggagcgagcgcgagtagtgattgccgagagtagtgcagcgagataaccggtccgtccgagctggcagagtcaataaataagccagccagccgacgtatcatcttcatacgtggtcaagatgtcgaaatgtcctggcgccggctcgttgattcgaacgacggagtatggttgctgagcagggctgtccacccctgtcacatgagacgcatccacccaggagctcgatcgagcgcagggcgagggccccggacagcgatgccacgctgcggggtgaggaatgcaactgcagtcccaatgagtcgcccgaaacgagctggagctcacagggcagccctgagcagagccaaggcaagagcaggctcctggcnnnnnnnnnntccccgtacagcgatgccacgctgcgggatgaggaatgcatctgcagttccaatgagtcgcccggaacgagctggagctcacagggcagccctgtgcagagccaaggcaagagcaggctcctggctgtcacgttgcaaggcacggtccggggtatacattgtatccttcgaactgaacctcaaaaagtcgcacgcactgtggccttgatgcagagaacaatgaggtgaggccgcccaatgcgcacctgggcccgaacccggcagtagagnnnnnnnnnnatggccttgatgatgcagagaacgatgaggtgaggccgcccaaggcgcacctgggcccgaacccggcagtagagccggatggcacgggtgatgcacgctccagcgcggcgtgccaagtatgcggcgccccgctggagcacatgcacttcctggagcaggtttcgcacgtcaagcgctgcatggggggccgcagggctgcgaggaggtccgcggcagcggggccccgtcgccacgcgagtgcacctgctcctccccgcagcctgccagacgtgctcaaggtacgcggcgcgggggctgaggccggcaggagcattgcattggtcgaggaccccctccccctgctcatgatggcacagccctctcagcccagatcggtacagagcctcatgcccatgtggcccccaactcaccgcaggcggccggcctgtcnnnnnnnnnnagcgcggggctgaggccggcaggagcattgcattgatcaaggaccccctccccttgctcatgatggcacagacctctcgacccagatcggtacagagtctcatgcacatgtgggccccaactcaccgcaggcggccggcctgtcggagcacgcgcccgcgttccagcgggcagaggtcacggtcgacatcctgcacaccctctccgacgctgagctggcagagttggggatcacgcaggccggcgccaggcagcgcctcctcggctcgctgacgtgccggccggcgccggctccggtgcccgggtccaaggccctgcgccccctgcgccaggtcctgctccccattcagctcccctggaactcccccgcccccagcgcagcctggctgccgtgtgctgaccctgttcgcgactgcagccctgcgccggcagaggcctcgggccgcgcctgggaggcggcgnnnnnnnnnnttgctgaccctgttcgcgaccacagccctgcgccgccggaggcctcgggccgcgcctgggaggcggcggccctctcgcccctgcgccgccgggctccccgtgccagaccaatcgccggccccgtgtccccgccccgccgtcgggcgcgtctggcttgcctgggtccagagacacagctccccccggggtcgcgcctggtgtccccgccccgcacgctgtggcacgctgcggggacgtgcagcgcgcgcggcgcgggcccctcagcctc

SEQ ID NO: 40661 - DNA, 48754 bp, Chlorella protothecoides
  modified_base (4424)..(4433): a, c, t, g, unknown or other
  modified_base (5026)..(5035): a, c, t, g, unknown or other
  modified_base (5941)..(5950): a, c, t, g, unknown or other
  modified_base (6972)..(6981): a, c, t, g, unknown or other
  modified_base (7548)..(7557): a, c, t, g, unknown or other
  modified_base (8929)..(9041): a, c, t, g, unknown or other
  modified_base (9649)..(9658): a, c, t, g, unknown or other
  modified_base (9791)..(9800): a, c, t, g, unknown or other
  modified_base (10228)..(10237): a, c, t, g, unknown or other
  modified_base (11440)..(11449): a, c, t, g, unknown or other
  modified_base (12228)..(12355): a, c, t, g, unknown or other
  modified_base (12589)..(12598): a, c, t, g, unknown or other
  modified_base (13466)..(13475): a, c, t, g, unknown or other
  modified_base (14507)..(14516): a, c, t, g, unknown or other
  modified_base (14671)..(14680): a, c, t, g, unknown or other
  modified_base (14748)..(14757): a, c, t, g, unknown or other
  modified_base (15856)..(15865): a, c, t, g, unknown or other
  modified_base (16121)..(16167): a, c, t, g, unknown or other
  modified_base (16391)..(16400): a, c, t, g, unknown or other
  modified_base (16558)..(16567): a, c, t, g, unknown or other
  modified_base (16694)..(16703): a, c, t, g, unknown or other
  modified_base (17973)..(18082): a, c, t, g, unknown or other
  modified_base (20009)..(20018): a, c, t, g, unknown or other
  modified_base (20464)..(20473): a, c, t, g, unknown or other
  modified_base (20694)..(20703): a, c, t, g, unknown or other
  modified_base (21429)..(21438): a, c, t, g, unknown or other
  modified_base (22233)..(22242): a, c, t, g, unknown or other
  modified_base (24552)..(24561): a, c, t, g, unknown or other
  modified_base (25106)..(25115): a, c, t, g, unknown or other
  modified_base (27885)..(27894): a, c, t, g, unknown or other
  modified_base (28404)..(28413): a, c, t, g, unknown or other
  modified_base (29010)..(29019): a, c, t, g, unknown or other
  modified_base (30045)..(30054): a, c, t, g, unknown or other
  modified_base (30562)..(30571): a, c, t, g, unknown or other
  modified_base (31248)..(31257): a, c, t, g, unknown or other
  modified_base (32077)..(32086): a, c, t, g, unknown or other
  modified_base (32464)..(32473): a, c, t, g, unknown or other
  modified_base (32678)..(32687): a, c, t, g, unknown or other
  modified_base (34999)..(35008): a, c, t, g, unknown or other
  modified_base (35361)..(35448): a, c, t, g, unknown or other
  modified_base (35675)..(35684): a, c, t, g, unknown or other
  modified_base (36193)..(36202): a, c, t, g, unknown or other
  modified_base (37754)..(37763): a, c, t, g, unknown or other
  modified_base (38469)..(38478): a, c, t, g, unknown or other
  modified_base (39675)..(39684): a, c, t, g, unknown or other
  modified_base (40375)..(40384): a, c, t, g, unknown or other
  modified_base (40467)..(40476): a, c, t, g, unknown or other
  modified_base (40998)..(41007): a, c, t, g, unknown or other
  modified_base (41543)..(41552): a, c, t, g, unknown or other
  modified_base (42308)..(42317): a, c, t, g, unknown or other
  modified_base (46419)..(46428): a, c, t, g, unknown or other
  modified_base (46641)..(46650): a, c, t, g, unknown or other
  modified_base (47175)..(47184): a, c, t, g, unknown or other
  modified_base (47682)..(47691): a, c, t, g, unknown or other
  modified_base (47776)..(47785): a, c, t, g, unknown or other
  modified_base (48027)..(48036): a, c, t, g, unknown or other
  modified_base (48565)..(48574): a, c, t, g, unknown or other
ccctcctcgccccccgccgccgcctcctcggtctcgtagtcggccgggttcatccactcgttgtgcttctcggagtcggccagccagcgcgagtagacgcgccaggggccgcgcgggcggcggtcgggctccacctcctctggcgcggcggcggccggcagccactcgtcgtaggagtcggggaggtaccaccagtgcacgcgcaccaaggctccccgtttctgaaagcgtgtgtgtgtgtgggggggggttggggggggatgaggagaggagggttgacgtgggggtggagcgtgggagtccgcgacgcgactctgggcagcaaggcgggagcgcaggcggctgatcgatccggaacctgccccaccacagggcagtgtgagggacagcgactggaaccagcatccgctgcatcacagcgtacttgacatgtgcagtgaagcatggtctgtgccttcttcccacccttacccttccacccctcatcctggacatcacaagcccccgcacctccagggcccggaggtaggtctggccgtcgtccgggtcgcccttggggccaaaggggtagacgacgtgcgtgaccccgggcgtcgtctcgacgggggccacctcgccgcccaaccgcgtcaccgcgtgcgtcaggcgcagcgtctcggaggcgcaggaagggtgtacgtacacgcggggcgggcgcaggtgccccgccctcagcagctcctgcctcagccgggacaccagctccaggttctgttttttaaagggattgggagggggtgagggtgagaggaaagatgcggtgggactcagggagacggccggttcatcacacagcgcagtcctgatcccacccgcaaatccatgagctaggaccgcccctcacctccttgcgcagggcgggtgaggcccagtcgatacgcttcatgccccggacgcgcatggcgttggcgcagacgctggcgatggtgtgcaggggcccggagggcgaggtgtcatggaacaggctggcaggcagcttgggctgagacttgtacatggactgcggggatggggggaggagagaaccagttgggaggcagggcaacccccccagctgtgggcatgtgcttccttgggtccaggaagaacatgcgattccctgaaagcaccatctcccagccttgggtacccagcgtacgttgatccccagcgcatcctccatgaactgctgcagcccagcaaagagctgggccaggccccgacggtcatgtttgaaggcagtctgcgtctcgttcaggctcgccaccagcttgtccaggcgcgacagctgctcctcgctctgctcgtggatgatctggtcgagagtcgggtcacatcccgcactggatggcgagccagtagcatgccaccgtgcaagtgcgccatggcgcactggcacgggtccaggcactcgagtgctgtcacacacatccagcacctcgcacctgtgccagctcgagctgaacgttgccattcctctttccctggtcccccgagggaccctgcgctgccatcggcaggcagctctgagcgcacaaggccccaagccaccgaatgctgctcggggatgaccacgggcagcggcccggaagacagcaaagagcctcagaaggcactaacggtagaacgtgtcttcgattattgtctgacagagtcctgttctgtctgggcaccctcgaggagcagatgcctgcatgcgctttccctgtcgggagatcctccaaaagtagattgttttgttgttgtgctgggtgcaggttctttcttccgaaacgatcatggagtcacattggccttacaagctgcagacgatccccttggtgcaaagaaaaattcaaggtagtcccctctcatatcaaggtatgagctgctcgccagccatattggtgaaaggcacaccggctgatggctgccatggagtactgcccctctgcaacagatcgccgtgatgccatcaagtatcctgcgtccatgcatgaacaaaaaacaagtacgcaatcctgaacggattttggcaaatcccatcgtgttcttggcttcgtttcaccaggctttgaccaataccttgtggcggcacactgccccacaatcagtgtaccatgcagttgcctttagaaaggcccgatttgcacatcgggcattaactgacccctcatggaaagtaagcagaaccccagagtaaccctgtgcaggttgcatgttcctgacgcatcatgttcctgcctggttgggtccggcacgttggggagtttacgaaaactcggcaaatccaaattgcccgatgcggaagctgtgcctggataatgacccatcgtactcatcccgatgggcaaatgcaatgtttgattttggatgacggtgactgctccttagcgatgctccctcggtagtcgacgtcgtcccccaagcacccaatgccccccgtggaccccttgctgacctccctctccgcctgctggctggtctttgccacgactgcaccgacaacatacgttgtgggcgccacctggctgcatcgcacccgcaatgggaacaaggacccccgccccagccagcccgggtgggggtgggggtctgggggtggggtccggaccctcgtgttccaggccctcagcctggtgacctggctcctcggctgcgccgtggcctttcccgtcgtctttagcgtccaattggaccatgcagacgtgacacgtgagctcctggccggagcagcggcggtgggtgctgtctcagcacagctgttccaggtgtcggccctgctcagctttgatgccggggccaagcccctccgcatctggtccggcctgcaacagggccaggtggacgtcatgtgggatgtcaaaaaggtgggtgactggtttctactgccgcgggagggttgagcgcgcacggggctcaagatcctgttgcccaggtttggcaccaggacaagagttcaggaacccagcaatgaaccgctcactaacccagatgcttgcctcggacccttgcaatttccttcctgccccccctttgccaccatgtaatccttgcaagcacactccgtcgcccctcttggtcggctcttgtgtttgtctcctcgccgccaccccccctcccacatcccccttcgccccagctcccctcccgcgccgccgcatcctacgtcgtgatcgccatgggcacattgtgggtggcgctgggcggcgccctgctgtacctggggtcggaggtgctgcatgatgccagctcacgcctggcctacctcgtcctcgccgtcgcctgcctcaccatggccgccttcaccacctacggcctggccgggcacctgcgccatgccccggccctcgccgccggcagcgacgacgacagcgactcggggcggcgcgcccgcgccccgccctccgcctggcgcttcttccagcccttccggggcggggcctggtttgtggcgacccaggccctgggctggggcctcttctcggcgggcctcaccctcatgctgtacctcattgcccaaggcgcagcgggtgtgatggagggcgcccggcgctacacctggacggcgggcgccatcatggtcaccgcccagctggtgagagatgttgggaaaggggggagagtgggaatgggggatgaggtcccttggcggccagggggggctccggaatgaccttgctaaggttggaaacggatagtatcgaggcacctgttgcagcccctatgcctccatgcctagttatcaaggggtgagtggcccgaccggcactctatgccttctgacggcatgccacgctgtcctctgcctgactccctcccctctccgaaccaaacaggtcctggccagctccctggtcttcttccaggggccgcagcgtaccatgcagctggtcaggcaaatcagcatatccctgggcgaggaggcgcgcccccgcaatttgcgtcagcgccttgaaaatgtggcgaccatcatcatcctgtacattccggtgaggaggctggagcggcccgggttgccgcgcctgttcaaaagtcaatgacgggaaggccagggtgttgttcaggatcagcacaggtccaggtctgaaggttggttcatgtaacctgagcagctgtcctgatttcagctgatcatcacagtgatcctgataggtcaccgccccctcgcgcccccccacaccctcccctcacaacagatgcacgtgacatctgcggccatggctgcatacttcttcttcctgccacctcacattgctgtcaccttgctgattgccacgctcttcgtttactacaccgtcaccagcctgggaggcgcgcccgaggtatcaggtgagctggatgtgtacacagggcgcaaagaatgccgtccagagaatagtctggatgtgttgtattccagggtctcatgagcccgtccgcctcannnnnnnnnnctcgggtgagctggatgtgcgcacagggcgcagagaatgccgtccagagaatggtctggatgtgtcttgttccagggtctcatgagcccgtccgcctcagcaggcctggccaaggcagtgtgcctgtgcctgattcagccatctgctcccctgttcctccctcgcgtgcccacaatccaagacaccacacccccgctcatccctgccctgtcccgcctcttgtcctcaaccagggcgccgggagtggcctgccttccaggactggtttggccggcagctggaggaggtgctgcctgcctggctggggtcgctggaggtggtccgggagggggcctcccagccgctggacccagagaaacgctatgtctttggctttgcagcgcacggcctctaccccctgggtgagtaaggaggggggaaaggagggagggtgatcatgtgaaccagggtcgtgtgagctggtccctccagcgactgtgtcggggctcagcacctgcagcggcatcggatcgggtacagggaatggtgaggtacggtccccctactctttgcccatgcgcttatgtgtccatcatgagcgcaccacagccacnnnnnnnnnngcatgtgaaccagggttgtgtgggccggtccctccagcgactgtgtcggggctcagcacccgcagcagcatcggaccgggtacagggaacggcgaggtacggtccccccactcttcgcccatgcgctcatgtgtccatcatgagcgcaccacagccacccctccgacacccgaatccgctcctatgctcacaggggccggctacctcccagtgctcccctccttccggcgcctcctccctggcatccgccccgtcaccctcaccgcctcggtcgtcttcgtgctgcccgtgctgcgtgacatcctggcctggctggggctgagggtggtcacacgccgctctttcttgcgtgccctgcgcgagcggggctccgtcctgctcgtccccggcggccaggccgagctggtgcacacccaccgcatcttcaccgcccgcgagtactgcgtgtaccgcagccacaagggtgaggcgctctggggcggccccgtgcctcgacgccgctgtcttggtcactcacacgccatgcctcggagcgccccatcgcaacgccccgcacgcccaccaaattccacacccgcccacactcgaatgcaggcttcgtgagggtggcgcagcaggcacaggccagcctggtccccctcctagtgctgggcgagatcgactccctgcgcaacctcatcagcgccccggccatgctgcagtggacctacaagcgcctgggcttccctgtgccgtacctcatcgtggggcggtggggcctgacgccctttcctcagcccacgggactcaggtaggggtcctggggtgtgtttacctggtagggaagctcttggcctggaagaggcttgcatgcaggagtgatgttttcacgcgaggtttcagtgcaagggacgccaggcagacctnnnnnnnnnngtcctggggtgtgttttcctggtagggaagctcttggccgggaagaggcttgcatgcagaagagatgttttcacgcgaagtttcagtgcaagggacgccaggcagacctgccaggcagctccccgcacaggagggatgtggctggccattcaagtagcattgcccaagccagacactcctacactgtggtccacccccccgcagattcatcatcggggagcccatcccccccgtcgagctggggccgggggaggagcccacccaggagcaggtggacgctgtgcatacggcgttctacgacgccatgcaagcgctgtggcacaagcatgcccccagcttcccggggtacgatgacgtgaagttcgtcctggttgacaagtagacagccctttactgagcactgcagatcatccctctgaggaggcccatggcttgtgctgaccgctacatgctggcccccaggctgcatggcgtgggaaccccagcagatgcaagggttgccttactgccctgtatgccccagacaggagagaatgtgaggcgtcaagcctggcctgagacacaaatgcactgcctagctgcacaggaatggtgcctaatctcgttctacatcgccgtgcttgctactgatccatttattgtccgactccccagacgttcctgtcctccaccaatcggacgactggcccacactcgctagacttccatgactgctcagggttatttctgggcattgagtggctgtatgccgattcagaggctttgtgaaggggactgggcggtaggccctgcctgtacaatgtaagaaccatttgctcgaagggaatgcggttttgggtcaacctgtctgcaccctgctagatttggatagacacccatggcatcacatctacaagcatcctcagcacgagagtcaacacatgagcaccctttcagcaagtagacaatttgattgacggcattgtttgggtcagagagttcaccggggcctagcagactcctgagatcgaaatctagaaagnnnnnnnnnnggtcaatatatgagcaccctttcagcaagcagacaatttgattgacggcattgtttgagtcagagagttcaccggggcccagcagactcctgagatcgaaatctagaaagatctcgctccgtgacaaagacacacgcactgagcaattgggcgcatgcgcccatcgatctgccttcccattacaccaactcaattttcaatatgtcctgatgatcggggtaatgcaggtgatcgtacctgggcgcttcatcaagtctgggaccccacggggtcgtccgacaccccctggacggaggatgaccgccgtccccacccccgcggttccccggctaaaggacaccatgactgaggcctatttcaatgagaggctggaggggcagggctggccccgcttcgatgccgaggtgagcaacaggttgttgggttgcggagggggtagttccgacaaagttggctggaggacatgaacggcgccttctccacatcattaatctcccccctggcccccaacccctaaccccccagaaagcgaatgccgtggccagggaggcgtggcaggcgctgcannnnnnnnnntcaggttgttgggttgcggagggggtagtttcgacaaagttggctgggggacatgaatggcgccttctccgcaccattaatctcccccctggcccccaactcctacccccccagaaagcgaatgacgtggccagggaggcgtggcaggcgctgcagcacatctacgggctgggcgtgctggagaccccgctgctgcgctcgcccaacttggaggcggcgtgcaccgactgccgcgtgcacctgaagctggagagctcccaggccacgggcagcttcaagctgcgtggcgcgacccacgcgctggcttcgctgggcggcgctgggcgcgtggtcaccgcctccaccggcaaccatgcgctggcgacggtgcaggcggcgcgcgcgctggcgtcccgccctgaggcccccgccctggagcccgtcatcttcctgcccaacaccgtcaccccgggaaaggcgcggcgactggaggcgctgggagcgaccctgcgctacgcgggcgacgattgctgcgacaccgaggccgcggcgcgcgccgccgcggcggccgagcgctgcccctacgtcagcccctacaatgacctgcgtgtggccggtggccagggcacggtcgcgttcgaactgctcatggccttgccccgtctgcacgctgtgtacgttcccgtgggcggcggtggtctggtctccggcatcgcctccgtgctcaaagccgtggacccgtgcatcaaggtcatcggctgccagcccagcgcctcggccgtcatggccgcctcagtggaggccggccaattgctgcaggacgttatcagcatggagacgctctcgggagcgacggcaggtgcgtgctcaggagtggctaggggcgggacatgggagcgcaatggtggctggggtaccactatggtggcaggactcttgggcctcccgcctggccctgtgtactcccagcttgccacggccgccgtttcttcttcacctaaatgttttgtgtgctacagaacatggcatgcgcgagcaaagcaagcccatgcatagtgtgcgccccctcctcccctcgaccacacaggcggtgtagagcccggcagcctgaccttccctgtctgccgggatctggtggatgagtgggtccaggtcagcgaggaggagatcgcggcggccatggtggacctcgccagctggcacgcgctgagggtggagggcgcggcgggggtagcggtggccgccctcctacggcatgtcccggggctgagaggaaagagcgtcgccgtcgtgctcagcggcggcaacgtcagcgacgacctgatggaagaggcgcacgggattgcaaggcggagccgaggggccgcgccagctcagccgaggatctaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatggctcgaggtcccaagagctgggcagggtgtcgtctggcgacggcgcgcatgcccctgcgcaggcacaccagccagcggcctggatgtttcgcccagcgtgaccagtgctcaagcgcccggcgcgggatgcggcctgccatgggcccggcccttcaagcccggggcttggagattagcgggcgtggacgcgcactgaacttatacttttccctgaccacgccgacgacctgttgattggtgggcatcgaagactgtgaatactcccagtttgttgatgggcatggccagggcagcactgtgaccatcccgcgggccactacccgcacctggggtggcctccaactcagcacgcctccaaccaaccccacctggtacccagtgctgcccccgctggtgtccttttccaggatcgcgaatggtttttttaggggcacgcggctgccctccagctggtggtacccaatggtcaggaagatgcttccctgcagggcgaggcagactggcatgtgcggagcagggccccatgggaattgtaaagcagctaggcaccaacctggaacctaccagcactcctgatggtagctcaccgtcgatgaggtggnnnnnnnnnncgaccatcccgcggggcactacccccaacctggggtggcctccaactcagcacgcctccaaccgaccccacctggtacccagtgctgccctcgctggtgtctttttccaggatcgcgaatggtttttttagannnnnnnnnncccccatggggatttgtaagcacctaggcaccaacctggaacccaccagcacgcctgatggtagctcaccgtcgatgaggtggacagggtaccgatgtcaaatttctcatccagtcccccgccgtccttacgctcgatctccccctgcatctctatcatcgcccaggcaggcaactccccgctagcaccagacacaggcaccaacatgacaagtcaagctcgtgcctactcgaataaagttacgctagatggagggtttccatgtgccgttggagcaacgatcaatgcactcttcctgatttttgtcctcttgatgtgctcggggggacgacaatgtcgctggatttgaaagtggtgcacgatgcccgttcgggcgcgattgacgaaactttgcgaggcatgatccaggcccccacgaagcgcgcagnnnnnnnnnngcttttcctgattttttgtcctcttgatgtgctcgggggcacgacaatgtcgctggatttgaatgtggtgcgcgatgcccattcgggcgcgattgacgaaactttgcgaagcatgatccaggcccccacgaagcgcgcaggacgaattgtaacaaacaccgactctaagaccgccagtgattacgtataaggactggttccgcagtgggactgcctcgatcgctgccctgctcacccaaacgacagctctaccgagaactcgtaagttgctcggccagagtatggcccctgcttccaaatgtaagccatccaaggccgacctcatcggaaggagggtcctggtgcccgagtcggtgtggccagacgagccaccaccagccggaaaaaagggttgggaaggtgagcctcgttcggacccgctcacacacacccggcaggcgactgtgccacaactcagctttgcaccggcgctccccatgacacaggcactgtggagcatgcgcgggggcccaatttcaagtcgttctacgtaagcttccccaccgaccccagcacctactggttctccgctgccgacatccaaaaatggctgctcccgaagtctgcaaaggactccaagcgccaggcactgttggcgcctgccaagaaaaggaggagtgatccgagcgcagacacagcacctgcccagagggggaacggcatgcaaagcgcagacacagcggcagcccctcagcagcaggatgtcaacaccggcgcacgggcagaaggtgaggcggctcatctgtgagagccggttgctgctgatctgtgcgaatgcatagtccgcactggaacacttgcttcaggcctgtgtccagagggatcccttgcctcagacttgcccccttcgacccccttcaggcccagaagagccggggatggggagcgtctttgcgcagcctgaggagccagcccccttcggcttcccccccgcatccatgacacccgtatcgacagggcgaccgagtctggatgccctcattgacgtagctcaggcgctcacggacgaggacatgaacaggctgacgcacaaggcaaagaagctcaggtcgcggtccctcaatagatcctccttgcccagggacgccggccagtgacacccatgacctgccgcctgcacaaactgatctccgaaattgcacggcactcttcccttgactttcnnnnnnnnnnccctccttgcccagggacgccggccagtaacacccatgacccgccacctgcacaaaccaatctccaaaattgcacggcactcttcccttgactttccatgaccgcctgacatgctttctgcaacgcatctaaatcagtaaaagccgacgcagaggcaccctctcgtcactgcagttcctccttcttcactccttcgccagctctggggctgtggtatgaggaaggacaccgttgaagcacaggccaacctcccctgtaatgacccatggcatgattaggtatacgatgcccgagcacagatactaggtttgcaaccatccacacgtaaccatgctgacctgagctttgaggcgtctccgttgccaccagggctatactgggggctggtgggggagtattgcgggctggtgggactatactgcgggctggtgggactatactgcgggctggtgggggagtactgcgggctggtgggggagtactgcgggctggtgggggagtactgagggctggttgggctgtactgcgggctggttggggagtactgcgggctggtcggactgtactgcgggctggtcgggctgtattgcgggctggtcgggctgtattgcgggcttgtaggcctgcaaagtgttgatgacataagttgttgattcaaaaccctaggagcatcatgtgcatccatgatcagaccccccttctcggactgctgaggtgaaccaggcatacccaggacaacgtgacttacgagtaggctggacttgtgggtgagtaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgggctcgtgggcgagtagccggggctggtgggcgagtagccggggctggtggggctgcgaggtggacagggggatgaggggggggaggttcagggcatcgtcccatcacgctctgatgctgtccagggtcccctgccctgcccgtcatttcaatcccttgtatccctcccgcgctcagcagacccatccccctccccccaaaacccaccaccagcaaacacacctgtaccnnnnnnnnnntgtcatttcattcccttgcatccctcccacgctcagcagactcattatcccccccccttcaaacccaccaccagcaaacacacctgtaccccgggctggcccctcctggggagaacatgacgtcacccgccggggagaagaggacggagtcgtggaaggggctctgggagggtgacatgagcgcggagggcgaggccctgcccggggtcatgagcggcgtgcgccccggggtcagcccgccgccccaggccgcctcctcggcaaaggcgtagtccagctcgatggcgtcggccagcttggcctcgtccagcatgaggccaaaggcccccgtgcccacggggcagagctggcccagcatgatgttctccgacacgcccgccatgtcgtcggcctccgcgtacgccgcggcgcggcacaggatctccaccgtctcctcgaaggaggcctggtgaaggggcccggtttcgtcgcggttgatgccgtgccgcgtgatggccatgaagtagccgcgccgcgtcatggagtccaccagggagctcaggtggcggtagttgacgtaggagccgtcgaactcgatcacgccgcgcaactccttgagcagcgcattgcgcgccgcctcgatgcccagcacctgcaggatctcgatcacgtcgttgctcaccgtgcggctgaagtcgacgtccgggtggcacatcacctccagcaggttcacgcctggcggttgcgtgggggtgtttgtgatcaggacggggggagggaagcgggatgtgagggggatcatgggcagtgtcctggggaccagtgatccagacactggcctctcccaggcagggccagcagggcccgacccacgtccaactcacagctnnnnnnnnnncgttccagacactggcctcttccagggcccgacccacgtccaactcacagctggccatcccacctgcgcctgccatcccccccccccccacacacacaaaaaaaaacagcaacgacgacgacgaacacccaccttcggtgtccaggacccactcagtgtcctggacgaagccgcggccgccctcctcgtccagtcgcgtgcgcttcgcctcgcgcaggaacaccttgcggatgccctccacgccctgcagccgcacctggctcagcatgctggtctccaccttcttcaggaacacgtcgtcgtcctcgccctcgccgccgccgtccttgcccgcgccctcgtcggccatgacgcggatgcgcaggatgaggcggtccgcgttgtcgtcgttgaacaggcagtgcagctcatcctcgaacccggagttgatgcgctccgccacctcgctgagcaacagcttcttgtccaccatcatgtcgcgcgccagctcgatgcgcagcagccagggggacatgcgcgacgcgtccacgtcgccctccgccaggtcccagtacgccgccacccactccgcgtcctccgccaggtgggtggagcgcgggtcggggtcgtagtggatctccgtggccgcggtcacgcggcgcagcgtcgtgaactccagcccgcactgcaccgccttggccgcctccttgtcccgcaccgcctcgcccagcaggtgcaccgtcaggctgggggtcttgatgttcttggaaatgttgatgatctccgtcagccgcggcacgcccagcgtcacgttcttggccgacacgcccgcaaagtggaaggtgttgagcgtcatctgcgtggtcggctccccgatgctctgcgccgccaccgtgccaaccacctcaccgggcgccgtcagcgcgtgcatgaatcttccagatttggggatggggtttcggtggaggggggcgaggtttgctggagggcgctcaaacaagtgccatcaggcagtgtggcaacactgcggggaaggctggtctgtccagaggnnnnnnnnnncgagggcgctcaaacaagtgccaccaggcaatgtggcaccactgcggggaaggctggtctgtccagaggtgcagcacatcgtcgtcacgatgcggatcacagagcatttcccccggccccccccccccatcattcacctggtgcccacctccccnnnnnnnnnncagggggatgtgcgggggagggttgcatccgtccagggacatgcgggagtgtgtcggcccgggaagannnnnnnnnnaggatcacagagcattcccccccaccccatcattcacctggtgcccacctcccccaccagccactcaaaggcgtcgggggagagcttgtgctccgccagcacgcgcttgctggccagggtggagcgcaggaggcagaagaagagcagcgtcgcgttgcgctgggcctcgcgagacagcgggtcggcgccccccacgacgcgcagcttctcggtcagctcccgcaccttggcgatcaccaccagcgggctcaggccttttgagggggatgtgtggggagggttgcacccgtccagagacatgcgggagtgtgtcggcccgggaagagcagtgctcggagccgggacggtgttcaagaatgccacgcatgacacgtcacatgtgtgggccccccccctggggctcgtgctgcacaggcctctggtggatgccaccgacgagaccctgtcgcgcttcaacccccccatcctccacacacaccagagaccacccaccggtggaccccggcctgtagggccgacaggcaaacttgcgctgcgcgttctcgatcaggcgcttgaggttgacggggaggttgcaggccgcctcgccgccgcgcatgacctcgcgctgcagcgtgcgctgatcctcggccagctgcgccagctcggcgtccagcgcctggcgcgcgtccaggtcggcgcgcagcgcctccagctcgccggggtcgagccagtcaggggcccaggccgcgcggtccaggtcgtaggcgaaggcggcggcaaagcgcttgggcgtgtagcgcaggaagtccatgcgctggctctcgatggccgtgccctccatgccgtcctcgccgtacaggaactggatcacctcgcccaccgcattcctcaccgtgccgtcgtacctggcgagggatgggggtgatgcaaagggaggcgggtgagatccaagggtctggacatgggcgagggccagagcatgggaatttgaggagcaggctgggggcgcagcggggatccagggaaggcggagacccatcgaaccccatgccggcatccttattcctccctctcccacacactcatacacacgcacacacacgcacctgaccatcannnnnnnnnncaggtgatgcaaagggaggcgggtgagatcaaggatctggacatttgcgggtgccagagcatgggaattcgaggagcaggctgggggcgcagctgggatccagggaaggcggagacccatcgaatcccattcccgcatctttattcctccctctctctctcacacacacacacacgcacacacacgcacctgaccatcaggtcctccatggccttcaccaggcggcgctggatgtaacccgtgctggcggtcttcnnnnnnnnnnnnnnnnnnnnnnnnnnnnnnnnnnnnnnnnnnnnnnnccatggcgtggaagaagaactcctgcggcgtcaggccgcgcaggtaggagttctccacgaatccgcgcgactcggggccaaagtcgtccttggtaaagtggggcagagtgcgctgggagaagccaaaggggatgcgcttgccctccacgttctgctgccccacacatgcaatcatctgagcagggggatcgacagtgttgtggttgcagatgtggttttgtgtnnnnnnnnnnaacgcacgcaatcatctgagcagggggattgatagtgttgtggttgcagatgtggttttgtgttcattgtgcgtatgtgtgtgtgtatacgtgtgtaaacgtgagtatccaagatgcgatccaaaatacgaccgtcagcatggcagaggctaaagtgnnnnnnnnnntgagtatccaagatgcgatccaaaacacgaccgtcagcatggcagaggctaaagtgtcaaggatcatgaaccatcgccccctggccacacacagacacacccacaccactctacctgggagatgttnnnnnnnnnncaaaccatcacccccttgccacgcacagagacacccacaccactctacctgggagatgttgatgaaggagcccttgctccccgcggtcaccatgcgcacgacgttgttggtgtcgtgcagtgagccctgggcctggttccccgcgtcgtcgcgcgccttgttcagcacctgattgacctggttctcgaaggactccatgatgctgcgccccggctgctgctccagatcgttggactgcaccttgccgatcaggcgcttgacgtcctccttggcccgttccataatgtcgttgatgatggtcatggtgcgcgcgtcggcaatcaggtcgccgatgcctttggaggtgggggggggggttgatggagggatggggagggtgatgaagggatggagggaggtgatggagggatggggggttgacgggggggtggggggaaaggacgaaacgcaagggctgtgactcacgacaccctgctccgcaaagccctgtcgctcagatccatccccggtgggacccagatgcacttcctcatagtaggaccctccccccgctctctcccaaaatgttcatcccccctcgccccctcctcaccgatgctgaagccgtgctgcagcagccactggttgacggtgaactggacttgggagaggaaggcgcgcgcggcctccggcccgcactccatccagatgacgtgcaccagcccccccgccgacgcgcccagcgtcttcttgcacagcgtgcctgccagcaccacgccgtcctggatgatgacctgggcgtccacgggagacatggcgtccggctcgccgtcgcggaaccaggcggcgcggcgctgcaggttcacgcgcggcaggaacatggagaacacctgcttccccgtccacagcgggcgcggcttgaggatggcgggcgtgggcaccacgccgtcccagccctccagccacatcagcacgttcatgagcaggtcgcgctccaggaaggtgtcgcgcttggtgaacaggcgcgagcccagcagcgagtcctggacgatgcccatgacggggcggttggcctggggggacacgatgttcagcggcaccgccatgatctccttgatctcggcccggacctcatggctctgaaccatgtgcatgttcatctcgtcgccgtcaaagtcggcgttgtaggggctggtcacgctcaggttcaggcggaaggtggagtagggcaggatgcgcacgcggtggccctgacgaggtgcgtgtgtgtgtggtgggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccatatgaagtgacatccctggggaggggccgcgcggcagtgcaacgccagtgtccccctgggacccagcgacgctgccgggccagaccccatccacagtcccccttctgggtgctgtgctgagcacttccctccagagacccccctcggacccccctcccacttcacccacccaccatcatggacatcttgtgcagggagggctggcggttgaagatgaccacgtcaccgttgatcatgtggcgctccaccttgtacccgggctggaggtgccggtcctgcagagtggtttgggggttggcatggtggctagggggtgctggtgcatgcaggtttcccttgtgcaccacgactccaatgcacccccgtctgttggacggcatgccatgctatgacaccttccatgcccctcctgcacacctcacccccccctctgaaacaccccccccacacacaaaaacaaaaacaaaaatcacacacccgctcggtcttcaggaagcggaggtcgaggcgcgagccgtcgtcgcggatgatgaagcgagcgcccgtctggccggggggcgggtagggcccgttctccaccagcgcgcgcaggcgctcgatgttgtgcggcgtgacgctctccgggaaggtcagggtcagcgcgatgccccagggcacgcccagctcgtccagcgcgaggttggggtcccccgtgatgacggtgcgggccgagaagtcgacgcgcttgcccatcaggttgccgcgcaggcgcccctccttccccttcagccgctgggagatggacttgatggggcgcccgctgcgctgcttggcctggggcagccccggcacggtgttgtccaggtaccccgtgacgtgcacctggaggagcagcgcgaactcggagacgatgtgctgcggcgcgccggcctcctcctgccgcgccaggcgcaggttggccttcaggatctcgcccagctggtgtgtgaggtcatcctccgaccgcgcgctggagtccatctggacggaggggcgcaccggcggcggcggcaccgggagcgcctgcaggatcatccagtcggggcgggtgtagcgcgtgtcgaaccccagcgcggcgcagtcctcgtcggagacgcggcgcaggatctccagcgcgcgctccgccgtcagctcctgcttgcgctccatgctctccagcagcggcgcgccgtccaggtcagaggccttgggcgcggggaactccgccagcacgcgcagcgtgccggactccagccggtatatgggctgcgggccgcccgtgtgctcacaaacccgcttgctctggcacagcgaggtgaaggcatgcaggcgtcgctccgggttgcggatgcgcagcagcatcttgtacttggggtcgtcctggtgtgtgggggggggagggggcgggggagttttataatgggtgggtggtattagatggggctgtgatagcatgagtgagggtggcacccaggcttgagctgatgatggcacgcacgaggaatgtgatcatcagcgtgctgctcccacgcctcaagaatgacaaccccccctttcctcctctaccctctcaccggcatgagcaggatcttggagttgtggtagctgacgcagcgcaacacccggatcaccgtgcgcacaaagtgcacgtggtacatgggcttggccagctcgatgtgcccaaagtagccggggcagtccagcacgcccgcgccgtcggtggtgcacttgaaggcgcggtccatggtgcccaggcgggggtcgctcaggccgcccagcctgggccggcccttgtcatagttctgcgaggtctcgatcttggccacggagtaccgacgctggggaggaggggcggggatggggaaacaatcttgaaaggagtctcatgctcatacgagctgagaccacgcaccgtcgcagacgannnnnnnnnnaaaaggagtcccatactcatgcgagctgagaccacgcaccgtcgcagacgagcagccctcccaagcgggcttccatcactcccatggatcgcatcgaaataccacccagccatgcgcgcagaggccaaggccgtcacgatccagaagtcacgcgcacagccacaccgccagcaccatcccaggcgcacgatgaagtcggggtccaggatgccgaactgcaggcgcttgaccttgcgcactggggccgtgctgtggctctcatagttggacatggtgtgggagggcgcacgggccaagccccgggggcgcacccctcgcgagcgacaatcacctcctctgcctcacacccctgccccctggtctctgaagtgagtgtcgcggtcctgttatggaccagagaaggttggattactgtaaccagccccgctctgagctacacacttgcnnnnnnnnnnctcacacccctgccccctggtctctggagtgagtgtcgcggtcctggtatggaccagagaaggttggattactgcaaccagccccgctctgagctacacactcgcctggcgctcgtctttgagaggttgtgatgtcgggaatgcggggttggggccctttccactcccattatgtttgggtcccaattcttacccagcctctgaaaatcaacttcctcgcnnnnnnnnnnacaaaacacgtcactagtaaagacccatcgcactgtagcctccatccacacgcagcgtttgtccggtgatgtagctggccgctggggaggcagcaaatgccaccacccgcgccacctcctcaggctgcgccaccctgccgagcggcgtcctggagaggatctgctgcagcagctccttgtcccccagcaggttctccaccagcggggtgtcggtgtacctgaaagggagtgggaatcggatggaggcttgccagcatgctaagcttcagggcaggaggcctgcacatgccatggtcgatgtgatccatcacacaaagtgcatttcatcccacccctcaccagggtgcgactgagatggcccggatgccgtctgaagcccattcgcaggcaaagttcatcacaatttggttcagggaggccttggtcaggccgtacaccgcccccgacttcatcgccacggggccgccagccaccgaggagatcatgatgatcacgccgccgcccgcggccttcatgaacgggtgcacagcctgggaaagggcaaaggcgctctccaggttcactgcaatcatacgctcaaagtcggcgggggtgtagtccagcgtggacttcctgatgttggtgccaacgttgttgaccagcacatctgggcacgattaggttggggggctggtggtgggtgggtgcccccccctcctccggcctggagcctgtgcagcagacagnnnnnnnnnntgataagtttgggggggctggtggtgggtgggtgcccccctccctccggcctggagcctgtgcagcggacagcagacatgcaaggacgtcgacacaccaagatccatcccccatgcacgctctacaccaaacaaccaaatgccttgctcccaccgatgcgtccgcctaatgctgctgacgccgctttcatgaccgactccctgccctcgggtgtagccacatccgccgtgatcccctccacgctccagcccttggccttgcagtccgacaggaggctctccagagcatcggccttgcgggcacacgtgaagaccctgcaacagcactggcttcctcgtgtgtgcgcattacaacctacaatggacgatagatctcaacccagtagggggatatcccgactggcatgtatattccacatgcacattttacctggctcccaggattgcgaattcctctaccacggcccggccgatcccgagggtgcccccggttaccaggcaggttttgccgtgtaacccatagtattttgcgaggtgatccgccgacgacagcgacgcagtcattgtcggaggagtgtatcgatgagaaatcgagggaatgcttgggtgatgggcaagaatattttattcaacgcatgacgttaagaggggcctccttgccgctgctggatgacgagacgaggactcatatcgcatcatggaggcaggccatcgtggagccgctcgagcctggtagtttgcatttgcattgattcaaattaagtatacatacttgattggatcctgtgcaaagggnnnnnnnnnntgccgctcgagcctggtagtttgcatctgcattgatgtatatcaagtgtacatacttgattggatcctgtgcaaagggagaccggaacatccctcgctggactggggtctcggagcaaacgctgcagacgaaggggtttgtaagtatgcatgcaagggaacccagatttcgtgttaaaatcaatactttgttttgcttattcctcactgaaattgttacaaccggtcgaccccatgtgtggatcgtccctgccccccaaaccggagagacgagcactttggattgctcggaactgcccagcagagacctttgccatggggtgttcggtcgaggcagtagtgacgattgacatcagactctaagctcaacacatcgctgatcaggcttccctctttacatctcctgattggcgagctggtcattcctgcaacacggtggacgcgatcacttccccggctcctttcggggcatgacggagactcgcccctccaccgccgtccggcacatcaggtgacctcaatgattacactgtccggtaccggatgcacatgtagtgctgggtgtcaaccgcggatgcaaccctcccctccccccctccaacccactcccagtgctgtgcagcgggtggaggagctggagatctccctgcaggccgcccatgaggtgaacgcccacctgaacggggaggtggagaagctcacggcccgggtgacggcgctggagggcgagcgcggggccttccagcagagaatccacctcctgtcccgcaagctggccgccgcccggcgcgatgcggggctgggtgtgggctcaggcccggcgggggagggccccttggaggcaccgcctgacgccgggccgctggccgggccggggccgggcgccgccgacgccgcgcccaggttcgacggcgccaggtcagcaaatgacgaccccgcgcttcgggcctggctcccgggcaccgcgtggcgcgaggcagaggcccgcgcccgcgagcagggctggctggtggacccgcgcgaggtggcgctgggccccctgctgggccagggcacctttggcaccacgcatcgcgccacctggcgcggcgcggcggtggcggtcaagcgcgtgcgcgtggccgacgcggaggggggcgccatgttcctgcgcgaggtggaggcgctgcgccgcctgcgccacccgcacgtcatgggcctgtggggcgcgtgcctggcggaccccggcgccgcctggctcctgtgcgagctgctgccggggggcaccctcgccgcctggctgcacggcgcgccgggcgcgctgcgcgcgccgcgccgcccgcgccacgcgcgcctgcaggccctgctggacgtcgcgcggggcatgctggcgctggaggcggcggacccgcccgtcctgcaccgcgacctcaagccctccaacgtcttcctggacgcgcacggcgccgccaaggtggccgacatgggcctggcccgcgtgctggagccgggcgcggcggcctgcctcaccggcgagaccgggacctacagctacatgagccccgagtgcgtgcggcacgaggtgtacggccctcgcagcgacgtctggtcctggggagtgatggccgtggagctgctgagtcagcgcaggccctacgcggacctgcacctcacccccgtgcaggtagctatggaggtgggggcgggcacgctgtgcccggagatacccagcgactgccccgaggagctggcggggctgctgcacgccgccttccaccccgaccccatcgagcggccgtcctttggcgccatcgtggccggcatggcgcgcgtggtggaggccgaggcgcggggcggcgagggcggcgggggcgggggagactggctggcgcagggcaagtgggggctgcccactcggctcaccggcctgctgcgcggctgatggagggaagcaagggcctcacacaggactcgagcgcccactgcctcatgatgagctgaagaattttcgcttgcaaaaggttgggtcaataggggccagggtttcgcgggcccaggcaaggcagagaaaatccgagtcgtgatctcaaatggtaccggtggctgtgccaccgcgcatgggcgtgcgtggcagtcaggctgctgctccaagggggcatgcacctggtgcagaccgtatcacatttataaaaaggagccgatgcacaaagctcaagcttagaagaggaccgccgccccgaaagggacgcgctggagtccgccgccccccatcttcatcatgcctcgggcccgggcggcgccgaggacagggcggcggcgcgggcgtcccggnnnnnnnnnncgctccaaggggcatgcacttggtgcagaccgtatcacattcataaaaaggagccgatgcacaaagctcaagcttagaaaaggacaaccgccccgaaaagggacgcgcgggagtccgccgcccccattcttcatcatgcctcgggcccgggcggcgctgaggacagggcggcggcgcgggcgtcccggaagtcccgcagcgccgcccggatctcttgcgcggcgtacgcctcccaggccccatggtcgaggccggacaggctctccagcgccgcgatcttctggagataggctcccaggaagagcagctcgcggtcggtgtcgcgggatcggtgggacttgcgaaacggacggatgaccaggccgttctgcatggggcggagtcgggatggtgcacgctctggcagtgggacttgcaaggttattcgactgttcacagtggcggagcacaccagatctcggctgtacatccgacatgccgtctactatgcatatcccacagcagccccagaggaaaccccccgcccccagaggccccgccccacnnnnnnnnnntatgaccaggccgttctgcatggggcggagccaggatggtgcacgctgtggcagtgggaattgcaaggtgatttgactgctcacagtggcggagcacaccagatctcggctgttcatccgacatgccgtctactatgcatcccccacagcagccccagaaggaaccccccgcccccagaggccccgccccactgcacctggggattgaggatgtagttgcgccgcaggtcgtccatcatgatggtgttctcgggcgtgtacacgcccgggaatttctgccagacaaactccagtggcttgcagtcaaacacgcctgaggcagggtgcgcagggaggggcggtgggcggtcttcgctgcacgcctcgcggccgggggtgggggccaacttgcggcactggcaggaccctcaaaacgtgtacgagtccaactccccccccctgcatgcagggcctgcgcactcgtcggtggtacaggcccctttgtccaacccccaaacctgcataacaacgtaccgtgcttctcatggtgcaccgtgaccatggccatgtggtctagcatgaacgtcagcttgtactgctcgtgggtggagacccccagctcccgcatcttcacctcgatccacttcatggaggtggccgaccagatcgcaatctggagggggcatggccgaggatcaggattgtaggaattgtggagacttggcactgttcatttcctaaggatgcagtccctgcattggtgatgtgtttgttttccccagctggcaggtagtggagaccaacgagaccccttgcttggctgcagccagtccgaatccaactcacatcatagtgcgcatacgctggatgatatcgcaagggtataagggtggaggatgtgtgatgagcaaggcgtagacacccaatggctgagaaaccaaggaccaaactccccaatgtcattcaatgcaaactaggaccaggtcaaaactcgccagggtctcagccgtcccaagagcaacattcccaagttgccttgtgacgctcccagcccctgcctagccaccaacccccctcccagccaagctctgcgcaccgagcgtcaggaagtggtgcaggaagggcctcgccagttggtcggctcgctcagcggaggagcccaggtcgaagagggtgtagtcgatgtccagcaccagcagcttcttgccaggcctggggggctgcagcaccttgacctctgtgcgggcgacgcgccgggccagccgctcgcggaccccgggctcgtcgcggatgtcgcgtgggtccaggctggaggcgggggggtccaggtcaaagtcgtcctgcaccgccggcgccacctcggcctgcgcgtccagggcagcaatgttctcctcaggtgccctgcatgcgggccccgggggtgggggatacgaggggggagaatggaactgcagcgccctgacagcgatgccaggcaggggttgtgtccacagaagcatatcgttgttgacacagtgcattcctcaaagagtccacccagtcacaactgcctaccccagcatcatgatggggacgttggccttgagagccaggtccttgaccagggtggcatctgtaggggccttgccatccttgcccttcagtcccagcagcttctggcgcttgggctggacgctggtggctgcctccaccttgcgcctcagaccatccaccgactcctgggggtgggtgacgatgtcgtagatcgtgcttctccacttgaacttgatcacgacgccctcatccgccatgcttctccccgggagccggagggccccaaatgctgctcaggctgtaagattggacatcagcttataaatagtagtgagggtggacaatcaatgtatgatttcaatccctcgaggattgcaaaagcaaaactcaccgcggaaattcgaagaccgcgctgagcgcggaacgaagcccatccccagagatttcaaagaccttgaatgttcactggtgagctgagctgcccacaggagggagaacaaaatgacgcccatgctgcggaatcctacccgtctggacaggctgcatgcgcgatagtgtactctgcaggccccttcattgacgagaaatatcattgccaggtccagcgctcttatgcaggtagccacctgcccctacagccccatgtgtgctgggcaatctaagaccaggaactggcaatgagacggtgctggtagactactgttgggcgagtatgctcataatgtgtgggcttgcccatattgactccttctgtctcttgatttcagcttgcttacagtgactctccatgggccgccccatctcctctggagaggttgcagcagcagctgaaactaaaaatatcctgcaatgcctgcacgtctttcagaaggacatgtgcagagacagatgccttaggcctgctcatacgcacacttcttgaagatctctggcttcacggcatgactgcaagcttccccatggccataggagagagcacatgctgcttgcatgggcgtcgccgatgatgctgcagtcttgatggtaccgtgctccatggcctgactaggtcgcgattctcatggggctggcagtctgctgaagtgctcgactcctgccagccaaagtggcactgcaccacatggcaaggggggcatcctccttgaaataggtgaggaagcccattaggcttggccacttgctggcgtcctcaaaatccctacatgctcaaggatggcttgctgcgattgccactgcaggtccagcaatgctgcggccnnnnnnnnnnccatggcaaggggtgcatcctccttgaaataagtgagggagcccatcaggcttggccacttgctggcgtactcaaaatccctacatgctcaaggacggcttgctgcgactgccactgcaggtccagcaatgctgcggccaagaggggctcgcacccagcggagccatcatgcgcccggggatcttgcttccaggacagctgtcacccttgtttgaagtgctacaagctccgaagattggctgccttcctgagaatcaactagagtgggcactaccagcggagccagagctgcgtgggtcgttctggacaccaaggactccagagctgcctgttccggacctgatgaagctcccagcacagacagactaaggagggctccagccctctctccccacgcccgtcctgcctcagccccagccatgaatcctgaaattaaacaatgaaagcattttagggtgcattcacatctgcccatcagcttggtcagtgattctaaccccacctgtctgnnnnnnnnnnccctgcctcagccccggccatgaatcctgcaattatacaatgaaagcatttttagagtgcattcacatctgcccatcagtttggtcagtgattctaaccccacctgtctgaatgttcttatatacctgagtcgaatccggcctgcacagactcctgcttgccgacctctagaccttcgagaaacccagcattgtaatgtccctcgcgtctcgattgccattctctctccagctgcccggcatccgtgggcgagtcgtcgccccaaacatcggcatcttgcatggtaggtgaccggcacatgcgccgagcggataggaaaaggatgttgctgatgtccaattccaataaaaaatgtatgtaatgcctatcggcgactaatgtgacatcgttgtgtgagaccatgttttcgttcagggttctggatcgcgcgcgctgctcgggggatgggtcatacatctggcaaatcccaacgatggagccccccactaggctccctcttagtgaatctctccctatctacctatatgtttcccaatcccagtatacctctgttgagaagtttgattagattttcaagacgcagctgcaaccaaagtnnnnnnnnnngtccaataaaaaaatgtatgtaatgactatcggcgactaacgtgacatcgttgtgcgagaccatgttttcgttcagggttctggatcgcgcgcgctgctcggggggatgggtcgtacatctggcaaatcccaatgatggagccccccactaggctccctctcagtgaatctctccctatctacctatatgtttcccaatcccaatatacctctgttgagaagtttgataagattttcaagacgcagctgcaaccaaagtgggcatgttctcggccgacagagggccgtgcccagtagcaagggtcatgtttctctcagaggggagctacaaaaacagggagggcacgatccgggaggggagtggcgacattgatctcaggcgagatacccacgacttcacgccagcttctcgacgttcttctccacgttgtcggccacatcctcggcgccagcagccttctggacgccaaagatcttggccaggagcacaaacgacatgccccccgccacattattgcccgcacggatgaccgacgtcaggatgcggaagatgccgctggggatcgccggctggacgagctgcgcaggcgagtgagggaatgcgagtgggcagtggggtgtggggctggagtatcggcgtcgagaataaataatccactcggctgaaggtcgacggccagatgctgctgctctgggctagagagtctgggcatggagccctccctggctgtgatcactcccggttgcgcacacagaacgaaagtccgacaccccaaccctatccctatcacaccgagaccgccccagcgcaccatgtcaaagccattcaggatctggtagcgcaggttggaggagaagcccatgtgccccgcccagcacgccgcgttggcaaccacgttgggaggtgtgttctgggggggggtggggcgaggtcggcgtcatgatgggctactgtgcgggattcatcatgagctcctggggagcatcccccgctgctgcactgtcagagacccagccgcaccagannnnnnnnnnccatcatgagctccttgggagcatccctcgctcctgcactgtcagagacccagccgcaccagaggtgccctctgaaacccccaaagtgcccccgccacccccaccccaccttgttgacgtaggagggatccagcttacaccgcagggccagcagtccgttggagagaaaggtgccccccaaccctgcggccatgccgatgccggcaaagatggtgcccttgtacagaaagttcaccaggcgcgcggtcacggcaaagcccggctcaaacatgtggccacctgcagggaggcacgggttggtgggcggcgcaggccttcaaggttgaagtctactcttatctgtggcgccagggatgggtgccggcagcaaaggtcgagcctgttcacagcgggatatgctgcgcacaagagcaattcattctgtgttcaccctacaacagcatcgcatcccctcaaacctcctccccacaccatgaccacacacctggcgccccccaggctttaaggnnnnnnnnnntcctacaacagcatcgcaacccctcgaacctcctccccacacaataaacacacacctggcgccccccaggctttaaggtagtggtcgctgaagagcttagtgaccaggctcgccccggcggcggtgcccccggccccggtgggggccagcaggtacatgagcgcaaagttgacgatggagccgacgaccagggtggcaaacacaaagtccagctcatccaggccccagttggggcgggaggccatgtcaccgatcacggccgatcccacgcccaggatctgtggggttgggataaaaatgaaaggatacaaatgtgttgattgccacaaggaggaaatacccagcccggccagcccggcacgtccccgaccctgacccagcaggcatcgctcctgacctgctccacggcgaccttgtaggtgaactgggggtcggcggccacgcggtccgaccatcctttccacaaaaccctcttctccggctcgggctggtttgagccctcatcgccccagctagagccgccgctgccgccgtaccccgcacccccgccattaccagcatacccaccacctcccgtggaggccaatggggcctgagacctggtacatagaggaattccaaggctcaaaggatatgtgggggaaggcatgcgcaggggatcgttatggtttaggcannnnnnnnnngttccaaggctcatgggatatgtgggggaagtcatgcgcaggggatcgttatggtttaggcacggctgcctgcagggactgcacaagtcaggaacagggtgcatcccccgttatgggaccaatcccgacccatgcccgatccgcaccgcggtcacctcgagttcagtcgcgatcccttcccaagacctggccgtgcaaatggtcgaggcgccagtcccgtccgaacagaggggccatgtgccgcccgggtgagacccgcggaccgaggtgtgggagcgccccgtgcggagggcagcaggctgaactgcgacatggtgatgtctaatatttctttattctactccaactcgcggtggaggaggaggttacacccaaaatgcgccgtgccagcaacactgctgttcgagcccaccggacccacgtgggtttcagctgggcgcggtgcagcagtaggtttacacaggggtcaacgaccatagaccacggcccccttgggtccctggcccgacgcgtacggctttccagaggcccacagcatgccccgcagtggcagcttcaccaggccctccacgacgctggccgccagctgcgccgcgcagccacagggaaggcacagcagcttgaaggggaggaggaggagccagaccagcatgcccaccagcgatacaaggacgaagaggggcgcggcaatgcagaagaggagccagcggccgcaggagggggaggcgtctggccgcgggctggtgtcgatgagcggcggaggcggctgcgcggcgggagccccggccctgcatgtactggtgccggcaggcgctgttgnnnnnnnnnntgggcttgtgtggatgagcggcggaggcggctccacggtgggagccccggccgtgcatgtactggtgccggcaggcgctgttgaagcggcgtttccatcctgttttgcacccacgcccgcagagcctgccgtccagccagccacgtcggaggcaaaggtcacgtctggcggcgggagggagtagggcgcggcggcgactaatcgctgaccgcccggcatggcgggcgcggccgacggtgtgcccggcgacccatccacgccgttctttgacaccctacgtgcagtgtcttccaggatgccttgcacgacctggggcgggagaggtttgggtggggaaggctatgttggctcacggctgggccaggtgcaacatggtgnnnnnnnnnncggggagaggtttgggtgggggaggcttggttagctcacggctgggccaggtgcaacatggtggctgctgtgagccaaggcccaccgtaaccaagtgctcaccagcctgtcatccagcgacattaccataattcctgccacgtgcatgcacacctactcaagtccaacacatcgcaccccgcacccacctcgtccgagcggcgannnnnnnnnntcgagtgctcaccagcctgtcatccagcgccattaccataatttctgccacgtgcatgcacacccactcaagtccaacacaacacaccccgcacccacctcgtccgagcggcgatggtccaggttgagcgtccgtggctctgcggcatcataggccgtggccgccgcctttgcggcggcccacaccctgagggcctctgctgcggtcgccctcgcgccgcccgccccccccggcgaccgccactggaccagggccatgaaggtgaggctgagcgcgcgcagcgtgcccgcccggtactccgcgtacctgcccagcttgggggcgaccgcaccggcctgcgccagcgcctcgctcgatgcggcgtacagcgaggccgcctcggccgccaggctggcgatgagggtggggctggtgcccttggcgatggcacgcagggtggtgaggtactgcgcctcggctaggcagtgctgggaaagggcggatacagcggccgcctctgcggcgacggagggatcctcaggcgggaggtggggcagcaggcggtccttagctgtctccagctgcccggcagcagccaacaggtacttgtatgcctgcagggtgggtgcagagtggtggcgtatcggtggtggcgcctaaagtctgcgccgagggattccagggcggccgagcaggcccagcatcagggaggttgggcgcccaagtgacccgccattctgcgtctacagttggcacaatctgacgctatcttgtgaccccttgcactgtacccatgtccatggatgtcctcgcccagaacaggtgtcctggaccagctccatcccagcccacctgcatcgcggcaggcgtcctcacacccgaggcagcgtcgacgcatgctgctgccgccgcgcgcattagggcggtggacctcgccatgagcgcggccacgacctccaggatggcgtcgctggaggcccagtggggtcggggaccgccgcgccagacataccgggccgcggaccggaaagggctccctgggtcgaggcctccccccttttccgcatcctgctgtccaatcagggccagtaggaggcccagataccgcgcctgcaccacgtcaacccgcatggagctgccgaggttggccgaggaggccagctccgcccccaggtcctgccgtgcctgggtgagcaggcgcagaccgcgtcgcccggccttcttgcgagacggtgcaatgaacgcatccagctcaatcccaaagtccaggggctccggcagcatgggcagcggggagtgcaggaatgggtggatcaccacgctgtcgctggaggatgccccgccctggagggcgacctcctccccctgctgcagcgggaggggggcatccgggacctgagatgcctgcattacaggtttagtacatgagacaggcccatcgcggcgcacgatgatggaatcgggcctcgacgcgtcaagatctccgtgtcaccccgcgggcgcgcccagtttcgtattttggatcgtgctgggcgtgacgcggtccggccaccagatgtgaagggggacgcctgccctcacctgccagcgctgatttgacactacaaccttccaaacaccacacaccagttgtccttgtcataaaaggcatccaggagctgcgcgcccggcacctgcctcaccagcccctccagctcccccgggcggaagaggtggtagtagcgctggaagcacactgtgctcttcttgccgtccagcaccgcactgggccgggcagcggcggccgccgcctcggcccggtgcatggggacgtgccagggcaccaggtagtcgtttgcctccgactccgacccgggcaggggcgcccatttctccagcttccgggccatgccctcctgctccgtcgcccacacggtcaccagggcgcggccgcctgcgaggggaacagacagtgaggaccgatggccttccaggagttgcactgggaacctgcagtaccaaagtctccagtcatccaaccaacgcgccacacctgcacgcccatcccactgaggaaaaccttcagatgctgggcaggggtggtcctgcaccctgcgcctcaatctagcctccaagatctgcaatccacccctcccctccaagccctcagcgctcacccaggcacagcgtgctcagcagctggtggagcagggccagccgtcgggcgacggtgctcatgtgatggagcactgcgatacacaggacgccatccatgcaggcagggcgcagggggagcgccagggcgtccgcggccgcgacgtcagcgcgtaaagagccctggagcccgcgcatgnnnnnnnnnngtgtgatggagcactgcgatgcacaggacgccgtccatgctggcagggcgcagggggagcgctagggcgtccgcggctgcgacgtcggcgcgtaaagagccctggagcccgcgcatgggacctccagagacgcgctgggatgccactcccgccagaccttttgaaaattattggggggaatagggggaactgtgagcagagtgcttgtgcgggattgttggatggggtgggggggaggagaaattctcagcatggagggtcatgtgtccatgttcaaaagagacggctcaccctctctgagtaccgatctatacaacatgagaaacagtagcactggccggaaacaagccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctattatttagaaggggtatttgaaagggggggaggggaacgtgtctttggaatccatgctcctaggaggatgggggataaggccgcattatgaaagacgctcggctcggcttcttctgtgtgcagcgcagcaatccccccccttctttccccagtggccccctttccagacaatgccgacatgctcccctgctatccccctgtctgcatcccctcactcccnnnnnnnnnnagcagtccacgcatatacgcccacctgtgctcctgtcggtgcccaggacaaaaatgtcgcttcggaggccaaaatacttgccgttgccgcatcccacgtcggccaccaaggcgccggggggcaaggccatcacaaattcgcgcactttgggccacactgcgaatctattatttagaaggggtgttttgaaaggtggggaggggaacgtgtcatttagaatccatgctcctaggaggatgggggataaggccgcattatgaaggacgctcggctcggctactcctgtgtgcagcgcagcacccccccccccctctttaccccgtggtcccgcttgccagacaatgccgacatgctcccctcctatccccctgtctgcatcccctcactcccaccttgtggcgctgaagtggggtgctatcgcgttgtacacgccgttcacgtggtcgtcctccagcgtgctcccagccccagccccgcactgtgcacgctgagctgccattctggtgggnnnnnnnnnntgttcacatggtcgtcctccagcgtgctcccagccccgcgctgtgcacgctgagctgccattctggtgggggggatgcctgcgccctggctatcgcactggtcggggaacgggcagctgcaggggtcgccctcctgccggacctgcaggggtggtagtgtgcagggtgtaggaggggctgcagaagggaggggtttacaaggtcagccaggcaagggttctctggcagggctacctgtcctcgcctccagtccatcaggagcatgcagccttcgcacatcaatgcatgcacgacaggctcactcaacggacagtgcgacaaggagagcaaggaccggcggggtgcatgtcgagccgccgccccccggcatagacacacccacctgacggaatgtgaaggacacacggcgctcggcacgcagcaccacctcccctcccaccatgtcggattttcggtgaggaatgtagtgctgcctgcgatggcaatcggaagaggacccgggagcactcctcagaaaggatgtcgtggagtgctgcgcatagatgtgcacaaactccgtcatgccttcgctcctcccatccacatcacttcctggagctggttaccaaaaccactacacaccctgcgcaccaggcatgccgcgcctcgccttgcaggaccagcagggaccgcgggggcagagccagcgccacgtcagcacggccttccttccggaacaccatgacgcaagggccggccaaggaaagggagagcagggtgtccccaaatgcggagtgggtgtccacgtggggcgacaggcccacgccagcaacatactcgttcaccgtcacctgatccagcgcctgttgcgcatgtcggggacagggggaggggtgtgggtgttgggtgcaccggattcgccggtatgagcaccttgtgccactgcactggccagctctgcttggtaattcatcacagcagaggccccacactacgtaggattatatttgcggtctgcacctgcgagccgggtatccgcggggctaagcgcaacgccacaaagtcatggagggcgggtggcagcggcgactgcgcagcgccaacctccacgtgccgtgtctgttgttgtgtatgcgggggatggagaagatgcattgcacaagggcttgaaagaaataatttcaagtcaacctgtcgattccgtgcgttccactcacatcgcactgcaacaggccccacccccactcacagcatactcgaatcgcatgccatggtgctgcacacgcctcttggccaggtactcccagggctgggcatccacgagggccagcagctcgacttcctcctgggtactgacgaattccaagatgaggtccagtcctggaatgccagcctgggaagccgacatcaaagcatctagatgggatggcgcagatccctgcacaggatgacgcatttgtgttgtgagaaaggggtattgatgtccaagatgtactcctggtgagcatgcatgagcaagcatggtgagagtagatgcctgtgtggaaagtctgcagcatggccctcaggcaannnnnnnnnncaaggggtgttgatgtccaagatttacttctggcgagcaagcatgagcaagcatggtaagagtagatgcctgtatggaaagtctgcagcatggccctcaggcaaggacaggtcccacccgcttacccacagtgcagattcgcaagcaacgcacctttttcatcctctttgtctcagcaaacttcacgcccaatgtcctgccattgtactcctggccatgcaaggttacaagagcagcattggccgtctcagggtcagggaatgtggcgtatatgtgggcctgtcctgtctctgaaggagccacgcggacgcaatggagtggagcaagaagctgagcgtataccctctcaggatcacagcccaggcctggcccacacccactcaggcgcaggtggcgggtgggctccttgtgttgcggcctgcagaagatttcatggcgctctccatctggtgggtcgcgcatggtgctgtatacattcgggttttgccaaggattacaatttttaaggagagtaaatgtggcatgggagcttcatcgttgttggtgctctgaatactgcatgggatacacggccgcacagaaacgcgcgcgcggagtcattgctgttccggggcggactggagcgctgaagccacaaatcagtagtcgagcctgaagtggttattcattcgaaaggggtgatcacatactatacttgaacagcaannnnnnnnnntctgaagccagaaatcagtagtcgagcctgaggtgaatatccattcgaaagggtgatcacatactatacttgaacagcaaaagcagcacacgcagagtcctcctacagatcttcgaatttgcagcatggcagcaaatcctccgctggtggaatctccccagggtctcgtgccggccccatacgccagcgagtggatcggtctggcgcgatcaggcgtggagatacgtatagatggccatccccagggcccggaccgctgggatcggcggggcaccatcttcatcaccaacctgcgcatggtcttcgtggccgaggttccggatgctgccacggggctggtggcctacgacctgcccctgtcctacatcacccaacactccttccatcagccgatcctgggatgcaataacctgaaaggtgggcttggctgtggccgggaggttgagaggtgggggttggacgtgctgctgtggcaacatggcaaaagagctgagactgccctgcctgcaaggcctttcccccagtgtgactgccatccctcacttccatctccttattcagtccgcaatggtttcccagctgagaatctaagccgacaccgtaggtcaatgctggacggtggagcagggtcccgggcaagggacctccatcaggtggactatttacttcaagaaggggggcgtgggcaccttcctccccctcttccactcctacgtgcgggcctacgcccagcagcgccgaggatccgagccacccgcgcccgcgccggccgacgttgccagcgcgccgcccgaggagacctccgagccaaccccgccgaccttcctccgcacagcactggtggaccccaatgaccccacccgcgtgttcctcactcagcccgtggaggagtctgatcgtatcaaggaaccccctaagttctccctcatctgatgcagtggctcccttgttcaggggcattctttcataaacatttcagttgtaatacagggtagggcatgcggggaacgtgcgtcgcgggacgacgcacgcggtacactgcacgtcactgtgcgcccctagccttgtgcaaggggcagcaaaagggagggtatcctgaagtgatagagctggaacgtggcgaaccaggtgggcggcagcagctactggccccatcattccgcccattccaccggccctcacacgcgctgctgggcnnnnnnnnnngtgggcggcagcaactcctggccccatcattccgccccttccaccggccctcacacgcgctgctgggcgggggcctcgtgcgccaggcctccgtaggccagcccgccgccgggctgctccaccaccgcacccttgcgcggcacggcgtcaaaggcctgtgcgatctccgggtggctcacactctgcgcgtcgcggtccagcgcccagcagacgaaggccgcgtccagcaccgccagcagcacgccgcccaggaagttgaggaggaagagcgaagccaggcccaccatgccacccagcaccgcggcattcaggccgggggaggcctccacccccgccgctgcaccgcggtgggccaggtagtagacaccgccagaggcgaagccccagcccaccgccatgctgaaggccgccagctgaatgaccatgggcgtaaaccagatggtggaggcaaaggcgtccagcaggttgcgtgccaggaggtcggtgacgcgtcgccccgcggcaaagaaagcgtcgccggtgatggccatgaacaccgtggcaaactgcatcgcaaagtgggaagaggggggaaatgaattatggggatggaggatggttggaagcggatgttgtatacatccattatgcagcattgctgcaaggtcagcggtaggaccccatcacacatgatgcacaacaagctatcatnnnnnnnnnnccccacacacaaagaacaagtcggtcatggtaccttggtgaggtactcaacgatccccgcgaggcactgggcaatgcaggacnnnnnnnnnngcagtgaacatccattatgcaccattgctgcaaggtcagcggtaggacctcatcacacatgatgcacaacaagctatcatgctctggtagtctcaacaacccatcaggcaacccccattcctcacactgcaaaggcccacctcccacacacacacaaagaacaagttggtcatggtaccttggtgaggtactcgacaatccccgcgaggcactgggcaatgcaggacatcacccacgacagcacatcctggttttcctgggcattcctggaggtgggcagggagaaggacatgttgttggtctgatagctggctgtcatcacatggtcgaataaacctacatgcggagagcacactcacaccacaacccaaaaataataagtgccaaccctccaatccacttgatgctagcttacatttgcttgccaatgcatatttccaggttccacactcaattattgccccccgcttcgcagcacaatattgatcgtccccccctccacacacacatcaaccaaaccannnnnnnnnncataatcagtgccaaccttccactccgcttggtgctagagtacatttgcttgccaatgcatgcctccaggttccacactcaattattgcccccagcttcgcagcacaatattgatcctccacccccctccacacacacatcaaccaaaccaatcgacaccaaccccctcacctctccgcgctgttgcgcagggcctcagtgatggtgagcacgagagaggagagggccagcgacccgaagctgggcccgaaggcatggcccagcgcgcgtcgcgtggtgccgcgcgtcacatgcagcgcgcccggcggcgcaaagtaccactgcgccacggtgccagagatgacgtagacccgcacctggttggccaggagcagggtccagagcatggcgagcgcgccgagggccgcggcgggcttgacccaggggtccaccccccaggcgcagcagagcacggggtcgccagcctcgttcaggcacgcgccgccggcggccgccaggtcgcgcgccggattgggcaccacgtcgccgttcatgannnnnnnnnnggcctcgtccaggcacgcaccgccggcggccgccaggtcgcgccccggattgggcaccacgtcgccgttcatgaaggacagcacgagggcggcggccaggggcgtggcggcggccaggctggccacgcccagcagcaccgaggtggtgatgaggtgggggttggcggccaggccgtgggctgacacgcccagcagacgggaggccagcccgatctcggcgcgccagaggtagaaggccaggccggacagcgcggccaggcccaggggcaggagcgaggcgcggccctggccggagccgagcatgccagcgcccaccgccagcggggcggccacctggatgagcaccgtggcccgggtcatggtctccggcaggtgctggaagaggcgcaggaaggcggcgcccaggagcagggacaacgcgacgccggcgcccagccagcccgcggcctgggacatgaactcgccggcgtcaaaggcggggaggtcgccctggcccgcctcccgcaggcggcgcccgccatgcagggggcagttctcgggatcggacaggtagtcctggttgatcagggcaaagtcagggttcctgtgagcagaggaggaggtgaggaaggggggctagtgagtgagggccgggagcagaggtatgatattcaatttatgaggcgtgtgagggggaattccggggtcagtgcatctccctgcctccgtgtacatatgagggaggcgatcactggtaatgcggagtgggttctgaannnnnnnnnntgtgagtgagggccaggagcagaggtatgatatcaatttatggggcgtgtgagggggaaatttggggtcagtgcatctccctgccttcgtgtacatatgagggaggtgatcactggtaatgcggagtgggttctgaagttcctgcgctgagaagttctacggcctgatattgggaactcccctttacccagccagacagtgagcttccgagcaagtgcacgggggccaagcacagccgtgagacccgatccggcatcgaaagagtgtctcgagactacacacacgcatcccacctgttcacatagccgtagatgccggcgaccacgacggcagcgtaggccaggccaaaggctacgccccaaccagcgtccttgcggctgcgagtgaactggtagggaccggcagaggcgacgagggtctcaccctccctctgaagctcctccagacccatggtctcggttctcgccgacggtgcagccgaagatagatgggaggccagcaccccgaatatgccgagtgcgaggattcgccgatgcaggtcctaggtatgttccgttgttgtgtcgtctagctgtgcctatcaatgagccttgattaaattttcggctggtgtaggcctcgagcttgggctcgaggcgtgcctacttcgcgaagctctcggggagaaacgcgcctttggcgcgttcggattggatcgttctgcttcccgccaccagtggaccgggacaacgatatctgtgtgggttgggcaggacacagcactgcgcgttggatccacccactgggtgacatgacgcaataattaagacgtcaaatcacggctgctacatcgcttgcacaccagtgagacaatgctcgcgcgaggctgtcactggggtggagggggagcgaggcaactccgtacacaggctcccagctcgcagtttttcagggcagcaggtcatcgcaggccacccaggtcacactcgacatgcataaaggcagctagcccctctggtacagtttcagccctgcatggtgaattgctgctgggggcatgatttgggtgctggtgggcctggccgccaacagctgacattcatgggccccccacctttgccaggcgcggagccgctcatggtcagggcggctcgtggagaggagctggagcgtcctccatgctggtgaggagggactaagcaggttgcagggaatgttggtcctgcggcgacggccatgtgcaggccatgcctcctcctcctcctccacgggcattggtgtgcctggctccatcgcccctcccacccctccccaaactcacctgcaggatgatgcgacaagcgggccggtaccagaaggcctaccgcgacctggccctgcagtacccctccttccgccagcggtcggagaacaccgacctcatcgtggatatcagcctgcagccatggcactccttccgccccgacggcgtcatcattttcaggtgcgcttccctgcagggctgtgcagcgtgcgcagcgcagcgcagcgctttcggcaacgcgggagagccttgcggcgctgtccctcatgcagctcctgccccgccggctgccttcccccccacccccccctacatggggcccgccacagctcccctgacccctcgcttcccaacccgcgttcctcctttcctccttcatcgcagtgacatcctcaccccgctgcccgctctgggcattccctttgagatcgacgacatcaagggcccgctcattgccaaccctgtgcggagccaggagcaggtggacgccctgcggtcgttggacacagatgccgtgcactttgtgggcgagtccctgcgtgcacttcgcgcggaggtggcgcccgaggccgcggtgctcgggttcgtgggctgcccctggaccctggccacgtacattgtggagggcgccagctcctccacctacaccaccatcaagtcgatgtgctacaccggtgggtgtggggcggtggggttggatagcttgatccactggcttggtgacgtaaaatgcccgtgcacttgactcattcccctcgccccccaccctccaatccctccctgcagcgccgcgcctgctggactcgctgctgagccacctggcagaccagatcgccgagtacgccatctaccaggcctcctcaggcgcagactgcatcatgctcttcgactcctggggaggccagctcccccccaaggcacgttgggtgtgggggttgggcgatccgctggcttgcgggggctgcatgctcgatgccggcagcctcgtccagtgcaagggcctcccacccctccttcctctggtccgaacgcactcccaacaaccctctgcactctcaacccaggagtgggatgtgtggagcgccccctacatccggcgcctggtgtccaagttcaaggccgtgcaccccctggtccccgtgaccctgtatgccaacggctccgccggcctgctggagcgcctgccctccaccggcgtggacgtggtgggcctggactggacggtggacatggccgacgcgcggcggcggctgggcgcgcacgtgcccgtgcagggcaatgtggaccctgccgtgctgtttgggcccgcccgtgcggtggaggcggcggtggacgactgcctggccaaggccgggggctcggggcatgtgctcaacctgggccacggcgtgctggtgggcacgccagaggagaacgtgaagctcatgttcgacctgtccaagcggcccctggcagggcggggggggagggggcagggcctgccagccgccgccgcgggctcgctgcgcggctgattgtgtacagagccgggcgttctggttcggtaacatctcatgcaagggaacaccagggcgggatgtgagtgcaggaagttgctagcggcacacccgcccatgggtccacgcgtcatttcttcccttcccggcaatcggggacgcatcgtacatcgcttgaaactgggaatgggacagacacgcctcgaattgagcacggcaccaaggatcccatctccatgtgggcaatggaatgatgtgcgggttcttcaatcctcagaggtcacatcgggagcaaggtcgctgagcccaccgttcgagggtgatcatgctggtggacaagctgccctggtgctcacacgatggtgagcgctggggggaggcggttgattatttggcaaatttcgatagccagatctcgggatcgagggccccatcatggctccgagctgtgatctgatgtcgggagtgcccaccccgcccacccacccacccaccctgcgcaggccaccccatcttctccgtgcacccccagccgggctccacccgcttcgccacggccggttcggacggcaaagccaagatctggagcttgggctgcgccctggacgccaaacaggaggctcagccgggggcgcacaagctgctggccaccctcacagagcataacggacccgttaacgtcgtgcgcttcagccacaacggccgccagctggccacaggtaggcgggagagggactggaattgtgggaacgtcagatagtggggcagcggggtgtttcgcctgagctgcgcttgtgtctgccaggtccttggactttgaacgcctgaaatgtccaacaatccacggcttcctgctgcacccttacgcccccctcccatgcacactccactctttacccatgcatacctaccactccgccctcctgctcacccacccaggctcggacgaccacctggcctgcgtgtttgagctgcggcccggtcctggcgtcggctcgctgggctcctccacccccaacatcgagaactggcggctgaaggccgcgctgcggggccacggtaacaacgtggtggacgtggcgtggagtcccgatgacgccctgctggccaccgccagcctggacggcacggccgctgtctgggcgattgccagtggccagcgtgtggcccgcctggacgcccacaccaactttgtcaagggcatcgcctgggaccctgtaggctcctacctcgccacccaggtgggtctgggaaatgggtgggtggttttctgcgagcggcaagggtctggtgttgctttccttgctgtccaggaggcactgtnnnnnnnnnngaatgggtgggtgtcgttctgcgagcggcaagggtctggcattgctttccttgctgtccaggaggcactgtgcgtttcccccctgcctccttgacatgatactcctgccaaagttggggaaaggccttcgacacccccaccgccctgcccccactgcatccctctgcaacgtccagtcggatgacaagtcggtgatcgtgtggagggtggagnnnnnnnnnncggcatgatgctcctgccaaagtcggggaaaggcctttgacaccccaaccgccctgcccccactgcaaccctctgcaacgtccagtcggacgacaagtcggtgatcgtgtggagggtggaggactggagccaggtggctcggatcgtgtcccccttctccatgatgatctcctcaacctttgccctgcgctgctcctggtcgcccgacggccagtggctgctggccggcaactccttccagggcgccacgcacgctgcggtcctggtgccgcgcgagcgctggacccgccccaaggactacctgctcatcagtgggcacagcggtgcgacgatgggggatgcgggggggggggatcggttgaggacgaggtggcggcgagggtgcgcagagtgaacctgggtgctgctggcggcccacactctcgggtggcgctcaccgatcccttgctccctgttgccctccttccgcccaccaggcgctgtggtttgcggggccttcaacccccgcctgttcagcacccccannnnnnnnnncctcgggtggcgctcaccgatcccttgatccctgtcgcccgccttccgcccaccaggcgctgtggtgtgcgggaccttcaacccccgcctgttcagcacccccagccgggccagcagagccagcggcaaggagaacggggacgcaaacggcgaggccgcaaacggcagcggcgaggccgcggcaggcgacggtgcggcgcacggcaccaaggcggggcggggcgacgatgaccccgatgccgacgcgctcgcccctgtctttgccatcggcagccaggaccggagggccacaggtggggatggaggggtgtgggcgcccttgggaggagtgcggggggtggagcgacgcagggaatactgccttgcgtgccaactgcatgcggtgtccagcctcaccccccatcaccctcattcacttgcctcctccccacccacccccacacgcagtgtggactgcgggggcggatcgccccatcttctgcgcctctcgcttcttcnnnnnnnnnnccccatgcctcctccccaccccccccactcacagtgtggactgcgggggcggaccgccccatcttctgcgcctctcgcttcttcnnnnnnnnnntgtggcaaccctctacccccatgctcgattgccccactagacattctccaacctcccgctccccacaacaagggcaggcacggtggcgatcttccagttcgactgtgacgagctgggcgccgcagcgccccccctggcagtggatggcgcgctccagacgctgtatgggcgcagcggggcaggactgggccagcgccggcgcctggtggaaagcgtggagcagctggagctggaggaggcgnnnnnnnnnncctctggctatggcctcctcgccagctccaccgacggtgcggacccggagcaggagggatgcggtgactggcgtgcggtgccaggccttgggattacacattgttgttctatgtggaagctgcgttccaggggatggcttggccgtgccgtgggaaccctccccccccatgctcaattgccccactagacattctccaacctcccgctccccacaacaagggcaggcacggtggcgatcttccagttcgactgcgacgagctgggcgccgcagcgccccccgtggcagtggatggcgcgctccagaccctgtatgggcgcagcggggcggggctgggccagcgccggcgcctggtggagagcgtggagcagctggagctggaggaggcggcaggtaagggacccgagggggctaccgggtcacaggcgccagagcccagcacgacagcagcgcccgttccagcgcccccggtctcgacgacgaccccggcgcagccgcccgcccccgccgacctggccgccctggacgnnnnnnnnnnaccggtctcgacgacgaccccagcgcagccttccgcccccgccgacctggccgccctggacgccaggctgggcggcgcggccgccagcttcggcttcagccccagccgtgcgccgcaggcgggcaccgcacccggcgagcctcccgccgccacgcgcatcgacgtcgtgccgcagcgccg

SEQ ID NO: 40662 - DNA, 71 bp, Chlorella protothecoides
tgggcctccctcatggccaaatgcccaaccctgcaccctacacatttgtgcctcctgcagcttccaggtct

SEQ ID NO: 40663 - DNA, 61 bp, Chlorella protothecoides
gccgtgcatcccggcacacgtcattggctggggccgtcaggtagtggatgaaaatcttggc

SEQ ID NO: 40664 - DNA, 464 bp, Chlorella protothecoides
  modified_base (131)..(206): a, c, t, g, unknown or other
cgggtacgcgccgccgggcgcggcgctgggctacgcgggggcaggcgccgggctgcaccgccccctcagctcccagtccggcacggtgccgggcccgtcgccgctcagcggcggccgctcgcccgcggggnnnnnnnnnnnnnnnnnnnnnnnnnnnnnnnnnnnnnnnnnnnnnnnnnnnnnnnnnnnnnnnnnnnnnnnnnnnngactacgccctgcctctgggcctgcagcagcagcagcaggggggggtgcagggagcgggggcgtacgcccagtcgggccccggcgaccccgcgcggcgtctgcagcctgcctacggcgccccgagctctgcgcccgagtacggcgccgcgccgccgccctacgtgatggccggctcgcacacgagggcaggcgggcgctcgccgccgccctctgccctcggcagcacggggtttgcgggcgacggcggcgccgcgctg

SEQ ID NO: 40665 - DNA, 72 bp, Chlorella protothecoides
gccacctccgcgctcagggaggtgatcggcgatgcgccagttgcctgcacggtcaagaccaaggacatgtac

SEQ ID NO: 40666 - DNA, 61 bp, Chlorella protothecoides
atcctggctccccctccgctacggagtgaaaggcagggcagcaagggtagtgaggggtgaa

SEQ ID NO: 40667 - DNA, 65 bp, Chlorella protothecoides
agagccatgggtgtacgaattcaccgccgcgcatcgcggctccatcagcgccgagcacgggctgg

SEQ ID NO: 40668 - DNA, 62 bp, Chlorella protothecoides
gcagcccctgcagcccctgccctgggcacccccaccagcggcgaggcagagctgctggcact

SEQ ID NO: 40669 - DNA, 92 bp, Chlorella protothecoides
gcgacggcgcgagccagacgccgctgatggcggcctgcgcgagcgggcacgcgggcgtggcggcctacctcctcgccgccggtgccgacccg

SEQ ID NO: 40670 - DNA, 63 bp, Chlorella protothecoides
cttgccaggctgtcccgggtgcccaggaaaggcaggagaaggaggaggatgtcgagcttgagg

SEQ ID NO: 40671 - DNA, 2136 bp, Chlorella protothecoides
  modified_base (156)..(184): a, c, t, g, unknown or other
  modified_base (437)..(446): a, c, t, g, unknown or other
  modified_base (1115)..(1124): a, c, t, g, unknown or other
ccggtgcgggcggtgcagccgcgccgtgccgactcgaccacggcctccttcgggtcgcgggcgggggaggccgaggagggcgggcagagcgcggcggcggggcagtttgtcaaagcagagagcgccgcgcacggcggcgcggcggcggcggcgggnnnnnnnnnnnnnnnnnnnnnnnnnnnnnagcccaaccccgccgcgcagctcgcggccgccgcctggacggcagggatgaagcggcccccaggttggaaaggggggagccgcagggcctgaggggccgctgggtgttttttgcgtgtattggggggggagttcttgggcgggcaagggcctgtagacaaagtacggtcgagggtaggtggtgcttggcagtcctgtcctggagaagactgttgcctgccttggacttggcagcccaacagctgtgctgggcnnnnnnnnnntttttttgtgtgtattggaggggagcgcttgggcgggcaaggggctgtaggcaaagtacgggcgagggtaggtggtgcttggcagtcctgtcgtggagaagactgttgcctgcctcggacttggcagcccaacagctgtgctgggcagccaggccggctgcatgtgtcactgtcccggctcaactgtgaacaagcaacctttccctgccgctgaccgctccgacccccgccccgcacaggccgcccgcccaaggacggcatctaccgccccgagcgcctcgcagccgcggccgcggccgccgcggccgccgctgctgcggccgccgtcatacagcccaaggtggaggggcgagaagccccggcctaccagccctggctggacatcccagagggtgaggcggcagggtggaggtctgttggcctgatcctggcagggcgatgggtgactgcctggtctgcggggtgctgcccctgtcatcgatcacgggtgtggcccgggtatcatgtccctgcgatcctgcattgcccaccccagcattctgagtgcaataccacgaagaaatatgcagcgcctccagcgcggcgtccctcctccttcggcctactcccccttttcattccccttcacacacacgctgagtcccccccccccccccccccccccccccnnnnnnnnnncgagtgcaatgccacgaagaaacatgcagcgccttcagcgcagcgtccctactccttcggcctactcccccctttcattcccgttcacacacacgctgagtcccccccccctcctccctccgccgcaggtcgctgccacgtgatccgggtacggtgggcgggggagcgctgtgcggtgtgcgacgccgatgctgacaccgactttgaccagctggtctcctgcgacggctgcgggctgaccgtgcaccagagctgctatggtgtgcctgaggcccccgcccaggacgacctctggttctgcgcggcctgcgaggccggggacgggcccgacccgggccgcgccgcgttgccgcaatgctgcctgtgccccgtggcgggcggcgcgctgcgccccgcggcggttgcgcccggcctctgggcgcacctcacgtgcatgcagtggatcggggagctgtcggtgggcgacatggccagcatgagccccgtgctgggcgtcgaggccatccagcgcgagcgctgggagctgacctgcggcgtgtgccgccagcgctgcggcgccaagatccagtgccgcgcctgctacgcggcctaccacccgctctgcgcgcgcgtggcggggtacagcatggaggtggtggaggcgggggcgggggagggcgtggccctggtcagctactgcgcacgccacgcgccgcccgcgccacagctggccgcggtcaagcgcctggacgcggcggaggagcggggggacctgccggacctggcggcggcgccgccggcgctctggaatgcgcagcccttcgagctggcgccgcgctgcgcgctgccgcgctgcgaggcaggcgcggcgcggtgccaggccgtgctgcgctggcaccgtcagagccacggcacggggacgggggtgtcctccaccgccgggttctggatcccggaggcaccggccgcgccgcctccgggcaagcctggcgaggggccctgggccccctccccccgcccgctcagcgcaggc

SEQ ID NO: 40672 - DNA, 100 bp, Chlorella protothecoides
cgagtaccacccgcagccctcgaagcggcgaaagttgaacaggacggtgaagaatgcccacccgacgtgcacaaaccagtcggtcttcttctcgtccgtc

SEQ ID NO: 40673 - DNA, 110 bp, Chlorella protothecoides
gcacacttcatcatccgccgctgagtggggcgcagggaggggggggcaagggagggggggcgcaggggaggggggcgcagccaggcccatgagcacgcacgcacgctcgg

SEQ ID NO: 40674 - DNA, 68 bp, Chlorella protothecoides
gcgctccaagctcacacccacacccacatgaccctcctgtacagcctccgaggatgaggtccggtatg

SEQ ID NO: 40675 - DNA, 61 bp, Chlorella protothecoides
aaggcccgctctacactaggccatatcgaagcaccagtagtctcgtctccacgttgatcaa

SEQ ID NO: 40676 - DNA, 137 bp, Chlorella protothecoides
gattgcaggaaggcatcagcaccattgactctgagtgcgagacacctctgaccaccttggacccttcaatccacatgagcatggtgtagaccctccattcgccctcgtacactgcaggattggacgggtggggagcg

SEQ ID NO: 40677 - DNA, 80 bp, Chlorella protothecoides
tctcggtggtcccgcctggtggtcggtgcttcggctgtcaggcttgtgcgtggacgagcccaccacgtgcacggagcggc

SEQ ID NO: 40678 - DNA, 1682 bp, Chlorella protothecoides
  modified_base (243)..(252): a, c, t, g, unknown or other
  modified_base (409)..(418): a, c, t, g, unknown or other
  modified_base (1209)..(1218): a, c, t, g, unknown or other
cgccgccgctcgacgcccagcgcggcggccggatcagggcggggtcggcgcccgcggcgcgctgctccgcctcgtattcgcggcacggctcgcacagccactcaccggcggggagctctgccacgtcgtagcagcgctggtgcaccgccacgtcgcagcgctcgcagaacacgatctcgttgggcgactctgcgcaagggtttttgttttttgggggggagcgagggggcagtgtttgaaggnnnnnnnnnncctctgcgcgaggtttttgttttggggggggagcgagggggcagtgtttgaaggagggtgaagtgggggaggggaggatgtgaaggggaacggtggttgtaaagattctctatgacattggctggcatcaatgtgatgaggcggagagcctgtcgcnnnnnnnnnnctctctatgacgtcggctggaatcaatgtgatgaggcggagagcctgtcgctctgcctcatcgcgaagccggcttggatagccatccaaccagctcagactcctgtcgcctgctgtccctcccctcctcacccccatcctccaaagcagggactgtctcactcaccagagtggccatcgccacacacggcgcagtaggcctcctcctcgccgctgcgctgcgccaggacgtcatacatctcctgaaccagggtggggtgagaggccaccggggtctggcgctgtgtggcatgacgcacggccccaggaacgtcatcctcacgaggcccagcagcaccaagcaccccactcgtgcaaccgctcacgttgggccccagcagcggcccggtctcctcctccttgccgccggcggcctccctgtcctgctgcgccttggcatccggggtcgcatcctggctggcccccgcccgccgccggcccagtgtgggccgcggggaggaaagcaggaccgcggccttctgggccatggcctcgcggtgcgcgcgctcgcgacgctgacgcgaggcggcgttgcgctcctcccgcgccttggccaacgcggcgcgcacgcgctcctcctcggcggcggccgcggcgcgggccaaggccgcgctttccagccccgccagggcgccgcgcaccgccgccgccgcgcggcgggcgttgctgacccgctgcaccagcagctcgctctttcagatggtggaatgagggagaagggggtgtggtgcgttttactgttcactccgacannnnnnnnnngtggtggaatgagggagaagggtgtgtggtgcgttttactgttcactccgacacccccgtggcccagcacaagtgtgtgcatcgggggaagtcccctccaaagaggtgatgcagtttggcgagcggcttgcgccaggtgacaatcccctttcaccccccggccgagtggctgcgtcccagtcccatcccacacatgcgtgacaagacccagctccacggccaagaccccccacccacaaacgcagcaggccacccccccccttccacctccaaagcagacccccacacccaggacccacctgcagggccaggagctccgccagcagctcgtcctggggcgccgccgccagcagcacctcggccgctgcggcctggctccaggggtccacggtcagcgccccccgcgcgacgcacgcggccaccgccgcggccgtggccggcgtctgctgcggcgccgcggcggc

SEQ ID NO: 40679 - DNA, 155 bp, Chlorella protothecoides
agaagattggtgcgccgggggttgcacatgtgcacatgacagtgggactgattgcacaatgttgtccggcctggggctcttcagggaagatagcggcgcgcatgatcgtcacattcttgtcagtagtgccaatccacccccctgtaccctacgcc

SEQ ID NO: 40680 - DNA, 243 bp, Chlorella protothecoides
acaggtgggcggctgagagggtccgccgggacacatgctgctcctgaccgtgggagggggtcgtgcgtaccgtgtgatgggcgcatgccgccgcggggatgtgtcggctggagcctgtgagggagccccgcccacgccccaccccatccctcccccttgcaggccggcaatcgtccggggtcctgctggggctgcaggtcccggccgaggacgcggcgctgctccagacctgcatcgccgagc

SEQ ID NO: 40681 - DNA, 74 bp, Chlorella protothecoides
ccaccacggcgccgtcacccgctggcgtcccgtcccccaccgcagcctccccatcccccaccgcggcgccgtca

SEQ ID NO: 40682 - DNA, 61 bp, Chlorella protothecoides
tggtctatctacggtagatcctcctgatggtaggtttgggtgtcagccttgccgctgtcat

SEQ ID NO: 40683 - DNA, 9200 bp, Chlorella protothecoides
  modified_base (7255)..(7280): a, c, t, g, unknown or other
gggccctttccccactttccatctgttctcgctccgcaccgagtccacgcctccttgcagcgcccatgaaacccaagcccctcaccgtattcgggtcttgttctgaacattcctacttcaggtcatatacagcggtccaccgttgtgggggccagcccgcccccacaacagtctggcacctgagtgctactagagctccactcacttcgctatgcatttttatcattctggaacagtcttcctaactaaagtttcccagctactctccctttatgaatcccaagtgataataggacgttgtgctctgcccccgacttgccgctcatagggatgggttctaatgacatcggcatgagcacagcaaagcgtagcatttggggcatggaatggtgggtaaatcagagttcggatatcatggtggctgactgtgatgtaccagctgccctgctctggatgccgcccaccaggcgggttgtgactgtgaaatgggtaccctttgctgctgtaattcctggtctgagtgccgatcgttcttttacaggagaacgaacaatgcacaggaagtgatgcacaccacactgcgacagcggtgttaagcgatgcagcagcttttttgtgaaaggatggaaaattcacacagaggatctacgaagatggaggagcaagttgtgctgggcggacgcagtctaaggcattatgctggcgaatacagcatcacctctcactcctcagttcgaatctagatttgtggtgaaagaaagacatttcaaaggttgcttgcgatttttaggtaggaaggcggttcatacattctccagggagctccctatttgggatggtgtggcggcatctcctgagggggtggagtatgctcttcttgggtggtggaggtgacacccacttggttgctggcagagattttttcctggatggtagaagagacttcttcttggatggggatgggtggctctttttatggttgggagggagacttttcctggatggagaagaatatgcccccttgggtggggattggaggctcatcttgggtgagggaggcacacttttcttgggtggtaaaggcggtgacctcgtgagtggtggagggagaatctctggggaaggtggagagggggccttgtctcgggcgagggaggggtttgctatgtgcgaggtggggagcttgttttgggagcagtttggggcttctcttcgatgagggggaggattgctgggagtaattcatgaagcaggcgcagaaggttcacttgggacaggaacggggccgttgaaggctgatggtggactctcagaagggctgggtgccaaaagaggcttgccagcagcaggggcggggattggaatgaatggaggaagtgaagggaccagtggtggaggggccggcgaagggaaaggcatcaaagcaacaggagcagacctgacaatagtaccgttgttgaacaaggcaagcacagcgcccgttccttgtgatgtggcgctcttaatctgcataggctgcttgacgattctgtccgcgggacgcatctgtagagtatgtcctgttccatcctcgagaacaatatcgaaggtgaggaaatcagcgaccatgctggtttctgcctccaggctgcacgagatggatccaccggctggagctgcgcaccaggcatgtttcagtgtacaggagagaaccggggtgggacgcgggctcgcaaattcctgcgcgaaggaatgacggcggcactttatgagcaatgccacggcgttcacagagaaaatcacgaataaaagccatcctcgagcccaaccaaactcacagctgtcgttcgcacagcataaagcgagagaataaaggccagcgacaaagtgaagagtctacagcaggccatcctcagtgacttgggcgagacacacgattcgcgtcgaccacgacgaatagtttctcgttcgagccaatttggtcgtctctaacaaaatgctccagcgagtggtgtaaacggtgttgcattactgagcactctggattggatgtgtcctttctttcgcttctgcaagcatcagtgtccgccggatttcccttgatgctagacatcggcgaccggagataactccgagcattggctcacgacctcgattcccagagctatcaagcaactccgtcagaagtggcaaatggccgagcgggcctgcaagaccattccacagacttccctgtggttgccatgggtatcttgagccgaggacagccccgacgctgggtacccagcctgtcattgctcagaattatactgtccgcccttgagaatcgcacgtgcagcaaaattacgaaacaaggaagcccaccatttcagcttccttatgacaaagtgatgtgagacactgtagtactgcattgtacgcagatacataatcaaaaccagagcaagcatgtgcagtggaggatcccatcgtgtgagcaacggcggcaaacgtgaatgggagcatactatcttggtgcaatcctagtaatcacagagactgatatctatcgagggtgcaggggcaagtattcatgatgcattgttccccagtaactgcgttgaaggctgaacggagtccctggctgtcttggtctgcatctagcttcttcacatcctgaaaggtcgaatattcgggcatcagacatggcgcttggtggttgctttgtgtaagaggtccaagtcgcttcttcaaggatatagactccttctgggatgggtgggtggcttcttgtatggttcgacagtcctggtgtgtgcagagaatggctagccggtcaggtgagtgattgccaatgtagctggaagagttgcgaccttgacgcctcagaaggtggccctgccagcttctgggaatgtcttagatccagcttggaaacttattcatcggtgcatggagcacccctgccttgtttagttctatcaagttcctcaagcgaaggtagggcgcggtgctgtgctcaagaggcagtccaacatcatttgcgccataggagggctccccagaacattatagtcgaagaggaaccaggtgtcttcctggctggtgaagtataatcaacatggaggaccaaatcggcaagtttcacacttgagaatgataggtgttggtgcacacaacatgggggggtgggtatctcccgttgaacctggtcacgcagcacgcgacgaacatgcacacccatgtcggaatgggcgttacacctggtacttcctttaacgctcgatgtggtgcgacgatctcggcgctgtaagacgtgcgcgttgtcacagaagttacgggacgagcatgaaggcctggccgcggcgagtgtccagcgcgatgcacgcctcgtgcacgatgacaattacactcgagctgatgtcgaggcacccttgaagtccttctgtgatgatcggactcaccgagatcgccattgttgcggtcgcaggggctgtcctgttcggtgagtgcccactaggtgcccccaggcctcttctgacatcctcgatcttgcatccagacgcccctgctcacctcgcacctgcaccctttgctccccaggacccaaagaactgcccggcatagcacgtgctctgggcaggcagacagggcgggccatggcctacgttcaggcggggcgcacccactttttcaagtttgcgcgggagaatgaggtggacaaggtgcgtccgccgctctcgggggaggcttgcgagaggagcccgcctcgcatccagcagcgctatggacaaggcggtgcgtggcagtggcagcctcgctgcttgttccatgcttcccgacccgtcctcctgcatctgcccacgcagctgcatgctgatctgtccgcgaccctgaaccagctgaatgccatccgggatgagctgcggggaggcctgaacatcatgaagcctgggtgaggcaccgtctgtgtggggttgtgtgcctgcccatgacatcggtatgggaaggggtgtcagggtcgggaaccccatgcaggtcctgaagtgcaccaggccccctgccaccaccggatgcagaggtggtcttgccatcatgtgcactctgcatgctggccaggctccctcgcccctcttacctacctaagcttgccagtcggtgcatacgcaggccgatgacgaggcggctgctgcaggaccagggattggccccggccccattgagcatcgggaccctcgccacgccggccacacccgagggtggctccgctggcgcccaggccaggcccgtggcatcgttctccgtgcgggaccctgcggctgtacctcaaccccaggccccagcatcctcctgggcagccagcggcgctgcacccgcccagccagccgccatggcctctctcatgcaggcaggaaggacggcaggtgtgcatgggccgaggatagagggtgcaaacgcgccgagtacagctcgccaaactggccttgggacagccaggggtagcccagaccaggggccacacccctctcagatcccagtcagcgcgctggaggctggcctagtgcaggatcgaactggcacgacacccacggggtctggtgaggagagagtgaaggtccgagggagggtcacccactcggtgtgaggcgcacgccatctcacccccccctggtgacacccccttgccctgccagatctgatgatggatgccctgctggaggagatggtagctcgccaggcgcagatgttcttcaagaatcaggaatcccgatccatgacttgataatggagggcaagggataccccatcgctgctggtggctgcaaacggataaagcttgctggagtgctgagcagcccagagggagacgacttgcggagggacgcgggtctgtatgtcaaatggccctttggcaatcaggcgtgggctgctcgagtgtcgttgacttcaatggccatgtaatccaactgacatgttgcgccaggtagctgggaccacaacagcatgttcatcatgaacatatagtcacaacatctacaatcattctcacccgatggatccataagaaggcacgatctaccaggacgtgataccaagcatctaagttttgttggaggaactatgcgtcattgccagacacatcagcaacgtaccatcagcttctataatgccggagcggtatctctcagccgcaagccgcaaaaaggaagcacgctcacataatcccgggcagggtttttttgtgacatgtcgctgacgtcaatgccttcctggatcccaacaaattcctggcaatgccagttccagcacaaaccctcgtgcaacactgaaccgaacaccgcggcgccctcgcttccgaaagggaccgctcgcgaatagcttcgtaccgcctgccgtcacttggtggtgtgtgccgggaggtccccagtgtccccccgcagcacatggatgtcaaagttatggatgcagagtctggagtcaaggcttcgatgccctcccctcgacgagggtgggtgaatgcgccgctcagccagctgccgaacaagtctgacgctatcaggtgggtggtccacgggtggtgtcagggcatgggacaagtcagcccgagaaattccaaccgacatggaaaccacaggccatttggatactctggagtatatcttagaacagttcattatctttgaagagattctggaaggtttgcaaggccctcacattgtgcaaacacaccatccaccgtgcgcaggaacttcagccccagcctgtacatagcgtccacatgcacggggctcatcggcatcctcatcgacgtcagcccgtacctgggcaggggttgggcggtgccgaccgcctgggcattctggtggctcagcctcctgcaattcactggagtaactgtcatgatcctgctgaggtgcggggttggtggtgggcgccagtggtcctggatgtgtggggctggggggtgtgattcctctacgaggttgcccctgacccgatgaccacctagcttctcgtgtgcccgaatccctcctcatggctcgcccgggcggcagctgcacccaccaactcctcaacaacaacccgcactcccagggtgaccaggttctggggcagcatcgcctccctgcccagcagcaagtcggtggacctgttcttctttggcgccgtggccatatccgtggccatcctgtcggagggcttcgtgcgatacatgacgcactactttggcagcggcttcctggtcgccggccctgcgctctgggtgcgcgggaaaaaacccttgagcgctatctgggtcccacatctggctgctgccagggtttgggtgctggtttcgagcgcccaagtcggcaccccggtccagctcctatactcttcaagcccgacccttcccttttttcaatttgcagtgggccaccgcgaccatcaccgtcctgctcaacgtggccctccccttcctggccatccaggcgcactcccgggagtgagtctcaaggcagaggtgccggcatgctggcgtgaagagtggcttgcctacggcacttgctcaggttgcacgctgacctgtaactgacccgctgttaacccccatgccacccgcgcaggctgccggaggtgctgcccatctggatcgtcgcgtttgtccccggcgttgtcacaggatccgtgggtcccatcatggcaagcgtcctcaccgacctctcgtgagtttctaaatggggggaacggtgaacccgggtgggggatgtcatttctcaggcacagcgccccactcaaagggatgcctggcggccgtccaccacgtcatgggaagcgctggacccaaccgacaggagcgtacgcatcactcccaacctccagcctcgatctctgcctcccctccagtatggcgcgccacatgatctacatgagctacatcctggtgggcctgtcctttcccatagtgttcatcatgctgaccattgtggtgatgcggctcctcttccacggtgggtgccctggtgccgagtctttcggctcgatgatcgcctcgtcttcgctctgacccaacggaacagttgtgaatcagctggggcgatgcgtgttgctggccatgggcctggtatgtgcggcgtgctgccagcggcaggcggaatccatgccttgcagccccctgtgtgaagacactccggtggctccccagggccggccgtcttgtggcgtccacctccatgcgtcatccaaacacccctccctttcttccccaaacacacacacaggcctcccccccccccccccccccccctgccttacnnnnnnnnnnnnnnnnnnnnnnnnnngctcatcctgagcctcttcttccccgtggcgccactcaccctgatgggggacgccctggtcgagctggcgcacggctccatccacgccttcccgcaggacagcctttttaacccgttcttcaatgtgagcctgtagtcggagcatgtgggctgctgcatgttgatctgggcatgcctagcgcgcgactgtgttgcgggagggcatggggtggggtcccggttgcgcccgtagcagagcaccaggggtagccatgctgcacgtgggcttctccctcgtcaaccctcctgcacacgctttccagaccacatcctcctcagcgcacctccggctcgacaccgagcgtcgatccaagactccttttcccccctcccttcccatatctacttgtgttcggcccctttctcacacacatccccaccaaccaacccctccaccccccaaaaacactgcctcgtagtttgcacaccccggcctcacctcggcgctgatggcggggggtcttttcttcttcggcgccgccgtgtggtgggccctgtttgccgcgctggcgacggtcgtggtggccgctcgccgccgcggcctggcctacacggtggcctggtggggcagcgtcttcccgctgggcctgctcggcctcactgccctacgcctgggcacgctgctggacgtggccgcgctggaggtcgtcggcaccgtgctgtccatctccacggccgtcatgtggctcacctgctccctcatgctggccgcccgcatctgggacgggtccaactttgcgcgggcactctgaggccacgtgccttgtgcccaagaatgtatttatatgggggtggccagtgcgactgactcgtcgcaccttgatcccagccaggctcggccaggcgccgaggatggcgtggaccccttcttcacccctcccttgctctccaatttgcactgtactgcccggcaacacacccgtgaatgcagggcgcaggtgccagcaaacaccctgctgtgcgccgctgctgcgtcccccaatcacccattgggcccctcctatgagtgtcacacagccctccaagccaggcacaagggcacgtggcaccctggccagagcatgtgcgagggaatgcttgccctagaaacctgcgggaaggtcaggcggtaccccgtgtccagcctgtgtgcatgcagaccacactaggacagctgtgggctgccgtgcagcccacgcagcatgttgatcagatcctggccggagagcacccggctgggctctgcccccggctccggcagcaccatgcgcgcgggcttggggccggccaggtcgccctgtgagagagagtgtgtgtgtatctgtgtgaaaactgggtactaggtggggcctgatggtggtctacaacagggaactcaacatccgccaggggcagagagtggtcgccacacgggcggcaccatcgccacactctcttcctcgctgcccgctgaatgtttctgtgccctcccctgcatgtgccaccccccccgccccttcccacccacacgcgaccacccacctgctgctgcacgaggaggtccgccagcggcccctccgctgccgcaaactcgacccaggcggcctgccccgccagcgcttcccggagctcctcctgccaggcctccacgcgcccctcctcgccgcagtaccccggctgcatggcggcatgcagcgaccccgccagcgccagcgcccagcccacgccgggactgcgcaggccgggggccaggtcggccgcctttgcgcacagctccgcgatcgctgtggggggggcggggtccaaagcatccccctcccttgcatccgtctccccttgcggctccgcctcctcgccggggacctcccccaccggccccccctcccctgctgcgccggacaccaactggcgccagaggccagc

SEQ ID NO: 40684 - DNA, 100 bp, Chlorella protothecoides
ccctcgcagggcggaggagagcgacgccgcacgcgaaaaattcttcgttccggagtcggaccacctcactctcctgcacgtctaccagcagtggaagagc

SEQ ID NO: 40685 - DNA, 69 bp, Chlorella protothecoides
ggcggtgcatatcacaggcaccctgacgacattgggagacctcttgcggcggcatgagaagtaccatcc

SEQ ID NO: 40686 - DNA, 72 bp, Chlorella protothecoides
tgagtgagagagagagagtgtgtgtgtgtgcgcgcgtgtggaaaagggggagggtggtggggaggggttgtg

SEQ ID NO: 40687 - DNA, 72 bp, Chlorella protothecoides
caggcccagcgaacccaggttgggcaggcctgcggagcccaggttgggcaggctcagcggcgctggcagctc

SEQ ID NO: 40688 - DNA, 77 bp, Chlorella protothecoides
gttgcgaggcagcagggtctggcatgtccccaaaccgctcctccgcatcgggtcggggcgctcgcacctgttgcgca

SEQ ID NO: 40689 - DNA, 91 bp, Chlorella protothecoides
catgctgcgcattaggtgggctcggtcgctgtgggagctcattctccgcactcctgtcgggtcccaaccaagatgtacattcaagtttgac

SEQ ID NO: 40690 - DNA, 67 bp, Chlorella protothecoides
ccccccagccgccagttcgaactgtatcatcaaaatcacccagcacacgtatcagagggatacgaac

SEQ ID NO: 40691 - DNA, 61 bp, Chlorella protothecoides
gggggctgaggccgtggttcggggatggccacctgccctgggaagcagagccgacacccat

SEQ ID NO: 40692 - DNA, 76 bp, Chlorella protothecoides
ggcagcgccaaccccgagatcctggcggtgggcagcgcagtcgtgtattggtctggataggaatggggccctgggt

SEQ ID NO: 40693 - DNA, 61 bp, Chlorella protothecoides
ccgagtgtctcgaaagaaagcggggcggggggacgttgccatgcgccccaacttacaggtg

SEQ ID NO: 40694 - DNA, 61 bp, Chlorella protothecoides
gatggcggcggccgcggccacgcagcacgaggaccaccaggccacgctgcgcctgaccctg

SEQ ID NO: 40695 - DNA, 63 bp, Chlorella protothecoides
agcgaggtatctggcgagggggaagggagctgggcaagcaagcaagctcagcggcgggcaaag

SEQ ID NO: 40696 - DNA, 113 bp, Chlorella protothecoides
tcgcctcgtcaccccacccatcccctgaacacccaggtgcccgtccccagtggcgggacgtgagtggtgaggtggccgtacatccctcctccgtcatccaccccctgacccac

SEQ ID NO: 40697 - DNA, 164 bp, Chlorella protothecoides
gtgtgggggactggagagccaaagggggggcatccaaggtgctcgagaacagcaacgtaaggtagacaggcgtgggcgaggagcacacagggccacctggccccgcaatatcagggactgagctgcgctgccccggtcaccagggaggagtgactgtgctctgc

SEQ ID NO: 40698 - DNA, 182 bp, Chlorella protothecoides
cgagacaatatccaacccttgtgcgggcatcaggacttccggtctcggagacctaaatgtcctaggttacttactcagacggctggccttcctcgatgaaaacgtcctccagagaccccagtgcccaacggccaaatcccaacagcctgtaaaccgcatgccttttccatgcttgatcgaca

SEQ ID NO: 40699 - DNA, 61 bp, Chlorella protothecoides
ttgttgttattgccaatgttgtggcttccccgattcttgttgcctgcgaggaatgaggggg

SEQ ID NO: 40700 - DNA, 69 bp, Chlorella protothecoides
ttcgcctcgcggctggcgccaaaacggggggtttgcccaacacccacgtccgtggcttctgctttatta

SEQ ID NO: 40701 - DNA, 61 bp, Chlorella protothecoides
gcacggcggcgccaactgcacggcctgcccgccgggctgggccagcagcacgctgaacgcc

SEQ ID NO: 40702 - DNA, 465 bp, Chlorella protothecoides
  modified_base (133)..(379): a, c, t, g, unknown or other
gggtagggtggaggtgcgggcatgaggagatcatttagaggcagagtcaagggccagcctcactttatttcaaagtttcattctccgaacctagtttgaggaggcagggctcttctgcaggtgccttgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaccaagacatccagcaagcatggctccacaccaccgcatccattctgcgactgcagcctggaccgcccggaccttcttcctgg

SEQ ID NO: 40703 - DNA, 2355 bp, Chlorella protothecoides
  modified_base (96)..(105): a, c, t, g, unknown or other
  modified_base (1043)..(1052): a, c, t, g, unknown or other
  modified_base (1679)..(1735): a, c, t, g, unknown or other
  modified_base (1920)..(1929): a, c, t, g, unknown or other
ggagattctgtacggcgtgtgagggggggggaggagggaggtgggagtgcctcggaggcttgtgcgcgcagggcaggcccgatgcttgctcgcgcnnnnnnnnnngcgcggcgcgctgggcctggcgcgacgacaaccgccgcgtggccgaccccgtggccgagctggagcgggaggggtgggagcggccctggtccgacgccgaggtccgggccttcatggacggcttcctggtgcaccacaaggtgcggtcgggggtgtggcaccgtgggagattctgtacggcgtgtgaggggggggaggaggggaggtgggagtgccacggaggcttgcgggcgcagggcaggcccgatgcttgctcgcgcggaggccgcgcggcgccccggccgccccgcggctcgcgcccctcgctttcctcggcgaagggcccccccccccttcgcccaatcccatcctcctccacaaccccccacctgaaggactttgcgcgcatcgcggcgacgtgcctgcccgggcgccgcgtgaccgaggtggtggccctctactactccctccagcgcaccgacgtcttcgctgccacgcggcgcaagtaccagctgcgcaagcggcgcgagcagacggaggtcaacctgcgcgcgcgcgccgccaccttcatgggcatgggcgtggggggcgagggcgccgccaagcgcggcgctgaccgcgctgcgggcggtcctgcgccgggcctggcgcggaccgtcagccgcactgaggtgcggaggttggggggggggttaggggaaggggagaatcgggaagtcacttgggtggggaggatcagtgctggggtcagtggcgagcttcagagtgcaagggggttgtctgtcgtcgccaggggcgcaccatggccgtgcagccgcgtctgcgagtcgtggccctgggctcagggttgtgcatgtgcgtgctgacaccgccatcttccccagcgcgcccactccccactctgccatgggcacgcacacctgagtttctgacgccgccaccgtgagcccgctgcgccnnnnnnnnnngcagggttgtgcatgtgcgtgcggacaccgcccacccccccagcgcgtccactccccactctgccatgggcacacacacctgaattcctgacgccgccaccgtgagcccgctgcgccgccgtccgggcccgccacacgtcgccccccaccccctctcctgtcgcagtcgtccggcctcacacggaccaagtccaagggcagcggcggcggggcggggcagcaggcctcccccttggcgccgccctcgttccaggccaccaaccccgagatccccgtcccggggaccaaggggccgcggggtcggcgcagccgcgcgccgcacgtcgtgctgccggcctggatcgggcggcgggcctcgccctgggcgccgggcgcggccccggagccccgcgcgcctgccatgccggggcgcgcgggcgccccggacgaggccctcacgccctacgagcgcgagttttgcgatgccgtgcggctgcacggagtcgactttgaggtgcgggtggggaggggcaggaagggggggagggcttgtctgtgcctggggtggtctggccccgcaggttcagcaggtccaggcatagaattggttggagtacaggtgccccccccccccccccccctgacccnnnnnnnnnnnnnnnnnnnnnnnnnnnnnnnnnnnnnnnnnnnnnnnnnnnnnnnnnggtcccatcgccaggccgtggcagagtgcctgggtgagacgagctctgcctccgtccagctcttctgggaggaaaatgcggagcggctggcgctcgacgtgctggcgctcgacggtgcgagggcgctagacacatcaggggcgctggccgtgtcggggccgctggaggacggggcgctgggaagnnnnnnnnnngcctggtgtggtctggccccgcaagttcagcaggtccaggcatagaactggttggagtacaggtgcccccccaccccctccccatgagccctcctggtcccattgccaggccgtggcagagtgcctgggggagacgagctctgcctccgtccagctcttctgggaggaaaatgcggagcggctggcgctcgacgtgctggcgctcgacggcgcgagggcgctggacacatcaggggcgctcgccgcgttggggccgctggaggacggggcgctgggaagcccccccgcgcccgtcgcgcctcgggatggccagcaagccacccgggccgcgagcgggtccccctgggagggaccgtcgcccgtggacggcgtcgcgccgccgcccgcccccgaggcaccggacgccgcgcccgcgcccggcgaagc

SEQ ID NO: 40704 - DNA, 61 bp, Chlorella protothecoides
cacgcgccccgcctcggcctcgttgatcccgcgctccaggtccaggcaggcgccatggtcc

SEQ ID NO: 40705 - DNA, 76 bp, Chlorella protothecoides
ggcggtgtgggacgacgcggcggccgaccccgggtgtgccccggactgccgcctggccaccacgctgatcgaggtc

SEQ ID NO: 40706 - DNA, 117 bp, Chlorella protothecoides
cggggcgccagggcgacggcggcgcctgggtttacgagggcgcggaggcgagcatggaggtgccggtgggggacttgcaggccgtggccccggcgcggacagacaccgtcaaggtgg

SEQ ID NO: 40707 - DNA, 61 bp, Chlorella protothecoides
ctgggtggcccagggcgggcagtggcaggggcacgtgccttgccaggctgcttgcataccg

SEQ ID NO: 40708 - DNA, 1617 bp, Chlorella protothecoides
  modified_base (160)..(169): a, c, t, g, unknown or other
  modified_base (228)..(314): a, c, t, g, unknown or other
  modified_base (750)..(866): a, c, t, g, unknown or other
  modified_base (1007)..(1016): a, c, t, g, unknown or other
caagtgttcgggtgggtgggcgtgcggggaggggcgtgagggtgcggagagcgctgcgggggagggtgtgggttctaccgtgggcgccggactgccccggcaaaaggcgtgctcggggggtgcatcgcccaaacacactgatccagccagccacattccnnnnnnnnnngactgacgtgctcggggggcgcatcgctcaaacacactgatccagccagccacattccnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctggtggactacgcctccatcaacgtgtggcagctggagggcgcagagggcgatgcccccaccatctacctggcgcccgcatgagccggggctcaaatgcgagggaggggcgcccagtccacatgccgtatgtcccctgcgccagctttcctcaccccccttgccaccgatcctgccctgacccccaccctgacccacccatcgcactctgacaggagatctgtacaccatactgccgctccacggcgaaaatttaaggctctcatgcacatgagggtgccgggcgtgacatgtgccgagggagaccaacagcatgcaaaagaaaaaagagaaacgcgcaaacgatggcgaccaggccggccctgtggagtggtgttctcgtgcattgctgttggtcacatataggagacagtgcggctgctacaaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctcgttgtgccacactgcatacgggtggacgaaagggtggaggttggatgagggtcagaaagggctccagcacacaagagtggtattgctcaagctcacccgccttgtgccgcgctctcaggccatgcagggaacatcnnnnnnnnnnacctcgttgtgccacactgcacatgggtggacgaagtggtggaggttggatgagggtcagaaagggctccagcacacagggctggtgttgctcaagctcacccgccttgcgccgcgctctcaggccatgcagggaacatcagccgcactgcgagccgaccttggatggccccttgctcatctttgccacggtgcacatcagccaaagcgacccaaaaacaacacagcatcttctttcccaacaataaacactgcacctatttgtggagaaggtggcggacagggatcggaaggaggcggtggccagctgctccgtcagcgtgtgcggtgcgttggcgctcaacgccgccccctctcccagcccagcccctggtctgagcgcagagctggcgggggaacagtgcggcccccgaccggccgacgccacgccggccgacgcaccgccgccggagtccccaccggtcccctcgcccccgcctcgctccgtggaggaggaggcgctgccgctgcgccctgcaagcagggcgtagagcggggccggcagggaaggggcggagggcacgcgcggcagcggcgcggcgtcgcgccgctcgcgcggccgg

SEQ ID NO: 40709 - DNA, 64 bp, Chlorella protothecoides
ggtccagacatttcctcagtgtcacggcataaaacccccccctcccttgctcgagcaatcccct

SEQ ID NO: 40710 - DNA, 19258 bp, Chlorella protothecoides
  modified_base (343)..(352): a, c, t, g, unknown or other
  modified_base (1201)..(1210): a, c, t, g, unknown or other
  modified_base (1880)..(1889): a, c, t, g, unknown or other
  modified_base (4675)..(4684): a, c, t, g, unknown or other
  modified_base (5255)..(5264): a, c, t, g, unknown or other
  modified_base (5747)..(5756): a, c, t, g, unknown or other
  modified_base (8589)..(8598): a, c, t, g, unknown or other
  modified_base (10013)..(10022): a, c, t, g, unknown or other
  modified_base (10093)..(10185): a, c, t, g, unknown or other
  modified_base (11002)..(11011): a, c, t, g, unknown or other
  modified_base (11947)..(11956): a, c, t, g, unknown or other
  modified_base (13135)..(13144): a, c, t, g, unknown or other
  modified_base (14417)..(14426): a, c, t, g, unknown or other
  modified_base (16221)..(16230): a, c, t, g, unknown or other
  modified_base (16367)..(16376): a, c, t, g, unknown or other
  modified_base (17261)..(17270): a, c, t, g, unknown or other
  modified_base (17782)..(18008): a, c, t, g, unknown or other
  modified_base (18169)..(18178): a, c, t, g, unknown or other
tgccgcgcgccgggggccagcgcggccagccgccccgccgcgatggagcccagcacgtgcgcgtgggcgcacccaggcgccatggccagcgcggcggccgtcagctccgcggagcgggagttggcggcgcggcgcgcctcgccgtcctccgcggccagcgccagcgacaggtctgtccactgcttggccgccaggcagtgcagcgccagggagtcaggctccagccgcagcgcctcctgcagcgattgtgaaattgtgatggggtaagggtgtgtgtgtgtggggtggggatcgcgatgtcggacagcaagcctgacagtgcgaaaagggtgcgagactccannnnnnnnnngggctccagccgcagcgcctcctgcagcgatggtgaagttgtgatggggtaagggtgtgtgtggggggggtggagatcgtgatgtcggacagggaggctgacagtgcgaaaagggtgcgagactccaccaccttgtcctgatcgagcagggtgcagcgacattggaaaagcacccaacccacgacatgagcatccgcgccaccgccccgcacctcaaagcactccacggcgagctggacgttgtactgcctctcggcggcgaggccggcctgcaccaggcgctcaacctccggggtcgcggaggtgggccctcgggccctcggccccacagcagggctcgcgatcccgggctccagaccccggggccggcgctgctgccacagccggccgccccggctgagcaccctgcgcgaggccgcgccggcgtgctgctgccaggccgccgtcagctgccgcgccagctggccggaggcggacttggactgctgggaggcctgcaccagggccatgaccagggctgcccggaggccggccagggtgtgcgtcacgcggctgccgaggcccgacagggggcgactgtttcgaggcacaaactgtccaccgaagcgagagaacttggggcgagggggagggtgcagcaggcgggggcgagcgggggaggcccgcggggggaagctggggctccgacaggcagcctccgacagggaggccaggcagggcacttccggcctgtcctcggggctgggctcccattcgaacatcttgtcattgaacttcattgtggaaactttggtgcatgtgatttgacctgcgtgaacagcgcgagtcatggggtgtggccttggtggnnnnnnnnnnaggtcattgaacttcattgtggacacttcggtgcatgtgatttgacccgcgtgaatagcgcgagtcatggggtgtggccttggtggcaacactggcttcccactgccgctaggtccggcgaggaggcaagcaaccgaatattcgacggctctggacgcggtgaatcttgtgagcaagtgaaaagagtactggggccagcgatgtccgagcagaggctgctcgcccagctttgtgacgcgctggatacctagggtgggtatcggacaggaacccatggccagcgcggcctggaaggtggcacagatctgccgggagttggaaagaatttgaatcccgatctcgcgagtgaggaaatggattgacgcagactctgcgaaatatgtggcaggatattgcggaaattgtggtcgttcattctagagtacttgtagcttgcacgcggcagcagctgctctgctggtgaaggccatcagctcgctccatgtccccatggctgcctagattctctaagtggcccttgcaagtaagaagcgagctccgtggcttcattgttaatgtagagagcgattgtcgagagtctgctcctactcatatcgacatgaatctaattgtcagccccatccgcaggggttgcataggttttgccccaacagggctggagcaaatgcannnnnnnnnnggagcgactgtcgagagtctgctcctactcctatcgacatgatctaattgtcagccccatcggcaggggttgcatagattttgccccaacagggctggagcaaatgcagcctggtattcctcacaggttctccctaccctcacaagccgccaagcgtcctgcactgcatgtggtggtgggatctgcgaacctgcacaacagtagtgccttcccctacacaggaaatgtatgaagggagctgtaacacaaccaagaagcaaccgcgctggctcccgataccttgtcgaaacatgttttcaatacagacgatcttcggactctttccgagtagacatttaggagctccttggagcagtgcaactggcccgatctattgagcgacttttccggtcacatgtgttcacatgagcgcaaacggtggcgggaaatttcttcaccggcgctctcgcacagtcccatgaccccaactgcatgtgcactcatgggcacgagcgactacctgaacgcgtgcacgcgccggaatgccaacgtgtatacctttttcaagcttatataggctcgttcccgatgccgtgccctgcttgaccctttcagcattcattgctgcacatgcacgccatgcaatctcctgcgggctcgcgaaaggtgttcctgctgctgatcgtcgtctgcacggctgcaggtgagcatattgaggctcaacgtgcaggctcatcattgctgctcgttgtgtggtgtacttgtattggagcccgaggcccctcgacccattcgccgcgcacatgctcgcaggcatccatgcccgcactccccgcgcgctcctggactcgagctcctcggactccgtagctaccatttataaggatggtcttcagtcgggtgggtgctcgagcagtgacctatgtcgggatgcgatgagctcccatgcttgccaggcccgtgccatggtggttgccgatcggttgaggggcctgtcatggggccgtggacgtcgagcaggcgagaatcaggcggaatgtcaattcaccctgtgcgccattcggggcttctccctcgtactcatgagtcatgctcttgacactctttgcaggctggggcagttggagctggggaacgaaaacgctcaacctccaggactctgggaacgtgatgagcggcagcaagtatgccctgtgcgccacggtgagcagggcatgcatggatggcagggacacagtcatgtgcagtgccttggctgagcgtggggcagagcgtccagggcatgcatgacatacgttcatgtatcttttctcaagagcttccatgatgtcagttgacatccactgtcaattgcctggcccctcatccactcaaacccctctttcaccacgctcccaacagctggctccctacggcgcggtgtccctgaagtccaacatccccttcaccctggacggcatcctgggtttctacatccacagcaccggcggcgccaccacctcctccaacaccagcttctccctgggcgacctggagctgcagttcgagtccagcgccccctcctcctacaccatctcccgctcctacaccctgtccgagctgctcaaccgccagggatggattgacggcaagagcccggacaccatgctgcacaacatcgagagcaacggctgggagtcgctcaaggtgcagatgggcggcttcgcgcccagcggcaccgactccgccaagtacgaccgcatcacgcttggctcctgcctccagcgcttcgacctgtgcacagggaagaccgtgcctgacatctacctctgtctggacaagctggtgatggtgtcgggagggtgatgcagccggcagctggaaggaagcaggaggttgggcagcccagtgggcgtcggtgcccttggccgtgcctggcggttagggccaaggcttgggcgcttcaatctatggagcattgtttgctggtatccagggcctgcccggccagtacgcagcatgcactggtccgtgcaagctcgccatggccgacgacgctcctgccattccccctccatcactcgccatgcctccacagcaacccacaatgggggtggccgcggcccgatgctcctcctcccaattccccagcctgcgcccacccagatgcccgccccacactcccccgatgagcgtccacttgaggaaagtgagactgatgccccagccccgactgccggtccgtgaacaaccgacccgtgacgatacacacgccctgaaactggtccagtactgttacccctcctccccctcacctcgcccgctttgcccttcacgccacctcccttgcgcacgtgacagaccgtcctgcaaagctccactctagcgcctgtgtgatccccctctcccctcatggcaatgtaacgaccacgtataaagacgaggagggagcaggggggttcagcacagaacgacgggaaggtgctgccgggggcaggtgctgagagggtgactggaacagggcaccaccaatacatgacattgcctctgcccaggtagctcaacccctggcaatggccctccagccgatgtcgcgccggcagaagccgtcggggaagctgatcgcgtccactgctgagtaggcggcacgctgggcagactgcacatcgtcgcccagcgccgtcacgcccagcacccgcccccccgcagaaacctgcagcatgggtgacggggtcgagggaggcagacgtggctgcgcttgggatgcactctttgagctcgacccctgcaatcatctcgaggcatcccagggcagcatgcaaaggtcnnnnnnnnnngcggggtcgagggaggcaggcgtggctgcgcttgggatgcactgtttgagctcgacccctgcaatcatcccgaggcatcccagggcagcatgcaaaggtcatccatagccatgccatcgtcccacccaggcacgagtccctggcagacaccgactccagactgctggtatctcccaccacgacagcgacacccctgggcacccaccactcgtctgtcctccagcagccgcgtgccggcatggaacaccttggccccagtcacgccgtccaagcccgtgatgggctggtccttgcggtaggaccccgggtaccccttggccgccatgaccaccgtcaggctggggcggaggggcgggagaatggagggagctgggcggtgctggcagtcgtggctctggggaagctgtgtccggtcgtgcagcaatggggtgccagaccatcgcacttcctgtccccaggcgcgccgcctcggcctcgctcccttccaccgcacgcgcagaagctcccggccccgccccacagcccttggccagtgcaccgagcacacgctcacctggggcgtggatcccannnnnnnnnngacgcgcagaagctcccggccccgccccacatcccctgtccagtgcatcaagcacacgctcacctggggcgtggatcccagtcgagggtgatgggctccccctggatcacggagtgcagcgtggagagcaggtcggagcgcaggcgcaccatcagcgactggcactccgggtctccgaagcgcacgttgtgctccagcagcttcacctgcgacccctcgatcatgaacccggcgaagagcacgccgcggaaggggcggccctgcatgcgtgtgtgtgtgtgtgtgggggggggggcggcgctggggggggcattaaccaaaccagtggggtcgacgcttgggtcacccatttgaggcaccatccaccatgacctggcaacggaggagggaaggacagacatgcccggtgcagtggctggaggtccaggccatagcgacatttcagcacctcttctgccaggctgcctctgtgacacaccctcnnnnnnnnnntatgacccggcatcagaggagggaaggacagacatgcccggtagagtggctggggggccaggccattgcgacatttcagcacctcctctgccaggctgcctctgtgacacaccctcttgatctcccaaaccccctggtggaccctctgttaacacaaacaaccattccatgccagatcagccattcccccatcccccccgtctccaatctcccctcctcctccagcctacctcggagcacattccgcgggcggtagggtacatgatggtctgcatggcctggtccaccagctgcggggtgagcaccggggcgggcgagtagctgcccatgccgcccgtgttgggcccggtgtcgccctcccccaccgccttgtggtcctgggcgccgaccagcgggatgacggtctccccatccacaaacgcaaagaaggaggcctcctcccctgtcagaaactcctccaccaccacctcctcgcccgcgcgcccgtaggcgccgcccgtgagcatggcgtccacggcctcgtaggcctcctccaggctgtgcgccacggtgacgcccttccccgccgccaggccgctggtcttgaccacgatgggcgcaccatgcgcccggatgaaagccttggcctcccgcgggtcggtgaacacgccgtaccccgcgctggggatgccgtgcttggcggtcaggcccttcatgaaggccttggagccctccagcgccgccgcggcggcgctggggccgaaggccgcgaccccggcctccgtcagcgcgtccaccacgccctcgaccaggtattgctccggacccaccaccaccagctggatgccgttgccgcggcagaagtcgatcacctgcgcggatggaatgaagacttgtgtgcatgtggtgtgtgcggggttttatgctgctgggtgagagctggtgtgcccagggagcggggtgtcttcctcactctatgactggcaggggcggcctacatgtgaacccacagcatgagcacccggccacatcctgtacagaggtcatactcctctcggccctctccttcttttcccctgtctctctcgcaccaacctgcttgtggttggagggattcagccccgagacggtggtcatgttgggctccagggccgtccctgcgttcccaggcgccacaaacaggcgaccgcagtcgggcgactgggcaagcttccaggcaagggcgtgttccctgcctccagagccgaggagcagcacgttctgaccggaggctgtgactcttgggggtgttgcccggcaccgcctgtgagaccgagactgtaggggccgagcattcccagcagaggcacgcatggggcggggcatggggagggatgagaaaccctgcgccatgctaggcatcgcgctggccgtgtgggcggctggcatggacggggtcggttggctcactccctaggatacggccatgcaagtgccgaggagtcactcgaggattgctgccagcgcaggccaaatggcaaatggattggattcgagttcttttggcaaacatgcgcccttagttacctccattcgcatccatctgggctaggatgcccgattgctcaggcacatctgtgcgccctgcgctgcgtgctgtcgggagccttgatgcccaccgggtacacacgcaagctgtcctgcgcctccatattaacacctgttgcgacaactaaaacgctcgaaacatgacagcttcatcttcttgcaagccacatcccactgaacttgcatgaggagcagggaccttggtcacacctgcgcccctccgtcacaacggccaacgtcgcatggatcgccaggccctcgagtacacccgagaacactacaacaagcactcgaaccagtacggcagcactcaggaggctctagccgcgcgagcatctgggcccggggctcccctcaagaagtttcacaactatatcaagcgccacctgataaacaggcatgctggatccagaccaggggacgatgatctcggactgtgcatgaacgataggatgtctcaaggccacaccttgtttgccctctgcagatttgccaagggagctcctcgccttctagatctagcatgcggccggggcggggacatctggaagtggattgatgccgggatcccatgtgtgaagggcatcgacctttccccccatgaaattgaggaggccagggccaggtgggaggggaaagagttgtgtttggtgattccatcaagggtactggcaagcaggctggcaagcaggctgatagatagagatgcatggctgtgcctgtgcctgtggctcaatcgtaccctgatgaggtgcagggagtcttgctcaatgccgaggtgatgtgctaatgccactcgagtccagcgtcgccttggtgcaactcgccgatgcctgggattggcgaagacgtctctcatccacctccctcatgtgtgcgcatttaggttctcagaggcacaggctcgaaagtcggaactaagcctggactacagctttgaggcatcgccagagctgggcttgagcgagtggaaggagagcgagagatacgatgcagtgacatgcatgtttgccgtccactactttttcgttgcagagaaggccctcaagcaggtgggggaatgcttctggtcttggggggctggcagccctattgacctgtggcctagaccccatggactgcctggtggaggggtgccaaaatgctgacaattccagtctgctttgattgcatgtccttggcgtatctgtgtttggtgtgggatgacttgctgactccatttgccatgtacgctagcctcttgcacttccgtcatcaagatgctaannnnnnnnnnatgtatctgtgtttggtgtgggatgactcgctgactccatttcccatgtacgccaacctcttgcacttccgtcatcaagatgctaaacatgctcgacatcccttccaacatcacccatccacagttcttgcacaacgtgtccatcaacctcaagccaggcggctacttctttgggaccgtgcccgacgggcggcgggtgaatgagtgcatccggggctccttgacctatcaatctcccatgctcactgtggaggccaggtggaaagggtcgcctggctgttttgggagcgcctacatctgtgccattggagacactgtgacaggatgtgagtcgaggggacggtgggtggcggtgactgaagggatggacagagggccttggcttgagggagagttgtgacagcggacgtgtcttgtggagagtgattcctcccgcaccatcacccattgccactgagcccaagacacgacgcccttgtcacatcctactgcagctgagaagggcacggaggggtctctggagtacctcgtctactccaacgtgtttgtcggggtggcggcgcagtacggcctcgtacctgtcctgcagtacgatatgcccagtctggaaaacgtccttgacccggtgagaaggcttgggattcaaggagggaacatggacggactctaaagcctggggatgcacagcgcttcgtgcattactgtgagacatacaacctgctgagaccctgcgccagaagccactgaccctggacctcccatctcccaacttccctaaggctgacgccaacaagccgctgaaacacttcctgccacgctttcctggcagccaccccagcctggagcaggcatcccgtctctttgccacattcgtgttccagaagcagggggaataccccgcggccgagccgggtgccaggaaacaagatgccgctgagccaactgccaggaaacaagatgctgctgagccggccatccggagtgatgaaacgatcgaggcatctcagccgcaccctcggcttcacgaggcgacggctgcggctgagaccccagcagctacattgcaggtgcagaaacgcgacaggggggctgatcttgcaccaaagaaccctgcagacgatgacaatcccatgcctggccttgaagctgccctgaagcgaacacggcggtgactgttgtccgtcggttttgttgcgaagcatgtagtggtcgcagcataatgagccacgtggatggctgctgctgctgcaaatggcacccattcagcagaatgtgtggagagtgaagcgtgccaaaagcaaaggagatttgtcagaatcctgaacctaccgccgagtggtgtggaccaccttagtcttgtcacctgagccgaggttcctagcgggcatccgatcgccgatggagcgcgggcgcgnnnnnnnnnntcttgaagctgccctgaagcggacacggcgatgaccgttttccgtcggttttgttgcgaagcatgtagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagcaaaggagatatgtcagaatccttaacctaccgccgagtggtgtggaccaccttggtcttgtcacctgagccgagcttcctagcgagcatccgatcgccgatggagcgcgggcgcgagcactgtttctctcagcaccccggagcccacatgcgatgccaagttccgtccttccaaactcattgtcacaaagaacaacatagctccatcagcagctccctgagtgccattggccccaccactcgaaaccttgactggaccgtaccgcggagaatatctcgatctgggcgctgcgggtggttttggagacgttcttggtccacatagttacatctgaagtcacaggagtccgaagtcgtcccagcgcccctgtttggtcggacgtgcgagtccaccagtgagtgatctggccacgcagagctgagaggggttgtgccagtccatgcaggggtgatccgaattcatctccccctcttctcactttgtacagtggccgatgctgcgccaggcccaaacggggcagtggctgagcctcccagctatgcccaccccaccgctgcactcttcctcgtcctcttcaagttctctgccatcttctactacgtcctctgcggcctgtttgggaccggtttcgtcatcaacttttgcgtgatcacattcctccttgtctgcgatttttggacggtgggtggtgctttgtgggtagatgtcacctgggcgtggttccgaacggcccatgcagagggtggacctcctgaaggctgccttcaatgtcggaagaaaatttacacctgggcaggcctcgccgctccannnnnnnnnngggtgggtggatgtcacctgggcgtggttccgcacggctcatgcagagggtggacctcctgaaggccgccttcaaagtcggaagaagatttacacctgggcaggcctcgccgctccagatccagcatctgaagaggcctccctcctcaaaccacctccatgcaggtcaagaatgtgtctggccggctcttggtggggctgcggtggtggaacgaggtgtctgagaccggtggcagcgactggaagttcgagtccctggcggagggtcagcgcaccgtcaacaagcatgatgcgcgtgtcttctggctggtcctgtacatcactccccccctctggtgcctcctgggtctggtggcactgctcaagctcaacctggactacctcctcctggtggtcattgccaccctgctgtccggggccaaccttgcggggtacctgaagtgctccaaggcggcgcaggcgcagttgaagggagtgacctccggcctcgtcagtgccggaatcaaggtgcgctgggagttggtgttttggctgtttgggtggagtgagagtctataactgttccagtacatgccttgcttaggactgtgtgacaccacaggtcgggcaccctgcttgatgcttacgctctgccctttcacacacccgtccaggcatatttcaaccggggttgagggagccagaatgtgcgcttgggcattgttggagtggcgaccgtcaagcaacattatatggcatgctaccacttgtgattgccatcctgtactgtataggacccagtggttggaagaccaactatgcacccggcgggacggtggtagacttctcggcagcagagcagcgcgcgcgaaaacttgcgaccatgcggacggcatttttaactagaaatcgctccgagattcaaggaattcaatattcatttcatctggaattaatnnnnnnnnnntggtggtagacttctcggcaacagagcagcgcgcgcgaaaacttgcaaccatgcggacggcatttataactagaaatcgctccgagattcaagcaattcaatattcatttcatctggaattaattgatttcgcatatgcgaacataactcatgcctcgctggcaagcttgtcgagacattggacagtgtcgtgcgaaggaccctcgtcggcgaggcaggtgtacagcaagaggaccaggactccaatagctcctagaacaactgcttagtcgctttggactggtgtcatgggtgatgacgagccagccatgctggctgccagcaaggtatggagtccatgccgtgtaccttgtagcactgctcaatgcctcatgtcggctaagagggaacattctgcactcttggccggttcctttctcgacgacacacaggcagtcctcatgccatctgaggacctaccctccgactctgtactcattcgtggcttcgagtttgggaaggaggcctgcaccctggacgcattgatgtcatccatgctttccaccggcctccaggctagcgccctgggtcaagccatcgtcgaggttaaccgcatggtgaggaagcgggatggggacttgaggatgctggtggtcggtgatgttgagtttgacagtcagggagctgagggagtacctctgagacatgctcaacttggaatccgtaaccccaccatgcagctcaaacccagtattcccccctcccccttcgatccatctccagctggactggagactctcggacgagcacgtgctcgacacagatgcagttgttgagccagctgagcgagcctctgtccgcgccaagctgttcctgggctacacctccaacctggtgtctgccggggtgcgggagcacatcaagttcctggtgcagcacaagctcgtggacgtactggtgacaacagccgggggcatcgaggaggacttcatcaaggtgggcttgctttcttatgaaccggccgggttggggaggagctgcgtggcgctgggcacacccaacctcctttttcatagttctggcaaagcatgaggagtcttcgcaatggagtgacatagccggtgatatggcgcaatctcccactgaggccttccttactactgaatttgcttgacggcccagccttcagccatgcaacannnnnnnnnntgcgcaatcacccgctgaggccttccttaccactgaattttcttgacggcccagccttcagccatgcaacaggataagccagccccacccaaacctgccacccacagtgcatgtcccacacctacctgggggactttgccctgaagggtgcagacctgcgctcgcgtggcctgaaccgcatcgggaacatgctggtgccaaactccaactactgtgggttcgaggactgggtgatgcccatcctggatgccatgctggctgagcaacagaatgctgggacgaggtggacgccctccaaggtgggttggggcgcggggcaagctgaggtcacagcagacacctggtttgcgggaaacagggtggcatggccccggccccctaaccctctgcagccgctctccagcgctccttctcttcaggacgccgcatgactgccttgacccgtgttgctccttcatgcaccaccgtccccttcaaaccatcaggtgattgcacggctgggccaggagatcaatcaccccgactccatctactactgggcctggaagaatggcatccctgtctactgcccggccctgaccgatggttccctgggggacatgctgtatttccattcttacaaggcgccagggctggagatcgacattgtggctgacatccgagctatgaatgacgaggccctgaaggccagccctcggaaaacgggggtcatcatcctcgggggcggcgtgcccaagcaccacatctgcaacgccaacctgatgcggaatggggcagactttgcggtgttcctcaacacagcacaagaatttgatggcagcgattcaggtgagggggatgtgagggtagggtaggggagtggatggacagctcatgtgtgtgatccggagggagggcatgtgatggactcaagagattggcatggcttcaactccacactgagacgagcatgtactcggctgtacgacgcagcgcattatattcgttcttgagccatggtttccaaatgcacctgggccagccgcaggtgcattcagtgtcatttgaggcacccgacatctagacagaggtcctgatgaccagcactgaccatcttgccttccattatccaccccttccaggtgcacgaccggatgaagcagtgtcctggggaaagatcagggcggatgccatgcctgtcaaggtgtatggagacgccagcatcctcttccccctggttatctcgcaaacatttgccaagcgcctggccagagcggatccagggtcatccgannnnnnnnnnattatctcgcaaacatttgccaagcacctggccagagcggatccagggtcatccgatggactgtcgttaccttctgctggatgtgatgtaacagaatgactgggagataaaaattggcaggatagccctgaaggggtgtcgatacgctgcatagcttgtatcgcaatgtggcgggaactcctggtccttcaaactcattttgaaagtgcgccatgctgcgggcaccgaaaccaggccatgcgcacaagaggccgctacaattgaggtcacgcccttgctgtctcgttgctagtcggtcaattaaattgcggatccgagagtttggagtgctcgctacgatgtccggcttcgatggtacgttgggctctggggcttgtgcgccggggtgtgctgcgctccggtacagtgcaagaatacacacctgcctcgatggtggtctgttggcgaaaatattcttcgagctcgtctcgccatccgccgtgcagagggcgccgtgttttacagcgatcagcagttcgtgtccgtgggcctagcggaggatgccgttaacctgaccaagcagcaggcgctcaccaagtttggggagttcatcaggacattccagatcgacaataagagcagcagcttcccatatgcgtgagtctgagggcgcaggagcctttgggaccggctgcaatggtgcctgaaacagccagggttgcaagtgctgtctcatctgctatcatggatcttcgcacagggaatcgaaagaggcacacgatccgcttgccctcctatgaacctcattccccttgaatatctgcagagaccagcttgccaagagctcgcaacgcttgcgggtcgatctggcgcaccttgcccatcccgtgtacggcgcccccgacctggccagtgccctcacagaaaatcctgccgacttcctgcccctggtaggcagctgaaatggggcctgaggtcaggagtaattggtagtttcaatggcatcaaccacccaatgcagtcaccctgaggtgcagtaatcctcggcatgctccctggccgtcgtgcctggtcacctatccttccaaccctcctctttgcccatgccgcgttcagttcgaggcagccgccaaggctgaggcacagcgcatccgctccctggccgaggatggcagcgagcccgatgtggcagatgtccaagtcatgctgcacaagagctcccccgctgggcacgctgcgcacacgctgtccatgcgcgacatcaaggtgggctcatggtgctgcaaggggtacagggcgtgtgcatggagcgcaggcccgcggcgcgatggtctcggtccatgatcgaccgggtagagtttttttccccctcctcttgtcaccccaaccttcccacctttcctgccgcagcccgagtcatatgtgagtaagctggtcatggtgccgggcatcatcaccgccgcctcccggcccaagcacaaggccacctacatcaccatccagtgccgccagtgcgggtgggtgaatggggaagggaagtgcgcagtacggaggggtgttgtggcgcaggaagccgtgggggaatggaatcatgccaacacataatctgcaggttcagaggtgagacttgtgtgaagaccttttatacacacacgagaggccccccattcccaccagagcgccaggaactctttccatacaaataatgatgaacctctttgcccacctcgacgcatctccatcctcacgtccccaaatcaatccccccccaaaaacaactctcacaattccctgcaggcactcacagcggctggcnnnnnnnnnncgcgtagtagggaggggtgttgtggcgcaggaagcccagggggaatggaatcatgccaacacataagctgcaggtccagaggtgaaacttgtgtgaagacctgttctacacacacgagaggccccccattcccaccnnnnnnnnnntgtccccaaatcacccccctcccccaaaaaataaaccctcataattccctgcaggcactcacagcggctggcctgtcgccccggcgtgggcggcgtcaccattccacgccagtgcggcgcctccacggtgcccggccaggcctccaacacctgcggcatggacccctacctggtgctgccctcccgcgccgagtgcatcgaccagcagagcctgaagatgcaggaacggcccgaggacgtgcccacgggggacctaccccgcagcatgatgtgcctggtggaccggggcctggtgggttcggtgtcccccggcacgcgcgtcaccgcggtgggcatcctctccatctaccagagcaaggaagcggggaaggcgcgggacagggccggcggcgtggccatccgccagtcctacctccgcatcgtcggcttccaggaggatgtcatcaacggcgactcctcccggaaacctaccttctcgtaagggtattgtgtttctgtgggggggtggagaccacactgcccggcagggaggagttgcaattcaacataccaggaggccgcctcgttgcatgctcccctcacaccccaacaccaccgcgcagcctggaggaggagcaggagttcaaggagtttgccgcccagccgggggcaatggaccgcatctttgcgcgcatcgcgcccaacgtgagtgaatgcatggcgaggggcgcggcaggctgggtgggcgcgcgcgctccctgtctgtacatggtgatgttgtacggacaccgtgggatccggcgccaggccgtgtcagcaccacaagctgcctgctgaaatcccccatacaaaatccaccccatcccaacctctcaaatcacctgcacctcaaacgccgcagatctnnnnnnnnnncatggaccgcatcttcgcgcgcatcgcgcccaacgtgagtgaatgcgtggcgaggggcgcggcagggtgggtgggcgcgcacgctccctgtctgtacatggtgattttgtacggacaccgtgggatccggcgccaggccatgtcagaaccacaagctgcctgctcaaatccccatacaaactccacccatcccaacctctggaatcacctgcacctcaaacgccgcagatcttcgggcacgccgacatcaagcgcgccatcgcggccctgctcttcggcggcgcgcgcaagcgcatgcccgacggcacctatcgccgcggcgatatcaatgtcctgctcctgggcgaccccagcactgccaagtcccagttcctcaagtttgcctccaagaccgcgcccatcgccgtgtacacctccggcaagggctcctcggccgcggggttgacggccagcgtcatcaggtctgttattgggggccgggtgggggggtggatgggggaagaatggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactcccccacccaccctcccagagacccgtcatcgcgcgagttctatctggagggcggcgccatggtgctggcggacggcggcgtggtgtgcatcgatgagtttgacaagatgcggcccgaggaccgtgtggccatccacgaggccatggagcagcagnnnnnnnnnntgacgagtttgacaagatgcggcccgaggaccgcgtggccatccacgaggccatggagcagcagaccatctccattgccaaggccgggatcaccaccatgctgcgcagccggaccagcgtgctggcggcggccaacccgccgtcgggccggtatgacgacatgaagtcggcgcaggagaacatcgacctgcagtccaccatcctctcccgcttcgacctcatcttcatcgtcaaggacgagcgctccatggcgcgcgacaagatgatcgcgcagcacgttctgggcgtgcaccgcgccgcgggcgggcgcccggaggtggatgaggaggaggtcagggtgagtttgtggaagggaagttggggggggcagcaggggtttgagcgcacgaggaggatggggagcgggggtggggggtgcacggctgcccaccctctcgcctgcctgccgctgcgccttcaccagccctcacacgacccagcacacctccaccctccctcctcctttccctgcgtaacgcacacctggccccaaccttccccccccttcctccaatgtatcaacacataaggaggaggagttcctgaagcggtacatcgagtacgtgcgtgcctcgtgctcgccgcgcatcaccgactcggccgcccgcctgctggccaacgagtacgtggacctgcgaggggaggcgcagcgcgccgccagcgccgagggcgccgacgtccccgccatccccatcaccgtgcgccagctggaggccatcgtgcgcgtgtcggaggcgctggccaagatggggctgcaggcggtggccggcgagacccacgtccgcgccgcgctggagctgttcaaggcctccaccatggacgccgtcaagtccggactcatggacaccctggtcttcagcgaggagcagcgcgccgaggtgcaccgtgtggaggagcagatcaagcgccgcgtggccatcggctcctttgtctccgagcgcaagctgctggacgagctcagcaggttggcgtttattttttttagggggggggggcttgcttttaggggggggggggggtcttgttgtggggggggggggg

SEQ ID NO: 40711 - DNA, 66 bp, Chlorella protothecoides
tcgggctggcgtacacggtggccagatactcttccctgttgccagcaaactcctgagtgttctagg

SEQ ID NO: 40712 - DNA, 61 bp, Chlorella protothecoides
tgcagcccagatgccccagccctggaaaataactcgctccaccctcctcgctcctcaccat

SEQ ID NO: 40713 - DNA, 80 bp, Chlorella protothecoides
cccgttcttgcccgtgaacccctgtacgataacccgggtggtcttgtccacgaacacggcgggggtctgcggggttggag

SEQ ID NO: 40714 - DNA, 407 bp, Chlorella protothecoides
  modified_base (95)..(328): a, c, t, g, unknown or other
gtttgagctggcaggcgagctgttccgcaggtgggaattggaggcgagcaatgagctggtgcctggccctccatgtgacaggcgcatgcgcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggatgtaaatgtgggttcgtcggggcgaggagagatggtatctgcgtcgcaggggcgaagcatctccctcgatct

SEQ ID NO: 40715 - DNA, 61 bp, Chlorella protothecoides
caggatgctcctgctcaatgggggggaggggggtggcatgctgagggacaggacaggtcaa

SEQ ID NO: 40716 - DNA, 81 bp, Chlorella protothecoides
gctcgccccccctgggctcgccgtgcacggcccctgagaggacatggccagagcaggacgtctgtgggtgccgaggacatc

SEQ ID NO: 40717 - DNA, 75 bp, Chlorella protothecoides
tctgagccgaaggccctgcagcatcgcagctcctcaccggccccccacgagggcgagcagcgcccccagcaggcg

SEQ ID NO: 40718 - DNA, 73 bp, Chlorella protothecoides
agcccccgcttgcaggggcgtcagccggtgggtcaccttccttcccgtcgggcatcgattgcccggcggcctc

SEQ ID NO: 40719 - DNA, 61 bp, Chlorella protothecoides
tgcctgcagggccagcaactcctcggcgacatccccactcggctctcgatcccgccgccgg

SEQ ID NO: 40720 - DNA, 136 bp, Chlorella protothecoides
caccgcgttggcggaccaggccgtgctgaagttcatgcgcgggccgacctggcggaaattttgggggggaggggcgggggtataatcgggagggggttgggatggggagtgaagaggctggggagtgacctggagg

SEQ ID NO: 40721 - DNA, 2040 bp, Chlorella protothecoides
  modified_base (536)..(545): a, c, t, g, unknown or other
  modified_base (974)..(983): a, c, t, g, unknown or other
  modified_base (1324)..(1333): a, c, t, g, unknown or other
cagggagcgggtcacggccgccagctcctcatcgctcttcacgccaaacttgtcctcgtagtaccgccacttccagccctcctcccccagccggatgcgcccctcgtgcgcaaccatgtcgtcaaacaggtcggccttctccttcagctcctccttcatcttctccttgtacgcggcgatcgcctccgccgcctccgtcgccgtctgtggcggatgcacgtggaggtgggggcgggtatttgtacggagggctgcgaggtgagggctcacaggtacgaaacctcacagcaccaacaggggcgagggggcttggtgatctccgagttccttcaaccagtgcctgctgccctgccagcccgcacgcagccagacacggtgatgatgccctgggggtggggcgcactcatgagcctcccagacccgaccatgcatggtcgagcccggagcgccggccagcactcatcgacgtgccgcattccaaatgcaggggcccctttccggcaacccttccgtctagaataggaacacccctcccnnnnnnnnnntggtgatgctgccctgggggtggggcgcaattatgagcctcccagacccaaccatacatggtcgagcccggagcgccggccagcactcttcgacgcgccgcattccaaacgcaggggcccctttccggcaaaccttccgtctagaataggaacacccctcccccggcacaccttcacggcgacgtcgccaaccagctcattcaaggtctcctccgcctccagctcgtcgtcatcatccgcggcctctgccaagcctgcggtgcaggggacaaagccatgctgggcgtagtagcttcaacatgctcttcccaggcccccaccccagtaccaacatcgaccagagccattcaagccctgcgcaccctgcgtgtctctcttggagtccatgccgacccccgtcctccctgccagcgagccccagaactcggnnnnnnnnnngttcaagccctgcgcaccctgcgtgtctgtcttggagtccatgccgccccccctcctccctgccagcgagccccagaactcggccgggtctgggccggagggggcgatctctgcgcctccctctctctgcgcctctctgtcgcccagcttggcgcgcttgctgtcgggggcgtcctgctgtgccgcgggcgacgcgcccgcctcctccttggcgccagcgccggcctcctcctctttgacatcggtgacgactgcctcctcgtcgacggcgccggcctccccatcaccctccacaccaccctgcccatcgtccactgccgcctcgggctccccctcctccnnnnnnnnnntctcgtcaacggcgccggtctccccatcacccccgacaccaccctgcccatcatccactgccgcctcgggctccccctcctcctccccttccgggtccagaccggggatgccggtgggagcgcgctcccgcttctgccccgtgccggcgatgcgcgccctgagcgccgcagccgcgcccttgttgctggccggctgggcgctggccgacggggcccctgcggcctccttggcatcaggtggaggtgccgcggcggcgccgtctgtcgccgcggcggcgccgtttgtcgccggcggggcgagggagaagggcgctgcgggcgtgcgcagggcggccgacagcctgctggtggaggacagctccttggcgatggcctgcgcggcgtccgccacggagcgcgcaggggctcgggtcccccacttgctgtgcttctctgccttcctccgctcctgcatgtcgaatgggttggtggacagcgttgagggggggatgatgagaaatgagaaggggagcacgcactcgggaggctgtatttgagcaaaaagggtccctgccccaggtgccgattcatcttctcccttgctcctggtggtatccccagcacaaaatccgagccatctcttttaccaaaacccctaggacgctcccttggctccatgctccctccactcccatccacctccccctcttcccccccccctctccccc

SEQ ID NO: 40722 - DNA, 61 bp, Chlorella protothecoides
ggtgccatggcatcggctgaccgagcgcggtgccctgctccgggctcaccgcgccagcgtg

SEQ ID NO: 40723 - DNA, 81 bp, Chlorella protothecoides
cgccgtctgcacgaagcggtgagcgtgtccggtgggcgggtgtcagggtggcgtggagcttggaaggctgtcgtgagagtc

SEQ ID NO: 40724 - DNA, 10611 bp, Chlorella protothecoides
  modified_base (102)..(111): a, c, t, g, unknown or other
  modified_base (542)..(551): a, c, t, g, unknown or other
  modified_base (1589)..(1598): a, c, t, g, unknown or other
  modified_base (2961)..(2970): a, c, t, g, unknown or other
  modified_base (3046)..(3055): a, c, t, g, unknown or other
  modified_base (3666)..(3675): a, c, t, g, unknown or other
  modified_base (4790)..(4799): a, c, t, g, unknown or other
  modified_base (5095)..(5104): a, c, t, g, unknown or other
  modified_base (6083)..(6092): a, c, t, g, unknown or other
  modified_base (6309)..(6318): a, c, t, g, unknown or other
  modified_base (7167)..(7176): a, c, t, g, unknown or other
  modified_base (7326)..(7335): a, c, t, g, unknown or other
  modified_base (8657)..(8666): a, c, t, g, unknown or other
  modified_base (9210)..(9219): a, c, t, g, unknown or other
  modified_base (9803)..(9812): a, c, t, g, unknown or other
  modified_base (10023)..(10105): a, c, t, g, unknown or other
  modified_base (10348)..(10541): a, c, t, g, unknown or other
gggactctgctgtcacaccgcaggtgttactcgtgtaccccctcacgcacgcacgcacacacacaccgccttgctcacagcatgtaccgcatgccgtccctnnnnnnnnnnctccaggccctgccctgggagagcgtgcccgggctggagcagcagaggtgtgggtcggggtcggaccgggaggatcgggccgcatgggcagcgagggggccagcatcgattggggactctgctgtcacaccgcaggtgttacccgtgtgccccctcacgcatgcacgcacacacacaccgccctgctcacagcatgtaccgcatgccgtccctggccgtggcgctggccagctgtcagacagcttcggaaccgcggcggctggacccgcgcgacgccttcttcagcctcaatccctcgggcgacctgggggacacccagcaggccctggagcccctcttcctgcgccaacccacctggaaggcaagcgagggggtggacagtgaccggtgtggttgtcgggggggatgactccgaggccaggggtggggannnnnnnnnntacctggaaggcaagcgaggggggtgaaagtgaccggtgtggttgtcgagggggatgactccgaggccaggggtggggacatgcacggcatgcacgcttgacggcgcccccctccctcatccgacccgggcagggtacatcaggcaggccgccggccgccgccgagctggccgaggcgctccagacgcgccagctcttcgtctactgtggccacggcagcggcgagcagtacctgccagccgcgcgcctgcgcacgctgcgctgttccgcggcaggtctcatcatgggctgctccagcgggcgccttcgcccccccgcagccgccggggacgaagcccagggcgccgtcctggcgtacctccttgcaggtcggggatggggaggggggggagcaggtgtttttggggagctcggacaagaggggagagcaaatctgcggtgcgtcgcggcggcggctggcgccccatgtggttgttcgacgccgaggcattgctagctgcgccatgggcgcatgaagcatgcattgctcggcccttctgatgcccttggactgcccacgccatcacgtcacacgcagggtgccccgccgccactgccaacttgtgggacgtgaccgacaaggacattgatcggttcaccgccgcggtactggaggactggctggaggctccagggcgcgagcccggggccgcggtggacgtcgccgccagcgtgaacgccgcgcgcgggcggtgccgcctgcgttacctcaatggcggcgcggcagtcacctacggcctgcccaccctggtcgggtgaccagtcgtgatgacatgctggcggcagttgaggggcctggatataattgtgcatcaacctaaaaaaaacctctgctctcttctaccatgcttcgattctacaatgctgtcaagcttcacgccgggccaggagctcttggaaatcgaggctaccgagcgatgcactcgccaaaagggaaaaggacgaacatccttgtcatcttgagtgcccgcaatagggcgtaaggacctctcatcatgnnnnnnnnnnacatgccgggcctggagctcttggaaatcgaggctaccgagcaatgcgctcgccaaaaggaaaaaggacgaacatccttgtcatcttgcgtgcacgcaatagggcgtaaggacctctcatcatgcgagacagtctctatcatgcatcatcgcatctcaacatgtctcacctttccctccgccccagcacacaagacacgcctcgcgcaatcaccagccctactgtgcctcctccgccacgatgcggatgcggggccaggagttgcaattgacgccgcgcaagttccagatgggccctggcgcctctggctgcgtgttgtaggacgcgtcggtggctttggccgcgatctccacctcgcccggcgtccccggcacctccacctccgcgctccacagcacccaggcccagttgcgcccctcctcctgctccaccccctccagctcggcggtgtgccaggtggcgccgccgtcggcggtgacgtcgacgcggatgacgcggttcccgcccccgctccaggcgtagcccttgactgtcaccaggtcccccggctccacgcgcgcgcccggggcgggctcgcagatgagcgaggtcacgggcatggcctggatggccggggcggagtcccagtccacctcgtcccagcccatgctgggggagaaggccttgtagtcgcggcgctgccacagcgagtccgcctcctccccgctgggcacgactttagtcacccacttgaccgaacggcaccccgcggtgccggggacgattacgcggaggggggcgccgtggtcgcgcgtcagcggcgcgccgttcatctcgtaggccagcagcacgtcggcgcgcgggtccagcgcgcggtgcacggggatggaggccgcgtaggcctgccccgcgccatcggcgtcggcgccgaagaactgcacgtgccgcacgccctccgcgccggggtccagacccgcggcctgcaggacctcgcccaggcgcacgccgccccagaccgcggtgccgatggccgcgccgccccactccaggcccttgacgtctttgaccgcataaaagtcgttgcggcggttgccggagcactgcaccgtggcggtgaccgtgtgcttccggaactcggccttcagccggtccagggacaggtccagctgcaggggttgcgtgtttgactttattcttggggcagtgagtgtgtgtatacgaggacgaggaggctaagggggcatggtgctggtggcgaggaccaggagcagggagaagtgtgggaggggatgaaggcatgggttggaggcagcgcatgatgacaaaaatggtatgtccaatgaattcgtcgtagtggcctccaggacaggctcaggggcacccnnnnnnnnnncggccatgctcaatactgcccctctctccctcccaacgatgcaatcggccactattcctcaccgtcttgatgcccnnnnnnnnnngaaatgttatgtccgatgaattcgtcgtggtggcctccaggacaggctcaggggcacccgcctcaacacttccgagtccgcatgccgcgttttccaatgattgcccctcctgactggccatgctcaatactacccctctctccctcccaatgatacaaccggccactattcctcaccgtcttgatgccctgcccctcgatgcgcaggctgtactgggcctcatcgatcctggggacggggaggtggttcctgatgtaaaacacctcggtgggcgtgatgacggagccggtgaggagttcgcgcggcggctctgcattcatgggacgcgcgctgcgcacgatgagcgccgggagcctgcagagggagggagagggggtgaatggggtagcggggggcgggagtgctggggtcagtgggcatcctccaacgtcctccctcccgttgccggttccatggcggcatggccgggcttgagggatggggatacacaggcctgccaacaggcatgccggatgcaagccagttccagagctaccccatcccctggatatatggcctgcattacgggtcctcctccccctccagcacacctgtccttggggtcgtccgcnnnnnnnnnntcgggagtgctggggccagtgggcatcctccaacgttctccctccctttgccggttccatggcggcatggccaggcttgagggatggggatacacaggcctgccaacaggcatgccagatgcaagccagttccagagctaccccctccctcgatatatggcctgcgttatgggtcctcctccccttccagcacacctgtccttggggtcgtccgcgtaggggtcctccggcggcggcggggcgcccccctccagactgcctatccggtacccctccaggatgtcccgcacttgctgcgtgttgtgctgctggtacatggaccagaaggggtcgatggcggacccggcggccatcatgagccgggcctttcccccagggtggatgtctacccagtcggttatgtcgtacaccccctccttgtaagtcacccagacccggtcttcgggggtgcggtgcttggcgacttcctccttgctgtactccgggaggctggagacgtccttggcgagggcaggcccagggtgggtggccaggtaccacgccccgaggccgaaagatgcccccaccgcgagggagcccgcccaccacgcgcgagccgtggcgccctgctcgcgagccgcatcagtggtgagtgccctcgcgcatgctccgacacgccaggctcggtctcggcgacacgactctgcccagacccgcctgttgagtgaggcgacacacctcctcatccccgccaatggagctccagtgcaggtacagtctcgaaaacgatgacaatagattcagcaacaggccatgctagtagacctgggagatccagcactgtgtggattcgtgcccgggttcaatgttgtgcggaagaaaatgctggcagaatctgactcggcgcccgcacacagcgcggatcgcccggctgaaattcccgcatagtgagccccattgttgcggcatatagcgtcctcgatgtcccactgtctgatgcagcatcatgcataagccacaacatcattttggaggaaagttttgtaggtaagtccggcggatgcagggcgaagtggctcaacgtgactcttgaagtgccacgatctggggccccttcattgggaaaagtccagttnnnnnnnnnngcatcatattggaggaaagttttgtataaaagtccggcggatacagggcgaagtggctctacgtgactcttgaagtgccacgatgtggggccccttcattgggaaaagtccagtttttttcttagggtacaaaaatgaagaatattgccaattggaactcatggtgtgatccacggactgcccgtggcacccagacatgctattggaaacatattgaaaacgtgctcagggggcaagcccgacactgcgacgaggatcgcgccggtactccaagattgcaggatttgggtggctannnnnnnnnntccagacatgttattgaaaacatattgaaaacgtgctcaggggtcaagcccgacagtgcgacgaggatcgcgccgctactccaagattgcaggatttgggtggctataaagcatgatggtggtttaaagtaggagatgggttgccacattgatcactctccccatacagagacgatcgttggccgggtctccccgataagtcgcgatctcaggatggcccttggaaactgcgacggaccacttgtcgaaatcttggggggtctcatcgtgtacggctccaggggccatctggaccctggacataggtatccagggcggccgttacttcatcatagtgccattaccgagccatcttgtggagtaggtagggcccgcaggctcgcacaccctttcagccactaccaggcttgaaagccgcaaaccagggctgcaggtgcgacacgccacttcgcgggatcgggggccgtttccttggaggatcaagccctgcaatgcatcagggcctggcggatttaccctgatacggccgtgatggcctcctaggttccggggctccgccttgtgcgccactcggtgccggggcctcgcgtactgccgcatgcatggctgcccccggccgggcacccctcctgctcagcgacccactgccgggtgtatgcacatctgcctggtgatgtgcggtgtgcccgatgcccgaccccatgcctccccgttgtagcccggcaccctcccgcgatgggcctcagccagcatggcttcctcatcgtgtgctacaccctgtcggtcttcgtgctcaccgccttcttcgtctacgccctggtgtactcttacatcgtcagacgcaagaatgtgtccgtggagaatttcatcacagcccgcggacaggtgctttcctggtggtgaggggggtggcggccgggccccctgcagtgccccggctggccttggccccagagtgcctccagccccgtcggcctgnnnnnnnnnnggccccctgcagtgccccgactggcctcgcccccagagtgcctccagccccgtcggcctgcctccagcccccggcagcctgcctccagccccgtcggcctgcctccagcccccagcagcccgcatgccctggcatgcatgcagcattccccctgttatctttgggtgcccccttcaaaaccttcaataaccccctccttcacccccccccccccccnnnnnnnnnnatgcatgcccttgcatgcatgcagcattccccatgttatcttgggatgcccccttcagaaccttcaataaccccctccttcatccccccccccttcctcttttccagctgtccacggcgcgcatcgcctttggcttctacgccgccgcggtgggggcctgggtggtggtgggtccgccctcctactccccctatgccggcgtgattggctgcgtgatgtacgccgtcgccaccggcctgcccatcatcgtcatcgcctttgcgggcagcttgatccagaacaaggtgccccacgtcctctccctcaccgactacgtgggctggcgctttggctacatcgcccagagctacatcgtctgcttcgtctgcttcaacatgtccatctccatgctggccgagtacaccaccatcggctccctgtttggcagctacgtggggtcggagacctaccccatcatcattgtggtgggggtgctgaccatgatctacaccgcctacggcggcctcctggtctccctcatcaccgatcaggtccagggcgggctcagcatcatcctggtcctcgtcgtcgccatctacgtggcggtgaccttccgctacccgctgcccacccccatgccctgcgaccccgccgacgccatgggcttctgcatctccggcaccaacgctacgggctggggctccatcttctccatgcccgcctccctcatggtctccaccgtcttctcagaggccatgtggcagcgtgtttgggcctcgcactccaagaggtgcgcacgggtctgtgtgtgtgttgtgtgtgtgggggggattattatcgctatccttgcttgtcagggcgggagaggannnnnnnnnntgtgtgtggggggggattaatattgctatccttgcttgtcagggcgggagaggaagggcggggaaatcctactggttggtgtgtgacacaagcacagattgcccctcagccattcatgtatgagtggtcggttcatcgcatttttgtgannnnnnnnnncactgcttggtgtgtgacataagcacaggttgcccctcagccaatcatgcatgagtggtcggttcatcgcatttttgtgaccccccccccaaaaaaaaagaaacttccaatacccctcatcaaaaggtcgctccgcaaggccgccttcatcgcctgcgcgggtgtcatcctggtcgtcttcttcaccggcttccttggtctgctggcggcgtggtcggggcgcatcacggccgacaccaaccccaacctgtacctgttcgaggcgctgcgcggggccatgaacgaagccgggctggtgtccaacgccatgggcgtggtggtgctcctgctcaccatcaccatgaacgagtcggcggtggactccatgcagaacgggctgacggcggccatttcctcccacttcctgcgcggcctgcccctgtactgggcgcgcctggccgtgctcgtcatcaacatccccatcatggtggtggccaccaagggctacaccgtgctccagctcttcctgctcactaacatgctctgcgccaccaccgcgggccccgtgctgctcggcctggtggagcgcctgcaccccgtgtacggcggcgcctccctcctcttcacctccatcttcaccattttcctcacctccgtctacggcatcaactttgcgtgggtggacggtgcgtcgcgctcccacaacatcgccgagggcatgcactacacctggatcgggaacaactacgactaccgcttcttcctggtcgccatcggcgtgtccatcggcatggtgggcgtcacatccgccttcaactacctctcccagacctacctgatcaagaagaagccggaggtgctgggcttcaccgcgccggccacccacccccacatcccgcgctaccatgatcgcctcatgcatgcgccggtgcaggcctccagcggcagcgaaggcggcgtcgacgacaagatcgcggcgggcgatgggctcaagggcggcgcgccgcacgacgcgctcacccgcctgtccgcgcagctgccggaggcgctgctgcacaccgccgacgagaccccgggccaccgccccgcctgagcgcggtgaaaggagggtttctgaccccaggactgaccccagggcgcttgcatggcccttgcaaaacccaccccaacacctcttgtttgccccctgtccacaccattaattccttgcgcctcgacatggcgctgccgcgccccgccccagtcacgacctttgagatccgatgggcgggagcggcggcgccacaatcattgctctcttgatcccggggcgccgcccgcgccggctgcaaggccgcgccctnnnnnnnnnngcacctcttgtgtgccccctgtccacaccattgattccttgcgcctcgacatggcgccgccgcgccccgccccagtcacgacctttgaaatccgatgggcgggagcggcggcgccacggtcattgctctctcgatcccggggcaccgcccgcgccggctgcaaggccgcgccctgggcttccacgtgcgcatgtggcgtggccctgcacaccggaccccggcgcgggcgtgcgcctcccttcacctactatcgagcccacccactctgtgccacattgccgtattgtctgggctgctcctgttgtcaagtctgatgagaaagcagaagcgccagggtggtgaggctggaggggggattggcaggccagcctgcgcccaagagggaagtcagggcgagagcctctgcatggccatccccctgttcagccggcagcttccgtgagtgcctagggccaccggacggccgggaatgcaggggggtcctggattgaggggaaacatgacgtgcttccttgattccattcgccgtgagggactgaggcannnnnnnnnncgcttccacgtgtgcatgtggcgtggccctgcccaccggacccgggcgcgggcgggcgcctcccttcacctattatcgagcccacccacgctgtgccacattgccgtactgtctgggctgttcctgttgtcaagtctgatgagaaagcagaagcgacagggtggtgaggctggaggggggataggcaggccagcctgcgcccaagggggaagtcagggcgagagcctctgcatggcgatccccctgttcagccggcagcttctgtgagtgcctagcgccactggacggccgggaatgcaggggggtactgaattaaggggaaacatgacgtgcttccctgattccattcgccgtgagggactgaggcacgggcgcacgcactcaatggaatgggagccccttgaacccagttctgtctgaagggataggtcctcacgaaaagaattccgtggcaacgggttccctctggccccttttcacctggctgaacccggtttgttttgaacacgttggtgtgcttgtggatgcgagcaggtatggtgatgggaagaagaatatctcgacatgcagtgatgagtgaaaannnnnnnnnnctccgtggtaacgggttccctctggcccctttccacctggctgatcccggtttgctttgaacaggtcggtgcgtgtgtgtggatgcgagtaggtatggtgatgggaagaaaaatatctcgacatgcagtgatgagtgaaaactgagcctacttgcatcagatgccaggggtgcacggagcatggccgcatgcaggcgggggagggaaaaannnnnnnnnnnnnnnnnnnnnnnnnnnnnnnnnnnnnnnnnnnnnnnnnnnnnnnnnnnnnnnnnnnnnnnnnnnnnnnnnnncaccgtgtcccagtgctgcatgaaggcaccatgggcgccgtcctcgaagatggccatccaggctgagggcaggacctgccccaccagcttctggttgatggcagggaccacagggtcccacaagccgcccaccaccaggatgtgctgctgggtgctggccagcgcgtcgagggtggtgtcggagaagtactgcatggagatgggtgggggcagggggagggatggggccaatgcaggtctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaggcgacccggcctgtcgccgccccaaagtctgcacacacgtattcaatcaaggcttccagctgccg

SEQ ID NO: 40725 - DNA, 61 bp, Chlorella protothecoides
tccttcttgcccaccagcagcaccggcgatgcccagggggacgtggacggccggatcagcc

SEQ ID NO: 40726 - DNA, 76 bp, Chlorella protothecoides
ttcatcgtaaagtaatgttcatgcctacctacaacatgcaccccctctgggcatggcatgcagaccacctccaccc

SEQ ID NO: 40727 - DNA, 106 bp, Chlorella protothecoides
gcagatgaacctcccagcagctcgatcgatgcatgcagtgtcccgccaatcaaggtaaacactcgtgcacacacgcgcaggcagcaccgggctggggcatgtgcgg

SEQ ID NO: 40728 - DNA, 61 bp, Chlorella protothecoides
cggaggaggagagggcggaggaggagagggaggaggaggagagggcggaggaggagagggc

SEQ ID NO: 40729 - DNA, 42754 bp, Chlorella protothecoides
  modified_base (107)..(116): a, c, t, g, unknown or other
  modified_base (465)..(474): a, c, t, g, unknown or other
  modified_base (1466)..(1475): a, c, t, g, unknown or other
  modified_base (1559)..(1568): a, c, t, g, unknown or other
  modified_base (1628)..(1637): a, c, t, g, unknown or other
  modified_base (1957)..(1966): a, c, t, g, unknown or other
  modified_base (2843)..(2852): a, c, t, g, unknown or other
  modified_base (3754)..(3763): a, c, t, g, unknown or other
  modified_base (3929)..(3938): a, c, t, g, unknown or other
  modified_base (4118)..(4127): a, c, t, g, unknown or other
  modified_base (4599)..(4608): a, c, t, g, unknown or other
  modified_base (4668)..(4677): a, c, t, g, unknown or other
  modified_base (4762)..(4771): a, c, t, g, unknown or other
  modified_base (5117)..(5126): a, c, t, g, unknown or other
  modified_base (5386)..(5395): a, c, t, g, unknown or other
  modified_base (6345)..(6354): a, c, t, g, unknown or other
  modified_base (6570)..(6579): a, c, t, g, unknown or other
  modified_base (6950)..(6959): a, c, t, g, unknown or other
  modified_base (7147)..(7156): a, c, t, g, unknown or other
  modified_base (10959)..(10968): a, c, t, g, unknown or other
  modified_base (11354)..(11363): a, c, t, g, unknown or other
  modified_base (11709)..(11718): a, c, t, g, unknown or other
  modified_base (12491)..(12500): a, c, t, g, unknown or other
  modified_base (12678)..(12687): a, c, t, g, unknown or other
  modified_base (14341)..(14350): a, c, t, g, unknown or other
  modified_base (14736)..(14745): a, c, t, g, unknown or other
  modified_base (15107)..(15116): a, c, t, g, unknown or other
  modified_base (15554)..(15563): a, c, t, g, unknown or other
  modified_base (15977)..(15986): a, c, t, g, unknown or other
  modified_base (16532)..(16541): a, c, t, g, unknown or other
  modified_base (17085)..(17094): a, c, t, g, unknown or other
  modified_base (17400)..(17409): a, c, t, g, unknown or other
  modified_base (17567)..(17576): a, c, t, g, unknown or other
  modified_base (17865)..(17905): a, c, t, g, unknown or other
  modified_base (18126)..(18135): a, c, t, g, unknown or other
  modified_base (20371)..(20380): a, c, t, g, unknown or other
  modified_base (20818)..(20827): a, c, t, g, unknown or other
  modified_base (21162)..(21171): a, c, t, g, unknown or other
  modified_base (21621)..(21630): a, c, t, g, unknown or other
  modified_base (21988)..(21997): a, c, t, g, unknown or other
  modified_base (22987)..(22996): a, c, t, g, unknown or other
  modified_base (24208)..(24217): a, c, t, g, unknown or other
  modified_base (24437)..(24446): a, c, t, g, unknown or other
  modified_base (24861)..(24870): a, c, t, g, unknown or other
  modified_base (25346)..(25355): a, c, t, g, unknown or other
  modified_base (25647)..(25723): a, c, t, g, unknown or other
  modified_base (26104)..(26113): a, c, t, g, unknown or other
  modified_base (26596)..(26605): a, c, t, g, unknown or other
  modified_base (27642)..(27651): a, c, t, g, unknown or other
  modified_base (28547)..(28556): a, c, t, g, unknown or other
  modified_base (28725)..(28734): a, c, t, g, unknown or other
  modified_base (29948)..(29957): a, c, t, g, unknown or other
  modified_base (30564)..(30573): a, c, t, g, unknown or other
  modified_base (31363)..(31372): a, c, t, g, unknown or other
  modified_base (31457)..(31466): a, c, t, g, unknown or other
  modified_base (31804)..(31813): a, c, t, g, unknown or other
  modified_base (31879)..(31888): a, c, t, g, unknown or other
  modified_base (33328)..(33337): a, c, t, g, unknown or other
  modified_base (35025)..(35034): a, c, t, g, unknown or other
  modified_base (35333)..(35342): a, c, t, g, unknown or other
  modified_base (35827)..(35836): a, c, t, g, unknown or other
  modified_base (36311)..(36320): a, c, t, g, unknown or other
  modified_base (38190)..(38199): a, c, t, g, unknown or other
  modified_base (39952)..(39961): a, c, t, g, unknown or other
  modified_base (41175)..(41184): a, c, t, g, unknown or other
  modified_base (41258)..(41267): a, c, t, g, unknown or other
  modified_base (41369)..(41378): a, c, t, g, unknown or other
  modified_base (41557)..(41566): a, c, t, g, unknown or other
  modified_base (41849)..(41911): a, c, t, g, unknown or other
  modified_base (42224)..(42233): a, c, t, g, unknown or other
ggagggcggctaccgcatacaggtgggtgttttggaggggaggagagggggcttgcaagggtgcaaggagggggtctggggagctgctaggctgtttggcagtgggnnnnnnnnnngcgcgactttgagtggctgaccgaccagctggtgcaggtggccaacctctgctgccacgggcgcatcgtctccgtgctggagggcggctaccgcatacaggtgggtgtgttggaggggaggagaggggcttgcgaggttcaaggaggggggttggggagctgctaggctgtttggcagtgggataaccctttcgggcagggcctgcgcgcctgcaagctttgggccagtccaattgcgagccacaaaccagagccgttgcactgtaacttcccaacacccgccgtaatcctgcccaacacctgccacgcccaaccgtagttcacctgctcccatcccccctcccccctnnnnnnnnnntgttgcactgtaacttcccaacacccgccgtcatcccgcccaacacctgccacgcccaaccgccgttcacctgctcccatcccccctcccccctttcccctccagggcggcaaggtgtctgccttctcccgatcggtggcggcccacgttcgtgccctggccgacgaccaccgcatggaatgggatccaaaggcagccgaggtgggccgagcgggagggggcgtcgagatgggctgattgcattccatgcggtcgtcagccatgcctgagtttgtggtgatcagaatccatacggcgcccatttttagaccttgaggtctgtgggctccatgctgcatgttgctgctgatcagcacgtgctgcagatgctggactccacaaagtctggatgcccctggcaacagcagcccccactgccactccctcatgcagtgggaaagggagcacgaaaagcaagtccgggccgaggctgaagcgaagagagcggcggcagccatggccgccgcctctgcactgctcaacaggtcacaggccgtggagaccggggaggggcaggagaatggtgagggcggcgatcatgcgggtggggaggaggatggggccaggaaacgacggcgcaggggtgatggggtggactatgttgcactcaacaagctactggaggaggagagtgcaggcacaaaacaggcatgaccatcttatgcgatataaacttgtaaatgggatacaatggacgagagaaaccggttccttttgctggccgagattattgtggcgggagagctccttgtttccgggagcactcctgataccggaccccacgatgccctgtcatggcaacacatgagatctcgtgcggccagcagcgcccacacattaattcaaaagctcacacgatactgggaccccatagcacgtacgcctcttgtggctttgtcccccacgatctccaaccggaagacgtggcaggcacccgagtgtgaagtacgagnnnnnnnnnnccatggcaacacatgagatttcgtgcggccagcagcgcccacacatttattcaaaaagctcacacgatactgggaccccatagnnnnnnnnnncgagaaactggtttcttttgctggccgatattattgtggcgggagagctccttgtttccnnnnnnnnnngataggcagattaatacggcgccggaagcctggtgtagcgctctcttgacgccatggaggtcgataagaagctgaccatgagcctggacgacctcatagccaagcaggccagggagcggaaaccggacaaaaggcctgacgcacgagccaagaagggcgccattgccaaggtgtgctggacattctgaagtttgttatgttgtatctgtcttagtctcgttggtatcaagctgctcctcgctggaggctagggtaattgtacacctatacagcgccccacacccacccggctgcagggacgccttccagctgcaccggcnnnnnnnnnngtaggtgattgtacacctatacagctccccacacccacccgctgcagggacgccttccagctgcaccggcaaagaatagcgaaggccgcgtcccaaagcagctcggcatcaggtcccagggtccgtcccgtgctggaggtgtccagaaaacgcagtctcatgccagggcccagaatggtgcccaggggccacacgggcagcaccctcgcgccttgcagcaccaggtcctgcagcagacgggccgtgcagccaaccgcagcaacggacagatgcagcagcagaagtctgccaacggccgcgtcatcgccatcaccttcaagaacccggggcggggcggagctggtgtagggcatcaggcatcaacgcaaggccagaagcccaagccggtgccggcttcggcgcccaggttcctcgcagaccagcagaacggggcccattcgagcgggcccttggtcttctccgggagcagggagcagcgtggattgctgacacacctgcacacagacttctcagcccccgggagcctgcgacggaacaagcacggtgtgctcattcccgcctgaaccgatcattgcccttattatgtggaccagggctcaatcctctgaccttggggatgcctataacagaatgctacttgtcaaggatttcaaataccagatggagtcagctcacagagtgacagtctgttttgtaaaatgacaaaagaaattcacatagtgatatagtactcggctaccatcacatgctcgccgaggcccgtttgcttgcgaatgccgcttgagggacctccatgcaatcatttagcatgcagtctgcgcaccagaactcatcacctctgtgtagaatactccagggtgctcccaaacataagagnnnnnnnnnnttaaagaaattcacagagtgatatggtactcggctaccattacatgctcgccgaggcccgtttgcctgcgaatgccgcttgagggacctccatgcgatcattcagcatgcagtctgcgcaccagaactcgtcacctctgtgtaaaatactccagggtgctcccaaacataagaggacatgtagttgctgcaaggaatggtcccgctcgtgaccatgcacgaggtgcctgcttgaggatgtcggacggtgaccaggccaagccacttcgacgcgatgccgcgtcgctgggctggctggcacagagctctgtacaacccaggaaacgaacagcgatcgaaggtgatgcctgacgtgcgctgtgggtcgaggaccatgtgcctgccaacttgtcgtcctggcacctcgatcgcagcgttcccggtgtttccgtgaggcatctcgaccctctccaccccacacacaatgatcctacaggcgtgagtgggaccagcctggtgtccctccgctcccagctggccagcaagcagcaggaggctgcggcgactcgcagtggcgccctggaccctgaggagctgagggcccgcaggaaggggagggacgtgctgtcccaatcgaaccccggggtcacgagtcgcgacgcccgtgaccgtgcagacctgccggccacccccggggacgtcctggccgcctcgagggccgcactggagcgcaaggcggcgctctacgagcgcctggcggcgggagaagatagcgcgggcggcgagtacgaggtggacttcgccctcaaggcgcccgacacggcgcgcttcgccgtgacgggcggcctggtgagccgcgacatgctcgcggagcggaaacgccgtgcctggatggaggaggtggaggccaaccacgcccaggannnnnnnnnnacgggaccgccgtgcctgggaggaggaggtggaggccaaccacgcccaggaaagcgaggccgaagcgcggcgccggtcccgcatagatgtgagtctggggggaccttgtgtattgtgtgttcttgaaggcgcagcgcctcggagggcgccctgatgcagcctagcnnnnnnnnnncagggggaccttgtgtattgtgtgttcgtgaaggcgcggtgcctcggagggcgccctgatgcagcctagcacatgctgattggtataaaagggaccaaaacattgggaccattgtgaagaggatggatgtctttcttggggcaacagtgatcaaagggcatgctcggcggtcagaacccnnnnnnnnnngggttaaaagggaccaaaacatggggaccactgtgaagaggatgggatttctttcttggggcaacagtaatcaaagggcatgctcggcggtcagaacccccgcttatgcgcccctgcaggctgtcaaggagctgatggcggagacggcagaggggcgcatggccgctcagggcgcgagagccgcttcgcagcaagcagcggcatccaaggctgcagcgctgaaggccgccttcctgaagcgccaggtggaagctcggcgggcaaagaaggcagccagcggctcaaagggcggtgtcacctgactgggagctgtgccagtgggaaagggtgggtaccacgccaacacttctccccgctggataacagggtggggcctcttgccagacccggcctcaaggccacatcagggcttttcttgcgagagtaacggagggagaggggccccagttttctgctctacttgcgcctttannnnnnnnnnctcttgcgagagtgtcggagggagagggcccccagttttctgctctacttgcgcctttannnnnnnnnnagacaagttcccctctcctcctcacgtgactcacacacgaccttgcgtttgacgtttacctttcgtaaaagcctgttcggatcannnnnnnnnngtgctgcaaggaacgcctccctctcctcccgtgtctcctccagccggccagcctcgatggccgttaccctgtgcgagcacatgcccattgtcaggtctgatccttcagacatgacaagttcacctcccctcctcacgtgactcacacacgaccttgtgtttgacatttacctttcgtaaaagcctgttcggatcataaatgcctccatgcagcctccaatctgcatgccagggagggatgtggtcttcattatgcacacagggtggagcttgacgcgatgtcgcaagctacaactccgaatcttccctgcctccttcggctcaccaggaagcaggtgcctgcaacnnnnnnnnnngagcttgacgcgatgtcgcaagctacaaccccgaatcttccctgcctccatcggctcaccaggaagcaggtgcctgcaactgtcgcataatagcggggtggcagcgacatgcaagtgatccttggtgggggcgggtgtcgcacttacttatagctatgtgtctttcccttcatcaaatatcaaataatccaaatgtcgtcgaacaagtcctcccgccctaccctcgctatgtgccttgttatcacccgtccttggtcggnnnnnnnnnntgggtgtcgcacttacttatagctatgtatctttcccttcatcaaatatcaaacaatcaaaatgtcgtcgaacatgtcctcccgccctaccctcgctgtgtgccttgttatcacccgtccttggtcggagcgcctcaaaccaacgagggtcttgatcccggctacctcagaatttggggagctccaccatcaccaggaggcggacccgagtgatcttcgaagctctcgtttctatccgcttgtagtgttcgtattgccaaacgcaaagttctcccccgtgccgcagctgccgagcccttcgaaccttcttggctgggcccggacctcctctgacaccagtgcggggacatggcttccaagcgcattcaaaaggagttgcaggtgcatagggtattgggaggcggtgaccctgatgagtcgcgagtgcccctgggctcgcagcccatcctttccctccccgacctgcctgcctgcaggacttgcaaaaggatccgccgacatcatgcagcgctggccctgccggagatgatctcttccactggcaggtaggctcgcatccctgcgcgcgggcgtggtgccgggcagccccactccccaggtggcgcgcgctgtccaacctcgggcaccccaccccctctcccgcaggccaccatcatgggtcccggcgacagcccctacaccggcggcgtttttttcgttaccatccacttcccgccagactaccccttcaagccgcccaaggtccagttccagaccaaggtgaggctgggattgtggggtggaaggggccgctggaagtgcaacgaattgctagaaggccggcggatgctggagggcaaggcgcccagcacggcttcgtcccgcctgcgattcccaccagcaagagtcgcgtggcgcgctccatgccttgcgaatcgcacccccctccccctccccgccgcccacccatnnnnnnnnnncgcgattcccaccagcaagagtcgcgcggcgcgctccacgccttgcaaaccgcgcccccctccccctccccgccgcccacccatccgcacccctcccaccacaggtgtaccaccccaacatcaatagccagggcagcatctgcttggacatcctgaaggagcagtggagccccgcgctgaccatctccaaggtcctgctctccatctgctccctgnnnnnnnnnnggaccccaaccccgacgacccgctggtacccgagatcgcccacatctacaagtccgaccgctcccgctacgaggacacggcgcgcgagtggacccgaaagtacgccatggggtaacctcggggggcggcaccgccccgacgggggtgtgccgcgccgtgcctgcctgcctgctgcccgtccagtgtgatgtgaaagcagaatgcggccagggggtctgggagcggtttgaaccggggacgacgctcggcagggcagggggcgatggggctgggccgaggcgcatcatgcaggaggggccggtgagggggaagactgctgaccgggcgggtgcgccgctcatcttgccggccaggcagaatactgcctggcnnnnnnnnnnaggggaagaatgctgaccgggcgggtgcgccactcgtcttgccggccaggcagaatactgcctggccaatggcacattcttccgacgccgtccgaggccgtgaggctgcaggggaaggcccggcggccgctgcacggggcagggcaacggtgcgccaggcctcgggccttcagagcatccctccctcnnnnnnnnnntcgacggccgctgcacgggtctgggcaacggtgcgccgggcctcgggccttcagagcatccctccctcgtttgaagggggtggtggggcagccccacgcgccggctgggcacttgcggcggggccaggggccgtgcgtaccacatggggcatgccgctttccagcgcctggtgctgcaggcggctgcgagtcgcgactctccgccctaaaactgcttgcccatctccagcttcttgcgcagcatcttctggccgtggtacacggtggcgtcgacgatgccgctgatggtgaatacgccgccgacgatggcgcacgtgctggtcaggaaggcgaggaaggacgatctccgctcgatgaacgtcacctggtttgttgtggagggtggaaggggattgggatccggctgccgtacatgaagaggtgcgatggcagccatgtcggctgcgaggccagacctcgaggggttcaaatctccctgcagaccccagccgactcccagcacacgcatctccccctgccccacgccctccagcccctcagccctccacctccaaaccccgcacccccccttcccgcggccctgccttgatgggcgagaggtcgtagaagaagaagatgcccgtcagctcctggcccattcccccagagggcttgaaatgctccgtgaccgagaactggttggtctcgatgaccgcgccgcgcgtggcgtggtactcggtgggcaccaccttcaggaaatactggtgctggcccagcacggggcggtcatgcgagtcgcgcacagcgtgcacgtccaccccgtccagcgggttgtgcatgccctggcgggggagggtgaaaagggtggacaaggggaagggtgaggccgctgggtcggctggaatcacaatcctgcaagcatgggaggctgaggcatgaaaacgggctggggcgcaggaggaaccgtcctcctccggtgcgcgcccggcatggctcccatcaccgctgccgccgtgtggcccagcacagcactcctctttgcctctggccctgccattgccctccgacaatcaagggttccatcaaggcctcctcccccagagcaatgacgaggaactcatactatcccccgccccatctactcaccggatactcctgtccaaaggccaggttgtcaatggtgtgcgaaaagtcaaagacctcgcccacaaaggggctggtgtcatgcacatgcatgtgccccgcctggtacgacttccccggcgccaggtgcaggttgcccgccaccttgttgatggacagggcgccgtagatgcggcagccccccccccgactggccttgatctcctccaagtagtggtcctccgcgcactggatcacggtggccgtgtcgcgcaccgcccagccgcggcggcggtacgcctcccgcacctcctcgcaggtgttgcagcacttgcccgcctcgaactcggcgccgtagcagctgccgcaggccgccgtcgcgttggagccgcccagcgctgcaggcagcggctgcccggtggggcccacgtggtgctccgagtcctcaccgatggccaggccctcgggggacaggcgccggcgaaacacggtgtggtcctgggggtggtggtggaagaaggcaggaatggagcatgagtcgcgtgagccgcacgggcggccgcgaccaccagccccccggcaagcatgcgcctcccccgccgctcgccccgaaccctggtccctcggttgtgccatcccaccacgtccagctggagctcgccgctgacgtccatcgcatccacgctgacccaggaacagggcatgtggggcagcgtgatgtcaaactgcagggagggggggggttggtcatggccggggagtggaaagcaggagacttggtccaggaattttcaggaactcaagtgcaaggtggagctttgcatggaccagagtctggagtttcattgaaccagcagcccccatccatccatcacagtgaaatactggtctcctcacatggatgtccatcttctccccccgactggtgtccaccaacagctccgttacggtatcggtgtgcatgaagatgcctgtggggggttgggagacggcttgattggggctcggcctgcggtctccacgcgcagccaaggagcccccaccaccatcacacccctcctcacccagctcagacacgaagagcagggtcatgagcgcagcagccaccagcgtgatcactcctccagccatagtggactggaagaactccttggcctcctcccgctgcttggggaaggcgtcgaagtggcgcaggaccgaccaccccgaccccgactggggtgggacgggcctcgcaccgtacataccgcctgacgccggatgcctggcactgtgtcgcgatggtcaatgctgggaggactcagtcaaaggcatcggctggggaagcgcgcggcagctgagccccggatttagaaatgctgtcggaatcaaagcacgcgctcagcatggcgaccatggcagcggtggcgagagccccatgctcctatcaagtatgtcttggattggtgagctgaagcggacctcacggtcgacatgtacgagcctgaaagtcgcgtcgggctcttttcatggaaccgatgctgctttcaggctgtgataatgaaaacggcacgaatcttgacagaccaggggctccctgccggcacatactgaaaggaaccagcctaagcatgctccctgcaccctctgcacgagcagcccaacagcctgacgtcacccccgtcccaagcttgcatgctgtctttgcaggcaaatgagactccttgatggtcaatcaccctatgcgcatcttcacaagctgcagccatacacatgactcccatcaggcaccctgccgcacatcgcccaaaaccgatcactttcgtcgtaatgtcacaacgcatacatgtagtgcgcagagtgggtacagtgccatgcatgtgcagagcatgtgggcatccccagggggaaggcacgcatgcacggcagccaggctgcatgcaaggatgttgggtgcatcctgaggctcagtgacctcccgacctgtgcttgggctccctttccaagaaaaagacagcagcaatcagaacgtaggtgatgatgagctgcaggcccaggagccagtttgaggatccatcggaggacacaaagtaggccaggatgacagccactgcaagaggttggtgtgggttcggtcaaaggttgaacagacaaggtgctcttaaggaggcagctcctaagatgaagttagtgcacagatgatgcgcccagcgccaccattgtatccagctgtaatggagcagtgaagacgacacaactctcttgcagaaatcacccacaagccccccacaacattccttccgcatgccatttcccacctgtgagcatgaggacgctgaagacgtcaaagtcaagggtgaaggtggtgcccatcacccagccggccaggacctgtgcagcaaagggataagggtattgcacggttgacatggtgctgtggagcatgtatttaagatgtgattggcaggttgtgatgattcgatatcccaagaccttcggctgggtcctcggtccggccagagcctgcacagttttgccacccaccgtgaaagggatggcaaaaagggctatctggatggaggagccgactgccactccgatcgccagatccatcttgtttttgaacgccacaaacacggctgaggaggtggggaggagggggatccccaaagaggtgttgcggtataggaattgaggagcaagattctatgtacgacagcagnnnnnnnnnnaatccccaaagaggtgttgcggtgtagaaagtgaggagcaagattctatgtacgacagcagctctgatggtcacaaacttgcaggcctcctgtgccgcccacaatgtcgccctggcttgaccctgcggaggcactgcaccgactcaccggtgatgtgttcgcatgcattccctgcgatgggcaggactatgagacccaggaaggatgggttgatgttgaatttttcactcactgcctcgatggcgccggtgaggaacctggcattgagcggtggtgaggggaggagggtgggtcctgagtgcaggagaggaagggggcagcaacccaagtgagcccaccaggtgacgagtgcatgattcgatcccccaagctcactccgagcacannnnnnnnnntgtgcaggagaggaagggggcagcagcgaaggtgagcccaccaggtgacgagtgcatcattcgatcccccaagctcactccgagcacacagccacaatgactgtgatggccgagaggaaagccagggccccggagagggacagcgcggggttgtcctccgactcgcccgaggcgaagaggtcgctgtgcgtcttcagctggaaggtcaggtaacagaagtacctgcgcatgaggatgtcagatttgtgagtctgaggtggatgtcacaaggacgagtggggagagacgggccagtgtcctgacacccaaagaggggacgggtcgactgcgcaccgccaaaagcctnnnnnnnnnntgagaggggccagtgtcctgacacccgaagaggagacgggtcgactgcgcaccgccaaaagcctcggcatgagccgtcttgcatccctgcatcggcctccttcgcccaatcaagcggtgcagcctgcgccatacaggacgcagtcccagggcaaattccaggtccatgctggccgacctgccacccacccaccctgccagccaactcacacaaacatgaggaggatggcgatggcgtggctgaggttgatcaccgcggcatcggtcatcacctccgagccatagatgcgcttggccatggtgggaatgatgatgccgatgcaggccacgaagaggagggaggaccccacctgcgcaggggtgcgtgcaagtgcaggtgaagtagaagggggatggggtaccgcttggggcagcacgtgcatgcattgctgcctgtggctggtgtttgacaccgcatacccagctcgaatcaggggtgcggtcggtggacacactgcattggatccctccccacttcagtccacatcaccgtgtccccatcgtgcgccccaagcccaccttgttggccagcggcgagaagcgctgctgctggaagcgcagtcctccaaacaggaagcacatgcctggggaagcaggggggaggtggggacggggacggctgagtggactgcgacgcccagggagccagggggggggcttgacacctcgaggcaaatgcaggccatgaactccgtgaaggacacgcagggggcactgcattggagctgccctgcnnnnnnnnnngcgcccagggaaccaggcgggggcttgccacctcggggcaaatttagaccatgaactccgtcaaggacatgcagggggcactgcattggagctgccctgccccagcaagcagctgggcggggcgcctctccctgcctgcatcgccgctccctccccatggcctcccccatccagaacnnnnnnnnnnctggcgggcgcctctccctgcgtgcatcgccgttccctccccatggcctcccccatccagaacaccacaaaaatgcatggggccccgtacctaggacgaggaggaggttggagaggatggacccgatcagactggtggccaccaccgtgtagaggcccttgcgcagcgcggcaatggacaggatcagttccaccacattcccaaaggtggcgttcagcagcccaccaaccgtgtccccaaacctgcaacaggtgggcatggaatccagggcgtgaccaccatggcatgctgcatgacgccgatctggaggctgtgcaccgccttctctccctccttccggcaaagaagcactctcacacctgacggccaggtcctccgtcgtctcccccaggaggagcgccaggggcaccagggccaggaagttctacaggagcgggggggggggagagatgtcacgtgcggggacccactgtgcagatcctgcatcgtgcagagccttcccgagtgtggcacgccagggaatgcccctccttgcacactgtgcccctcccgccccactcccccttcacaatcctcaccatgatgaagacgagggtggggctccagcccagcgcgccggccagaatgcccacggggatgcaggccaggagcacgttgatgtaggaggagacgagcatgaggccgatgcagcgcgcgtctgacccgggggaccacaccccggggtggtgctccatggcgatggactggttctggagcacggtgcccgtgcccagcgtgcccgccagcgtggagatgaaggtctgcgcgatagcgtcgcgggagcggtcgccgccgcgccgcgccaggcgccgctccgacaggatgctggccgtgtcggagtcggagttggcaaagttgtcgggcatgagcttgctgacgtgggaggcggcgaagcgccagtggcggcgcgcgcgctcgctgttgtgggcgccgcgcgggggctggtgagggggcagcgcgccgttgcccgcgggggactccccggcttccgcagcggcctccgggtccagcaagggttcctccagatgccccgaggcccgggagcggctggagaggcgaggggagcgcaggctggtggacagggataggttgccctcctggtcggccccgtccacgccgctgcggcgcgcggcgtccgcagagaccaggtggagctggcgccgggagatgtccatgtcggcgacagggggaggggggtgcgggggttgctgggaggggaacggcgacaccgacgccctaacggagcgcttggtgcgtcgcggatgcgcgccctgggcagcgcggtacggagatcccctgcgtcagaatttccgatcgagggccatgctggacgagtactggcctggtcccgtcatgcgcgcggtgcatgacagcgccatcgtgggaccgggcagatcgcagacgatctccaccacgaggccctttctttgggcccctgcatctcccaggaagggggacctcctagccgagcgtgcggcgccaaaccagtccaaaagcacagctcctgtgcgacgctggataattcttggatctcaactcaattttgaaggggtgtacatgatgcagggttgtattgttctgtcgacaggcattgtttaggacaggcagagatctnnnnnnnnnnaaaggggtgtacgagatgcaggattgtattgttctgtccacaggcattgtttaggacaggcagagatctcggcgggagggggggggcagccacgatggaagcagctggctgaacaactgattgacctgagatatggcgcgcgctccaccaccatactgtcctgctaccagtcagactgctcaataagttgattccatgtcctcttcctggcagctagccctgtgtcagtagatgacctggtacatggatgcaagatctggagacaatctggtgcacagccgtcgagggctcatcatctggtatcctgctggaaatgcagacgctgtcacttcccaaacctgaatcagactggaacttcttgcatcaggagctcggcagggcagggnnnnnnnnnnactcatcatctggtctcctgctggaaatgcagacgctgtcactgcccaaacctaaatcagactggacctccttgcatcaggagctcggcagggcagggtggggtgtgagatcacacactcgagggataaatcgttgttgtctatgagatccagtacacaactcttggttgagatgccatgacaccgcatcacacctgaaatcagccacagaattgacagtggttgaggatacctcccgaaatggtcttggtgcaagttgcactgcccccattcagattctgttcatgatcacgtgatggtcgtccggctgagcagtacaccatctgaccaatcgcgatgctcgcggctcgacacctcatctnnnnnnnnnnatcaatgttgactatgagatccagtatacaactcttggttacgatgtcatgacaccgcaccatacctgaaatcagccacagaattgacagtgattgaggatgcctccctgaatggtcctggtgcacgttacactcccccactcagattctgttcttgatcacgtgatggtcgcccggctgagcagtacaccatctgaccattcgcgatgctcgcggctcgacacctcatcttgcaaacccacccttgtattatctaagttactatgcggctggcctggggtggagatagagggcatacatgtatgcacaagacctctgtggaggcggaggccgtaccatcggcggtattcccggcacccttcctggcaccacaaccgggtcataggtcacttgaattaaattatgagaagatgctgcaggatgtgcgacgtaaatagnnnnnnnnnnagcggtattcccggcacacttcctggcaccacaaccgggtcataggtcccttgaattaaattataaaaagatgctgcaggatgtgcgacgtaaatagcactcgatccttggatttgacctcatgacgtgcgaggaaggtttagctggatcgccgggttccattgcctggtggagaagtatagccagaactcagggacgcagggccatgcatggtcatgcagtcgtaagagtcaactacaagcctcggaccgcgcgcatatgccgctggtgtggtctgcttctgaaaacgaaggaccgaaccatacttgtgtagggtttcgtggtgcccaggcgctcataatacgagttccactaggattcatatgcattctaggtgacttcaggacaccaaacgttccacaaggtggaaaggcnnnnnnnnnnctctgcttctgaatacgaaggaccgaaccatactggtttagggtttcgtggtgcccaggcgctcatattaggcgttccactgggattcgtatgcattgtaggtgacttcaagacaccaaacgttccacaaggtggaaaggcacatgggcaatccaggtacctccagaccggtgtccgacactcgtctcccgaaccgctgtctgacacagaattcttggcactgccagacgtcgagcgaagacctgcccgggagacccacctgaagccacaccttgagcgggcgcgtatccctgttccttggacatgacaatccctgaagatactatagtcacgattgtaccaacttcgagtcaaaacccacacgctttccgatattcgtatcatcaagcatctaaactccatcttaaaggcaaggatgggcgtccttcgtgtgtgcctggtcttgctcgccgtgcagattgtcgccggtcgctcaggtggggtgggtggcacggggtggttgtcctgcaccctccctttcatgcccgaacccttcccgaaacctgnnnnnnnnnnaagggggtggttgtactgcaccctctctttcatgcccgaacccttcccgaaacctggttgcaacgttctcgaatataaaggttgatgtacatgcctcatcctcggctggaaccctccgactgcaggtggcttcgtggtggacagccatgaccggtcgctgctggccgccaagaaggactggctccacgagtgggacgagaagaccctcgtgaaggcttgggatggcttccactcgactgttggttcgaagaagaacgggaatggatcttccggtggcaagatcaagaaggagaagttcgacatcgacggatggttcggcttcctcaaggggcagcatcaggctggtcccggcaagtctaccggcggctccaagggatcctcgaagtcctcaaagccagagaaggaattccccgacttcttcaagttcttgaagacgaagtggggcaagggcaagaactgagcacgccaaacaagagagcaccgatgctcatgcacaaacacaacctttggcctgggcaggacttgcttcccactcaacgccatnnnnnnnnnnaggtcccggcaagcctaccggcggctccaagggaccctcgtcctcaaagccagagaaggaattctccgacttcttcaagttcctgaagacgaagtggggcaagggcaaggactgagcacgccaaacaagggagcaccgatgctcgtgcactagcacaacctttggcacgggcaggacttgcttcccactcaacgccatcgaccacaaccacttgcagttttgtccctcgcaagtcagttttctaaccgcttaagttgtctagactctctcacccgggttggcattcagcagcttgttcccttccannnnnnnnnnccgctgggagggatggtatcaagcaccccggaccccttgaagcctagacgtgtctgcctgcccgattggctttcgaggtttccagtgagttggtcatcgccatgagtcaattcttcaacatcgacatgggggtgactgtgcggtccttgtgcccttannnnnnnnnnattctaatcgcttaacttgtccagagtctctccccccggttggcattcagcagcttgttcccttccatgagcgatgtaatagcgtcacgtagatcgtagtgcacccagactgagcgccacacccagtcagacgcagggagggatggtatcaagcaccccggcctgcttgaagcctggacgtgtctgcctgcccgattggcgttcgagcttttcagtgagttggtcatcaccatgagtcaattcgtcaacattgacctggggggtgactgtgcggtccttgtgcccttannnnnnnnnnnnnnnnnnnnnnnnnnnnnnnnnnnnnnnnntcttcgcacttggagccagaatcgtattctctgcttggcaatctggaagtacttggagacgatcatgatgctcagattaccggtgctggattccagcactgggcccacaaccctgtggggcgatggcagcttgcctatgagctgagctcacaaggacccccgagacttggtgttcgcacgaacaacacagataaagctgagatgcatgcggggtgaggcannnnnnnnnngagtcccccagagacttaatgttcgcacgaacaacacaaataaagctgagatgcatgcggggtgaggcaccctcacctctccgtggcatcaagaacctggcatctgatggagtaggaattcctggaccgtacgggtgagtagcatggaagtgcagcaggccctatggcatgtcggcattgaagtcacgatgatgcatggagacatcccggcggttcttagagtcgttgacgtgccttgtcaatggcaacgctcaacacttaaaaccgcctagagcaggagttgggttacgggtcgcagcagatatggcatgagggcgagggcatccgcttctccccgtgccggcctgtttactcagacataccaaatcgatcacttggtttcaaaggcaatgagctccttaaaagtttctgtgggcgcggcgttgtatgccgtcgcgtggcaccaatcccttcccgaatccttgctgcaagcaggtgcaggttgaacggacctacgacggctaccatggagcgctcaagatgccttggattcaattccacatactgctccagctacaggtttgttgccccatcaggatggggcgtgtggagaatgtgctgtgcttatgaccatcgtgtgcccttgaggaattgcgggctttggcgggtggtgcagctgggcaatccagagccttgggctccagcaagaaaggtcctgccatacatcaagctggtctggcgctggggctcggggactggatgcaggggagtcgtgcccgggaagccatcattcccttgcatggctcccctgcaccatttctcgtcccgtgcgtcagtgcaccggcaccccgcttagttgactgggactcgtccagaccctgagttccagacagatacggcggtcacatcctgatgtatatagtggtttagtcacaggaccttccctccttgcaggtgcaagcccagagactgctggtgttgcagatgagaggcatgcaaagggccacgcagcggattgccaggaggcggcgcctgcagtgtcatcagaatgaatgtagaagcttggacgctgcactgccttgcattgccgtgtgccacattggtgttattgctccgctggctgtggaccttgaagacctccatgcacagcactgcacgcatgccagggtagtattgccttgtccataggcgtcagcttcagtgtgctcaggggtgtcttatgtggccagggacacccttggtgcagaggtgggcatcctgagcgcagcgtgagacatcttgcctgcaccgtggctcggcgtatgcccggcgtggctcagcaatccggcctcagacattgaagcggaagagcattatgtcgccctccttcaccacatagtccttgccctccagccgagtcagccccttctccttggcggcggccaggcccccaacggccacgaagtctttgtaggccacggtctcggccctgatgaaccccttttcaaagtcggtgtggatcactccggcggcctgagaattgtgtgggagagggaggattcgacggcacctcccacggcatcggcctggtgggagtgcaccttggccctttgacagcccatgaacatgaacatgtgcaccagcggccctttccacgacaacagcacccccaccgtcacccccgacgacgccagtgcacaccgcagacgcacctggggcgcggtcatgccctccctgatcgtccaggcccgactctccttctcgcctgcagggagcatgcccgggaacgctcggtgcccatgcatgctcgggccgcctcccgacagggcagcagccggcgccggcagcacacttcacacgcccactccacaccgccaacatcccgtgccccctcgctgcccaccggtggtgaagtaggtgagcaggcccagctgggtgtaggtggtgcgcaccaggctcttcaggccgccctcgctggcccccaggtccgccaggtactcagcagcctccgccgcatccaggtccgtcagctcggcctccacctgggcggagaccaggaccaccccgcacccctcctccgctgccttggcttgcagtgcctgtgtgatttttccaaatgtgcaccaaagcaatcctgggtccagaattcgaactgctccatgcgcgccaggccacagatcatcgacgtgctctttatcaggcacacgggatggagggagcctccctcaccaggtggagatacctttcgataaaaataccagactcctggacggccccnnnnnnnnnnagtgcaccaaagcaatcctggctccggaattcgaaatgctccaggcacgccaggccacagatcatcgacgtgcttttatcaggcacacggatggagggagcctccctcaccagatgtagataccttttgataaaaataccagactcctggacggccccacaccataccataccctcccacctggacatgagggttgctggcacccttgtctgcaaggtctgcctcccccacgttggcagcatacgtcagtggcttcatcgtgagcaggcacaagccacggactgcgatgggggcattccatgtgaggggaatgtgtatatgtaggtgtacatcttcatggacttgggcatagccttgacccaatctgcagcctcgtctgactcctcccgttgccccccagaccccccacccaccaagttctgcctcctctggggtcannnnnnnnnntcatagccttgacccaatttgcagcctcgtctgactcctccccttgccccccagacccccaacccaccaagttctgcctcctctggggtcaacgagacggagcgagcagggagtccagtctccattgccgccatgagacgctgcagcacgccagtctcggcctcctgggtcttgatctcctccgccgttttggccctgcccttcttcaaccgctccaaactgaatgggtgggattggcaggagccggtgctgagcatgcgcagacctctctgctcctccctgccaagcacccgcagggctccacagagtcccagcccccacatagagcttgtccnnnnnnnnnnacccctccctgccgagcacccgcagggctccatagagtcccagcccccacatagagcttgtcctcagcccctcacagggctcactcaccgcttctccacctgaccgatgtcagccagtgccagctcaaagttgatggtgtcgatgtcctccactgggttgacacgcccatccacatggatgacgtcgtcgttctcaaagcagcgcacgacctgggggtggcagttgtacggcagggtatggtggcttgccatccctgcatgaaaaccgtcgctgagcaggaggtacctacatcccacagggacagaacagctcctcaacacatcatatgcccccccacgtatgaaaggctaggcccgacaagaccaccccgatgccctctgccctgaatgcttgcccaccacatccaacctccccagcagctgatctgcagcctctcgcaaagccctcannnnnnnnnnatatgaaaggctaggcccgacaagaccgtcccaatgccctcttgccctgaatgctggcccaccacatccaacctccccagctgctgatctgcagcctctcgcaaagccctcattccccctcctgccggacctgcactagggagtcgcactcacgaatggtggccaggaacttgttgcccaggccctcccccttgctcgcgcccttcaccagcccggcaatgtccacgaactctatgctggtaggcacagtcttctctgcgtgggagcgggcgattggttgccaggtgagggcggctcacgatgcccatggtgtggaaacgaaatggggtgcgatgaacacatcacgatcaggtccttnnnnnnnnnnagccaggtgagggcggctctcgatgctcatggtgaggaaacgaaatggtgtgcgatgaacacatcacgatcaggtccttgcactccttcccatgctagacccgccttgcctgacttggacatgctcacgaggatgtccaggcgtgggtctggcacagccaccacgcccacgttcggctcgatggtgcaaaaagggaagttggcggcctgggctttgctattggagcacagcgcattgaacagcgtggactgcaaaaccggaatcagggaagaggggcatgcgccttgatcacattcaagaggctgcaggctcaggcaagggcctctgaaaagccacgagtgacccgccacggcccttgcagggccacctccctgccacctgagccgtcgcttttcgccccacatgtcacaccttgccgacgttgggcagtcccacgatccccgtcttgagagcaagcgtgatggtggagctgcgcagcccccggcagtgtcgtggccgcgggctggcaggcatgaaggaagtggggcctgggtgcatgtgcgccgcctgctgtgctggccacatctgcaggctgtgtaacgccctcacggggaagtgcatccccctttggcccatgcttgccatcagtggggaggctgccacattaaaggccatgacaaggcggctggagcaggtggcctgcattccgcctgagccacgggggcaaaccctggccacagtgtgcggggagtttcacgcgatgtcacaacccgcttggacgccaggaatcgaagcgcatagactgtttatcacattgagcgatacggaaatccgtgccaggaccgatcatcaggcctggcgacgacacattccctgctccggcatgttatccttgtgtggagtctcgggcagcatggctcgcagcaggggcgcagcatggtgtgcaagtggcatggccacacctgtaatcggacgaccatcaagagatggtaatgccaaacgatgatgacnnnnnnnnnnggtggcatggctacacctgtaatcagacgaccaacaagagatggtaatgccaaacgatgatgacgaggggcccgccctcccactttgatgcaagaggaaattgactgtgctgagtgagaagttcatgtctccatgcccatagggttgcagagcggcaggccaagccggtgcacctaggtcatgtggggaggaagtggtattctggatctgcccactcaagaggcagcacacttgagtctcctgtaatacgaggctggagggcctttcctgtgctgacgtcatcggatctacccgcgaggctatccctccagcattgccaactacttctccaaacatatctcccttgctcgaatacctcctcacttcgcctttgcctcatacctgggccctatccaactgccttccggtactcaaggcttgattccctctttattgaatgccaatgcgacagctacgcagtcggtttgctgaagcttgccggcaacacttgtgccaaccactccatctgtgccttgccagctggctcagcatccagcccggcatgggattgcaccttgtcgacatccttctgggccggcagcacgccattcacgacagccactcccacagatttcatggcctttggaagttgtgaagagatcttctgggccggtgcgggggtctttggaagtgccttgccatgtgacccctggctctgcggctggccaggcttcttctgagcctcctcgccgaccgtcgccttggcagcagccgcttttggcagctggatcgcgggtcccttcttctcgggctctggaagagtcggagccgggccacctggggtgcccggagccgcaagtaccttcttgctcttcctggccttggtctttttggccagatcagcaggttggttgtgggcgtcggcgttggcggaggtagcagcttggcttgatgtgctcggggttgcaggagctccagagcctgcaggcagagctgcttttggcttcgcctttgtggccttgggtggctttgcagaaaggatgcggggcgcagctgcttgactggccggggggggtccactgcttccggtgggagtgactccaaccactgtgggtggcttggcgggattgccgagggggagagtggtttggacattcgttgcacctcctgttttgcccttctctggaggcagcgggagccctgactcggctggcatgctttgtgcctgagccnnnnnnnnnngttgccgagggggagtgtggctttgacattcgttgcacctcctggtttgcccttctctggaggcagcgggggccccgactcggctggcatgctttgtgcctgagccttggcagttttgggaggagacttcttctttttcgccgtggtcctgggaggcggggggggctgggactcagcgaggatgacggttgctggcggatccttcctggtgactacttgnnnnnnnnnnttggtcttgggaggtggggggggctgggactcggcaaggatggcgggtgctggcggatccttcctggtgactacttgtttggcggggggattggacccagcagtggccgatgtggtccttgcagcagcttgcacgcctttgtcaagcccgcctgctgagacttccattggtgtcacagtgggaatttcatgatggggagtgccacctggcgtggggccctccacctgtcccctcgcagcaggtcggcgcgactcccgcgccctgcgctgagccccccgctttgcgtccttctgctcgcgtttcacgtgccgtttcagcaggcccgccactcccttgatcaggccctccaaggctgctgcatcagctcgtgcagcagccactgcgcagggatgagacggggaatgctgcggtgcannnnnnnnnnagccctccaaggctgctgcatcagcccgtgcagcggccactgcacagggatgagacggggaatgctgcggtgcaacaggcatgagagcaggcatggcgcgcaggagacagaggcggtgagctgagtccaaccaaacctgaggccctgactcctacctcgaaccccctcctcggaatgtgctttgcaaagggcatacagcacgtccaggctctgcccatgctcacagccgaggggtggaagtgtactcgcctcattcgcctggtgcgtgcacgagatgagggttgatgcatggcagggaggctatcagcttctatgttatgagattgtgatagggaaaccaggagatgtagcgcaaaaatgtatagattgccccgatcatgaggccaatcgcatcaacattccttgctcctgaacgatctgcatgtacttgccgacagcatctccaacccctcaacccacaggcacctttctcgcgnnnnnnnnnngccaggagatgtagcgcatgaacgtatgaattgcctcgatcatgaggccaatcgcatcaagattccttgctcctgaacgaccggcatgtatttgccgacagcatctcccacccctcaacccacaggcacctttctcgcgggaacatcccactgcacagcgtacagtccccgccgagacgacgcccggcccagctccatgcgcctcagccgatcgcccagcaggcgatagatctcggccgaaacgaccaacgggcagcacaccgttcctccctgcacctgctcaggggaaaannnnnnnnnnnnnnnnnnnnnnnnnnnnnnnnnnnnnnnnnnnnnnnnnnnnnnnnnnnnnnnnnnnnnnnnnnnnncggtgcacagcgctgatcgccactcgctgcccagcagtgtgttctgcaaatggccttgattcttcttttcccacgctgctcaggcaaaggggctgggcagcatgcagcacgacgaccaccgctttccggaggcagggcctgctcaccttcgataacagcggtagcgccccgaggatcgcctgcagctccccaggcctcattaggaacatagcttccagacaggcatccgcgcctgcacagataatatagaaacttggcttggtggtagggggcgcgattggtcgagttctctgcccctggggggcaatgttctcaggtgaaaatcgtcccacaaagcccggaacatgccgatgcctctgcagtgcacagaaggcacaagcnnnnnnnnnncattcaggtgaatatcgtcccacaaagcccggaacatgccaatgcctctgcagtgcacagaaggcacaagctcccaagctactccagaatgacaaccatggccgggaatcatgtaaccgaggcactgacagtgacctgcatttgccacctccttgcagtatatgctcacttttgaactcttgctgccccgccaaaatcacggcagcactcctggccacagccgcaatgcggttggcaatcagagggtcccgcacgctcctcccagcattgtcatcactgctctcgggcagagggttgggttatctctcagacacaggagttgctggcaatggagttggcagcacacttttgtattgatgccatgatctgacccgtcatcaaaactcctgcaacacagagccgcatgtcgcccctcacatgtcaaatggctcctcaacggaaaccatgtaggccagcgtggtccagggcaggtaatggagcgannnnnnnnnngtgatgccacgatctgccccgtcatcagaactcctgcaacacagagccgcatgtcgccccttacatgtcgaatggctcctcgacggaaaccatgtaagacagcgtggtccagggcaggtaatggagcgacccctcccaggtggacactcgcacagcgctgtacaagctgcggtggggaagagtgaacaggaattagttgtaaaggggggaggaaggcgtcctgcacattagggccccacggtgagcagcgatcggtcagcaggccagcagtcttaacgcctgaggacctctgcacctgccacatgcagagcaaacctactctgccagggggtcttgctcgaggccggtagcccagagcttcaggagcggagccgtcacctggaagaaagccaggaacagctccgataaggtctctgtattttctgggactgcgtccctccacccccgcaggaggtccatggcgctcagcaggtccgccggcgccagggccgctttgtttacgcggtcaccctttccggggaaaatggctttcaagggaggcagcagcgggacagggcgggtctgcagcacaaagaggacctgtgcatggaaggagacattggctgaggtcttacaggcttgagcagaggttacttgtgcagaggggctctccctctgggatgtgtagggagtgcatcgggcaagagacgaagttgtttgggcaggatcttagcggtagattctagccgtgccacctagaaagatcgtgcatagcgacaatatctgtgcacaagcgccatgccagccccctgctcccagtgcttgacacctccctctcaccagcagagtcagagcgtggctgttcaacgagcccgcagacgcatcattcaggctatgggccttggcccacgtcttcacgaggcgcaccagagccccaaacctccactccatctgttggtgtggggtttggtgagtgctagcagtgtgacaggagagccaggctagccaagggtccccttgctgttttcaacacccttgcgtatgcgacatcaccagannnnnnnnnngagcagtgacaggagagccaggctagacaagggtctccttgctgtttccaacacccttgcgtatgcgacatcaccagaccagggcaagggctgatcagccaccaactcactgtccaaccacctaggaccctgacccatcacctggcccaggagacccaggacgagggatttcaggatggtatgcctgctcccgacgctgacatcgcactccacacctgaggtggcaagaggtgatgtgaagggaacccactgttgtgtgacatgcatgttatctgacactcccaaagttccatgtggctggcacgaatcctttatctagtaatgccgtcatgagcacggctccacacctgatcgtgcttcggtgaattttaagagggggaccctgatggacttgtgtgtcagccttagcagagagcccgccaccatgtcatggctcatcaacagaaaggcaaatttctgcagcaattctccatatttcgatcagaactggagtttgaatggagttcaaagccctccataggcacagccagtctgagggcaggcaagctgcgtcctcattgccttcaatgcacaaccccacaggccactctgcacgcagtgcctgctcacatcaagagtcttcacgtgtactgatcgcatgccaggatcgagtcgagggtccaggtccagatccaggagctcctccacattcctgcgagcccggaaaggtgaagctactgatgtccaggccaatatcgctaggttccatacgctgccagcgctcggcactctgagcaagaattctgtgccgttgcgggccagcaggcaggcgattgcagctcaggaaaggtggaaataccaacagcattctactcgccggagttttggacccaggatgcagagatcggcatctccgnnnnnnnnnngccgacggagatgacttccagcttcgtgttcagccgctcatgcatctgcacgacagaagagccgaactgtgccacggatacttgcttggcgacgcagcagcttccacagcccgaatcaaggctcggcgagcagaagtcgcgcaacacaatctccaacccaccgaaagtnnnnnnnnnnccagctcagaaaaggtggaaataccaccagcattctactcgccggagtttgggacccaggatgcagagatcggcatctccggtcatggaggagagccccgaggccaaggatccaaacgcctccagccaaagctcatcactaccgacggagatgacttccagcttcttgttcagccgctcatgcatctacacgacagaagagccaaactgtgccgcggaaacttgcttggcgacgcaggagcttccacagcccgatcaagactcggcgagcagaagttgcgcaacacaatctccaacccaccgaaagtctggcagacaggtcgcgctggctgggcatgaagtgacttgcgatacccgccaggcccgcctcgaccctggcggcccactcttcaggcagacgactgggctgcagggaggccatgtccttgcgcacaagcgctgccagaaggtgctcctcagctcccagcaggctgccgcatagcctggctccgggtgcaggacgcgtctgggccgggcaagagtggatagggatgaatttgacacaaggtttcactgccagagtgatactgaagtggaggtgtccattgtatcgatcctgaagtctgattcattccagaccaaagtaccactattggagttcatgcttgagagggcgcctctacatgccagcacaagtgaggttctgcaccttcctcaccttggtctccatctcagcaggctgcatggcagcgtccatgcactgagggaggaggccctaccagggttgccctctccacagtgctaccagccgccttgaagagaaagggctctgatcagcgccaagtctcccggttgtatccaaggcaactacaaggcagcaattttaggtcgagcactggtgcaccctctcctcacttagaccgagagccactgagctgccaggtagtgctgtgtgatcggcattttcgatcgccgcacgatcctgcatatacttacagcgatcgagattaggcactggggtccgttcacatcgaatcaatgacgcacagtcctgtcgtatctacccgcagcattgcgcgcccacgagatccgagcgcgcggatgaagtgacagggtctctacagacacagtcacccaatcagggcaggtatactatatcccgcatgacccactctcattcgagcagatcgatcggggcatcgagccgctctggatcgacctggggccgggctgagnnnnnnnnnnttactatatcccgcatggcccactcttattcgatcagatcgatcggggcatcgagtcgctctggatcgacctggggccgggctgaggaggagggatgtcgggcctggagcaggccctgggaaggctccgagatcagcctcccgtgctgcagcccctgggagtgcatgcggtctttgatttgatcagcgcagcttccagcccatcccctgctgccatcaccgtatgcctgggggtgtccagcccggtgaggtgcttttaatgccggatgcttgcggatctgatgggtgcccctcatgcatgatgccataggccatgcagcctgtgaccagtgcaacaacctcttcccactccaatgctgccactcacgtgacccaaatcgacccctggatccgccaggatgcagctgcggtggcggtgcagcgcctcgtccagctggcgacagctgggcgggtgagccggggcgcggcacaggacctgctgctggccgcggcgagcggcgccccggttccccacctccccgccctcctcaacggtctggtgggcctgatcgtggcgcatccccccccgggccccgtcgcctggccgcggcacccgctgtgcagggccnnnnnnnnnnggctgggcgggtgagccggggcgcggcgcaggacctgctgctggccgcggcgagcggagccccggtcccccacctccccgccctcctcgacggtctggtggacctggtcgtggcgcatccccccgtgggccccgttgcctggccgcggcacccgctgtgcagggccctgcacgtcgggcccagcgcggcggacgcggcggtccaggcggccgtgcgcgcgctgtggggcggcaggggcggcgcgacgctgcagcgcacgctgcgcgcgctgtgccccgtgctgtggtgcgccacctgcgacccggggctggggccagggccccgggcatccgcggcggcctcgctggcacgcctggcggccgggctggccgcggagccgcggacgggggacctggaggccgcggccagcctggtcagtatgctgtgccgcgcactgagcatgtgggaccctcatgacgcgctctccctggcgcctgtcgtcggccccaccctggatgcctggcaggcgctgcgcttcgaactgcagggtgggcgagtgggtgtggaggtggtcggggaaggaagggtggacagaagcgcgctccaggggcaagcgctgcctcggcgcatgtgctgggcatgtttctgggtgtgtgcgtcctcagcgaggatattctggcaaccccaccgcagcatggggccctgaagccgcagccgtttgccgactcgcagctccgtacacgaaaccccttcgacattccggttgctcgccatgaacatgcagggaccgccgccgaggacctagaccgcnnnnnnnnnnccggcccaggccctggtcccggcgtcggcggccagggaggccaggtgcacaagggggaaggcgatcaacagtgcagcggcgcggnnnnnnnnnnatacaggaaaccccttcaacattccggttgctcgccataaacacgcagggaccgccgccgaggacctagaccgccagctcggaaacgccctgctgtccctggccttggccgccggcggccgccccgccacgctgcgccagctcagcgcggcgctgcacgttgtgggctgggggcccggcgccccagcctcgcaggccctggccctggccttcctggcgggcacagcgggcacagcatgcgcgccgggcctgctggccctgctgggcaggttcctgggggatgaccaggaggcagcagcccgccccgaccgcgccgctgcactgttgatcgccttcccnnnnnnnnnnttgccagcggccagggccagggacagcagggcgtctccgagctggcggtctaggtcctcggcggcnnnnnnnnnntcttgtgcacctggcctccctggccgcagacgccggggccagggcctgggccgcaggcgtgctgaagcgtgtcgctgggttacaatgcccccttctgccggttacagagtccctgaatccaaatgctcacccaaaggcccagcccgcctgtcggtcaatcgctgcaccgagaccctgggcgcgatatgcggtggcgctggaggcgctgcgtgcgctgtggcggggctcccgtgaggccacccgcggctggctggtcgcgctgcggacccatgctggagcctgcggccagtctccgtcttcactcccggtgggcatgctgtgcgcgctgctgcgccacctggacgtggagacctgcgaggaggccctgcgcactctcgctgcgctggcagggcctggagcgggcggcacggccgtcgttctgctggcccaactcctgcgggcactgagggaggaaaccagggccggcccggccatggccatgctccgccagctgccggctttgggcaagcatacggaggcgctgccatttgtcctgctgtccctgcagcgcctattccacccaggtgggtggcgggctggggtttgtcggaggtgtttggggggtttgagtgatggctggcagagacgataccattcatgtttcatgatggtgttaaccagcggaccaggcgtacctgcagacctgacacacccggcgtactcaggctgccagtctgtgcgtgccctcctcccgcagggagtgatccacgactcagggagctgggcttcgagctgatggaagctgcctggaaggcaaaccgcagggcgtactctgcgctgcagacctgcctgctcagtgagtgcgggtggttcagcagatggcagtgatagagattggctggcagaggtgttccaagctgcacagcacctgttggtgtgcgtgttgcagagagcgcatgcccttcctcatcgtaggatgaacctgaacaccggtgttgctgtcgtacttcccccaccaggcgcgacgcgtgcctcagcatcaggcaatccagggccgcagccatctgtggcgcagctgcgggccgtgtgctccgtctgcgcccaggaccctaacaagggcgtggagtttctaggattgatccaggcggggctgtcgagcactggcgctgatgccctgcaggcgctggcgctgcgctgcgtgcgccagctgtgcgccgccgacgtgctggagttttacagcgcctggcgagccgtggtcgtattcctgccgactctgccaaccgccgatggcaccgcagcggagtgggtgggtgctgatggggcatggggtttgatggggagtgtggcagttcatggtgttttggtgattcccaggatacaggtgaagtcctgcttcagtgagcatcattctcaaggctcgagcccgactctgcatgtgccatctttgccgccgctgcacannnnnnnnnngtgatggggcatggggtttgacggggagtgttgcagttaatggtgttgcggtgatttctaggatacaggtgaagccctgcttcagtgagcatcgttctcaaggctcgagcccgactcatgcatgtgccatctttgccgccgctgcacagttggacctcatggcgcacggagccttggacgctgcggccgagccggaggtcgtgggcggtatcctggatgccctgtggctggccacgcagcaccgatccgccgcggtgagggggagaacggccgagcattggtgtggtgcaagcccatgcagatgtattctccatgttcaagcccggggcgtgcgccagaggatgcctcacgtcccctcacccgcctccctgttgcttgtcaggtgcggctggcggcgttcctatccctggcggcctacgactactccctgctggaggaaagcgaggaggcccctgacgtcccggacctgctggcattgttggtgtgcgaggaggacgaggcgtgcctggacgccgctgggaagctactgggcgccgccctggtgttcaattacaggttgcatggttgggaggatggaagccgggatggtctgccaggtgcatgcagcgggagacttgccgcgggggatgggtgaccgttcgatgttgccagcgagcagactggagtgcagggccccaaatgaacggctccatgctctccctaaaccctgacccctgcccgccactggtcggcagccggctgcaaggcacgggcaaggcatccgtgggcgcccaggacgccagtccgctggaagactcgctggtcgccctgtctaagtccatgctggacggcgggtcccaggcagcgccggccctgctgcgacgcctgccttccctatcgccggtgcggtgcggggcaagtgtctgcgtggtgtcgggacggcgctgcctggggtagtggtccagccggtgcctgggatctggtggatgcaccgggtcctcaagcaatgcactgtcagggacattgcttcggagccccatctgccccgctgcatgcatccctagtcaggcggagcagagcggcactgaaggaccgtgacttcaagagcagaatcgtgtcaacatgctcgccatcgttgccagcaggcccgtcgccgtctcacccctccgctcaccctccacccgccccaggtggcagtactggcgttctgggcgccgccgctgccccagggagcgaccggcccgagcacggcggcggcggccgcggcgaccgacgcctacgccgccgtcctgacggagctggtgagcatgggcgacatggtcccgggtctgcgcgtgcccggggccgaggccgccgagctcggggcgtgtgagcgcgcgtgccgcgccttcttctcgcgctgggcggccgcggggcgcgcctccggcgtccctgcccccgccgcccgacactttgagggcctggaggtgcgggccggcgacgcggcggccgcgccggccgaacgcgccgcagcctgctggtgcctcggcgtgctggccggcatgcacccccagctgctgagccggcgcgggcaggaggccctgggtcagatggccaggtgtgttgaacgtccaccggccgtccgacgggcggccaccctgggcctggcggcgctgctggcccgcgtgccgggggagggtgcggcgcgcgagggggagcgcctgctggcnnnnnnnnnngaccggcgcgggcgggaggccctgggtcagatggccgggtgtgttgaacgtccaccggccgtcaggcgggcagccaccctgggcctggcggcgctgttggcccgcgtgccgggggaggatgcggcgcgcgagggggagcgcctgctggcctcggtatgtagtggcgaggatggcgggacgccatcgcagaccaaggctctgcgccgtgcggtgggcggcgccctgcgtgcgtccgagtccgtggcagctgtaccatatatgccccccacggaggcttggcgccgcctcggcgacgctcnnnnnnnnnnggccctgcatgcgtccgagtccgtggcagctgcaccatatatcccccccgcggaggcttggcgccgcctcggcgacgctccgccgtcgccggcagagccagagaccgcggccctgacgctggccggcgcgggtcccggcgccgcgcggccggcggatgcgcggaagctggtcgaggcgctgacaggcgcagcgctgggctcgcgcggcgccgcgcggcagggcgccgcccgcggcctgtgcgtgctgctggagggcgggaccttggagcctgagctggaaagtgcagccctggaagccctggagaagctggtcatcgcggcgcgctctgaccgggacgcccgggaggcctgctggccggtcgtggccctgtgcctcgacaccatgtgaggatgaaatggaatgggggggggaggaggggggggctgtgcatcatggcaatgcggtgtcccttgtagagctgtggctgctctgcatctgggacctnnnnnnnnnngttgggggggaggggggggggaggggctgtgtatcatggcaatgcggtgtcccttggagagctgtggctgctctgcatctgggacctttggtgatcgaccagggcgccggagagagtagctgaaaaggtctgatgcttggccgatctcagctgtgcggcctacactttcctcccccccaccttcacaaacctacacgcgccctccccgccgcacgcacagcgccatgcttaagaaacggcagcgccgtgccgtctccagcaccccctcgctcgtcaactccatgctgggcatgctgcgcgccgacccgggcctgcgccccggtcccgccgctgccatgctccgcgcgctgagctgccttaagcggctgccgccggggtcgcagctgggcggcatcctccgacgtgcactggggagctccgccggcggcgactcgacaaagccggcccctggcaaggctgtgggcgaggaatgcannnnnnnnnnatccgccagcggcgactcgacaaagccaacccctggcaaggctgtgggcgaggaatgcatggtgcacgccaacaatcccctcgtcctatggtccagcgccgtggaactcttagccaagcacccgcgctgggcgccggacgcggcgctgctcctgctggacggcctgcgcgacgacggcgaggcagaggaggccgattcgagatctgcgtcgcgcatgggccgccaagagaccctggcagagcctgcccaaggaccggccctgggccccatgccccggggtgcccgcgtcgcagcgctgcaggcgctccccggtttcctctcggtcgccccggagcccgcagggtcactccgtggcgtgtgtgccgcggtgctgtgcagagagcgggactccccatcccgcctggcagagctccatgccctgctgacatccctgcgccggctccagagcgggcaggcggagaccagctcgagcgcgccgggcgtgctccccagagccgctgccgagtgcgtgctgcgctccgtcctcgaccagactcccccgacgctgcccttcctctcgctgtctgacggagcttccattgggggaccagtgcctgatggagccgaggccgagggaaaggccccatcgcaggccgcaccggggtgcttcccctcaggtgccatcgcgcggtgctgggacagcatcatggcctgcctcgccctcattgatcctgccgaggtatgacggtggatttttgaggacatggcggtttgaggggacatgcctctgtcccgaaccatttcccctcatgaaggcgcaagctgagatccagccaccgcccggcactcacgccgcgatcctgaacgccacgacaccccaccgacccacccgttgatgctgcgcaggtggagggtgcgctggcgcagcggctgcatggccggcccgatgcgggggccgagtttgcgctggcgagcgccgtggcacgcggcatcctgcctggagatgcgctgcagctgggcctgaacgccgtcctgttcgaccctggcgcggcgacccccggcggcgaggcaagccaaggtcggggcggaggctccctgcaccggaggtgtggctgggtagcgcaggcggccgcccggctcggcccggggcagcagcggcactgggtgactaccgcatgccgcatggcccaggtgaggaggggaggagactgctgtcctcacacctgccaggaacatgggaggctcatttgtgtattcaaagctgcgctgtgttgcgcctgtcacagcccacctaaacctttgtcctcccaagcagggggcgacctccccgagggcagcacgatgcctggtctcctggctgggattggccgtggcgggtgactcctggctctgcgccttccccgacggcagcagcatggaggagggtgtcctggctctcctgccccaggccctgggcgacctggtcttggacaaggactgggccccttgtgtgaccgaagtgctggcggggcccctgcgcaccttactccccactcaggactacctgcagtgcctctttgccgcgaggcgtgtgctgcccgggtccatgtgggaggagctcctctctggctgggacggtgagctagcagcggccgttgaataatgccagtgccttgtgaatgtatcacagcaggcgcagcaggagggagccggtgcacaaaccccgaaggcgcagctccgatacaaatgcggtccaggcatgcgcgatccgtgcagcgtgtcgttgcagagcgatgccatgagtgaaggcactcgatgaggcatcgcgtggcgctctcctcggggtgacgcggtaggaatggagtgtgccgaggtcactccgggcggggcgctccaggaactgcaacgcctnnnnnnnnnnttgcagcgtgtcattgcagagcgatgccatgagtgaaggaactcgatgaggccacgcgcggcgctcctcggggtgacgcgataggaatggagtgtgccgaggtcacccggggcggggcgctccaggaactgcaacgccttgttcgcgacgcggaggcctacagctgggcatcccagctcccagatgtttcggatacagtagaccagagggccatcaagaaggcccgtctcctggagcggcttcaggttggccgtgcttgaagtgtagtgttccggtgggaactgggatgagatttgagggtcgcatgggcagcggcctccacaccagtccgctcactcctgcaggagctgcactccgaggagaaggccctgcgacgtcagagcgtggtgccacccacacctgcccgctccagccgcactgcacaggacccctccaccctccagtctgaggtatgggtgcaggggatgcctgtcccgatggttgagctgtgcaatcttccagcacacaaaggcttcactgaaactaagaaaactttatgcccagaattttaatcataacgcatgccggtttccctcctttgcatgcgcaggaggcggttccgcacccaatggcagtccagcctttggcatggcccacccccaccgccctctggcccccgcgctccatgcacagcttctcagcgggcgacgatgacagcatctcgtgcacgcaggcggtggactgcgtgccctccacccccgcagacgccgggccggcgctcacgccaggcggcgcggccacccctctcgcagcatcgctgggtccggcatccgtgcccgagtcggtgccccgagccacacatgggctgctccaccccgaggaccccaggagcccgcctcgcggccgagcggagcacgcacccggccccagccccagccttgctggcgcacccgcgcctcccatccagctgcgccttccattcccggtcctgtttgccacgctggggccggggccgggcccgccggtcatcgccctggtcctgggcagccacgcgccgccgcacgagcccacccacgccctcgtcttcgacccggagcggggccgctgcctgtggtccagcacgctcacgcgctgcgagggcggaccgcacccgggggggctcaacgcaagctccatgctcctcgtccgcgcggcgacgcccgctgccaagccctccgccgccgggtgagctgaagtcgtgcgcggacggagcgatcgtgtggtccaggactcgtggtctcgagtcctctgtcgaaaacttgccggacatgcaccttgtatcagtggtgttcccacgctcacacccagactgccgggagaggtcgctcaggaccccatacccactgcaccccctgcccaccacagcggcgcaccttctctggccctggtccttgctggggggctggcccccggcgacccctcccccggccagcccaccatccacgttgtcagcctgggggctggcgccggtctgcccccactctccatagaggccgagcgcgctgtgtatgctgcgctggacctcgggggaggggatctcctcctcgcaggtgctcggggggctccgggtctgggcggggagcgggtggagggtctccggggcgcggcagatgctcgtcggcggatcccggccctgcttgttcgagaacgaggagtgagcaggccgcctacccatcggtgcatcgtgcgaggcccagctcttcgccccattcacatcgccccaaccaccctcccnnnnnnnnnntgagaacgaggagtgagcaggccgcctgcccatcggtgcatcctgcgaggcccagctcttccccccattcacatcgccccaaccaccctcccaccgccctccaactcaggtgacggccctgacctgaccagggtgcgtctggactcgctctggaggtcctacacctggggcccggcgccgccagccgccacagtcgccgcccgcgacctgcccgacatcgtgtctctggcctgggccggcacggcgcagggccccggccctgcccggcgcccgctggtgggcctgagcagctgcggaggagccgccgtgtggaccccgggcctggaccaggtcctcgccctggtctggccgcccgacggcctgcattccctgcgactgtcttgttccctgggcatcctgccggcggcggggggcagcggcggctgcaccctggcctgcgccggggtgcaggagcctggaggacgtctgggcctgaccgccgcgcagcttggagaaatggaactcggcgcggcggcagtctccgcagagtggggcctgcctgccaactggacccagctgcccggccaacaggtgggtggttgggcgaggaaagggcggcgcggcgcggggcacactcagcccgaggggttatcaggggcagtgatcgtccgcgatgcccggcgagaccgcccctcatgcccagccccctgaacactgcaggcagtgaccgcggtcctgcacgtcgcagcagggcaggggccgggggaaacgggaatgggggcggcgacgcacagcgccatggagcagagccttttcggctggctggtggtgggattggcgggtggcgacctcgtggcctggcacctgccctccggcgcggcggccggcggcctgcgcggcgtcagcgccgcgcccgtaacctgcctgcaggcctgtcttgccgaccaggcagacgcaggctcgctgggggtttctatcgtcgcggggtgggcgtgcggtaccgcgcttgtagtccccgacgcggtgctgggcctagggccagatgcggccatgtaaaagtcaaaggactcgcctcttccggctcacagcaggcattgaggggggaggcggcgcgctgcacagcggctgggaggcctccggcccccgggcagccgtggccgtccctggttggcctgcagaaccaatgggcaattggaaaaaagggggagcaaaaaacagttcgtcacggggacttnnnnnnnnnngggggggaggcggcgcgttgcacaacggctgggaggcctccgccccccgggcagccgtggccgtccctggttgnnnnnnnnnncttgcatccttcgcagctatgttgatgctcgtgctgctacccttggtcctccaggccaccccaacatcagcaaaaatacacttcgtcacagggacttcccannnnnnnnnnaacctcgccattcccagaatatattgactggtgtttctgtatgtgccccgctcgatgtggcgtcgatttccctctgtgtgggtgtccaggcatgttcgctctacggtgctgcagaaaatgatcgttcccagtcattattatccaggcacataaaatggaaagtatgcagaggcgagtgnnnnnnnnnncctcaccattcccagaatatctcgactggtgttcctgtgtgtgccccgctcgatgtggcgtcgatttccctctgtgtaggtgtccaggcatgttcgttgtacggtgctgcagaaaatgaccgttcccagtcgttatcatccaggcgcataaaatggaaagtatgcagaggcgagtggtaagaacttgcccttgcatcctttgcagctatgttgatgctcgtgctgctactccaggccaccccaacatcagaaaaaaatacacttcgtcacagggacttcccannnnnnnnnnnnnnnnnnnnnnnnnnnnnnnnnnnnnnnnnnnnnnnnnnnnnnnnnnnnnnnacaggtgcctggaagtttcaaactatagccgtcagatccaccagctctcagcatttcagccgggttctgagtcgagcttcagatgcccgcatgctcccacaacccacaaccgactcgcatcttggatttgggtgtttaaaagaattacacaccggccactcggtgacagcgagacatctcagagagcggtgaggagccctcaatgctccagtatgccgacgaccgggtttccccaactccacccctttgtcaaggcacgcagagctcccgctcccagcctttgccgtgcccgggatgctggcatgccaccgcnnnnnnnnnncttgggtgttttaaaggattacacaccggccactcagtgacagcgaggcatctcagagagcggtgaggagccctcgatgctccagtattccgacgaccgggtttccccacctccaccccttcgtcaaagcacgcggagctcccgctcccagccttcgccgtgcccgggatgctggcatgccaccgcaccgtctgaggatggctcaagtgtgagggttctggtgccctgccttgcagcatctccaatgcaagaccaagcacgacaccgtctagggcctcagctcccccgcctcctcgctggacgagcggctggggccctgggcccgcgccgccgccgcggggtccctgaccgcctccctggacgctccattcaactccggacccggctccccgccgcgcagcgcgcgcagcacctcctccgccgccttcaaccccccgccgcccagcagcaggcccgggcgcgcgcccagcacgcgcatgactggcgccgccgccgcgccgggccccgcgcggcgcaggccg

SEQ ID NO: 40730 - DNA, 80 bp, Chlorella protothecoides
tcaatggctcaccatatgagtatcatacacccactttgtgttttggggggcctgcatccacgctcggctgctgcaatctg

SEQ ID NO: 40731 - DNA, 76 bp, Chlorella protothecoides
tctgcctggacctcctgcgctcgcccgtggtgctcaactgcgcgcaccgcttctgctgggcctgcctgctctccca

SEQ ID NO: 40732 - DNA, 424 bp, Chlorella protothecoides
  modified_base (97)..(324): a, c, t, g, unknown or other
gcgtcccgcgccctcctttcctggcgctccttctccaggacctcctgggggagggggtgcgtggcaagcctgctcacagagtctgggccgatgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacagggtctggcgctgctggaacggaatgcagggcgctgccagcggcttgactcgagatgatcggctccactcgcgcagccatggtgtcccccctcag

SEQ ID NO: 40733 - DNA, 107 bp, Chlorella protothecoides
agcatgcacgcccgccaggtggcgcgcctgtcgcgtgagtttggcggagggtaggggccggggctttgtctggccctcaagttggctgggactctgggatgtcttgg

SEQ ID NO: 40734 - DNA, 61 bp, Chlorella protothecoides
tctccatgccccacgcagtggtctcatcgcacctgccacccctgtttttgaggctcagagg

SEQ ID NO: 40735 - DNA, 1998 bp, Chlorella protothecoides
  modified_base (352)..(361): a, c, t, g, unknown or other
  modified_base (600)..(609): a, c, t, g, unknown or other
  modified_base (1009)..(1059): a, c, t, g, unknown or other
  modified_base (1180)..(1189): a, c, t, g, unknown or other
  modified_base (1898)..(1907): a, c, t, g, unknown or other
gcctcgcccagcgcacgccaggccagcgccgaccccgactcggccgccagcgcggcggccgagtccagccgccccagcgccagcgccaggtcgaagcggtgggcggggtcggtggccacctcggccgccgcctccaggtggccccgcgcctccaggaaacgcgccagcgcggcgtgctccgcctcgggcacggtggggagcagggcgcgcgcgccgtccacgtcgccgcgcagcacgcgcgtcttgaactccaccaccggcaggagcagggtgtaggccaccactgcccccgcacggtccaccgcgtacagccgccccgcggccgccaggtagcccaggaggtagagcgggnnnnnnnnnncgcccccgcgcggtccaccgcgtacagccgccccgcagccgccaggtagcccaggaggtagagcgggcggtcggcgtgggccagggtggtggtctccccgcccaccgcgtaggcgatgcgccagctggacgtggtgaaggccaggcagtcgccgacccagaccgcgctggtggcgggctctccaatctcgcccaccagctcgaaggctgactccacgccgtcctcgtccacgccctcgnnnnnnnnnncacccagaccgcgctggtggcgggctctccgatctcgcccaccagctcgaaggccgactccacgccgtcctcgtccacgccctcgccgctggccagcgcggcctccgccgcctcgcgcgagtactccaggatgtgcgtcgccgccgggcccaccagcgccacgccggcgccgccctccgaccagtgcaccgcgcgcacctcggcctcgatgcggcggaccaccgcgccgccggcccagtcgtagaaggtgatggcgtcgggggtgcgcacgcccagcaggctgccgccgtggatgccctccgcgctgtacggcaggcgcagcgtctgcgcctccttaaagttgcggaagatcttgaccacggtgctcgactccctgtgtgtatgtgtgtgtgtgtggggnnnnnnnnnnnnnnnnnnnnnnnnnnnnnnnnnnnnnnnnnnnnnnnnnnntttgcatgggcagggggcgcgtgggtggatacggggggtgaggggagacggaccgggcgtcgcagatgaggagcgcgctgcgcatggggtacgcccaggcgccgcagtgctctggcccgtnnnnnnnnnnattgcatgggcagggggctcgtggggtggatacggggggtcaggggagacggaccgggcgtcgcagacgaggagcacgctgcgcatgggggacgcccaggcgccgcagtgctctggcccgtgaacgggctgtcgactgcagccggagccctccagcacccccaaacacctccgcccctccacacggcacctgatggcaaaggtgttgctgtcgtcgctccaggcaaagtccagcgccgcgccaaaggccttgttgcgccaggccagggcggtgtagatgacatactcgccgtcgccacacactgcaggccggggtgtggttgtgagggatgagggtcgatgagcgtgtgacacaagggatggtggcgagagcacaggggccccgctcataccactgcccgtgcaggacacatcgcagcagcgcacgcctcctcaccacgtcctcgtccggcgacacccacccacccagcatcccagccacgccaccacacacgcacccgcgacgaagcggccgttgggggagtgcgcgaggtactgcgggtactgctccgaggaccccaggtccttgactgccagcggcaggcgctcgccgtccttctgcgggcgcgccggcgaggggaggttgggctcggcgtgcggtgggggtgtcaccaggtcccatcctggcagcttgctgcaggtcgaggcctcctgcgccggcaccccccccnnnnnnnnnntgagggaaggagggcgggctcggcgtgcggtggggtgtcaccaggtcccatcatggcagcttgctgcaggtcgaggctcctgcgccccccc

SEQ ID NO: 40736 - DNA, 472 bp, Chlorella protothecoides
  modified_base (130)..(354): a, c, t, g, unknown or other
gatttggaagtatgggcaggggttcaggggggggcgagggcgtgggtttgagggcgggagtgaagatgtccgatggagaagcagtactcctccaaggaccaccagccctgccagtccagcccgccgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgaagcgtgctcgccggcaagaacggggcgccgtcacagcaggcggggccatgccggccaaagcacgtggcagcgtggagtggacgatccagctttccccccttccccatcccac

SEQ ID NO: 40737 - DNA, 106 bp, Chlorella protothecoides
tgctcgtgtgtctcccaactccatctacacccccccccttccccccattccaccacaaactatgctcaccttggataccaccagcaagctcaggtccagcttgttc

SEQ ID NO: 40738 - DNA, 73 bp, Chlorella protothecoides
ctggagtttgaggtagctgtctgggtgttcagataccttactgggacgtccagtcctgggctcgtctccagac

SEQ ID NO: 40739 - DNA, 80 bp, Chlorella protothecoides
ccggggaagggtcccctggtgttggtgtgttgcatttggctgtggaccaaggtttgacatggaggtggagtggaggggcc

SEQ ID NO: 40740 - DNA, 2321 bp, Chlorella protothecoides
  modified_base (159)..(168): a, c, t, g, unknown or other
  modified_base (1504)..(1513): a, c, t, g, unknown or other
gagggggccgggggaggggactttgccagcctgctcggcccggccacgtccgcctcgctggccagcgtgattggtgtctggccctgcagggcaactcgatcctgggctcgctctgtattcctgttggtgccatgatctgtcgccaggggcagggatgannnnnnnnnnatgctcggcccggcctcgtccgcctccctggccagcgtgatcggtgtctgcccctgcagggcacctcgatcctgggctcgctctgcattcctgttggcgccatgatctgtcgccaggggcagggatgagggtttggttctggctgccaggtctcaccatgcacgtcaccaggcaggcagcctggtgggcagcaggagcgctcatatgccagtgattgaaacaggtaccctccccctgcctcaccttccacattctcagtgtgcgtctccccgggatctacctcctccaccgcctgctggggcacctccggcagcaccgcggagttcaggtatatgaggcagggcagcagaaccacggccgctagcaaggctctgttggatcttcttcggagccatctgtccacccaagtcattccggcggaccggatcatcgcgccggccaccctgcccgtgaggcaggtgccgggggagctaccactgcgcaggccggctgtggcggttctcctggaggaagaggcggccgcgcagcaccaagactacgttagacttacgcacatgattcacgcagtgttgatccttgcccgacttgtcagcgggaacgcgtttcacatccccgttggctggggcagggctgccccccagctcgggcgcgagatctgaagatcgacgaacgagtcgctcacaattgttgttgtggtgcatcccccggagcgggcgattctgaggggaggtaattattacactactgatctccaaagcagaaatgatttgccaaggactggcagctttcaacgaccattaaaccaggctggtcagcactgtcacctggtggggtttggccacacccgcccacacccgcttggtcggcccagggagcggcgggcacgtcatggatggatttttgaagagcgtgggaggggcttggagctccctgaccgagaagtatccccagttgacgcagctggaggagcgcgtcgtcactctgctgcccaggctgtcaccagagcatgtgatccagctgggccccaagcggtatagggtgatccgcaccctcggggagggaggctactccaccgtgtacctcgtacgggagctgagcgagaggagtggagatcttgggacagctcccgccgagccgccagggccggacctggcactcaagcaggtgtggaacactgttgcgagccaggatgagaaaaggcaggaggtccagtgcacccccaggagcacctgatttctatctccccgcacagatctccgtgcaccccctgccccagggattccctctcccacccacccaacctttcagattttcctggccgggcccgaagaggagnnnnnnnnnnggagaaaaggcaggaggtccagtgccaccccaggagcacctggtttctatctccccgcacagatctccctgcgccccctgccccaggattcccctctcccgcccacccaaccctccagattttcctggccgggcccgaagaggagcagagggcggcggcagaggtccgcctgctgcagtctctggcccaccccaacatcatccgcctgctggaaagcacagtgaccgacgtggacacgccctcggggccgcgcagggccgccctcctcctcttcccagcatatcaggcaagacggccggggtgggggtgggggtgggggtcggttgtgagagggggaggcgttggggaacaccgctgccaacatgatgaaggtatcgaggcccctgcttcgggcaagctgagcagatgtgcttggcatgtagtactctttcagagcaggccccacgctgcacgctgctggagaaaataccgccggcctcaccaaaccttaccgcccctacgggatctcccacgacgcagcacgggtccgcgtgggatgcggtgcaccgtgccgcagcgcccccgcccctgcgcaccgtgctttccatcttcatccagctgtgcgccgcgctggaggcggtgcacgccgcgggcctgtcgcaccgggacgtgaagccgcagaatttactgatggaggcgcgtccaggcgccacgccgcgcaccgtgctgatggacctcggcagcgccggcccggccgccgtgcccgtgcgcgatcggggtcatgccctggagctccaggaggaggcggaggtgggggtggttggggggg

SEQ ID NO: 40741 - DNA, 97 bp, Chlorella protothecoides
ctgagcttgatccgcttcagccgccgcctggggggacaggggcagggtgggtccggagaagctttcaatgcgtgccgcccagagcggcagtagtggc

SEQ ID NO: 40742 - DNA, 61 bp, Chlorella protothecoides
gttaacagtcgggagaggagtggcattaactccatccttcatgaacttaatccactgttca

SEQ ID NO: 40743 - DNA, 68 bp, Chlorella protothecoides
ttcaccgtcctcttcaacttccggcgcttctagggctacggctggtactcggcggggcactggcggac

SEQ ID NO: 40744 - DNA, 61 bp, Chlorella protothecoides
cctttttattcaagggttgcgatgcggagttcttgggcacgtacagatgtgatggcagaga

SEQ ID NO: 40745 - DNA, 61 bp, Chlorella protothecoides
aggacggcggcgggctgggaggaggagagggcggcggcgggctgggaggtggagaggacgg

SEQ ID NO: 40746 - DNA, 61 bp, Chlorella protothecoides
atgtagatctacaccgtgagcacggccacttctttccttttgtagtcgtggtggggggtgg

SEQ ID NO: 40747 - DNA, 71 bp, Chlorella protothecoides
gcccaccagttgcccatgcccacgatagtggtcattccagaggggggcgcggaactgctccgccagccggt

SEQ ID NO: 40748 - DNA, 143 bp, Chlorella protothecoides
ggtcccatgcgtggagtaggcccccgtcactagaccctggggcgggtggggacgaggggtgccacaggggtgggctgctggcagggcggcgggggccgagccgtcgcagccgggcaagcatgacggcaggccccctcgcctga

SEQ ID NO: 40749 - DNA, 181 bp, Chlorella protothecoides
cctcacccgccggcgagctgtgagtttggtgataggagggaacgaggaagatgcatgaggcttcagaggcgggggggtctgatcggttgggtagccattctggatgcgcagcaggacccatctctgcacccctgaggctggccggccctaattcgggacagcagccagcttgctcggctta

SEQ ID NO: 40750 - DNA, 64 bp, Chlorella protothecoides
gtatgcccgggcgctcgtcgaaggtagcgactccgcgagcaccgcagtgcggcttcctactgca

SEQ ID NO: 40751 - DNA, 112 bp, Chlorella protothecoides
gcacgcggcggggtgccctggccctgcccagctaccgagatgcagtgcagagtgctgcttggggcagagcctgaggaagcatcgagaagtagcaagaagaagagccaggggc

SEQ ID NO: 40752 - DNA, 224 bp, Chlorella protothecoides
tcgcgccggggctccgccccggccaggggcgcggtggcgatggccacccaggacccgtccaccagctcggccagcacgacggtggtgggcgggtcgacgggcggtgggctggaggtgagcccttgaccaggttctgtgggcccccccggcgtcgtcgccgggtggccgtcgcgtgcgccctccccggccggcaccgggctccagggctcgatgcgcaggctgac

SEQ ID NO: 40753 - DNA, 9008 bp, Chlorella protothecoides
  modified_base (562)..(571): a, c, t, g, unknown or other
  modified_base (1890)..(1899): a, c, t, g, unknown or other
  modified_base (3259)..(3268): a, c, t, g, unknown or other
  modified_base (3503)..(3512): a, c, t, g, unknown or other
  modified_base (3590)..(3599): a, c, t, g, unknown or other
  modified_base (4994)..(5003): a, c, t, g, unknown or other
  modified_base (5680)..(5689): a, c, t, g, unknown or other
  modified_base (5782)..(5791): a, c, t, g, unknown or other
  modified_base (6772)..(6781): a, c, t, g, unknown or other
  modified_base (7033)..(7042): a, c, t, g, unknown or other
  modified_base (7840)..(7849): a, c, t, g, unknown or other
  modified_base (8082)..(8228): a, c, t, g, unknown or other
  modified_base (8366)..(8375): a, c, t, g, unknown or other
cggcgcagcgcgcccagcagcggcccgcaggccgtctcggaggtgggccccgccgcgacgcagccgccgaggcgcaggaccagcgtcccgacgctgggcgcgcagcgcagcgcgcgcagcgccacccgcgcggccgccagccagagcagggggtgcccaggcccgtgacccaggggcggggccgacagcaccaggctggaggccgtcagcaggccgtgcgagcgggccagcgaggccgccgcggcaaggtgcagcgggtgcgacaggctcaggctgcggcagtgggcctggctgcacagcgtgcgtttcatggcggccagcgctgcgcccagggccagctccgtcagcggggacgcggccagatggtagactgcgggtgtggagggtggaagttgggagtgggcgattcatgttggcaggcagctgcagaggacaccttccaaatgccaccagggaaagggggtagcaagggaagtgtgtcgccagacgagccatgcttgctgcgacccagactaggaggatgcatggccacccatcgggcgcccacgagtccaaggcaatnnnnnnnnnntaggcagctgaagaggacaccttccaaatgccaccaggaaagggggtagcaaaggaagtgtgtcgccagacaagccatgcttgctgcgacccagactagaaggatgcatggccgcccatcgggcgcccacgagtccaaggcaatgagccgccgcagcggccaccagccccatcatgtatctcatgcagagccagacaccaaccctcgagcccaatccgatccgcacgtctgtcgccgagggaagccacgtccgccagcgccgccagcagctccctctggaggtcccgcgcctgcgcagggtctatcccggcggatcgcgccgcctcccgctgcgcccgctcgatcagcacgccgtcgtaacccagagccacggcggcctgggtgtccaggaggagcgtcccggtgtccaggaggggggtgcgccgggcgccggcggcttgtgcatggccgggggggtgagcggggtcggttctcccagcaggcccggccacggcctccgggcgctcaaagatggaggtgacgtgggagccgggcgccccggtcagcctcacgctggccacggcccggcggtgccggatgccccccacgtgcaccgcccagttgtccccggcactgggcacccaggcatcgcagagtcggcaccgcagacccctgaggtcaggggtcaggtgggggttgacatgggagatgaagcaacgaggaacggtacctggaagtatccccctggatagcgagataaagcagccataatgcccagcagtgccccagactcccactcacgcccagtctcaagcactcacttctcgccatgctcggcatcctctggccgtgggcgctgcgggactgctgtggagctggtcgccaccacacgggacaaaggccccctaccagcagatttagaggttccgcctcgtggtctggttggggtgcctggcctgggcgtcacccggaactgtcgcacaggggcccgacgctcgccctgggcgcctccagtgaggacgtgcgcgacccaggccaagtcttccccagtgcttcccgccgacatgcacagtaatgggaacgatccaaaagtgcttagtataacagatgaaccggtatataccgtgcgaacgcaggagtagttggcgggcaatggagtgacctgccctcagcgcgcgctgagctgtgctttgaatgagtgtcgggtcaatgtgaccaggcacgatctgtgtgggcgcaggccgccatggtccatcgcacgatcaccatcttccgtcaatatcgttataaaatacgtgcctgaagccccaagggctgtgccgtgtgtactgtcacctcannnnnnnnnnccaatatcgttgtaaattacgtgcctgaagccctaagggctgtgccgtgtgtactgtcacctcacaggcttcccacctccaacgacagcacctcgcatggcagatgctgagggcaatgccgggtgcaagccacgcactcctgtgctcggcattctcttaccacagaagaaagcatgcaagcacttgactcctgcattgctccatcgcgccgctgacgaaggggtgacactgcgagttctggaagaaggggttcctctggcagctcagggtcattttgacgtcctgctccacaagatcaggtccccaggtgagacaggtggggtgcatggctggagagtcatggtccgggtcaggatctgcaaatgtttccgctctgtcaatgttcctccatgccagcatcccacggtcacatggtgcagagtgggaggaggaggtatgtgcatacctggactcccacccggaggtcaccatcatagaccacccaaaagctgtacaagccctgggcaaccgggctaccatgctgaagctgttggatgatgacacctgggttctgaaggtgggtggagggtgctgaagccaggctctgcgctggggtcggttgccatgcccgcctgcgatcgaggcgagcctcctttccaggcacagggtgttcaaatcagcgagcgcagacgccatgatggcatctgccgccacagccacgttgcatgatgcttgcagcatgtacaacttgtacacagcctcacagccctccacaccgctctgtcgaccccaccgcaggcccctgcccaggccagtccaggaaagggcggcgcaggcttcacatgcaccacgcccgcgcacctgctcctggctccagggtgctcactggccggggccgaggatgccctggctgcggcgtcgctgcgctaccccttggtgctgaagccctgctgggcagatggcagggagggagcccatgcacttgccctggtcacctcctctgccggcttgcagggcatcatcgagcgaggggcccagctggggttggctctgccggccctggcgcagccctacatcgagcatgggggctgcctgttcaaggtcggcacggggagcaccatggaggcaccggttgggtgagggcgggcaaccatctgtgtgtgccctcgcagcaaatgccaccgcgccgcccctcccatgtcctcccaggtctacgtgctgggcggccagtgccgcatggtgacccgcgccagtctgtcgctggatcaggacggcgtggcgagcgatgccggcccggggcaccatcgatctgcggacgatggggcggagcagccgggccgggctggggactgtgggaccgccaggccctgtccaggcttgnnnnnnnnnncccatcgatcgccggacgatggggcggagcagccgggccaggctggggagtgtgggaccgccaggccctgtccaggcttgcagctgatgagccgcgtgagcgcctacccatcgtctgagcgttggggtcaggaggacctcgcgccggcggtgagtcggggaggaatctttggacgccagccgggggacggggggcacattggacgggcgcttgccctgagcaacactgcagccgnnnnnnnnnntggggagcaccatggaggcactggttgggtgcgggtgggcacccacctgtgtgccctcgcagcaaatgccaccgcgcnnnnnnnnnnaagccgcgtgagcgcatacccatcgtccgagtgttggggtcaggaggacctcgcaccggcggtgagtcggggagtaatcttttggacgcccgctgggggacgggttgcccattggatgggcgcttgccctgagcaacactgcagccgcggcttgcacattttctattggaagtacgcctggtgacaagcaacacactctatcgactgctcattgccctctcgaacaggatcacggcgttcgcatccccccaccctgggtttgggacgcgctggcgcagaggctgcgggagcggctcggcctacacctcttcaatttcgacgtcatacttcccagggagcagggaaacgagccggggagtacatccaccctgctccacctcattgacatcaactatttcccagggtatgagaagctggccgggtacgaagagctcatggtccacttcttcaaagaggtactgcaacagagggcctgcagcaactgagggccagcgttgtgtgtgcatgaatgaaccattcggaactgactcggatagtacagcgttgaaggggttggttcagagggatacatctgtgcacactgccgagatcgacagaccaggggccacgcccgcccgggacaatttccgggagcccagagccaggctggccttggcggcctcgcttcgcgctttctcgcacttactggctcatgacacgcgagggtctcgggtcgcaccctcttccctgccaccttttggagctcagcacagggagtacgcagcgatgggcggcgaacgtgtgaggtgaggggctcttcagggcggtgcttgccgggctggacggggtgccgggaggctcgccagcactacttcaacctcttctctccgaccactgcacaggttgtacgtgactggacagttcctcggattccggaggtgcgtcgggcccgctggtcgtgattggggcggaggcttgcgagcttgggcggggggattccccggcagtcgcgcaggcctcgctcgcacactcagctcaccgagtgcagccgcgcatgccatccgtgtcaatattaggaagcgctggcggggttatgtcgtcctcaccatctcgccctctggccatgccaccctgcaggagcaagtccaaccagtacacccacaccagcttggtgaagatcgacggtgtcaactccaagaccgagaccgagttctacctgggcaagcgtctggcttacgtgtacaaggccaagaccgagaagaagggcagcaagttccgcgtcatctggggcaaggtgaagcctgggggatgatggaggggagggacgtgcccgtgcgcccagcgactaaatgcgcggtcgccaggtcttcagtgttgatggggaacctctttccatgggctaaacccctttccatnnnnnnnnnnaaagcctgggggatgatggaggggagggatgtgcccgtgcgcccagcgactgaatgcgcggtcgccaggccttcagtgttgatggggaccctctttccatgggctaaacccctttccataaggctttcaccccttacacgatgcgcaggtgacccgtgcacatggcagcaccggcaccgtccgtgccaagttcaagagcaacctcccacccgcagccatcgtgagtgggtgattgtctcagcgtggcagggtggtcgtgtgcatgcgtgcgtatgttggcatgccggcgtggtgtcaacatccccggctgggaacccgcagtgggaggtaggaaccagcgttcacgatcaaaacccctttccaccacctccatccttgcagggcgccaagatccgcgtgatgctgtaccccagccgcgtctgagcatgctcgtggctgctcccggaccgacccccagcgtggtcttgtcggttcttccctcggctgtaagactggcatagcatgccgtgtgcagatcagggatgcagcaatgtcacagcaggggtggcgcagggacgggggagagatggggcaatctcgctgtcagtcgatcgccagatggcctcgaggagggtggttggcacaaccggtgcagcacatacgtggaagagtctaccgggtggcagcatgagcagcgnnnnnnnnnngccggcgtggtgtcaacatgccaggctgggaacccgcagtgaaatgtaggaaccagcgttcgcgatcaaaacccctttccaccacctccatcnnnnnnnnnntggggaagggatggggcaatctcgctgtcagtcgattgccggatggcctcgaggagggtggttggcacaactggtgcagcacatgcgtgggagagtctaccgggtggcagcatgagcagcgagcttcagtactaagaagtagccgagtttgttttgcatttcaagacagaactgaaggcgctgggagaacattacgctcatctcgacatgccggccagaagcatgctgctgcatggtgtaaagcatgttataagcgcccaaccgctaacgcacacgtgctcgccaccaggctgtggtcaggcagggctgtcggtgtgcaaacccaaaagagtaaaagagagcggtggcagggacctattctaccactaaaccaactgcgctggttgggagggtagtcatgggattgactgcgcaatccgggaatcgaacccgggtctggtccgaatctgctgagccgttgaagagagtggattatgtgcacgtcatattcgggaactggactgtccaacacctgagcatggctcaacgctcctcaatgccacagaatggcggacatgtcgctccgagtacctcccttgttgagatgagaaggtggtggaacgctcagcctcacattagaaccgagccgtcttggtagtgcatgctggcctaccagcaccaggtcaaccacatagagcacagctgcactgttggatgttctcagttggagcttgtgatgaaagcagaaatcacacgataccaatgttgatggaacccttcgggccgcatactctcaaggagcaggatggtatcttgctggtttacaccgcactgctgtatattgttgaatggccactgatgtgcaggaggaccgctcaagcattgacgagacctcaaatcaggggcagcactacgatctaagactctgaatgggctgacctgtaggtgaccattacccttgggaacgatgactgggggttgggtggcgcccccctctttgtnnnnnnnnnngatgagacctcgaattaggagcagcaccacgatcttaaactctgaatgggctgacctgcaggtgaccattaccccttgggaacgatggctgggggttgggtggcgcccccctctttgtcatgctttcgacagttccctttgtcgaggaagggcgcggcaagggggccaaagtctgacccccaatatccgtaacaggcggatggactaacccgcattgtttttaggaacgggtgtggtcgacttcaccaaacnnnnnnnnnnacaaggggggcaaagtctgacccccaatatccgtaataggcggatggactaacccgcattgtttctaggaacgggtgtggtcgacttcaccaaacattgaagcgagtctggaccgttgctgcgcccctggcagcaaggtatggcctcggagcccgaggaggcgtccacccctgctgggatacctggtgactcgcaggaagaggatggaagccgcacaagctcacctcccctgcctgtaggatcagacgatgcggtgggaagcgcagctcagccgcctgagcgggagtccatggaggaggcgggtcctggtggccccgacttcgtgcctccactgcctgctggagatggaccgggccaggccctcatcctgcacggcaccggcgcatcctcagactctgactccgacgactacagtacctcatcggatgaggagccagacgagtcccagctcccgcccgggccgatcgacccctcccgctgctcggcgacgggcccaggcttctccggaggctcctccggcatgcccgtgaaaatggtaataacagcaaaagactctgctggccgtcgcatccgggatgggggtgcctacgtcctggtgacactcgacaaacccgcacccacagggtcagttgttgtggccagagcagaggtcactgatcacggggatggtacctacaccgccctgtacacatgtcctagtaagggtagctaccaggtgagtcttccaggatgggcttggacctggggcaggttgcggcgtcatgggggcggctgcctttgctgtgggtgcgcatgtcnnnnnnnnnncccaggatgggctcaggcctcgggcaggttggcgcgtcatgggagcggctgcctttgctgtgggtgcgcatgtctgggaggggggaccagtgagaggatggtgggacatggcgactgtcgcccagctctggcacccagggctctgataccgaatcacacatgatccttggcgttgttaaccctacacctccctttccccctgtccctactgccccaccgcagctgacggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctccgccgcccagctgagcgccggcgcagtcgggtttggcgtcgcccagcccattcctggagcagctccccctaccctggttcgtgttcaggttgttctttgttctgggaacgtaaggcggcttgaagaatggtnnnnnnnnnncgtctccgccgcccagctgagcgccggtgcagtcgggtttggcgtcgcccagcccatccctggagcagctccccctaccctggtgcgtggtcaggttgttctttgcactgggaacgtaaggcggcttgaagaatggttgtgagacggcgcagaccctgcatggccctgtcaggcttgccgtgtgtcgcgggcttctgaatgatgcttccctatcaagtgggggttgcaggtatgcaggtacgaccatgcgcacctcccacccctgccaactcctgccctccttgaactcaaccctgcaccaacccccgtctcttctccgaccgcagggggcgcaggccgcgctgtcaggtgtgcccttccccgccacggacctcgagcgcctgagccgaaccgtgctggtgggcgctccttgttccctgccctccggcgatgccctggcggcggccttccttcgcgccggcgccgtggccagcgtccagctggcgggccccggcgccgccttcgcctgggtcgagtttgccgccgcggcctcggtgccggcggcgttggccatggacggcgccgcagtgcccccactcgttcccggcggggagcccgtcacgctgcgcgtggaggccggcgccgcggcccgcg

SEQ ID NO: 40754 - DNA, 70 bp, Chlorella protothecoides
tcttctacccctacgtccagcagctggtcatggggcctgtcaccatcattgcggccctggtcctgctctg

SEQ ID NO: 40755 - DNA, 377 bp, Chlorella protothecoides
  modified_base (122)..(288): a, c, t, g, unknown or other
tgtcgcggttgcataggcacggagcagggggaaggggggtgcgggcactcccgggtgtgcacagatcgccactccatgaacgacactgtttcgacacactttcgtctcattgctttcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcagcgccgggagggagcccccagccctggcgctccctccgacaggcgcctgcttcccccccgccgccaagaaggcgcgggcatag

SEQ ID NO: 40756 - DNA, 134 bp, Chlorella protothecoides
gacctgagccgcaaccgcactgttggtgagagggtgcatggaggattggcgaggagcatcaatggggaaaggaggcctggacgaaatcttgaacaaggtcgagggtaccttgcaaggaggatggttctggaaaa

SEQ ID NO: 40757 - DNA, 8643 bp, Chlorella protothecoides
  modified_base (676)..(685): a, c, t, g, unknown or other
  modified_base (1246)..(1255): a, c, t, g, unknown or other
  modified_base (1404)..(1413): a, c, t, g, unknown or other
  modified_base (1718)..(1727): a, c, t, g, unknown or other
  modified_base (2009)..(2018): a, c, t, g, unknown or other
  modified_base (2787)..(2796): a, c, t, g, unknown or other
  modified_base (3614)..(3623): a, c, t, g, unknown or other
  modified_base (4635)..(4644): a, c, t, g, unknown or other
  modified_base (5053)..(5062): a, c, t, g, unknown or other
  modified_base (5889)..(5898): a, c, t, g, unknown or other
  modified_base (7000)..(7009): a, c, t, g, unknown or other
  modified_base (8431)..(8440): a, c, t, g, unknown or other
ccccccccttttccccgcaaaacctccccccccccacacacctcccaggatgcgcttcagggtgtccaccagtgcaccgcgcacggcggggtcctctggagggggaaagtactggagcacgcgcagggctttgacctgcagccagggcgaggccagaccgtagtaggtgtagtcctgcgggacctcccgcgccttgcagcggtccagcaccgcgatcaggcgggggacgcaggcctcgtagccgacgtaggaccgtgccgccacgcccagcagcagcgtggtcagccccagcagcacgccgacgtcggggtcggccagcatgcttgccaggcgcgagccccagacgccgggggacagcacctccgcgtccaggggggccttgcggatgaggcgcagcaggcacagcgcggccttcttgcgcaccacgggccgggtcgcgccgttggcctgggtgggggggtgggggggtgagggtgcatgggttgcgcctcctggatcgtcacgaaagaggaagacagtagttgaagagtggcggcgggggcaatggaagcgatcctgagggaaaatgtgggacgggttccagacaagggaggcctgcaccacggattgtgcctgttccgcgcagcgactcccaccccagagactggcacccatctctcgagcaccgcgccgtcannnnnnnnnnctccggacaagggaggcctgcaccacggattgtgcattttccgcgcagcgactcccaccccagagacaggcacccatctctcgagcaccgcgccgtcagcgcgccccgccagtacccaccagcacgcccatgacgtcgacggtgagcagctgcgcaaactcggcgcccccaactgcggtgggcaagggccaggagcggaagaggtgaggcggtcaatggcgatctgcatcagccgtggtgaaaagagtgctccacacaatgatggtgcctccatcggcctggaggtacagagggccagaagcacctgggaactcccaagctcccaagcactcaccattggctgtgaagtcgagggccaggcactggaaggcttcgttgcgcgagatgaggtcgttccggaccgaattgatcaccaggcggagaaactcgtcttgctgcaggagtggggatcaggatgtagggagaggttaccgcacacggcatggccgcctcacgccaggtacgtgggcgagggttggcaaggcagatacataccacaatgtgagacaagtggggtgcagnnnnnnnnnnaggcgagggttggcgaggcagaaagataccacaatgtgagacaagtggggtgcaggcgaggaggcgtgcaatgccccaacaattgcggcggaaggctgggggtcccatcagggggaaatcagagagatcctccaagccttctcaacacnnnnnnnnnngacaattgcggcgcaaggctggggtcccatcgggggaactcagagagatcctccaagccttctcaacacagctcacctcgctaaggaagaccgcacaggcgacgtagccgacctgcttctcggcatacctgcgtcaagcatggagttgggcggctgtccggcggccaggcagtttgtcacgagacaaggacaaggccagcagcagaccagtggtcaccctagcaagccgcagagcccttaaatgacgggggcccatgcccaccccctcgcaccgacctaccctggcgccgcaatcaagtccatgnnnnnnnnnnttcgcagagcccttgaatgacggggccctatgcccaccccctcgcaccaacctaccctggcgccgcaatcaagtccatggcttgcttgtggccgaactcgacattgtagccaagcatatgagtgtagagcagcttccacatgtacttccgcttgtcgtaggctgcgaatggacaaaggacaggtggcacggcctcgaggcagggagtgcagagggatactccgtgcacaatggcactagtgcaccagccagtcacgcacccccaagcacagccttgccggannnnnnnnnngagcatgtgagtgtagagcagtttccacatgtacttccgcttgtcataagctgcgaatggacaaaggacaggtggcacgacctcgaggcagggagtgcagagggatactccgtgcaccatggcaacagtgcaccagccatttcacgcacccccaagcacagccttgccggagcaaatgccaccccctcacctgacatggccttgtcggaggtgtacttcttcctaaccttacccagctccttatccacgcgctccttctcctgctccttggagctgcagttgcgcagctcctggatgtagttctgcggggggtttgggggagggagccgtccacattcgtgtgcgaccactggcgagtcgtgccggcagcagcctgagcggcaggcccagactggcaagactcaccctcagcccccgaacattggtgactttggccattgtggcaccgcgctgtggccgcggctcgtgtgcgaccctgcgctaccacggtcgagcaccccagtgcgatcgcggggggtgggggaggcaggtggccagcaacgatgtgggatcccctgggtgctttgcaatgatcaccgggtccgcagcacttattgcgcagggggagcgcgcgaccaaccggagagggcgtggaaacgatcactcgaaggtcgatctcggtccaaatcctgggcgcgttgtcgggggcggtttgttgtggagatgtgggacgcccaccatggagcccctgcccctccttgagcaggcttgtgttacatgcagaaaccannnnnnnnnngaccggagggggcgtggaaacgatcactcgacggtcgatctcggtctaaatcctgggcgcgttgtcggggcggtttgttgtgtagatgtgggaagcccaccatggagccctgagcaggcttgtgttacatgcagaaaccatggagcagcaatacaatgacaggggagtgaaatggggatggcaccggccctttcctggcggggcacggtcgtggcggcgcggagtgagacactcgcagcttggcgacaacccctgcatttcaggccggcaggttgctgaccttgcgggctgcctgccccggcaccaggtcgatcttgctctccttggtccgcacggcctgcacccagtcgtcggtggtcgcgctcttgccgctgagctgccgcgcgtccggccgcagcggcgcggagtccaccggggagtagtcgtccccgccctcgcccccggcacgccgccgcgactgggccttggaccagcccatgatgaagaccagggctgccagcaggcagcacagcgccacgccggccacgatgccccaccagcgggcgtccagctgggtggagtcgccctgcaggttgtgcggcacctgtgatgggcaggaggggggggcttcaagtatgtggcggcatttttgtgtgtgagtgtgtgttgggagagaacagggtgtgttgttcggggctggcgggactgagatcgaccggtgcaggacgcccccgccggaagggtctgcaaccttcgcctggatggctccgcgcacagtgtaggattccggcccccaacccaaccccctgaagatccatctccctggctgatcagccacnnnnnnnnnnacggaagggtctgcaaccttcccctggatggctccgcgcacatcgtaggattccggcccccaccccaacccccagaagatccatctccctggctgatcagccacacggccagccggcacgcacactcacctgggtcctggcagagtcctggaggggcaggatgagcgcatcgctggctcgccggctgtcgatggccggcggcttgtcggcggggtccaccaccaccaccgtctccccctcctcgctcccccgctgcggcccgaacacggcaaactggggcagctccgctgtcgcgacgtgggcctccgccgcgggcgcgtgcgcgcgtgagaggcgggagaaggcactggtcaccgcggcctgatcgccgaagagctggcccaggtcgcccccgtattgacccaggatctggtcgaacaccgccgtcaggtcctcgtcctgctgcctgggacgggggtgttgttggcgcggttgggaaggggggactgggggacggtgggcagagggatgcgcatggcagtggggctggagctctgggggggggtccagggtcagagagtgtgcggccatggtgccgagcctggccaatggttcccagtccagcagcggcaggcgccggagcgaagaattgcacccgtgcactcagcccaccagctcacccggcaccgttgacagccccggtctgcatggtcgtggcccagggattgagttcgtcgtcatcatcgtcatcagatgagccgtcgtcatacctgttgaggataaagggtggagggccggggtgacaggaggaacagagggggtgcaagagtgtgtgggtgtgaccggtgagcggctccaggctgggctcttgttcacacaattccccctaaaccagccgccctgccctggcacatgccgaagctgcacagctggccgactcacacgtagtcgtccaggttgatcaccgtgatgaccttaaattggctgtactctggcatgtcttcgacggaggtgggcgccgtgctttcctgcnnnnnnnnnngaattggctatactccggcatgtcctcgacggaggtgggcgccgtgctttcctgcaggcggcgcgtgggcggggcggcggccgcctcggccgcctctgccagggagtcgttcacggaggacaccatcatgccgagcatggtgttggtggccacctggacagcctgcttcgtgggcaggttcttggggccaggtcccgtctccccaaagtgttgctgcggggcatggacatggggtgggggggttgcagcaggatggggaagtgttgggagtgcgacgccgtgtgcatgtgaacactgcagttttaggaaggccagagaaactggtgcaaagtggatgaatatcaaagcaaaaggcctcgagtctatgcgctgagattggaggaatgagaaataccgtgggatcatgtcnnnnnnnnnnaccagagagactagtgcaaagtggatgaatttcaaagcaaaaagcctcgagtctatgcgctgagattcgaggaatgagaaataccgtgggatcatgtcggggcacgcgccatgcagggattccgagcatcggttcccgagtccgcgcgatcacctgaagaccatggaacagggactgcagtgtgtcctgtgcttccagggccaaaagattcttttggagggatgaaaactgtttgaagacgtcctctgccgtggttttctgcggggaaaatgcgggaggcaggctcgcgggtccggccattgccgacagggagcaggcggatccaggacactcaagcttctggaggactgcgcaatacccactggtgcagaactgctgtcggccacgacgctgtgtagtaggaagctggacacgaggcagagcaggaggctccgcggtatcctgctcgccatcatgcggtgggtggggtttcacacctcttgcggaatcacacgctggtttatggtcgccttccaaacaagtcggcatactctcgtgctccaatatggctggaaggtgcacttcaagaggctccagggtggttgcctcccggtctccgttgcctcgagggggccggtcttctcgcaagccgggttcatgcatgaattcttcgctttcttcaatctcattacaatttccgaaacgcagcctgcacctgtcgggaagctgatggatacttaaccacggtaaatgaatgtgtgataacagggatgcatgaacacgatagtctagtagatgagaataatttcttcaatgaatatatatgtacagcatggaaccacggctgnnnnnnnnnnatctagtagatgagaataattgcttcagtgtatatatatgtacagcatggaaccacggctgtcgagtcttgccatcacatgattggtaagagggaacccccaagccgtgcccacaatccagcgaacttgctaggagcacgcttctgggcccgccttctgtgagagagtattactatctaacgagcaactaatatgcaatcgacagatgctgtggtgtgcgacataccggtacgagaagcttgtgcacatgggttctggtggacgtttatcagggatataaatctcacatccgtgattacatctgaaacccttgtcctgcatccatgtaacaagatgccgtcgatagagagatccggacatgatggactcttgcctgaccccttgtggccacgtgcagcagcttctattgcccgaggtggcgaacgcggattgccgcgatcgagaatctttgccagtgtgatgtccaagtctgactgtcgcgcaacgataacctcgacgaattcaggtgagcttcaacaccatctttgtttcgacagcgttggatgctgagtcggccagccagaaaggtccccgtgccacccaccgacatctgcagggaacttgcaacggtaagtccgccggggaagtgtcggcgctcattcaagtcatccgatctaggttttaaaagcatgtgagtagccccaggccgcagaactcgatcggcgccaaccgtttccggccacgtcccagacgcctgcctgacccggtcactcgcaccaaacccaagcctcactttgtgtgcttgtatggaccgagaaactacttcttcgctcaaaataatgttccaatccgtgcgtgtgcgaatcgccgagagctgcgcgccaccatcagtgtcagactgagtgtgccaaggttttcgagaacagtgcctgacccagggagcaggctgatgccgtgcagctgcatgcagcgacccagcacagagtagctgtagagagcactgggaggtggggttcagtgagggtccctcccacctctgtgtgaggtgtggtcctgatttaacggtagatgggcggctttcctgcgcgccagtgctggggtatgccagctcatagctgcacannnnnnnnnnctgtgaggtgtggtcctgatttaacggtaggtgggcggctttccagcgcgccaatgctggggtatgccagctcatagctgcacagaggtgacacgggagcccagtgcacaaaagatgaccacggtccttggaatcccgcgttacccctgtgcctcgatctcgggcccctggatccgatttcatgatccttgtcagcgcctgcctagtcctaggcctttccataatgcccagcaaaacgccgggctcgccgttcaagaacacctccgcaacagcaatttgacatgcatggtgtaaaaagaggtgatgcatgttcgttcagggtgggaatccggcagactgtccgggaatgggctgtgcagccctcgccccctgctgtgcatgacgggtgcccccaccttccccggtgtccaagggaaggtccgcttccgggtataaagggagatggcgggcaccctgaggaccggttagaggcggctccccaatggagagtgaagagtgacatcgccatgtccctggacatcgatgacccgccgaactcccggctattcgtggtcgccgggcgtgcaaccagcgtgagtaacaatacccgggccccatcaaccccctcacccaaccccctcccctccctcaccgagtcctccttgtgtcgtcgcaggcggagtttctcagggatgtcttcgagcagttcggtgtggtgtcattcgtgaagtatctgcgggacaagggtgagtggacggcacctggacctcattgcccgccgaagcgggaatgggggcctccttcctgcattcccgggctgactcggggtcgttgaatgaatccgtgattgaagcttcccgcacccttgccctgcgcggagcccgccggcactctgcgatcaggcgggcccggttgtggcgtggccttcccctccccgccccgggtccaccactccacccgatgaatggcatgcagtgtccccgtcgcaccatgtgaccgcatgcgccccgcgatgccacatcctgccaccaacgccccccctcatcatgctggcactcccctccaccacaccaggggtggcgtacgtcaagtatgaccgggcctcctcagcggccctggccatcgagaacctgcatgaggtgaccctgaacgatggcaggggacctcgactcaaggtcatcctggcggaatcgccccacatgaggtgcttgccctggttgttgggcgcggaagggaagggggctggagggggagcaagggccggatccagggtctggcccgatgtgtgcacatgcctggaggccggcgcggccccagtcgcctgcgccatggcaagtaccacattgcaacgcgcgcgcctgcctgcctggtctgtaccgcagcggggaggagagggcgacccaatcaggaatgccacggtgtgtcctatccatccgtcccccnnnnnnnnnnttgccttgatgtgtgcagatgcctggacgccggcgcggccccaaacgcctgcgccatggcaagtaccaccttgcaacgtgcgcctgcctgcctggtctgtaccgtagcggagaggagagggcgacccaatcaggaatgccccggtgtgtcctatccaaccatcccccccccctccctcgttgaactcttcccccccacccacc

SEQ ID NO: 40758 - DNA, 157 bp, Chlorella protothecoides
tatatcgctgcagcaacgggtcttgatcactgaggattggtacagggcacgggtcatgccacctcatcgacgcgcggctacgagagccctagtgaggtgtcactgtgtaagatcccacacactgccgtctccgcctcatcccagcacagatttcctg

SEQ ID NO: 40759 - DNA, 80 bp, Chlorella protothecoides
gatgcagaagaggacccgggcctgaggcccgggcatgcgccgagctccgagccgcccgcccattagggaggccatcatcc

SEQ ID NO: 40760 - DNA, 76 bp, Chlorella protothecoides
aagggccactagatgctgccaccccccccctggccgcatgtaaccgtgcacggcagggccaggggcatcagaaggg

SEQ ID NO: 40761 - DNA, 61 bp, Chlorella protothecoides
cccaccgacagcttgatgtccacctggtagcggtgtgtgtgtgtgttgggggggggggggg

SEQ ID NO: 40762 - DNA, 76 bp, Chlorella protothecoides
ctatgaacatgaaggtattcgcttgacaggctatcaccccaaaccggctgctcacgtcagctcgatggcgagcttc

SEQ ID NO: 40763 - DNA, 241 bp, Chlorella protothecoides
ctccacgccgcgcgcctcccattcggcgcatatgcgttggtcgccgcaggctagcagcaactgccgccgcaccggcgtcaggaccagccgcagctttgccgcaatcgcagcgtccagcaggcagagctccgcgccgctgtcgagcagcgcggtgaactcactgctcccaatcctcgccttcgccgtgagggcctggtggggatggcgggcaggctgggggacggctgcgccgacgcgagca

SEQ ID NO: 40764 - DNA, 67 bp, Chlorella protothecoides
ttccgtcacactcccaagcatagagagcgcgtacgtctcatgtggcagattctgccacaacagagta

SEQ ID NO: 40765 - DNA, 109 bp, Chlorella protothecoides
ctgcaacaggccacgaagcagcatgccagtatgcagactcagggttgacgaaaacaccttgtcccaccccccataggcgccagggtcaccaagccactcctcacctttg

SEQ ID NO: 40766 - DNA, 115 bp, Chlorella protothecoides
gcgggggcggccgcgcggaagctggccgccaagctgcgcccggagctggagcgggtgcgcggcgaggcggaggccctacgcgccaagcaggaggccaccaagaacgtgagcttga

SEQ ID NO: 40767 - DNA, 64 bp, Chlorella protothecoides
agcatctttggcgggcggcgctgagggggcgagcgggctgccttggtcacggggcgggggaccc

SEQ ID NO: 40768 - DNA, 61 bp, Chlorella protothecoides
gtcggcgatagtcgcggtggtcgtggcaggggaggaaccccagggagcccagcttgaagga

SEQ ID NO: 40769 - DNA, 115 bp, Chlorella protothecoides
cactcgaggtgcgcacggcacagggcaatctacgcacgccttccaggcagggcatgtcaaacccacgtcccacgctgtggaccccctggtagacgcccttgcctttgttaagtcc

SEQ ID NO: 40770 - DNA, 61 bp, Chlorella protothecoides
gggggtcgccatgtcgtcgccaccgcccttgcgtgctctgaaggtgtggctggacgacgac

SEQ ID NO: 40771 - DNA, 61 bp, Chlorella protothecoides
cagcgcgcgcgcgccgtccctgagcgcgcccgggccgtcgcgagcggcgtgcgccagcgct

SEQ ID NO: 40772 - DNA, 61 bp, Chlorella protothecoides
ccccaagactgcctggtggagcgcacagcaaagatgctctgcgctaaatgtaacccacgtt

SEQ ID NO: 40773 - DNA, 76 bp, Chlorella protothecoides
cggaatgtaggcacctaccagtgagtgccttgccacccacctctacccaaaccataccttccagggaggcgaggta

SEQ ID NO: 40774 - DNA, 71 bp, Chlorella protothecoides
tggccacttgagtgcagtgcaggcccatcagaccagattttcatgccagacactccaccctcccatgcaca

SEQ ID NO: 40775 - DNA, 109 bp, Chlorella protothecoides
gaggcgggggttgggggttggccgaggattgaggcgaagcgtttcatgctggtctgagcaagggctcctcgtggcaccccagccacccagtctgggcgcaggccagggt

SEQ ID NO: 40776 - DNA, 61 bp, Chlorella protothecoides
catccctgtcgtggggagaagagaggtcgtcaggtggggcgggtgatgcgccggaactgtg

SEQ ID NO: 40777 - DNA, 2642 bp, Chlorella protothecoides
  modified_base (199)..(208): a, c, t, g, unknown or other
  modified_base (623)..(632): a, c, t, g, unknown or other
  modified_base (1451)..(1460): a, c, t, g, unknown or other
cccgccgccatctggaagggcgacgcagaggggacagtggaggccgccgaggcgggggcggaggccacgggcgtgaggggcagggccgcgctgcgcctgctgggcgtgccgggggcgcccagcgcgtcggtgtcgctggcggtgcgcaccgggcgcagcggggacgaggaggtgggggccacgccctgggccgccccgnnnnnnnnnnactggcggtgcgcaccgggcgcagcgggaacgaggtgggggccacgccctgggccgccccggcgggcgcggcctccggcccagtgccaaaggcggcagccgccgctgccatgacctggtgtggggaaatgtcccccgtcccccgctggccctgcgcagggtgtgggaacggaacagggatttgagcaccgcacacttgtgcatgggaggggtggaggcacgctgcgggcacacatcgtggcagcatattcacagatgcaaacgtgggcgtcacacgggcacacaatgcatcgatccgtctgccgccaggcgggcccccggatcaaattagcgttggttgcagcacaggcagtagcagggcccagaactttcagagagagtaatccggtgcacaccaaggcacggacctggaaggnnnnnnnnnngatgcatcgatccatctgccgccaggcgggcccccagatcaagttagtgttgctcgcagcacaggcagtagcagggccaagaactttcagagagagtgatacggtgcacaccaaggcacggacctggaaggcagggggaatgatgacgggggagagggagctggcgtggaccaggctctcgctgccaaggagggtgttgcggggagagggggaggcgccttcgacgtggaaaccgaccaccttcacgggaggagtggcctccaccttcttccccgacgtatcggatcgatgcatggcggcggatggggccagggccggcccacggagcccacgacgcctgcccttggaaggagtccttgctcgccacggaccctctggaggcagggtgctattgcaaaatcgtctcagccgatcataggctggctggggttgaggtaatggcgctggggatgggatcggtggggattgaagtgtggggattccggcatggccagggccacagtgggcctgggcaggccccggaggaaaggagggaggaagaatcatgcagcggaccccatgggcggaccatgggcgtattcacccgcccatgggggcggagatcctgagcgggacctataccattcattcgtcccttgcgcatcgcatgtgggcgtgccaggcgccatcgactgcacctgcggggtgtggacaccaactcgagacgcaccaattgttaaataagtgcacccatcgggtgggcgcctcaccgtacacactcggtcctacaacaccccagtcgcactaactctgcatcatggcgggcacacgacccccctnnnnnnnnnnccctacaacaccccagtcgcactaattctgcatcatggcgggcacacgacccccctccctccgcgccgtgattttgcggtccggacaaggcgtcgaggaggtcattggcggggagcgtcagggcttgggagcgctggaggagctcatgcatgtgtctgaaggcgaaatagaggtaggtcacctccagtgggacgtgcttttcggggtcatggagctgtcaggcggagcccgccctggtacctaccacggccccaacccctaccgtcgcagatccatgtcttcaaggcgccgcaattgcaggacctgccggagtacctggcagccaagaagccaaacatgctgtacataagcggtggagtgtatcacggaggggacagtcgtgcacacgcccccctcctccgtctgcccttcatgcatgggcccgacggtgcgctaccagcctggaaggctggcatgcggaaggtcgcatgggtgaagctgtgccgtgccgccgcaggggtgcatagtcatgcgatctgtctgagtcgacggtctgtaaagtgctggcatggaggccgacggcggtttgtaccgctgcgcatctataagagaggcgtggcagcaccctccgcacactcacccctgcaggccacccacagcctgccgcggtcgagctcttcctccgtgcactcaccgggctcaacctgtttgccgtctacatcgacgcggcgggctgcgaggacctaggtgaggggctgtgggggggggacccgggaatgcactgggctttggggcatccagatcaggcaggggcgcggtcactggatgccgccctgtggactgtgtgcccagagggtgctgggcctcagccccccgcaccctgcgcttccctcccgcacaccagcctccttcccccccctcccacctcggcgcccaggccggcgcatccgctcgcgtggcatcccgcacgtggtgacctgggccaaccaccccctcccccgcgccctgcccgccatgcactttgcgcacgccttcttcgcgcacctgcgcacgcccagcgtgagcgtggcggaggcctttggcctggcctcccacgcgctgcgcgcccacgcctttgcccccggcggcgagccgcccctgctccccctgctcctggccgccggctcgccgtgcctgcccggccccgggtcgctgccgccgctg

SEQ ID NO: 40778 - DNA, 61 bp, Chlorella protothecoides
caccggatgtcgctcctagcggcggcgagggtgatccagacttgcaccgcgcacgcctacc

SEQ ID NO: 40779 - DNA, 92 bp, Chlorella protothecoides
ggaagtttgtgggtgtggaggggagggcaggtgaagacgacggtgcgacacaggagcatgtggggagatgggcgcagccggctccacggtgc

SEQ ID NO: 40780 - DNA, 156 bp, Chlorella protothecoides
atggggatgcacccttgtttgaagacttgttaaggcgaggctggccaggcatgtagctgagagggggagctttgttcgctgcctgcccagcttacggccatgggaataaatgattgcatgccatgctgacatagtcgtgtagtctcatgcaggacg

SEQ ID NO: 40781 - DNA, 61 bp, Chlorella protothecoides
gggcggtgagcatgccggccacgtttggggagctccattccccggccagcttggaggatat

SEQ ID NO: 40782 - DNA, 61 bp, Chlorella protothecoides
gcggcaggggcaggcaccgccctgcgcgggcacccagtccccgccggtgttgagcctgacc

SEQ ID NO: 40783 - DNA, 80 bp, Chlorella protothecoides
ccacccaccacacttcatccggccctcttcagatgctgatcattaaagctctgcaggtgcacgacatcgaggagctgcgg

SEQ ID NO: 40784 - DNA, 112 bp, Chlorella protothecoides
gtcctcggccttcacgggggaggcttctacgagcgccgcactcgcagtctcgggcgccgtaccgtcaatttccatgggcgctgggccgtcgctttgctcctgccgcgtaggc

SEQ ID NO: 40785 - DNA, 90 bp, Chlorella protothecoides
tcgtgggccggcggccaccacggcagagcttcccccaggggcgtggtggcgggggaggcgccccgccgctgcttcgggccgggcaggccc

SEQ ID NO: 40786 - DNA, 70 bp, Chlorella protothecoides
tgagcgcctggtctcagcccagcggtcaccaatgtctcctcagcgtacggccgtggcgccgagccaggaa

SEQ ID NO: 40787 - DNA, 80 bp, Chlorella protothecoides
ctatggtggggacgatgggtagtgcggaggaattttgagctcgagcaaggggtccagcgcgcgcgattcggatctcacac

SEQ ID NO: 40788 - DNA, 106 bp, Chlorella protothecoides
caccgtgccccggcctccgcccctggcctggccgccccaaggctcagaggcgcggtcgaggacgccggccaggggcggcgcagggcgcggagcccacatggcccac

SEQ ID NO: 40789 - DNA, 78 bp, Chlorella protothecoides
agggtgtgccattctcccccatcaccagcacttaccccacctcccttccccccgcttccctcaccaaccaccaggcat

SEQ ID NO: 40790 - DNA, 17174 bp, Chlorella protothecoides
  modified_base (212)..(221): a, c, t, g, unknown or other
  modified_base (435)..(444): a, c, t, g, unknown or other
  modified_base (1560)..(1569): a, c, t, g, unknown or other
  modified_base (2667)..(2676): a, c, t, g, unknown or other
  modified_base (2849)..(2996): a, c, t, g, unknown or other
  modified_base (3137)..(3146): a, c, t, g, unknown or other
  modified_base (3551)..(3560): a, c, t, g, unknown or other
  modified_base (4269)..(4278): a, c, t, g, unknown or other
  modified_base (5379)..(5388): a, c, t, g, unknown or other
  modified_base (5656)..(5721): a, c, t, g, unknown or other
  modified_base (5865)..(5874): a, c, t, g, unknown or other
  modified_base (6682)..(6750): a, c, t, g, unknown or other
  modified_base (6933)..(6942): a, c, t, g, unknown or other
  modified_base (7062)..(7071): a, c, t, g, unknown or other
  modified_base (7190)..(7320): a, c, t, g, unknown or other
  modified_base (7745)..(7754): a, c, t, g, unknown or other
  modified_base (10756)..(10765): a, c, t, g, unknown or other
  modified_base (10828)..(10869): a, c, t, g, unknown or other
  modified_base (11447)..(11456): a, c, t, g, unknown or other
  modified_base (12902)..(12911): a, c, t, g, unknown or other
  modified_base (13302)..(13311): a, c, t, g, unknown or other
  modified_base (13400)..(13423): a, c, t, g, unknown or other
  modified_base (13512)..(13521): a, c, t, g, unknown or other
  modified_base (13856)..(13865): a, c, t, g, unknown or other
  modified_base (14804)..(14813): a, c, t, g, unknown or other
  modified_base (15305)..(15314): a, c, t, g, unknown or other
  modified_base (17073)..(17082): a, c, t, g, unknown or other
ccgaggcggccgaggcggccgaggcggccgccaattccacgaccgcgccgtgctctcctgaggcgtgctgcgcacgttgcgctcccttggtgcggctggacagcgtccaggcgcccagggaaggccgcacgtccacggtcaagaccggcaacgctccgggctcggccagcaccagggggcccgagatggccatggccgcgacatgcacgctnnnnnnnnnncccagggaaggccgcatgtccacggtcaagaccggcaacgcgccggggtcggccagcaccagggggctcgagatggccatggccgcgacatgcacgctgcgctcctcgccgcccagcgcccagccggcggccagcgcggcctcggccatccccgcggcggggaagagcacgcggccgaacacagcgtggtgggcgtaggcgcccagccgcgccnnnnnnnnnngcccgcggcggggaagagcacgcgaccaaacacggcgtggtgggcgtaggcgcccagccgcgccgaggccaggccgcactccaggcgcacacgcagctcgccgccgcggcgggcggaggcgctggcgttgctcagcagggcgtgcggcgcgggcacgatccaggagcgggcctcctgccacggggcgtcacgtccagccaccatccagacgtcggtggcgccgcccgcctggccggcgccggggctcagcagcgcgtgcgcgttggtgccctggaaggcgaatgccgacacgccgcccagtggcacgctgctgacgccgctgtacgcgctgggcaccggctggcgaggggccagggtgcggcaagcggggccgccccgcgcggtggcggccagcgcgctgtcgacgtaggggttgacgtggacgaggtagggcagcgggtcggccccagcctggcccagggtcagggccagccgcgtcaggcccacgatgccggcggcgggctcggcgtggcccatgaaggccttggcggccgtcagcgtcagcggcgcgccgcgcgggccgccgttcttggaggacgcgcgcagcagcagggctgccgccgcgccgatctcgatggggtcgcccagcggcgtgcctgcggggcgggggacgggttcaggggtgagcttgtgtgtagcgcacagcttcagaatgaaaagttgacctcgatcaaccacgtcaccattctactagccagaccgccaccagggacgcaatgcatccaacaccccgatcccagacacacctgtgccgtgcatctgcaggtgccccacagcccccggctcgagcccgccggccctcagggccagctgcacgacctcctgctggctgggtccgttgggcgcggtcaggctggaggacctgccgtcctggttgaccgccgagccgaccagcacggacagggcagtccagccaccgtctgtggtgaggggtggagggatccaagcaaaggtgagcaaaggagcggggatgaaaaggggtcggaagacattccctgcaactccattgtgggaaaccacagttttctgaaatgttgcagctgtcgtaacactggacctgcaggtgcccacccctgnnnnnnnnnngagcaaaggtgaccaaaggagcggggatgaggaggggtcggaagacattccctgcaactccactgtgggaaaccacagatttctgaaatgctgcagctgtcataacactggacctgcaggtgcccacccctggacctcctcggctcaccggtggggtgcacaagggaggcgtgggtgagcatgatggctcccactccctcagccctcacatagccatctgtgtcagggatggcgagggaatggtgacgggaaggaaagtagcaattacaaacacacccactgctgcaagcaccaagtgagatgcgcgccaggctgcagggcatgacaccttcacgagcatatcgcgataaagccagagatctggcttgcaagtctcacaacccaccacctgcacagagtcttaagcaagcacaggccacaccctcaaccccacaccctcaacccatttcaaaacactaaccccgcttgcacctgccgccgcatcaagggtcttgcagcgcccctcctccgacagcatgccggcgcgcaggcaggcctgcgtccagctgtgcaccagcgtgaggttcacccccaggctggcggcggcccggctctcgccgcgctccagcgcagcggccgccaggtgggtggtgaccagggaggaggagcaggcggtgtccaccgacagcgccccgcccttgaagccgtaggtgtaggcaatgcggccgggggcgacggacaggtgcgcccccgtggcatagtaggtgttcagcgcggcggcaccggtctccaggctgatgcgggcatactccagctgggacacgcccacatagaccgaggtgtcgcgcgagaattcggagagggccaggtgcgaggcataggcctcgccaaagctctccatggccagacgctgcgtgtgggttggattggtgcgcgtgtgagtttgcgtaggtttactgtgctggggtgaagtaagagcattgcagggatgcaacagagccgttggtacttgagcatcgggggcagccatgttgcatgggcgttgaggccatcctgtacggacgctagattactgcccatcacccatcccatcctatctacctgctgggggtccatgannnnnnnnnntgtaggtttactgtgcagggacgaagtaagagcattgcagggatgcaacagagccgttggtacttgagcatcgggggcagccatttcgcatgggcgttgaggccatcctgtgcggacgctagattactgcccatcacccgttccatcctatctacctgctgggggtccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgagagtgaggtggaggcacttcttgcacgaggagtgcgacaggtattgggtgtaggggtgtgaagacctgatgtgaatgccaataaactgtttgtagcgggcgtggaataaaacagcgcaggcttggcaagccaccnnnnnnnnnngcagcgactcggcagcagatatggagaaggcagcggcgtcaaacgtgtccacatccgacaggaacgagccgaatgagttgttgagctctgcggtgttgaatgggccagatgagagtgaggtggaggcactccttgcacgaggagtacaacaggcattggatgtaggggtgtgaagacctgatgtgaatgccagtaaaccatttgtagcgggcgtgaaataaaacagcgcaggcttggcaagccaccacagagagatgctgcaataaacccgggcagacgcggccccgagcatataacattgtgtccctggcatcggtcagctgcagctaccctcccctcactccagagttcagaaccctccctcccccaaccatacaccaccacagcacctctgaggttgtaggnnnnnnnnnnccattgtgtccctggcatcggtcagctgcaagtaccatctcctcactcaagagttcagaaccccccctcccccaaccacacaccaccacagcacctctgaggttgtaggagggcgccagatccacatcccaacgctccagcggcaccggcgtgatccggtcgttgtgaacgcgtgtgccctgggccagcttgccgccagggacggcgtgcgactggccggtgacgacgcagacgggtctggccggcgcgtcgggctccaaaacgagcgcgaccggcacctgcgaggtcgcagcagcaggcgcaatctcagcgcgctgctgctgctgggccagagcgggtgccaggccggcgtccacgatgaaggctgccatctcggcaggggaggggtagtcgaacgccagggtgcccggcagctccgcgccgagcgcagcctccagcgcggagaccagctgaaccgcggcgctggaagaaacgccggccgccatgagcggggtgtcggcctgcagatcctccccgtgccccaccaaatctgccaccgcacgcaggatctccgcctgcactgcagtcagggggggagaggagggaggggcggaaggggcctgaatggtactagaagaacgcacctgactggccgcggtttgctcgactgcagcagggcccgccagcgccacctcggcatcgatgaagtccgccacctcgcgcacggacnnnnnnnnnncagaagaacgcacctgactggccgcgttttggtcgactgcggcagggcccgccggcgccacctcggcgtcgatgaagtccgccacctcgcgcacggacgggtagtcgaagaccagggtgcccggcagctccagtcccagcgcggtctccagggcagtcaccagctggaccgcggcggtcgaggagaggcccgccgacatcaggggctcatccaagtccagggaggcaggggatacgcccagcaggtgcgccgtggcctgccccacgaccgccaggctggaggggcgggggccaggcttggccgtcacggttgacggcccatggcggggcgccggtggcggcgtaaacatggctgtgggaggggccggggtggcaacctctccgcgagtctcctcgcacagaaagtccaccagctcctggacggaggggtagtcgaagacgagggtggcggggagggtgaggcccagcgcggcctccagccccgccccgaactgcacggcggccgtggaggacagccccgctgccatgagcggctcgtcgtcggccacggccgcggcggcctccgtgcccaggatcgcgctcagcgcacgccgcacggcggcctccagacccttcctgtccggaccggccgcggcgggcggggtggcagggacctcagtggcggccgcagacgccggcgccgagggaacggcggcgccggcggtcttctccgaagcgaacgccttttcctcctctgcagccgccggcaggaggacggccgcatagggcggcagcagctcgcgcgcggcggagagcgcggtgcgcagccgcacgcggtcgcccgccaggaagctggccgggtccaggcacaggaccaccaggtcggcgcccagcgcgtcgacgcgcagctggacgggcgccagcgccgcgtcgtcggggcggaagagcgcgaccagggccagcgcgcgcgcgccgcggtccagcgcggccgccacgacgtgctccaggtcggcgggctgcagcgccaccagcacgtaggccatggaggggaggatgtctttccctggctccacgcccacgccggcgtccagcgtcaggacgggcaggtccccgccggcggccnnnnnnnnnnacgccaccagcacgtaggccatggaggggaagatgtctttccccggctccacgcccacgccggcgtccagggtcaggacgggcaggtccccgccggcggccgccgccagctggaagccggcctctgccacgctcacgctcctgggcgccggggctgcagcggacgccggggtgggagcgggacgcgtcccgccggccccgaagcgttcgcgcagctcagtcttcaggatcttgcccgaccctgcggcggcgggtgatttgccgagggnnnnnnnnnnnnnnnnnnnnnnnnnnnnnnnnnnnnnnnnnnnnnnnnnnnnnnnnnnnnnnnnnntgtgcatggtctgggtgcatggcaacatcccccccacctgcatgcaaaccatcctcctggagcaaaaccataccatccttgcagagccccgcactgcacgccctctgcctgggaaacagccaacaacagctcaccggtgacggnnnnnnnnnnaagcacaaccataccatccttgcagagccccacactgcacgccctctggctgaaaaacagccaacaacagctcaccggtgacgggcatggcgtccaggatgtgcaccgcgctgggcaccttgtactccgccaggcgctcggcgcaccaggcgatgagcgcggcggggtccgggcggggctggacgctggggtcgagggtcaccgccgcgcccaccagctcgcccatcacgcggctggcgacgccgaagacggccgcggcgcgcacggcggggtgggcgtgcagcacgctttccacctcggtggtgtaaacgttctcgccgcccaccagcagcatgtccttcacgcggtccaccacgcggatgcaggcgcgaggggcgtgcacccccaggtccccggtgcggaaccagccgtcgggggtgaaggcgtcggcctgggcctcgggcaggttgtagtagccctggaacaccgtctcgcctcgcaccaccacctcccccgtctggcgtgatggaagggggggtgtcgggggcagtcagggtcccgaggtgcgggggggatggtctgcgactgatcaagcacaggagacccttcccctggcgccagcctcagcgccgggcgaggggcatcccaccttgtcggagtcggtggggatgtcggccccggcctcatccaccagcttgacgtccaccagcacaaagggacgcccactgctgcacacgtaggcgagctgctcctccactgtgcggagaggaagggggtggcgactgtcgtgggtgaggtggagagggcatgggctggtgcttctggaaannnnnnnnnnnnnnnnnnnnnnnnnnnnnnnnnnnnnnnnnnnnnnnnnnnnnnnnnnnnnnnnnnnnntcatgcccgccgcgtcctctggcaggatgctcatgcagatcttgccgcaggtctccgtcatcccgtaggagaggaagaactcgcacccaaacacctggggaggcgaggccagcgaggatgggtatgacggcgcaggcggcgtgggattgggcgatagcatgcagagcaactttggctgtgctnnnnnnnnnnaggcaccaagccatgcatcataacttctcctgcaccccagcatgaacaaggtgatgctctgctgaatgcagccctacaaccacacctctgtccaacctcctggcccagcaactcaccggnnnnnnnnnnggcgccaagccatgcatcataaactctcctgcacaccagcaggaacaaggtggtgctttgctgaatgcagccctacaaccacacctcagtccaacctcctggcccagcaactcaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggatgagtatgacggcgcaggcggcgtgggatcgggtgatagcatgcagagcaactttggctgtgctactgtccaagtggacagacgaagatgagttcacgtgagggcctcaccgcaatggcccgggccactacggccggggactggggcgagccgccgcaggagacgaggcgcaggcagctcaggtccagctgctcgaccagggggttgttgaccagcatggtgatcatggttgccgccacgttgctgcagctcactcgctcgcgctctaggtcaagcaatggatgggagggtcatagggggcaagggaatacccatggtgagatctagccgtcttgaccgtttcctcgaccgttccgggtactggcacgcgggtgcatgtaagcgtcgcgcaactccccgctcccacccgcaacccagcgnnnnnnnnnngggtcaagcaatggatgggagggtcagagggggcaagggaataccgatggtgagatctagccgtctacaccgtttcctcgaccgttccgggcaccggcacgtgggtgcatgtaagcgtcgcccaactccccgctcccacccgcaacccagcgggtgctgacagcgccaagcaatgctcgctgtctcaccgatggtcagcagcgtgtcgacgggggtgaaggagggcaggatgacgtggcggccgcccaccagggtgatggcgtacaccgcaaacacatccaccagatggaacatgggcgcaaagtggccccacacctcgtacgggcccaggttcatgtctagtgggtaggagagagtggggtgagaaagagggggaggacatgaggggagaagatgggatgccccacattgaaacggctctgccatgcttcaacatcatctgcctgatgtgtccctttcccagcactgctccccctcccttgctccccccactgcctattctcaccaacgcctctgcctcgcctcaccctgaatggtgcccagtgcatgttgcagcacgatgcgctgactcagcatcacgcccttgggcttgcccgtcgtgccagaggtgtagtagaggtggaagttgtcctcgcctgcgttctccctgtccagacccagccctgcgacggtctcgagcccgatgtccagcagggaatctacgacgctggcgtaatcaaaggcctgcaggtagggtagcgtgtcgtatatgtcagcgaaggaggccaaagggaggacgaggcggcctctggctgcagtcactgcaagaatttcaccctcagaaacaagggtgagatagtgttgtgaccctaccacacaattcagtcgctcgctcacctcgatgcctgagggcagcacggcagatgccagggcctgctcgcccgcctggcccccctccacatccagccaaagcaagggggcgctgggcaccgacaggccgccgccggagtcggcctgcactgcgttcaacgcggtgagcaggccggaggccagggaggtgtctgccacgatggcggccgggtcggagttctccaggatgtaggccatctccggcggtgccaggtggacgttgatgttgaccaccacggcgtgcagggcggctgcggcaaaatgggcctccatcacgcccaggctgttccgggaggcgacggccacccggtcgccccggcccacgccctgggaggccaggaaggccgccagggccgcggcccgggcgtgcagggaggcgtaggagtgcagggcgccggagcccacgtccaccactgccagggcgtcgggttgggccctggccgtgttggccaggacttgccagcagtcggccagcggccactgtccggcatcgggggggtcccccattttttggattttcagttactttttgctacctgcgtggtgtacaaggggagaatggcgtgaggcaggcgcgatcgggaaaagtcgttcccggttcaaacccacggccatgttcgcggcgggatggcgagaggagcccgaagaatgcagcgtgccgcggcaggcaattatgaaataggctatcagtgcgttctggatccaatgccgcatcgccagcgccagcttcgggtcgcaccaggtgtgtatgagttgcagtagtgttgtcggcctggcgcggtgttaaggcggacaggtcccttctctccccgatcaacgtcaatgcaatgcaatggcgatgtaatggtttcggagggggggtgcgagggccggagggcgggatgttgtagcgcaggctcggacctgcaaacgcttggagctaatccgtgtggtcaagctctttccatttcatccctgaaccccacttgccacattgggctcacccttcatgaacaccaccaggagcgctgtgtggcatctgtgggcttacatatccatccgggcattgctatgtatccttaagaagacattgctacttgcaaagaattcttggcaggcattttgcccgggcaataggcctccttcatcccttacagcatggaggctggacacattgaattcatgcacagcccacaattaccatcctgttgtgattgcatgatccctggtcacagttgaggtattgctggactttgcaatattcatatctgcatctgcagttgtgatgagttactcggcccctgccccaacttttacatcgtggcgcgaaaattttcctcctcgggttaccgctataaacctcatcacgttctcgtagattgccgtgctgacaacctctcattcataattgaccaagaggaacacaactctattttggctggtcgcgacccagcacccgacagcagcgatgtccctgttcggtcgggcgtccgtcgcgagcctgcgccacatcaaactgcgcggcgcgcacgccgacaagggaagcttcttccagcagggacacaacacaccaaaggggcagctgttcggagagtctcccctgaagccgggggagaagcggcactgggagtcttgggagggcccttggtgagtacatttcttggccagcaggatgtaaaatggggattcgggcacgtctgtatactcggcttgatggcaggagagcctgaaggtggccctgacactgcgggtaggcccaagaagtcggttcacaacttgctccctgtgctgggcatctcacaaacccccatcaaccctctgcaggtacttcacctttggagcagcagcagccatcctattcttcggcctgaaggcgcgcccagacagcagtcttacccactgggcagacaaggaggcagagaagagggtggagagcgccctgagctcctgaggacaggatggcactgcccaagggagcaggtcgcaggcaaaatggagcacagcagaaatcccggaagcctgtgagcagggtttattggctgccctgttacataggatcatgacgttcccacgccgctcgtccctcctggagtcccaaccagacttcttgggggggggggggggggggggggggnnnnnnnnnntgccgctcgtccctcctggagtcccacccagacctcgggggggggggggggggggggggcccnnnnnnnnnnnnnnnnnnnnnnnnnnnnnnnnnnnnnnnnnntatcctgtaaggctgaactgtgtacttcccagatctatgttgcatgctgtacacccagcagccatgctagaggtccccaggacatgactacgcgtggcatgtcaaagacatagatctgttgctacagggtgagtcgcaagggactcgcttcttcaggggttcagcattcatcagcgattgggcagtcatgcaccagaaccgtgtggtcacacaaggagtgggaagcctctcattcagcaaataaagtctagaaagcgcggccagcagccacgctctgcttgatcttggcaatggccttcccagggttcagtcctgttgagaaaaagaaggtgtggtgggtaagggtgagtgagcagtctccctgggagggatgtttacaatcttcattggatacatctcatacacatcggcaagtattcctgcgtcgatatcactcaagcaggctcccaaacggccagatggaattataccaacccctccaaaatacaacactagtcccccaaagtggacacgcaacttttattccaaccccacctccccctcccccgcctccctgctcacccttggggcagacggtnnnnnnnnnngtgtggtgggtgagcgtgagtgagcagtccctggaagggatgttcacaatcttcaatggaaacatgtcatacacatcggcaaatattcctgtgtcgaaatcactcaagcaggctcccaaatggccatatggaatcataccaacccctccaaaatataacactagtcccccaaagtggacacgcaacttttattccgaccccccctccccctttcctgcctccctgctcacccttggggcagacggtggcacagttcatgatggtcttgcagcggtacagcttgaactggtcgtccagatcggccaggcgctgcgtggtggcctcgtcccggctgtcgatgacccagcggtaggcctggagcaggacggcgggtcccaggtacttgtcagagttccaccagtaggaggggcaggaggtggagcagcaggcgcaaaggatgcactcgtacagcccatccagcttggcccggtcctccttggtctggcggtgctccaggccgtcggcgggcttgggcttgagcaggaagggcttgatggatttgtactgggcgtagaagttggccatgtccaccaccaggtcccggatgacgaacatgtgggggaggggggccacgcgggtcacggccgaggggtcgcgctccacctttgtcaggcacgccagcccgttcttgccgtcgatgttcatggcgcaggagccgcagatgccctcgcgacaggaacggcgcagggacaggctcgagtcgtggtcgtccttgatcttcagcagcacgtccagcatcatggggccgcacctgggcgaggggaggacgcacggtgccggaagtttgcgagtgaacaccgccgctggttcgtttcagtcaaaccccaggctgggtgctgagccgcgtgtcgcaagggatgggaacagtcagccatccactcacgagttgatgtcgaccttgtatgtctggtatttcggagcctcgccatcgtctgggttccaccggtacaccaggaactccttctccacaaccggcttggcagctgcagctggggtggcagccgatgtggctgctgctcgtacgaatccaatttcgggtgccgcgcgggctgcacccctggccagcgccctgctaagggacagcatggcggggcagtcaagttgggcgctctggcctcactagctcgacgtgcaattcccagccacgattcgagtaatctttcccgattttaaggtggttggtttactcgatccgagttcggtggagcacatagctctgggtttctttagtaaccaggcaatgagtggagtaacacacgcggcgattccaggtttccaaatcgacttccgtagggcgccacggtgacagcgtggaagaaaacacatgttcacgagggagctgaaggtccatgctgccatgtagtgtttcaaactatcagatgagaagatgttgatgtcctatggccnnnnnnnnnntggtgacaacgtggaagaaaacacattctcacgagggacctgaacgtccatgttgcaatgtagtgtttcaaactgccagatgagaagatgttgatgtcctatggccctcgagggagggtgtttgcagcggcacgaccagctggatacctgacaccgaaaccccatcgatcgtatgccagaatctcaagcacacgggctcgagcgaccaatgattaccaggcatggattctaggggtctttctcgtaccatcgatgcgggagatacagctgagtgcttcttagtcgacactgtgcgcattgacgccattctcccctccgcaggacttgctgcatgagctcgtggaattgagcgacgaacagctagaggcgtggagccactcccacgccgacnnnnnnnnnnagtgtttctcgtaccatcgatgcgggagacacagctgagtgcttcttagtcgatactttgcgcattgacgccattctcccctccgcagnnnnnnnnnnnnnnnnnnnnnnnngtcagtgagaacaggggcgaacgctgttggtatctatctttcaattgaaatggtatccgacagtcagggtgtactggttcatggccgcnnnnnnnnnnttcatttcctcaagtggctggctactgagccccatggtccactggaggatgctgcagacaccctgggagcccgcctcaccctactccagatcgcatcctgtgagtatggccgtcttcattgtgaacaggggcgaacgctgttgatatctatctttcaattgaaatgttatctgacagtcagggtgtactggttcatggccgcggtgtcagaagctgtgagatactgcacatggctggttactgaccgctgccaagcttcaggcaagagcagcgcccatcatgcttcccacctgccaccctcttgacagcgcatgtggagcccacagccctcccgnnnnnnnnnnctcccactcgccactcattttacagcgcatgtggagcccacagccctcccggctcccgtctcaaaggacgagcttgccgatgaagacaaagcgcatcctgtgcggcttggtgccccgccccgagggctggcgctgagcccagaagcatttgctgccctgcaggcgcaggcagaggcgtttgggagccagctgggcatcaagcgcgcccaggcggtgctggagatcctgggacggaagatcctggatggtgaacagggcggatactctggtcccagcgatgcggtgagcaggcagcattctttagtatgtattgacttggcactgatcccaactgcaccagccattgcttgtactattaaggagtctcgcctgcacggcaactccaaagtctccagcagtcattctgcgtgcctggaggtcctcaatcgtgccctaactacccacaggagcggatccttgacgtcctgttggaggtcgagggaagggaggagcggagacaactcgcagctgatgcctgctcccccgcacctcccaccacaccagtgccagcagacgaggaggatgtggtcagcaccacccccatggccctcctgcaggccgtggctgcagccctcaaggcttgccagggagatgcagccagggacagctctgttgaggctgagaggctgcgtgagctgcaggccgacttgatacagctgtggaataaagagagttcacattcctagtgccatagattttgttgcagtcccagcattttgttgcaggaagtttgagtcgtgatcgcgcagcgaagcaaggatgggaataggcagcatcagtgggacgggcttgtgtgaggtcctggttgaccaaggcccttgttggaaaacagtgtactccacgacagatctccatatgctttttgtgtgtataacagcttgccagagctcgtcctgagannnnnnnnnnaaagcaaggatgggaacaggcagcatcagtgggatgggcctgtgggaggtcctggttgaccaaggccctcgttggaaaacaggatactccacgacagatttccatatgcttttcgcgtatataacagcttgccagagctcgtcctgagatgacatgcagatctccctaaggctgtgcagcccttggaggccaggacaggatatcctaccttgagcatctcacgcttcttagcaaagcatcctgcagcatctctttgccgccctcaaccccctcataaccccattgatgcagttgtacgtggagcttgattcatgtacgtggagcttgaatcatgtacaaggggtgaaggcattcattcaatgtgattaatatcgatggatgaaatcaggggcgcatgaccgcccataggcatgcctatatgcattgtaggctgggctgcaaccgcagcagaagaagagaggacaagttggtcatctcaggtccaaaacgccnnnnnnnnnnaaaggcattcattcaatgtggttaaaagcgatggatgacatcaggggcgcatgactgcccataggcatgcctatatgcatcataggctggtctgcaacttcagcagaagaagagagaacaagttggtcatctcaggtccaaaacgcctgaagagaggaaagccagaccgcacatgaattgttcacatataacctgcacactcattttcctgtcttggcctcccaaagccatctcatcgctggtagggaggggggtggcctgggcctgcaccaactggcgttgcttccttggccttctcaatgaactgcaagttggcattgacgaagggaggacaagctgatgccgtctgatgttgatgcatgcacatcagcagcagctctgcacatcccaaatggcccacagtctactccatctatggttgatactgcaccacctctccagtagagtctcagttcagtctcaccttgtccgtgacttggctcacagcatccctaccaaccacaatcaggcggttgattatctcagggtcttgctcaaaccgagccgcttcatattcttgccgagcgctctcccgcaggacgtcccgcctgggagggggggtcgcattcgtctaccatttgctgggctcgtccagccgctaaaagcatgcattgaaacaaggcacaagcgcagacacaagactttgtaatcgccaaagacaaccactcatgcccaggctatcaatgagcgcagcgtcccctgtttctcaccacaatcggccattgttgtcagggtacacaaaagcacgagtgacccgcaagatgtctcgatatctgcagggcaaggggggttgcaaggctgatcgattgggctgaagcgacaagggtatcaaatatatggggtatggcatgtgggacggcacacgcggatgcctatcgcgacctgacgatgatcttggccctcccacatgctactgaaagagctcacagggagagggcctctctgcgtgtcgtcagcacctgcagaggattcaagtcctcctttcgaatccgtttcttggcctgtgatgtgaagagggggtggcaaagaggcacttgtttggtccaactactttcaagtcagagaccacacttccaactcggctcgccccaagctcaccagattggaatcgatgacatcggctacgtcagcgtcgctggcatcatacaggtagccaccgctgacgtgacgtttcatgaattcttgaaagtgcgatgggctcgcgtctgtcctccaaacccccaccaagcgctgccaaggacagttccgaagcgccatctgtgagcttgtcgagggcaccagttacgagtacaacttcttgagtgggatgaaacttttcattattacagtgtacaactatacaacggatgctccttgcccgatgcttggaaattctgcccatgtggcgccctgccgacgagtttagagatcctgctgctgcgaagggtcccacagcaaggctcgtgtggatggagcgagcagctatgacaatctcgtgcccggtaacaatattgttttacattgcaaatcaatacatctggttgaagtgttgcgtgtacggctggaaccttggagatccatccatcttgtgctccaggcatgcagataggacggcatgccggggccagcatgccattcctcgggccttccgcggggcctctgaagcgatcaagccagcacttcaggtcacatgccttctcgcagcatttaagaagcaggtctgtggcgaggagtcttcatnnnnnnnnnngcgcggggcctctgaagcgatcaagccagaatttcagggcacatgccttctcgcagcatttgagaagcaggtctgtggcgaggagtcttcat

SEQ ID NO: 40791 - DNA, 74 bp, Chlorella protothecoides
cgttttgccaccctcgcattgggacctgggcggggaagggggcgatgaatgcagcgcttgcacgtggtcgagtg

SEQ ID NO: 40792 - DNA, 61 bp, Chlorella protothecoides
gcgggcgtgagggattgatcgacacggcggtgaagaccgccagcacgggttacatccagcg

SEQ ID NO: 40793 - DNA, 77 bp, Chlorella protothecoides
gtgtggtcacacccattggctctacaaaacctctccttacccccaaccgcaggtgacggaggtgtcgctcacggcca

SEQ ID NO: 40794 - DNA, 63 bp, Chlorella protothecoides
tgagggtccgtggcgtcgtctccaggcctttcgcgggcccacgcacgagcggcgcgtgcagcg

SEQ ID NO: 40795 - DNA, 61 bp, Chlorella protothecoides
ggggtactggcggcgggtacgtgacaggagggcgtctggacaagcatcatgtggcgagggg

SEQ ID NO: 40796 - DNA, 1027 bp, Chlorella protothecoides
  modified_base (256)..(265): a, c, t, g, unknown or other
  modified_base (663)..(672): a, c, t, g, unknown or other
  modified_base (738)..(747): a, c, t, g, unknown or other
cggcgccgtcgcccgcgtcgccgcgcgccgcgccgccctcggcggcctccgccatgcgcgcggtcaggcagtggtccagcatgacgtccaggagcatggcctggaggggggcacgcagcaccgggaccccggcgaacaccgtcatcaggctggggccgggcgcatagcccggcggcaacgggtcgccgccgttcagcggcgcctgcccgccgtcgcccgccgcccggccgtctttcaccgccgcgtggccgtcttnnnnnnnnnngacgggtcgccgccgttctgcggcgcctgcccgtcgtcgcccgcctcccggccgtctttcaccgccgcttggccgtctttcaccgccgcccggccgccagcgcagaggctgggcaccaccagccggcgcacgcgcggcaggctgtccatgaacatgcgcaggctggccacgaacatgggcaccgcgccgggctgggaggacagcatgcctgccagcgcgccctgcactgcctcggcacccgccagcagcggcgggtgagcctcgctgcccatcagctgtgggtcgtgcgtgggggggggggtccatggcgtcgggcctgcgcctccacagagcgacgcagccgcctgcgacgcacgggatgctttcctttccccatctctccaccaccgccgccaccnnnnnnnnnngctccccatgcgtttcgatacacggcaccaccaaaccctccacacccccgcacctccaccccggcnnnnnnnnnncctgggcccacgcgcgtgctccccatgcgtttcgatccacggcaccaccaggccctccacacccccgcacctccaccccggcggagtgcagccaggtggcgagcacgtcgctggactcgatgtcggagtcatcctcctcgtcatcctcctcctcctcgctcccctcgtcgtcatactcgtcgtcatactcgtcctcgtcgccctccagcccctcccccgtggaagaggagagcaggtcgtcgtcgtcgttgcgcgcgccgtcgtgcgcgcagccgtcccc

SEQ ID NO: 40797 - DNA, 101 bp, Chlorella protothecoides
ttgtgcaggcatgcacgcccctgaccaccttgctgcaagcgactgatcagatgttgtgtccttcccattttccaaacacaatgcaggccggcctctgcacc

SEQ ID NO: 40798 - DNA, 61 bp, Chlorella protothecoides
catcgacgagatcgacgcgatcgggcgcgcgcgcgggcgcggcggctttgccggcggcaac

SEQ ID NO: 40799 - DNA, 97 bp, Chlorella protothecoides
ggggggcgggggcgccgcgccgtctggcacgcggatcccgctgctagctccggtcggcgtcaagccagcagcttgctgccggcgctcgccacccggc

SEQ ID NO: 40800 - DNA, 61 bp, Chlorella protothecoides
cagccaggagaggtggtagcagtgcaggtctacgaagacaaagtcggcggaggcgacgtcg

SEQ ID NO: 40801 - DNA, 80 bp, Chlorella protothecoides
gggcagaggcgatgcgccgggaggtggctgaaaggcaggccgctttggcgcggctcgaattggagggcaggttgcgctgc

SEQ ID NO: 40802 - DNA, 86 bp, Chlorella protothecoides
ttctcccacctggcagcaaaggaacaggggtttgactggctttttgggatgtgtgatggtgggggggggggggggggggggggggg

SEQ ID NO: 40803 - DNA, 80 bp, Chlorella protothecoides
gaccgccgcgacggctgcactgccacggcagggcggcatcagcatcaccggtcgcctcccccgcccgccccacctgcagc

SEQ ID NO: 40804 - DNA, 2895 bp, Chlorella protothecoides
  modified_base (123)..(132): a, c, t, g, unknown or other
  modified_base (1074)..(1083): a, c, t, g, unknown or other
  modified_base (2048)..(2057): a, c, t, g, unknown or other
cgggagatttggtgggggttgtgagggagatcgaggttgtactttggagggggatgcggtgaaaaggggggagcaagcagcggcgcgcttgggccgctggcatggggtgaccctgggcgactnnnnnnnnnnccgaggttgtactttgggagggggatgcggtgaaaaggggaaagcaagcagtggtgctcctgagccgctggcatggggtgaccctgggcgactccgcctcaagctgtggccgccccgctgccaggcgtctggcagggagattgcaacactctcaccggtctgggcacccaagtggcggcgcaggggggctgattgccaacctcagcaggccctgagtgccagcacaaccccactcctcgccctctcactccgcgcaggacgtcatggggcggtgcctattttcgcagcctgcggcgcggcccaaggtcggggcggtcctgagcacgctgacggcgctggcggcctccgtgcgaccgagctcgggatgagctcatggatgggcgggtcagagggacccccccttgtggaaacgcgctggaggcatggtcagggtaccttgggagccagggcggtcgaggtaccgcccatttgacacgtatatcttcaagtatttgcttggcagcagcagcattttcaatgccacacactccatcacggtgtttaagctcgccggcggggccactgcttccctcgggggggtggtctccggtaggctgggtcttcctccttctcttcatcctccatccaagcctctcccatccctcaccttcacttgcttgcgctcgcgtgtccctccattattttttggcttgaatccggtcttcctgggatggctcacagtttaatgccaccattcaaagcctcatttcgacgcgcatgaagcggagaccaggcccatcatgggcacaggagttcgacggcagggtggaaaggtggaatgatgtccttgagtatcgcagggcgccctaccgggcatcatacctggggacgcactgacaacgtcggctcccccgccttccctctcatccattttatttgtaacctccagctcaggaaagcgcnnnnnnnnnngcagggcaccatacctggggacgcactgacaaggtcggctcccccgccttccctctcatccatcttatttgtaacctccagctcaggaaagcgcaagacagccagcacgcgacggtgaacgccgcgagccccacccctgacggcaagtcgagcacggacagcatggctgagccggtcggggccctccctcgcactgccactgcaagtgagtatctcatggtggatcagtacacacagcagcgtgcccatggggattgcgaaagctgcttggtacaccccccatcccctgccgccaggctcaccggccggtgcctgactctccccactcgccccacaggcacatgggcggacgaggtggaggaggaggaggagcgcctgatccagggtatggcgtgtttaaaggggtggtctgagcaggatgctcaggttggagcgttggcagccaagctgggtctcgggtctgggtccggtgggcggaaccatgcccatcgcatgcatgcagcccacatgtgggatcggtccgcacaccatgtcgtctgctgtgtctccgacccccggcacggggacggtcgccagcaccaccacctgcgctccgtctccccaacccccgattcctgcacccgctctgactccggcccccgcgaccccttccccccaacaccagccggcgagactctggaggcgcccacggtgggccctccgcactccggcccgccccaggcggcgcgctcgccacgcgcccctgccgccgctgcgaggcccaccccgagcggtccaccctacaagatctacatcagcaacctgccctgggaggtggatgagtacgccatcgagcgcttcttccagggcctggagatccgggacatcatcctgctgcgtcaccgcgacacgcaaaagcccaagggctgcttcgtggagtttgggtcggtgcaggacctgaccgaggccctgaccgccgacggcgnnnnnnnnnnacgacacgcaaaagcccaagggctgctttgtggagtttgggtcggtgcaaaacctgaccgaggccctgaccgccgacggcgccgagctcatgcgccgccccatctccgtcagcctggcagaggcgcggcccaacgaccgccgcggcggcggcggcggcggcggccggcactggaacgacggcggatacggcgcaccccgcggcggcggcgccggctctggcgaccgctacggcgcgccgcccccgggcggcaggcgcatgggcgaccgcgaccgcaacagccgcttccccccgcgcgacaacggctactctgcgggacctggggaggacgcggagcgctgggcaccccgccgcgaaggtgagcaaggggaggcgcagcggggcatgggacttgtgctggggggggtgagcgagagtttgctgaggagatccctgggtactctgggacggcaaccccacggtctgttcccggtggagtctggagccgctgctggccacggcaagggtccccgtggcccccatctcgtatcttcagttgcagcgcatagactgcactcctgaatgcaaagcatgcagccgagacactgcagtcacgccctcccacacccgccctgcccccaccagtggagcctgtgagggatgggccccacccccgcccagcccccgtggagccgcgccaggccacctcggcggaggccgcgcccgcggccccgcaggaggcccgcgccccgcgcgccaacccctttggcgctgcgcggccggcggacaccgcctccaagctgaaggagctggaggagaggatcgccgccagggaagccgccgagaaggaggcgcccgcc

SEQ ID NO: 40805 - DNA, 11922 bp, Chlorella protothecoides
  modified_base (332)..(341): a, c, t, g, unknown or other
  modified_base (1403)..(1412): a, c, t, g, unknown or other
  modified_base (2495)..(2504): a, c, t, g, unknown or other
  modified_base (3359)..(3368): a, c, t, g, unknown or other
  modified_base (4401)..(4410): a, c, t, g, unknown or other
  modified_base (4839)..(4848): a, c, t, g, unknown or other
  modified_base (5506)..(5515): a, c, t, g, unknown or other
  modified_base (5886)..(5895): a, c, t, g, unknown or other
  modified_base (6118)..(6127): a, c, t, g, unknown or other
  modified_base (7244)..(7253): a, c, t, g, unknown or other
  modified_base (7617)..(7626): a, c, t, g, unknown or other
  modified_base (8095)..(8104): a, c, t, g, unknown or other
  modified_base (8845)..(8854): a, c, t, g, unknown or other
  modified_base (9143)..(9152): a, c, t, g, unknown or other
  modified_base (9643)..(9652): a, c, t, g, unknown or other
  modified_base (9915)..(9924): a, c, t, g, unknown or other
  modified_base (10310)..(10319): a, c, t, g, unknown or other
  modified_base (10624)..(10633): a, c, t, g, unknown or other
  modified_base (11191)..(11200): a, c, t, g, unknown or other
gccgcgcaggccagcagcgtggggtcggcggccacgtccacggccgccgcgctctcggcgccggcggccaggaggcgtcgcccgcgtgcgccgccgccctgaaagagcgccaggcccaggaagcgctcgccgccctcgccgccgccgatgacgccggcgcaggcgttggtcgccaggttgaccaccttgacccccagcaggctgggaaccagcaggaagttgccggactcgtcgaagacgacgtttggcgtggcggggcgcgggggcgccgcttcgcgcgtgcccgaggccgcgccggcgccggcactcaccaccccaagcgccgcggccannnnnnnnnngtcgcgcgtgcccaagcccgcgccggcgtcggcactcaccaccccaagcgccgcggccagctccttctcggcggccgcgcgccggccaaagtcgatgggctccaggcggaaggcctcgggccccgagcgctgcagctccgcagccgccgccagcgactcgtccagcactttgagcaggcggccggtggcgtaacggaacagtcgcacgcgcccgtcggcgcacagcgcggcccagcgcgctccgtcccgggccaccgccaaggaaagcgcggtggtgccggcgcgggccagcgcgtacaggtcggtgtcaagcttgaagtcgaagcgcaggccagtggcggggctggccagcgtgcccgggtcccagtactctaccatgcctgggcgaggagcggggggagcgggtgggagtaggagggcagggcaatcacggatgcgtgcatcgaggcgaacgccctgcctggcccggacgggcagtggccagggatccagacgccagagagaggcgctttcccaccccgcgcaccgccggccgcagcccctgaccagagcatgtgcacacccacgcaagctccgaggccccacctgccgcgtccacgctgatgacggcgccctgctccggcgagaacttcatggccgtgaccggggacgagtgcagggtgaccctgcccagctcctcgtcgccgcccgaccgcgcgtcgaacacggcgatggccggcgtggcgaggtccgagaccgccaggcgcgccacggggtttcccctctgtgaaggcagcgatgggaggggtgcggggtgaggggctgggccctgagcggctgtggggccaagcctcaggccaggcgcgggcgccatacatgaaatcggcggcatgcacgccgcgccatgcgcgccggggtgccagggtgacgccgagtgagatgcagcgcggcgccgcctggccaaccctggcggccctcatgagccccaagcccaggcccacgcgaggctcccctcagcacgcactcattcctgcccccaaacaactgcgcgttcacctggaaggcccactcgatggcaccggnnnnnnnnnntaagcccaggcccacgcgaggttcccctcagcacacactcattcctccccccaaacaactgcgcgctcacctggaaggcccactcgatggcaccggggacgaagggcaggcgcagcatggctatcatgtcgaagctgccgatgtcaaacaccttgacagaggcgtctgtggaggctgtggccgccagggagccgtcggcggagacggccagggcggtgatggggcccacatgggcacggtactgcttggcaaactccacgccgcgggcgagcttcttccagaacttcagcacgccgtcggcggaggcggtgaggaaaaagtccgtgccgcgggccacggccacggcggtcacggtgtcgcggtgcatgtagctgcgctcgtacgtggaggccagggggagggaggccaggtactgcgcctcgtactgcagcgtctgcggggaagggagcaacaggggtggaggctttgctggggaggcggcgacgcgcgcacacaccagtgcagccaccaacttggcagggatggggcttgatacatgctctgaaacccgtagataacaggagctagaccggttgaagagccattcttgacatccccccattccaactgctcaccctgcgtttctttgcttggggcagagtgggtcccacctccacctcctcctcctcctcctcctccacagtgggaagcttatccagtgaaggcgggaggatcggaccgacgtcctcatcattcgctgtggaagacggaccgggctggggcggggatcccggctctgcaggcacctccgacgccatggctgcgatggcgagggacactggactccctaccgcatgccccactgctttactagactgcaagctggacggtgtgaggataacttagtttgaattaggcaggaatgtgtgtccaatcctgggaatcgtttgttcgctcgtttggcacttacaacgagggcgagagatcgcggcagcgtcgtcgcgccctcgatccacaatctcctttcctcaggccagaggtaagctcaaaccatgcgaccaaaacccatcgagatgctaccttgtttgggttgacttgaatagnnnnnnnnnnattagtttgaattaggcaggaatatgtgtccattcctgggaatcgtttgttcgctcgggtagcacctacaacgatggcgagcgatcgcggcagcgtcgtcgcgccctcgatccacaatccccattcctcaggccagaggtaagctcaaatcatgcgaccaaaacccatcgatatgctaccttgtttgggttgacttgaataggaagagtttgagcccggacgaggaacactgcgcaccacttcatctactgacacaaaattgccgtgctggtctttgacgtcaaaggaacgtgctcttcttcttgcgccgcgccaaggcctgcctcctccgccgcgcgtcttcgtcatcgctgtctccatcgaggggtgcccctctgtcgttcgatggggattccactgcttctggctggagggtatccccgtcatctgacattgcacgcctggtgtaggtggcaaggcaggggcctcagcagcgcaaggacgctcctcgccagagagagccagaccaatgtgatagagtcgacagtctccatgcaggaagatttattacttccaacgcatcaccaaacccatgggtgcatcggatccaaggtcaaagtgagaagacaaaggaccctgccccacctagcttcaccctgatcaaaccctcaacccatgatctcaccggcgggactgggaagcacgctgcctcttcaacgccatcctttcctgtttctgcttgagctgttccagaatatttgctcggaagtcctcaccctgcatcgcggtgttgagatgcgctcaagtgcgagcatgggggcatgtcgagaaggtgtcgggcacgcccgcgtcgaagcatggattacccacccagcnnnnnnnnnnttcgttcgatggggactccactgctcctggctggagggcatccccgtcatctgacattgcacgcctgatgtaggtggcgaggcaggggcctgagcagcgcaaggacgctccttgccagagagagccagaccaatgtaatagagtcgacagtctccatgcagggagatttattacttccagcgcatcaccaaacccctgggtgcatctgatccaaggtcaaagtgagaagacaaagtaccctgccccacccagcttcaccctgatcagaccctcaacccatgatctcaccggcgggaatgggaagcacgctgcctcttcaacgccatcctttcctgtttctgcttgagctgttccaggatgttggctcggaagtcctcaccctgcatcgcagtatcaagatgcgctcaggtgcgagcatgggggcatgttgagaaggtgccgggcacggccgcgtcgaagcatggattacccacccagcactgagccttgaccctcatcgtagacgccacagcccaccacacacctcctgcttcctcaacgccgccgcttcttgcgcctgggcggcattgagagccacccgctcctccagcgtcgcccgcgcctccctcccccaccgcctgccgagggctgcatccaggtgctccttcagcagcgtgtcctgaaggtggaaggggcgagcaaaggaggttgggagacagatgggcgaaaggactttcgcccatgcgatttgagatggcaggtaaacctgacacagcggccgagtccgtgacgcagggatctggctgcaccctgaccatggtccagagtggcaagcgtccagcatcctttgtcggaatggacacccgcacttcccatcgcaggccatttttcctctcaaagatccgtagcgcagctccacccaccctcttgtctgcgtccttcaagacccggtgcgcctcattcagagcctcaaacgccttgcgggcgtcttccccagggttcttgtctgggtgcacaaggactgagagcctgcggtatgcttttgagacctccnnnnnnnnnnaggcaagcgtccagcatcctttgtcaggatggacatccgcacttcccatcgcaggccatgtttcctctcaaagatccatggcgcagctccacccaccctcgtgtctgcgtccttcaagacccggtgcgcctcattcagggcctcaaacgccttgcgggcatcttccccagggttcttgtctggatgcacgaggaccgagagcctgcggtatgcttttgagacctccagggcagtcccctgccatgtcacgttccccaggacgtctgcttcgggggctggtagctccaggagcctgtgggaccgcataaccaggtgcgctagttgccactccaccacatctgcccaacacacctcagactggaaaggtgcatctcctctcccgccatccgacaggatactcagtgcctcgctcttctccacctcccaccnnnnnnnnnnagtgcatctcctctaccgccatccggcaggatattcagtgcctcgctcttctccacctcccacctgaagtagtcacgctctgcgtagtggaggaggattcgctcgatcacgtcggctgtggtcatagatgtgctgaggctcctcagcctgtctgcctcggtctgcgcctgctgcacccgagcctgggctggatcggccagcgcggcctcctcattgtgctgcgagtgcaaggcattgaaggcccgttctatgttcctgacagacatcccgttgtgccagggtggctgtcagattcacaccggcataatcatcgagtccagggtatgtcacgcatgggcacctcgcggcagtgtcatcatgttggaccttatgtatagtacataatgtgtatttgggcatgagactgtcgtgtctgagagatctgctcggcactctcgccgtttgcaaagcagggcgcgagaatccacgtagtttcggaggagcgctttcccggaaacatgcaccctcgacctcgctccttcacaccaggtccccactgctgaggtgcaaacatcacctatcccaaacacacgcttcacaaagctttcaacggcttctgcgcaacgaggcttcttgtaaatctccggcgcaggctcagtcctgcacaacttccactggnnnnnnnnnnacttcacaaagctttcaagggcttctgcgcaacgaggcttcttgtgaatctccggagcaggctcagtcctgcacaacttccactggattcgtctcgagcccagcttggcatctgaccaccttttgcaatgcaatcggccatatagtatctcgagacactctacgcctcgcatgcagcgtggcctcagtccacggacctgcccgccgaggacctgcctcgtgggcactcgcactcatgggcgcgggatcggcagaccaggcccgcaaagccgggtgagcggtggaaggacgcaggcatgctcatttgggttcgtagtggttctggtatcagcagatcatgtgttgatggtggccatcgaccggagtgcgcgnnnnnnnnnngagtcgttttggtatcagcagatcatgagttgatggtggccatcgaccggagtgcgcggcatccccatcgcgcggcgatggggcatttgaggctgtggccctcatgccgtgcccacctccccttgcgaccagcccagctccaccctctgctcccccacgcagccacactttccccctgccctgtcgctgtcggatccctggaagaccctgggggtgggtcacnnnnnnnnnncctccaccctctgctcccccacgcagccacattttccccctgccccgtcgctgtctgatccctggaagaccctgggggtgggtcactccgctagcgaggaggagatcaagcgggcgcaccgccgcttggtgcgccagcaccaccctgacctccacgcccctggtgatgaggcggtggccgcccgcttcatctcgatccagcaggcgtacgagatcgtgatgggccgcgccctgggccgcctacccgagtccagccagcatggcggctggaacttccatgactggtgggcccttgggtatgtgaaagaggctccaatgagggcccggttggtcggaggctggcctgtgacaatgctcaagggcacccaacgctccttgatccctgtttaatttcaggttctggagctttgcgcgacggagggccgatgagggcgtgcccaaggcgacggggccgcctcggcgggaacagtgggagcagcagctgcacctcctgcgccgcaaggcagccatcaagcgcggcgcctacgcccacggcgcggcgaccccgcaggccccggcccccggcaggtctgcgcacccggagcacgaggaggccgttccgggtacgaacagggtggcgcccgccgagcaaatgaatcgcgctccgggtggcggagcaccctctgccgctggggattcccagcctccagatgcagacgctgagtgcgcagaggatactggcgcggggggggaatgccttcagacgccggctgcggctgcacctggcatgcacagtgagcccccgccgccgccgcggatccctttccggagctcccaggacacgcgagagggagtgaccatccagctggcagggctgcgacgccgggccgggatcaagaaggacctgaccccagctccctgaagagcatctgggcgactcgcgttcaggatgctgattccccagatcgaccgcctgaggcatggcaggacttcaggctctcagacttttccactgccgcagaagaatgtgccgtgccaggcacagccatgctgtcacagcagcaccctcccttcacgcgagaaaggagttgcacccaaactcatacactctgtctcttcccctgtaccttactccagannnnnnnnnngccatcccctcacgcgagaaagaagttgcacccaaactcatacattctgtctcttcccctgtaccttactccagatcatctggcccttgggcacacgatgtgctgtgattttggtgtgatgccatgcgagccgtccagtgttgggatcttgcgatgacacacacggtgcagtatgccctcctgtgaagaagcacatcgttgatgatgcatgccatgtaacggccatccagtcagagccttggtggggatcaatgaccgatttgcaatccttcacggtgcagggagtctggatctagggccccagccacacgatcaagcaagcattgacatgcttttcaaagacacagtaacgcatgttttgcannnnnnnnnntacggtgcagggagtctggatctagggccctagccacacgatcacgcaagcattgacatgcctttcaaagacacagtaacgcatgttttgcaggcaaggggtcgtcaaagaccctaatgatcgccaacaaggtcatccacgactgggcccagctggtcgatgaggtctggggcccccatcgctcgtcctttgcatgcatacgctctgtgtgcggccttcctgcagaggcattgaaggagggtaaggtgtctaagacatgccacggtaggctgctagtgcacgagattatgaagcagcagcatgcatgctgacaagctacagcttcatcacctcccaccagcccacctgacaatcagggatgatccatagcaggccagcagggcggcaggcggcccctgtcgcgtcccatcaccagcccatgactcctgtccacgctgcatccatgccatgaatgctgccaggcagcccnnnnnnnnnntgtaggctgctagtgcacgagatgatgaagcagcagcatgcatgctgacaagcttcagcttcatcacctccccccagcccacctgacgatcagggatgatccatagcaggccagcagagcggcaggcggcccctgccgcgccccatcaccagcccatggctcctgtccacgctgaatccatgccatgaatgctgccaggcagcccgatagcacatcaccctttggggggacggacggtgccatgtggatgatccctcagacgggtgggagacatgcccaggagcagcggcatacacctctcagcaaatgggacgccaccaggattatccgactcagacccaagccctccacgacccacatcttcgtcacaatgctcacctgcccccccaccctgcgcagcgagcccggctcctcgcactccagctggccgtgcgcatcagccgccacgtcgacccgccccttctgcagcaccgccggcccatccagggcccgagcgagccgtcgtgcagcgtcagcgcccttggcctcaacgcctagggcctccgccagcctgcccaactccaccacattgggtgtgaggacgatggcgccgtgctttcctgttgagatgaggtggttgggtgtgtgtgtgaggtgtgtagccaagaatgcagacccaagcaacagtaccaaacccaatgctggacgcaaatctcctccacaggctcctgacctttgaccagggcgggggccgaattcacnnnnnnnnnncatgcaggcccaagcaaaagtaccaaacccaatgctggacgcaaacctcctccacagggctcctcacctttgaccagggcgggggccgaattcaccatccagagaccgtctgcatcgacgacgagcgggatgccgcgctcgaccacctcctggagcacctgagttgggcgcaggaggggtaggtggtaggttggcgctccgagggcgcccaagggaaacacctcagcgaccaggcagcggagagcttcctcgataaattcactccaacctcgctcactctggaggcggnnnnnnnnnnaccgcgctcgaccaccgcctggagcacctgggttgggcgcaggaggggtaggtggtaggatggcgctcggagggcgcccaagggaaacacctcagcgacccggcagcgggggttttccttgatgaaatcactccaacctcgctcactctggaggcggtgcgcaggacgaggtcatctcggcccaggccagggcccaccaccaccgcatcaaacttgggcagccagggggtgatggcccggatcgccctctccaccacttcgtcctcggcctccttgctcagctgagggggacgagggtggcgggcggccgtgaccagcagatgacatggccatgaacccacaacacattcgtcatccacacattgtcattgcccctgctgctgcccactcccatcttctggcaacccagacaagccctggcccctcccttgccttctcagtatcgtccctatcctcgccagctggcaggtaggggtgcactatgagctcannnnnnnnnntcctggtccctcccttgccttctcagtatcgtccctgtcctcgccggctggcaggtaggggtgcactatgagctcaggggagtagcccttgatcacggtggccgcgccttgggtgcagaagacatgggcgatgtctgatcccacctggtcccaagggtagtgcgcacaggggcagttgagcaggggaagagttagcctgtctttgaatatttgagggcgagggtcaagttgtgcctcacattccaccacatcatgctggtatnnnnnnnnnnaatttgaaggcgaggatcaagttgagcctcacattccaccacatcatgctggtatcaatatagtgttgagctgggcctctctgaatacaacttcaggcaactgtgtcagcaacaagaggacctcactctgagtgcagaaatcgccgagaagaaaggggcgccagtgtactccctgcaacctccgatcacagcgatctttcctgcctgtcccttgtgtctgtcctctgtgcgacggcagggcaaagaactctggggcgagggcccaatgcacctcagtccagctatgagacgcttctccacgcaaagtgatcaaccaggaataccttgtcgagcagaacatggccttcgtacgctggcaaggtcacccagaacactcgcctgacagnnnnnnnnnngtcaaccaggaataccttgtcgagcagaatatggccttcgtacgcttgcaaggtcacccagaacactcgcctgacagcttggggatcagcgcgagcacctgctgcagaagactagacgaaccagacatgctcactggtgcggtgactgaggaaaaagaggccgagcgcactgagatgggaagaccgcctagcacctgttcaaggtcgagtcgggcagcctcagggcgggcgatgagcagagtgccaacgagatggggccgagcggctcggaggctgaaggatcataacccatgacaccctacacnnnnnnnnnnttcgagtcgggcagcctcagggcgggcgataagcaaagtgccaacgagatggggccgagcagctcggaggttgaaggatcataacccatgacaccctacacgacagcaacacctggtgatagggggcttgacgactgcaacgtggcttcagatgaagacggacttcatgccatgagcactgcgcggcagatctgcgcagatgctgcagcgaggacgtcgcacacctatgcaggccagccgcgctcatgcaccctgcttcccgggcgcaaaaaggcgacgctcgctcaacctatgcaggagtaaggtttctgtcatgtatgattgatctaggaacaattttgggagcctcgaggtgtcaatcactccgcgacatcacccatgcgcaaggactgcgtcccgggcgctcaatctccgacatcgagttgtttaaacgggggggtccacggtgccaatctctgcacgccgatggaagctgtaggcaatgcagatacaatacaacaatgcgattggcatatatttagatctataacttgagcctggggtgcacggggtgcgggnnnnnnnnnnattaaaccggggggttcacggtgccaatctctgcgcgccgatggaagctgtaggcaatgcgagtacaatacaacaatgcgattggcatatgtttagatctagaacttgagcctggggtgcacggggtgcggggctgagaagtatacagccctcacctgcctcaaacccatgtcggcacgatgtcggcttcaggcgaggataatgagcaaagcggcaaccaacataaaagatcaactcctgaatttgtggaaatagatggtgagggtgacgcgtgcggccttccaccccgatggctgcttgtcctggttggagggagccctcgccatccaccgactctctgcaggcagccagctggagggcggcggccagattctgcgcaatgcagccgccctggccgccctcactgcaacccccatccgcatcagcgccatccgcgcggggcgcacgcccccgggcctccggccccagcacgtggcggggctggatctggtggcccggctctgcgacggggcgctggagggcgcaacagtgggctccacctgcgccagcctgagtccccaggcagggtacgggcccggctgcggtggcagcagcggcggcggtcatgacgaggtgctgggcgaagccggcaccgccgcgtcctgcatgctcatggcgcaggcggcgctgccctgcctgctgctgccccgcgccatgtcagcgcggggcccgcccccgggccg

SEQ ID NO: 40806 - DNA, 61 bp, Chlorella protothecoides
ggtcaggctcaacaccggcggggactgggtacccgcgcagggcggtgcctgcccctgccgc

SEQ ID NO: 40807 - DNA, 153 bp, Chlorella protothecoides
cacaccggccggcgtgaggattctccgcctcatcacatcggagttcatgtgctcgccagggtcccaatcctcccggcactccgatggacaactccacccccctcctcacatcccacacaaaacaagacgagcaaacacatacctgcaatgacg

SEQ ID NO: 40808 - DNA, 69 bp, Chlorella protothecoides
ctggttggactccagccgatgggcttgcccttgcggcacccacgccgagcctgttcacgagcgtggttg

SEQ ID NO: 40809 - DNA, 61 bp, Chlorella protothecoides
ccgtggacaggctcttcggcttgccaatggggagggagaacgcggtgccgaggaccaggaa

SEQ ID NO: 40810 - DNA, 61 bp, Chlorella protothecoides
ccctgccgtgggcggggagcagtggcaggggggcgcgtgccgccaactcccgtacagccag

SEQ ID NO: 40811 - DNA, 1137 bp, Chlorella protothecoides
  modified_base (377)..(386): a, c, t, g, unknown or other
  modified_base (954)..(963): a, c, t, g, unknown or other
gcggcgcccaggccgcgtccgggcccgacagtcgcgccagggcggccacgtgcgccgccgcggcgtcgggggccagagtgaaggcgagcagggcgcggaggaggtcggccgccaggcgcgcggcctcggcgggggggaaaccgcccgccgcgtgcgccaccgcctccagcaacgacggggccacgccggcaggggcagactcctgggtcgcggtgggtttggggatgcgtcgtgggtcggaggaggaaggagagcggcggtgtgggggcggtgccagcacagccgcatggggtatgtgcagggggtgcgcacgcatcgccccattccaacgagtccaagcagccccgactcccgggagccccacccaccccggcggnnnnnnnnnnttaggggatgtgtcgtggggtggaggaggagggagagcggcggtgggggggggcggtgccagcacagccgcacggggtatgtgcaggggtggcgcacgcatcgccccattccgacgattccaagcagccctgactcccccaagcaggcctgactcccgggagccccacccaccccggcggcggtcagtgccagccaggcgtggtgcaggaagtcccagggcagctctgtcaccccatgctccgcgagcttggagatgagcagccagacgccgcgcagggcggcggcgtcgctcgctgcgagcgatgtggatgaaggggaggtggcggtgaggaggcagaacccgtctgggccagcccatcgccctcttgggtggccgcgtgcgaaggacgacaacgtgtgctgctgagcggcttccgcgcatcgctggggccatgcctgcggcctctgcagacaccccccccccaaaacagtcgagtgtgcgtgtgaagcctcccttctccccccagcacctctcagactcccccacacaccctcctccgcgtcggccagacggcgcaggccccgcannnnnnnnnnccgtgtgctactgagcggcttccgcgcatcgctgggaccatgcctgcggcctctgcagaccccccccaaaaaaatcagttgagtgtgcgtgtgaagccccccttgtccccccaccacctctcagactcccccccgcaccctcccccgcgtcggccagacggcgcaggccccgca

SEQ ID NO: 40812 - DNA, 101 bp, Chlorella protothecoides
cggaatgatgctttgcagtgtgaaactggggtccaacggcttcggatgggacgcctcggccctggcgctgcccctgtcttgcgccaaacgacagcctcagg

SEQ ID NO: 40813 - DNA, 10667 bp, Chlorella protothecoides
  modified_base (1939)..(1948): a, c, t, g, unknown or other
  modified_base (2052)..(2061): a, c, t, g, unknown or other
  modified_base (2984)..(2993): a, c, t, g, unknown or other
  modified_base (3434)..(3443): a, c, t, g, unknown or other
  modified_base (5272)..(5281): a, c, t, g, unknown or other
  modified_base (6177)..(6186): a, c, t, g, unknown or other
  modified_base (6251)..(6281): a, c, t, g, unknown or other
  modified_base (6478)..(6487): a, c, t, g, unknown or other
  modified_base (6752)..(6761): a, c, t, g, unknown or other
  modified_base (6830)..(6839): a, c, t, g, unknown or other
  modified_base (7339)..(7348): a, c, t, g, unknown or other
  modified_base (8304)..(8313): a, c, t, g, unknown or other
  modified_base (9300)..(9309): a, c, t, g, unknown or other
ggcggcgcggcggccgccgccgcgccgctgccgccgccgccatcccccgctgcggccgccatgctgtcctggcgtgcaggcgcagccgtgcacgccgcgcgtcgcttcggcgtgggcgtgctggccctccggcccttcgccctggtgccctacaaggccgcagggcgcgcgtggcaaggggctgacgacggactgtgcgaggcggcggccgcctggctggaggcgcggggcgtgcagctgtccgaccacgaatttttcgccagggcgctacgccgcgccaggccggcggcgtgagggacctgcccgcgacggcgtggcgtcccttgccccccgtccgggtgcccttgtggacaaactccttcctgcaggcattcaggggtgtggatgcgccccctcttgatctccatcgagtgcccaaagtcttggtatctgatttcatacccaatgtgatagcagcattgtggcgtgatgcgttcgcatgtaagccttccagccgcttccagccgcttccagcgcgcgctcccttgcgggcccccggtgcccggcatccgcccgactgggcggtcatgaggctcggggtatcctgcgtcgacacaaaaacgagacaatatatataaaaatctgcttcctaccacccatttcaagcaactcgggatcacacacagatccaaggcgagtgcccgcaccctctgccccctctacgacgtgccagggacaggcgcgggtcacgatacgctggagacgccaccatgcccgagaccagggcgcccggtgcccccaagtacgacgatggatgcgatcggacgttccatgggtcgatgctgcgtcgatgtggcctcaggagggctgcccgcctgggaggcatgcacgccaggcgccagcaccgatgcatggcctgggagcggggcatgcctgtccctccctccccttccacaaccctccacgatcatttattccctgcagggcggcgtacaacctctctgacttcgagttgctgaggagactgggggacggcagctactcccaggtggtcctggccaggcccaaggcggggggcaaggaggtggccctgaagatcatggacaagcgctacctgatccggtgggtgcctggaggtgtgttgtacgcacctggcttgcagatagagcgccctggggtgggcctgcgggccggctgtcctggcaaacttggtgcttgctgctggcctgctctggtcgggcgtggccccatgtgtacgatagtcccaccttgctttcctccctgcgtgtgggccctggcacccagtttcctctctctccccccttcccccaaaaaccatctctctgcgcctgcaggcacagcatggtggagtacatccgccgcgagcgcgccatcatggaccagctttcgcaccccggcgtggcccgcctctacttcaccttccaggacgcatactccctgtacatgggcattgagcactgccccaacggcgagttgtacgaccaggtgcggctcaagcgcgcgctgggcgaggacaccgcccgcgtctacgccgccgaggtagtggacgtgctggcgcacctgcgcgcgcggggcgtggtgcaccgcgacctgaaacccgagaacctgctgctgacggcggaggggcacctgaagctcatcgactttggcagcgccaaggccctgcccggcggcgcggtggctgccagcggcgccctgtttgccgcgagggagagcggcgagtccggccgcggcacgcccgcgcgcagcgtggccgccacgcccagcgctggctcgctcgccacctcctcctcgggccgtctgccagacctggcgggggtgtcgctctccgcgcgcgcaccgcgggcgccggccgctggcgcggaggcggggccggggcccgcctcctcccagggctccgcacagcgcctagtcagcctggtgggcaccgccgactacnnnnnnnnnnggcggtggctgccagcggcgccctgtttgcagcgagggagagcggcgagtccgggcgcggcacgcccgcgcgaagcgtggccgccacgcccagcgctggctcgnnnnnnnnnngccgcgggcgccggccgccggcgcggaggcggggctggggcccgcctcctcccagggctccgcgcagcggctagtcagcctggtgggcaccgccgactacgtgtcgccggaggtgctgggcaaccgcgccgtgaccccggcggccgacctctgggcactgggctgcgtgctgtaccagatgctggtggggcggccgcccttcaaatcgccctccgagtacctcaccttccagaaggtcatcagcttggagtatgagataccggagcacctctcgcccgaagcccaggacctcatccgcagcctgctgcgctccgagccggaggagaggctaggtgggggtggaatgggagtgggtggtgtggggaggatgaggggagggcagggggcggatgcccttggagggaggggtgggagcttgtggtgggtgttggaaggatcagagaaatggaggttgacttctgggtctgacacgggagtgatagatcccccagtgcacacgccgtgactgccactgcgctgtgccaataggcaagggtgagaagtctcacgtccggggtgtgtgcagtgtcaggctgctcatcgccagagtgcatgcccggcgatgcaggggcccaggatctgcaggagctgaggcgccaccctttcttccggggattcgactgggacacgctgtggacgcagcatgggcccagctttgccgagctggatctggagtccatgggcagtgtctcctccagcttcgactgggagctgcaggtgcaaaggggttgtgacaagggatgggggtgcagtttttacaggttaggcggaggctgcagggctgcatcacatccggcagggcagtgggagacctgctggaagtatgaaaggtacccatgcatgccagagcactctgccagggtactgccttgacacagggctannnnnnnnnntaggttaggcggaggctgcagggctgcatcatatctggcagggcagtgggagacctgctggaggtctgaaaggtacccatgcatgccagagcacactgccagggtactgccttgacacagggctagggggcgcacagcatctcggccagccctgcgtcacaggtctacaaagtgcaaggcgcactcatacagatttcccctcgcccacgaacccccgtcccacactcactccacccccttcccccctcgcatcgcctccatgcagtccctgtcagccgcccttccaggtccggggtcgtatgctgatgtcccccgtgcacatggcagcgacagcgggtgcgagagcagcgacgacgacttcacccggcccctgcactgagggccttgctctgaaattagatagaaaatgcatgctgaaggagtcacgatctccgtattacnnnnnnnnnnatgctctaaaattagatagaaaatggatgctgaaggagtcacgatctccgtattaccctgagaacatagcttcgcttttccaaacgtctctgagcgtcttgttgccggctctggtcgtagcctcgcttcgtctagagctaaacgacgtcgctcttgcgctctgcccctgatctgtggctttctcactccatctcttccctccaacccttctccttgatgccattaaagcatgcgttgtcctcgttcctatcttgcaaactgacacagctgcgtaaagttacacccgacacagcagggattctccaccagcgcctcaggccagcgcatgcagagcccacatccttcgaacccaactgtgccgcatgcagaagcctggccacgacgcgatgcaggcgcgcggctgtggatgtcatcgtattcggttattccatttatgtatgcatgcatgcgtattgtctgcgtcggactgtgagagccaccgtgcagcgctccccctcgacgcaccatggaccgaaaatggcgaacgaaccgggcggccatattcacggtggtgccgtacgccgagtactgctcccgcatactccagtgcaccgcggagtatgatctggccacaccctcagatctgtatgccgtgtacaccgtgctccacatcgagagcaagacgtcagagctgcactggagcgagtctgggggtttctactacttcctggccacctggagccaggctccagaacctgatcaggtggggtatgattgccaccaagcagattgcaccgtacattcccagccatgcacagcaacgaatccgcatccctggcctccggttaccacctcaccgtcgacaagttcccctgaaccctctcagacagcaagtgccgcacagccagtgatgcaggcaggtgcgcctccagcccagggaaaagaggcagcaccgtgcatgagtgcggaccaaggaagtgctggagcccaagcacagtgtgccgtggaggttgccgcacacgatcgcagcagcgaagcaaacggtgcgggcgctgtaggcgcagtggccagcccccttaccagccctgacgcagtgctcgtgggctcgcaggcggcagactctagacccccgcctgccccaatcacgcgctcccagatcatcgtccccgtcggcagcgcctgcaccagcctcacgcccgccctcctgcagcgcttcttctccatccgtggggtggcggcccagcagctgctgctggccctggtggatgggaatggcatggtctcgcggacctgcctcttcaactacatccaggcacccctggagggccccggcacggctgacctcgatctcctggacgactgaccaaggctctgcggcttgcgttctagcccgggagtcttagcggaagactggagctctcttctcaccccagctcccccttgacatacgaacagcgccacttgactgacaatgtaaccttcagactacaaacatggagtcctgcaccaaaggaggagtggcggctggcagcccctgcgtgccaggctcgaccatacccatactcggcacgagtcggaatcttgcagaagatatgcacatcagcgcaatcaagccttggggggtgtccacgtctggtacttgagccagttgcgcttgtgctccttgaaccaagagcccttgggctggtacctcgaaactgtggtggtggagttgcccacgatgttggacgcataaatcggcgccgtgaagtcgtgctgcacaggttgttttgcaagggggaaaaggtggaaagggtgagcgcactgccctgacaagcgtctactccttggaagagagttagcccagcatnnnnnnnnnngggttgttttgcaaggggggaaaggtggaaagggtgagcgcactggcctgacaagggactactccttggaagagagttagcccagcatctttggcaaaacctgtttgagacagaagctgccccatcccttctcgcacactcgacatggcaacctctcacattggcagggttgacgtccacgctggcgtgcagccacccgtgccactcggcagggacgttggctgggtcctggccccgatagtccgaggcctttgcatataccacccagcgattgcggcctgggcaagaaggtatgcgaggggccgaacatggtttgccaagcagctcaagaacattaagccctgtacgctgctgcagcgttcacgagggcatgtgcttgcattgtggaggaaggcgctgcccatcactggattcgtcataaccccccaccctcctcaccgacttgggtgtccatcttctcaaagtaccgattcccgtgcttgtccgttcccacgagagttgcacctggctggtgctcgacgagtgtgctcctggcatgggcgggcatcagggtggcttgatgagtcgcgggagaaggaggagtggatgcccaggactcccaaccccgggatgatgcagcccgtaacgagaccgaccccgagacccttcaggcgctcgccggcacccatgaactcaccccaggtttccatcaatgaggaccttccaccctccattgctcacggcctcgcgccatgtctgcttgcccaggccctgggccagcgccttggtgacgccgctcatgacagcagggcgtcaggggccagccttgagcagcgggagacccgattacacgacaggttgtgctattattcgagtggtactctggcagcgttcattcgaggtttgggattgtgcgnnnnnnnnnnaacaggttgtgctattattcgagtggcaccctgacagcgttcattcgaggtttgggattgtgcgnnnnnnnnnnnnnnnnnnnnnnnnnnnnnnnaatgagaaagagggacgccgcgcccaacgtggtctgatatcatgggtcaccagcagcagatcacgtctggcatacagtcaaggaactatcccggtgacaaagaaacacaccagagacatgttcatacagcggtgccctgtcgcgggattggtggtttggggaggtttgagcagggaccccacccctccccgtcctcnnnnnnnnnnagcctgtcgtggggttggtggtctggggaggtctgagcagggaccccacccctccccgtcctcgcgctcaggagagggggtctggcacatcccaggcaaaacccacggcatccagctccgccacctgctccggtgtcagcgcgccgcagcgccgcgctatcctctgcacgctgcaccagttggtgagcaggaaggcgtccgcgtcggcgtcctgcccgcctcccaggccgcgggcccgcagccgcgccagccagccgcgccactnnnnnnnnnngggggcggctgccgcacagcgcgtcgccatggcgcacggcgtaggcctccagctcggcgcagcgccgcnnnnnnnnnncggggcggctgccgcacagcgcgtcgccgtggcgtgcagcgtaggcctccagctcggcgcagcgccgcgcccagtcggagtcggcggggacgccgtggccccagccggaggcagcgcgcgctgcgtcagtccccgcccagtcctcgccgccctccaccaggagcacaggctgcgcggccgcggcggccagcacgtcggcggcgggggccgccagccgcatgttgagcaggcgctggcgcacgcgacgcaggtcctcggtcagcaggcgcggctcgcgcgccgccagccggccgacgtccacgccggggtgggagccggcgcccagcagagcgtgcagggctcgcagtcgggcagtcagatcgagcaccttgggaggagggatggggtgctggtttgggaaaggggaaagagctcgggcgggtgctggccttctgcatcctccagcgcctcctcggcgcaggccaggatccagcgcgctgctcccaccgccccacggccgnnnnnnnnnngaagagctcgggcgggtactggccttctgcgtcctccagcgcctgctcggcgcaggccagaattcagcgcgctgctcccaccgccccacggccgtcatggccgccccaccgcccacccacctcctgccgccgcgcctggagatcccagagcaggtccgcgccgggcagggcgcggttgaacccaggggcatccagatccaggctcgcgtcagcctcgtccaccaggtcggacgccagggccagcagccgggagcggtcactgccgtgcactatgccctggccctgccagaatcggtccagcacggccgcaaaggtgctggtgcgggaatggagctcgccagcaccctgtccggcacgacatgccgaattataccgcgtcttcgagctgtagcgggagtgtagggccgagcagaaggcgctgtgcctcacaccaccgactcgcggcgtgaagctccccgccatgcgcggtcaccgagttcacgcggcatacacgctcatgcaagctggaggcgagagatccgagcaatctccagtcccatgcatgctaatggattgagagtagcccgccgagagtctgccagaggcaggctcttgtcgtgtgttttgccacttgcaccgtgatctgcatgacgggacggagccattggcgaagaatctaacccttcaccgcttaccttgaaacacatcaccagacgtgctcatgtgctatatgtgtgtcaattgcatcttgtttgattgatattacatccatatagttgccagtggacgggtcaaggtcccttatgctcctccgccgggccctggccgtgtgccttcccactcaggcccccgtcaccacacagctaggcaatgctagcatggctgccgagctgccgctttcccattccgcggtggtttctcagtgtcgcgtgctgaatcccccgagagcgagtgcggcgtgtccacccgcctgggcnnnnnnnnnnccagtgtcgcgtgctgaatcccccgaaagcgagtgcggcgtgtccacccgcctgggcccgctcgcacacgagcgacaagtccgccccttccaagaagtgctgggactgcaaggtgcccgtggaccagcgcacgcctcacttctgcggcacctgcaagaagatccagccccccacctacagcgccaaccagtttcagatactgggcatgtgagcttctcgttttgtgtgctcagagggggagacactggttgtggtgattgtggatggagggtgcggctgactgctattttcttgaacgaggggcccgcccctctctgcgccaaagatctaacacctgtcttcctcccccccttgcacctggaccgcagccccacgacctttgacgtggacgccgagaagctggaggcacggtacaaggcgctgcagaaggcgctgcaccccgacaagttctccacggcctcgccccgggagcaggccttctcggacgcccaggcctcggccgtgaactcggcctacgacacgctgagaaacccgctgcgccgcgcccgggccctgctgcgcctgcagggcatcgagcccgaggagagcgcgggtgtggacgaccccgagctcctggcctacgtgatggaggcacgggaggaggtggagggtactcgcagccgcgcggggctggagaccttgctgagggacaaccgcgagcgcgaggcggcggcggtggcgcggctgcgcgccgcctttgccgcggcagagtgggctgcggcagcggaggcggtgaaccgcctgcgctacatcgagcgcatccaggaggctatcagggagaagctgtgaggactggggtggggggagtgctgggtgtggaaggcccaatgcaagtttgagtcccgccctggcatggtcggctgcctgtgctctctcagattctcgagcctgcgctgggcctgggatgaaccattgacttgtaacaggagtcatcgttgcagagggggnnnnnnnnnnttgctgggtgtagaaggctcaatgcaagtttgagtcccgccctggcattggtcagctgcctgtgctctctcagatcctcgagcctgcgctgggcctggaatgaaccattgatttgtaacaggagtcatcgttgcagagggggctggtgcgtcatgcagagggtcagggattcgggtggcttgaagggcggtcggtatgccatctggaataaaatggaggactgtcgcaagatgttggcaggacagctcgggcggaacgcctgcggagggccgcacgtttcctgggcatgggtgaaccgcgcagcgcctgcacacccctgtgcgccccccgcgcggctccccttgccgcctgcgctgtgccacatgtcaggccgccctcacttcctggcagcttccacgtgctccttccgccccgcgtccaccgcggcccggaacttgccgacaaaggcggtgcgctgcggatccaggttgtacgcctcgaagaaggcgaccgctgcgtcctcccactgcttcagcccctcggccgccagaccctcgcggtaccatgcctggccgaggggcaggggaaggagcgaggcggggtggatggggagcgacagctagggcggcgagcagcctctcccacgcgttacacctcgcccctcctcgccaggaaggtcaggcatgcagcgcggagagcgccaccagcacgcaccagcacaccccaaggccccctggtcttcccatccacgctcgcaccttgacgtagcgcggctcgatggtccttgccacacgcgcgtccgctagcgcagacgcgttgtcgcccagcttgaggaaagcggcgcagcgattggcccacaccgtggcgtccctgcagtgcaggggaggaatcaaggtaagggcaggcccagggtcggatacctggacaccctcatgtggccactagccgccgaatggtgggcttgtgaacatattgtactaggaaccttggggcccttgccccagggccacttgcatgggcggtgctctgcagccctggctgtcatgcacccccccccccacagtcagaccctcagccccatggcacacaagagcccctccccattcgagcccttcacacacccctccccccccaagcgccatgcatcccagcccctcaccccgtggcgtggcgcaacgagaagctgtacatgtccacagcgccctgaaaatcaccctccccaaacgcgtcggtgcccttggccttgaaagaggaggccagctcctcgctgggctcctccgcggccggcaccgtcaccttggcgccgtggcccggctccggggctgcggcggctgcggcggctgggccgccgacggcggcctggcgcgcggcctggcgct

SEQ ID NO: 40814 - DNA, 80 bp, Chlorella protothecoides
aatagacaccgtgctacagcagcagggactgccgagggtacttacggtgtgtgcagccgtgtgccagcatgcctcaagcc

SEQ ID NO: 40815 - DNA, 72 bp, Chlorella protothecoides
agcggacgaaagggcatgggacgggggcaagccagagtagattgcaggtgcgccagggcccggcactcatca

SEQ ID NO: 40816 - DNA, 70 bp, Chlorella protothecoides
ggcgcagcgcctgctgcgcctgctgcgcctgctgcgcctgctgccccatgcctttccgcttggcgccacg

SEQ ID NO: 40817 - DNA, 61 bp, Chlorella protothecoides
cgggtgagggcaagggtatgtgattggaggccccagccacatcttcagcgccgtctccgat

SEQ ID NO: 40818 - DNA, 67 bp, Chlorella protothecoides
ggggtgtcggtcaagtgggcttggtaaggatcaggctggaagtgctgccatcatggcacccccggac

SEQ ID NO: 40819 - DNA, 61 bp, Chlorella protothecoides
ggctgctggactggtcttggcgggaaggagggagaaggctcgacaggtgagcgactcttaa

SEQ ID NO: 40820 - DNA, 63 bp, Chlorella protothecoides
gccacgagtgcatcaagagctgctccctccccgtttgcatgcaggaggagttttatggccgtc

SEQ ID NO: 40821 - DNA, 75 bp, Chlorella protothecoides
ctccatctgatggtccaaagcgcgcgaagccagccgctcgagcgccagcccccgggccaccgccgatccctcagc

SEQ ID NO: 40822 - DNA, 22965 bp, Chlorella protothecoides
  modified_base (540)..(549): a, c, t, g, unknown or other
  modified_base (1003)..(1012): a, c, t, g, unknown or other
  modified_base (1140)..(1149): a, c, t, g, unknown or other
  modified_base (1454)..(1463): a, c, t, g, unknown or other
  modified_base (1876)..(1885): a, c, t, g, unknown or other
  modified_base (2009)..(2018): a, c, t, g, unknown or other
  modified_base (2232)..(2258): a, c, t, g, unknown or other
  modified_base (2917)..(2926): a, c, t, g, unknown or other
  modified_base (3261)..(3270): a, c, t, g, unknown or other
  modified_base (3706)..(3715): a, c, t, g, unknown or other
  modified_base (3967)..(3976): a, c, t, g, unknown or other
  modified_base (4148)..(4157): a, c, t, g, unknown or other
  modified_base (5106)..(5115): a, c, t, g, unknown or other
  modified_base (5341)..(5368): a, c, t, g, unknown or other
  modified_base (6175)..(6217): a, c, t, g, unknown or other
  modified_base (6388)..(6397): a, c, t, g, unknown or other
  modified_base (6488)..(6497): a, c, t, g, unknown or other
  modified_base (6588)..(6737): a, c, t, g, unknown or other
  modified_base (6911)..(6920): a, c, t, g, unknown or other
  modified_base (7819)..(7828): a, c, t, g, unknown or other
  modified_base (10577)..(10586): a, c, t, g, unknown or other
  modified_base (11187)..(11196): a, c, t, g, unknown or other
  modified_base (12636)..(12645): a, c, t, g, unknown or other
  modified_base (15426)..(15435): a, c, t, g, unknown or other
  modified_base (15551)..(15576): a, c, t, g, unknown or other
  modified_base (16036)..(16045): a, c, t, g, unknown or other
  modified_base (16274)..(16283): a, c, t, g, unknown or other
  modified_base (16522)..(16531): a, c, t, g, unknown or other
  modified_base (17025)..(17034): a, c, t, g, unknown or other
  modified_base (17558)..(17567): a, c, t, g, unknown or other
  modified_base (18247)..(18256): a, c, t, g, unknown or other
  modified_base (18551)..(18560): a, c, t, g, unknown or other
  modified_base (19264)..(19273): a, c, t, g, unknown or other
  modified_base (20092)..(20101): a, c, t, g, unknown or other
  modified_base (20421)..(20430): a, c, t, g, unknown or other
  modified_base (21196)..(21205): a, c, t, g, unknown or other
  modified_base (21349)..(21561): a, c, t, g, unknown or other
  modified_base (21913)..(21922): a, c, t, g, unknown or other
  modified_base (22630)..(22639): a, c, t, g, unknown or other
  modified_base (22871)..(22880): a, c, t, g, unknown or other
gccgccgcgcgcctggcgcgcctggtggcccgcaaggcgccgtcggagggcgcgggcgacgcgcgctccgcggccagcgccgcgacctcctcctgcgctacgcccccgacctccgccgactcggtggggactgcgggggcggcggagggcgcctccccgcgtcggacccaggccgcggccctgcgcctgctcctggcccggccccagctggtcaccaggctggcggcctcggtgcagggcgccagggggtgacggaggagggcaaggacgagctcgcacgccacgggagcgtggtgatagcttgatctgatgagcaatcagggttgctggatggcttggcaatccgagctgaggagtcgagaggatgcatgcatgtgtggagctttttcatgaatctatgatgaagatgcgatgattatcaggagattcccgtggagtgtgatggtgggcatgagcagccccatatctgtaacagcaaggagttcgggctgggggttcagcaaggggatgtggactctcagggcgacaagtcagggttgnnnnnnnnnnccaggctggaggttcagcaaggagaggtggactctcagggcgacaagtcagggttgcccaggcgccactccgaggagcgcctctagcccctggcaggcccctgctcgaatatctctgccacgcggatgggcatgacctcgatgggcctgtcccgctcgccggcataggtcctgaactccgcggcggcgcccgcggccgcgaagctcaccacgattcgggggtggtgggcggcgccgcccagcaggtgacccacccgcgtcgcgtacccacgctgagggtgcggagccgggaggtcgtagtttatcagcagagaggcaccgcagggcgccgcctcgcgcggcaccagccgcagcgccgcgtcggtggtcgccaggatctgaggagtgaggggtggaggctggcgccacatgaacacgccccgagggcacggagggggcatgcaaggagcaccccnnnnnnnnnnaagggatggaggctggcgccacatgaacgggccccggaggcacggagggggcatgcaaggagcaccccaagcaggtgcatggcatgaattaaaggtggttcctcacgtctatgctgggcggctccagnnnnnnnnnngggtgcatggcacaaattaaaggtagttcctcacgtctatgctgggcggctccagtggagggggtgcacgctcgtccccacccctctcgtcacgcgcttgtgcggacggcgcatgcggggcggctgcggctgggtctcttgtgcgccccgagcacgctttgaagcgccacaccacagccagggcctcagcctcggagaggttggaatgctgcggggtggagaacgagcaactctgccttacttcttatcgcctggagcatgcccatcattctttaggctggcaacctgccagtagtggttccaannnnnnnnnncgggggacgagcaactctgccttacttcttattgcctggagcatgcccatcgtttttaaggctggcaacctgccagtagtggttccaactccacaaaatgtccccaaccttttcgcaccaggcagtggaggcgcacattctgcacgctgaggcaggcggcgcatacagcgtcgagggggtctctggatctgcgatggaggggtcgaagggaggacaatttctgtggctggatatgcggggagtgcttcgcgcccaacgtttcatgaggcatggggaaggtcgcctccccgctcacccacaagccacactcaggctcaggggagccgagggcagcagtgctcgcaggaggtcgatcagagttggctggagtggatcaagtggacaagagggtgagaggattgcagtagacacannnnnnnnnncgtatagattaggaactgtgaaggaggaatatattatccctgtgtggatcgatgtgtacacgctggatcatttgccattttcgtatcggtccgtatgaaatgcgcgtcatgcacgaactggcannnnnnnnnnctacagcttaccaacttggcatccagtgttccgacggcaacatagtactgtcgtatgccgtgcgatgcccccttgccctccatggactcttgtatagattaggaactgtcaaggaggaatatattctccctgcgtggatcgatatgtacccgctggatcgtttgccattttcgtatcggtccttatgaaatgcgcgtcatgcacgaactggcannnnnnnnnnnnnnnnnnnnnnnnnnnaatacataccgcaaccggaagtgtcctggcatgcgtccgcggtagtctcacgccaataaaatggcgcgcgactggaagagcattgccacggtcactgccttccttggggtcacgcttgcagcgctgtaccctgttgccgtggtcccgcttatctcggagcgtagaatgaccgaaactccggctccaggtttccgcaagggcggcatgtggaagcaaatggatcgcccttgacagttcaggttgggttgctggcgtgcgctgtcagactgcactgtgatcccctcgctgcacagtatatgctctgggctgagctgtatctgtaacaatgcacaataacatgggtcaaatccgggaatggttaatctaccatggcaaaggttactgcaactgagaatttcaagcaatcctgtaaatactcccatcctttggcacaggatactcgtgcagtggacagcaataacagcggctgggccctggcacagcctctgccatcgttgggggctttataatcgcacaacgcacccctcacggctggaaggtggggctgttggcggcggcgcccggcccggcagtggtcgcggccgcccccgcggcaaacccggcagagtgcatgccggcctgtgcggggttggaccaccctcccgccggtggctgtgcannnnnnnnnnagccgcccccgcagcaaacccggcagagtgcatgccggcctgcgcgggattggaccaccctcccgccggtggctgtgcagctgccgccgccgctgcggcgggcgccgggccctgcccgccctccgtctttaccccggggaaggtctggctcagcacgcggcgcggccccgtggccagggctgcggcggccgccaccgactggtacaccttgccgatgcgcttgagggccagcgcccgctcggccagctcagacttgggcacgcctgcgcgagcggacaaatgagatcagggcatgatcttgtcagaagcgactactgtatacatcagcaatgcannnnnnnnnntgtgggcaaatgagatcagggcatgatcttgttggaagcgactactgtatacatcagcaatgcagggttagaattgcagggggccgtgactggggcagaggggagagtagcagcagtgtgcatgccatcacgtgggccgtcggcagggtgttgccgtggcatcgccaggggcgccaggccaagtccatggggccctttcgtgacagtgaccccttcaggcccccacaggtatacttcctgcatccagcccctctccccgccaacccagccgcaccggcgtcgttcaggacggcgacacagacggcctccagcgtcttctcgatgtccagcacgttcaccttccagagcgctgccagggtcttctcggcgtgccccaccatcagcgcttcagcgtcctgctggctgatggcccccgagttcagctgcttctgcagcnnnnnnnnnnatgccccaccatcagtgcttcggcgtcctgctggctaatggcccccgagttcagctgcttctgcagctcctgcccgatgctgaccaggctcaccgcccccgacaccgcattgtactgtggacagggggtggagatgggcaggggggtgtaagggcgtggaacttgggctgtgcgaaagagccgaggagctccaggacagctgtccgatgccagccatgttcctcccactggcacagcctgatggtgctgtgnnnnnnnnnnaggctgtgcgaaagagccgaggagctccagcacagctgtctaatgccagccatgtctctcccactggcacagcctgatggtgctgtgtgcaagatctgctcactcccttccatcgtctactagcctcagcaacacaacaattcaccggcaaccctgcgcacggtggtcttgnnnnnnnnnncctcccttccgacgtctactagcctcagcaacacaacgagtcaccggcaaccctgcgcacggtggtcttggtgccgtgccccatcccacgcagagactcccagacaaagcccacgcccagggtcttcaggttcttgcccgcctctcgtgcgccgatgcggctgtacatatacctgtgtggttgtgagaaggagtgcttgggggttggggtaccaccatgcgatgtgtgtcacctacctgccttgcgggtctcgccagctgagtcggccgcccagggaaggaccccgcccacatgcaacgtgcgtgaagccaggtccccattcttcccccagcccgcctcacccgatggtggtcagcatctcgggcccaaagttgaacttgaccaggtcggcggcctcccgccccgcccgctccagggtcgcaggcttggtggccccctggtaggtccgcagccgggcggccaggtgctccgtcagctccttcacgcgctgacgctgcgcctcggccatcttggccgacagctgctgctgcgtgaggggctggccgctggcgtccgccgcgatggaggcggcggtggccagctgcagctggccgacgtactcctcaaaggcgtcggagccaaagaggaccccaaacagaacggaggggtccatgaggggggtgtcggataggccgccggcgcccaggcggtcgtagatctcgcgcttctgggggtcggagagcacctggtatgcggtgcccagctcctggaacgggacaagggggaacggttcgaggacggggaaagacgctctctttgataaaagcagtctgacctcagtgctgagtgtcctagatgaccagaacgcatacactgcatggcctggcaggtcatacccgcatgtaaccatcctgcagcatcctcataccacagcacacagtatacttccacacctcgaactctcggttgnnnnnnnnnngaaagcagtccgaccccagtgctgattgtcctagatgaccaggatgcatacacagcatggcctggtaggtcatacccgcttgtaaccatcctgcaacatcctcataccacagcacactgtatacttccacacctcgaactctcggttggcattggggtcgttcgggcgcttgtctgggtgcacctgatacgggaattcggcatgatggaagggttcataggggggnnnnnnnnnnnnnnnnnnnnnnnnnnnnacgccggagcaccctctgggtcaattattcgagctcattgtcacaccagcgcatgtgtaccttgcgggccctcaagtagtaggccttcttgatctgttcgggagtggcatccaccgaaatctgcagcacatcgtagtagacagtctccttcaccatcctgtgacacctgtggagcgagtggatgcaaagtttatcttgaagtcgtgttgatgtcgacagtggagataggaactgcttgggtgtctccgaaaggagtaactgggctgcagcagactccagtctcggtaccgacgacgcttcaccgacttgccttgccgtacagctcaatactccgttatatcttgttttcactttgattgagacttctgaccaaagggtcgaggattcaggaataccatctttgcaaaggtacttctgcgcgcaacacggttaattttcgggcgggacctgtcgaagctggaagctgctcctgcttaaggtcgtcatacaggtgacagctgggcaccccgccacgatgtcatccagtcagacatataacctcaggtgacataaagtcgcagtgatgaggcggggcatctgcaggcccgccccccgccccctgcaacctcttcctaagaggtgcaggactgggcgtggatcgaggcgtgccatgcctctgagcccagaggacccctggggcgaggagggcgtcaaactggcgtgatattctcgtctcaggggaggcagcatggcctgggctgggccgagagccagggtcctcgcaatcggcagcttcccgctgctggccacgaaaacactctactgtcnnnnnnnnnnnnnnnnnnnnnnnnnnnnnnnnnnnnnnnnnnngtcaccaggtcgacgaaacctggcgccggcacgcctgatagggagatgaagggccgcgccggcgtgctggcacggggttttcgccctctcctcttcggtacatccgctcctgcatactgtgggggtcgaagctccacagcgaggggaggagacgccatacctggtgccgtnnnnnnnnnntgctcctgccgcgcgccggcctctggcatgctggtctctcctctgccaggcagtctggtactctgaagaggcatattgccggccggcggcnnnnnnnnnncgcgcctgccgcgcgccggcctttggcgtgctggtctctcctctgccgggcagtctggttctctgaagaggcatattgccggccggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtgggggacgaagctccacggggaggggaggagacgccatacctggtgccgtttggggcgccggcgctccctctaccgcccgctccgcctcccccatggcgagcttgcgtggccgaccccggggtctggccgccggggcagcgctcggcgaggcgctagggtgcgacgccnnnnnnnnnngccccggggtctggccgccggggcggcgctcggcgaggcgctagggtgcgacgccggcgaggccaggggtgaggccttctgcgcctttgatgccgccgccctgccggcagcccgcctcctggctgccggggacgacttggtgcgggccccttgatgctgcacccaccccgcgttccgggcgtcccgcaacacctcccgccacgtcacccgtgcctcgcacgtcgggcagctgccctgcgaagggagggtgccgccttcctgcacgagtgtcgaggggtgtcttgagccgtgaggtcgcgcactgcatgctgggccaggcatgagctgcgcaacttcatacctcaatatgtgtccaaaatgaaccaagggggggcggcccttcctccccacccgtagcatccaccactcccccacccccatcgcccgctgcccgcactcccgtcagtagcgcacccagacagtcaccccaactcacactctcaccttctctaggaggtgccgggccaggcagcccaggtggaatcgggagtcgcacgagctgcatgcccaccaggtgcgactggcatcgccggcgcagagcccgcacgcccccttccccccagccctgctgggcgaggcgtgggggctgggcgccaggctgggcgccgggctggacgctttggaccccggcgtcgtagagtttgtggaccctagggccgcctgcgccgcctcttcctctgcctgggaggtggattcgtctgcgatgtcataccctgggtcgaggtcctgtgcgtgaagggtagcacatggaggttggtcgactcactgggatccgccagctctgcagcaggggtggacgcgttcccagccccactctctggcacgacctcaccctgaatgtccccgagcactgcctcccnnnnnnnnnngtgggacccgccagctccgcagcaggggtggacacgttcccagccccgctctctggcacgaccccaccctgaatgtccccgagcactgcctcccccaccaagctcccactccccacctccaggggagcaaaggtcacggcgatgtgggcgggcaggggcgggcactgggcccgcaggggggcgtgcgccgagctcaggatgtggaggctgagggggaagtagcgccagggctccaggttcaacatctcgtgcagcaggcgcaccttgccctgcacgccctgcagccgctttttacccaggcgctgcgccgccgcgcggacgtccagcgacacctccggatgctgccaggcccactcgaactgcagggctgtgaccgcggtggggaagccgtgcacgaagagcaccatctcccagggtcggagcctgggtggatgaagggtgggcgcattgggggacgtcgcacaggtgcggggctttgcaaggagtgggatccagctgagggcacaggctttcatgcctcgatgtggggccgtaggcatatgacggagtcctgtcgctacgaaacgaaggtacgcacgcagtcaacagatgcatacctcttcgtcttggccgccccgctgacgatgtcgccattgtgctggcgtaagcggcgggaggggttgacggtgaacctgagaacatggaaacggaacgcagtggggctacttggaattgtgcgtcacccagaaactggaaatccacagatgacattgtgttatgaaaccagcaagctcggcgcacccgatgtacgttctgcccttccccttggcgtggcaggacctcaggaggtaacacccgaaaacctcaggcatgggcgcaccgccctgcgccgtggcctggccctgtcggatcaatgtccagacgtctcaggcctgcatggaagtgcagatcgatggtgtgccggcctgagacggtgcgatctgtcacagagctcctgtatcttgcgatccgcctgatttgctgatgtggcctggtcgggaagattggcagcagcacgaggcacatgctcccccgtcgggatatgggtcgtccccgatccctggccccgccacttcaaaccctgcgggctatgcgagtgccctcgctcccgacaggctgatccgccgcgcgctcctggctccggggttggaaggctgtggctcatctgactcggcatgaccaccgctgctcccgccctggcctcggtcgcccgcctggcggcgagctccgccctcagagcagcaacagcagccaaacaggtgcagcctcgggcaggacggggcgttggtgtggggtgtaggtcacgtgttaccactccgtgacctggggcacgacacagcaatccgacagttttatcggggccccacgtgcgggcgggcgcatggcattttcgggatgggtcatttagtctcgctcgcctccaacccacagactggtccccgcctggcggatcactgggagaagagcgtggtggacgatgtcttctcctcagccctcaggaaacagacgggcgtgagcctgaagtacatgtgagcgcaaagggggggttgtggaccggatcagatggccgtgaagtcatgcatgggttacaagttgtatgtgggtgagggtgatacacaccataacctctgagcctctgacccaagcccccccaaaccggaaaaacaactccaacaggcttgactttggctctcggcccatcgagcgccagctcatcctgtccgcccagttcctgcacaacgagctccccgtccgcctggcgcaccgcgtggcggagctggagaactcgccctacggcctctccgccaagccccacgtgctcaaggtccgcgactggtatgtggagtcgttcaaggagctgcgcgcctttccccgcatccgcaacgcgtcggacgaggaggagttcaccaacctgctgcgccacatctacttccgccaccgcaatgtggtccccgtgctggccatgggcgtggcggagctgaagcgcgagctgcagcacgaggtgggcctgaacgacctccccgacatccaccagatgctggacagcttctacctctcccgcatccgcatccgcatgctgatcgggcagcacgtggcgctgcatgagccgcagaaggagaaccacatcgggctgatcgacacacggtgctcccctggcgtggtctgtgccgacgcgatcgccgacgcgcgcatgatctgcatgcgcgagaaggggtctgcgcccgaggtctccatctacggcgacccggggtttgcctttccctacgtcccctcccacctccaccacatggtgttcgagctggtgaagaactcgctgcgcgcagtgtacgaccgctgggaggacgcggcgcaggagccgccgcccatccgggtcgtagtggccgagggcgaggaggacatctgcatcaaggtgtcagacgagggtggaggtatcgcgcgctccggccagcccaagatctggacctacctttacaccaccgcgcgctcgcccctggaggacatccgggacaggagcgcgggcagcacggaaagcgcggaggggccctccgtcctggcggggtgaggcggtttgcagggggccgcgccagcgtgggccgtgcgatggagtatgggcgagcccctgtgaccaactggatggccatgggggtccttggtctgctggggagggcctgcaggggtgcaagcctgcccccgctccttgcgcggcacctggcagcggcgctcccagtcnnnnnnnnnntctgtgcgatggagtatgggcgagtccctgtgaccaactggatggccaagggggtcctttgtctgctggggagggcctgcagggtgcaagcctgcccccgctcctcgcgcggcacctggcagcggcgctcccagtcgcatgaccgcacgctctcctggaagatgcctctgcaacaccctgtcactcccactcaccccccttgccaaccccccccgcgcaggtacggctacggcctgcccatcagccgcctgtatgcgcggtactttggcggggacctgcagatgatctccatggaaaactacggcacggacgcgtatctgcacttgaatcgccttggcaatgtgcaggagccgttgccgtgatgctggcaggtacctgggggcaaggccctctgggccttctcctcctgcaggctggcatgtaccgagaacaatgtacagtagcactcctggcaagctcatgagtcagagtgagggtgggggaggggggggggtaaagggtgttgaacgtatttcaatagcatgggaaagcacggcgggcatgggcgggcttgccacttgtcagatgtgaaaattgacagcacacaacgcagacgcagcannnnnnnnnnagggtgttgaacgtatttcaacagcatgggaaagcacggcgcgcatgggcaggcttgccacttgtcagatgtgtaaattgacagcacacaacgcagacgcagcaagcactcgctatatagtgcgacgcaggagcgcagtccatattacatacaacaccttccgtcatgggttttgccggtgacctcattgctcagcacgccgaggcatggcgagacagcgttcgcgccccattcctggaccggtgcaaggatgggagcgtggatcccagggattttgagacctggctcattcaggtgcgtgttcaatgcggatgaatgggctgcgaaaaggcatgcgcgcagcttggaaccgagattcgatcatgagccagtgtgacgggcggaggggacacgcacacgaacagcccttacttgacagagggcatgtaccccagcatgccgccctccatgttcgccaggatttctttttcgcgagggaatgcacccgattcatcgcacttaacgtcgccaacgccccgttcaagctcttccccaccctactcggaggcctcaccgccattgacgacgagctccagtggttccaggtgacgattgatgggaagggcaacggtgacaaccaacttcacaagagctgtctggcgtgatgcaatttatctccttcccttgttttgttctgtgggtcccttattttgttctgtgggtcgcttggtgaaggccagagccccaacttgcatgcattggtcaggaacttccgctccaatgcagtagcctttatcttgcttgatgtggcacaacctcttgggtttcatcatgcgacccatgcatgtagtcatccaaggaagtagacaccacctgctgcagaacctagacatgcacccaacccccagcctacatcctctcccagctgatgaaaattctgctgcccttactgtcggcttcctcatactgcccacagggggagcttgaaaagcggaatgtcatcgtcgaggagcacaacccccttcccacctgtgcacagtacattgagtatctcaacaagagcacgggtataccctatgccgttcagctcacaatcctgtgggtggtggagaaggcctaccatgactcatggcgactaaacagtcccatggaggagccgtacggcacgtatgctcagcgctgggccagcgacgcatttgcagagtacatcctagccctggagggccatctggacaccctcatggagacggagggcagcgcagtcaggtgagggattcctgggcttctggatgctgttctgttctttgatagccccaaaggcttgtaattcctgtcgatgctgggctggcgtgcttgaggtcgaggacactgcgagtcgatgcatcttgtcctgggtcgggatcatgccttgtaatcatatcaccaggccgtagcccagacctccttttgatcctcgcagannnnnnnnnnctctgttcttttatagccccaaaggcttgtagttcctgtctatgctgggctggcgtgcttgaggtcgaggacgctgcgagttgatgcatcttgtcctggggcgggatcattggcttgtaatcagaccaccaggccctagcccagacctccttttgatcctcgcagagaggcagcgtcagaagctttcttggaggtctgcaagctggaaaaggagttctggggcatggtctgccctgcttgaggtacttcatccccttcgtacaccatcccctctttcctgtccatgaccatgtgccgagggaaacttcaccttcgcggaatctgttgttgtatcgacggcgcgcacctctagatgacctaggagtatgttttgagcctcttctcagcgttctcgtgggccaccgaggctcgactcgtcgggaacccagcgacctcggacgcgagttcaccgcgcggtccaaatcccgccggaccaagggatgtcggtgtgtaacgatttgcacgccgagcactcgacggcatggtcccaggctgtgagtcatcccttcctcgaggcatgtcgtgatgggacgctggacctgaaggcctttgacacctggctggtgcaggtgaggcaagcctgtggcacaggtccgccctgaccccgtgcagacccgagatgctcgatcgcctccgtttcacatgctggaataccattataaggcatatcgatgaacttgtggacctctcgagcgccatgttacgggatatccgtacatcacatcttgagactctcgccgtacccaactggcacaccttgcacaggattacctcttcgtcctggaatttgcccgcttcatggcccttgccataaccaaggccccctaccgccacttccacaccctgctgggagggatcatcgccctcgaggacgagctgtcctggttccaggtgatttggtggggcattgtctgctgggcgagttggataggaggggggaggaaagatgaatcccactggattacatagcggcgtgggcagctccatcggcctgcaggtgtgcaacaatccctgtcctcaccccacccctggttcccctgggacctggttggatcccacatgcggcttcatctaagcatcgccaccttgcttgacctgggtggggcagggctatgcgacctcgcctcggaaccccccacccccatccccccaaactctcactctcagtcgcccatccttcccacctccagggctgcctgggtacgcggggcatcaacctggaggaggaggcggccaaggcgccctgccaggagtacatcgactacatgcactcctgcaacgaccagccctaccccatccacgtcaccgtgctgtgggccatcgagaaggcctaccatgaggcctggcacgcgcaccagcccccccagcccaatcaggcgccctacgactacgccaccgagcgctgggccagcgagcccttcagcaagtacgtcaaggagctgcaggccgtggcggacgacgccctcgccagcgccacccgtgacgagaggtggggtttggaagggggggaggcgggatgtgaagttaccaggaggtttcagagatgggggaaggatggtggaggtcaagggtcgcttttggaagcattgatgactaatgtccacaccatccctctcccccgccaaccaataccctttcccactcaccacactgcaggacggcggcgcgggcggccttcatcaacgtgtgccgcctggagcgcgacttctgggccatggcctatgagacataaacaaagaaaaccgtgcccccgagcgcgtgatgccgctccgcccggcagaggccgctccgctcagccagtcgtgaaggcgccggcgccaaggggagagatggaaagagcgagatgggcatgttatgcctgcatttgacccgcacctggcttcggtcgaggtgcatcagcgaccccccttccttcctctcccttcccttcccctcccttccctcaccaacgctgcctttgctgggtgccacttcctccccctctcaggctcctccaaggtcctctaactgggtattcttgatttcctctacgaccccctggtgattcccatctttgtcgaacaattgggagattcttaaagattcgtcaccctactcagaacactctgcccatgccggagatctctgcggggaatgatactcgctcagttccgtgcaggcatgctgtgtgaacgcaaggtgcccctgtaactagacgatggggcttcagccatgcagccatatgatcaagggatcgccgcacagactattattcagagtgagggtaccagcaccatctgatcaaacttgaatgtgcctacgtgtggtagggggaccctctcaggagccttccacccattccacctgcatccctctacgccgcctggtagcgggcttgaaacccaagcccctcaccgtactcggggtcttgttctgtaacattcctacttaaggtcatatacagcggtccacgttgtgtaatctagcccgcccccacaatattttggtttcggaaacggttcggatctagatccccgggctccgagcccccagcacacaatagtgcatacctgtggccgcaactacgcggccagaaccaacatgccggccgacgcaaacccggcgcctgccgcgacgtccgcgcccaccaacccagcggacaagggcacctccaccccctcggccatgactttggcccgccttgtggagatggtgaccgcgccgacggcggagcggcaggcgccgggtttgcgtcggccggcnnnnnnnnnngtgcagccatatgatcaagtgatcgccgcacagactatgattcagagtgagggtatcagcaccatctgatcaaacttgaatgtgtctacgtgtggtagggggaccctctccggagnnnnnnnnnnnnnnnnnnnnnnnnnnagggcttggagccccggggaagaagatctaaatctgtctccgaaaccaaaatgttgtggggccgggctagattccacaacgtggaccgctgtacatgaccttaagtaggaatgttacagaacaagaccccgagtacggtgaggggcttgggtttcaagcccggtgccaggcggcgtggacacatcgaggggcgcgggtgcaggtggaaaggtggaaaagctccggagagggtgccaccataacactacgcattcaataactgcacacctcacgttagcatgaacatcatgggcgcggtgatgcacgacgcaatgggaagcattgccggaaggcctccagggcttgcctcctcgcgcactggggcgtcaagctcggcagggagcatcagtggcaccatgttcaagctctggccctcccatacgtcctatgagtggacgtgatggctgaggtaacaaagcgnnnnnnnnnntggtgaggggcttgggtttcaagcggcgtggacacatcgaggggcacgggcgcaggtggaaaggtggaaaggctccagagagtgcccccacaacactacgcattcaaagactgcaaacctcacgtaagcatgaacatcatggtcgcggtgatgcacgacgcaaatgggaggcattgccggaaggcctccagggcttggctcctcgcgcactggggcgtcaagctcggcnnnnnnnnnncagcaccatattcaagctctggccctcccatatgtccaataagtggacgtgatggctgaggtaacaaagcgcgcagacaggggcggccatacaccccaaggggatcaaggttccaagcggaggctccacccatgaagtccgaaccccaagggtcatgaggggctctcgcctgctggccgcttggcctctgcatcatcgcggcaggttggaggtgtcgtggcccatcgagtcgagcatgnnnnnnnnnngagggtcacgtcatgaggggccctcgcctgctggccgcctggcccctgcgtcatcgcggcaggttcgaggtgtcgtggcccatcgagtcgagcatgcgcttgaagtcaaaggagggcgggttgtggttgaaggcgtgcacaaagacgtgcttggctctctccgtgtaaaattcgtgcaccatcctcatgaggctggtggcctgcgtggcacagggggttggggggggcagggatcaaggctggctggctggagaacacaggatcgtcgagggaggggtccacctccatgctcaggtgcctgcaggctgggacagtgagccccgccgccagcctgccagcatcagacatgggccccagcgaatggtgctggagccatgcccacaacgcagggcaagggccagctggatcctgcctggccatggctcccgcccgtacgccctgcacactccacataccacaccttacctcgaagcgggtgagggcgttggggtccnnnnnnnnnngagtggaccccgccgccagcctgccagcaccagacatgggccccagcgaatggtgctgcagccatgcccacgacgcagggcaagggccagctggatcctgcctggccatggttcccgcccgtatgccctgcacactccacgtaccacgcctcacctcgaagcgggtgagggcgttggggtccacgatgtcccctcgcaccagcaccaccgacttggtagactgcagctccgtgtagtgggtcatggtcatgaacgggacagccacggggccctgccgcttgtactcctccagcgacgtcaggaggacgcacggcagctggcactggaccatgatggtctcgaatgcattggggcccttgaagatgggcagcacaaacatgggactgtgtgtgcagggaggcgttgggaggggcaggggctgtcgtacacgtgagggcagtgtgaggggagaggtggaggagagaaagaaagggcaagccagggtgcagcgtgccaggggctgggagactgctgacagcgtatgnnnnnnnnnngcagtgtgaggggagaggtggatgagagaaagaaagggcaagtcagggtgcagcgtggcaggggctgggagactgctgacagcgtatgcgggccggaaatggcaccttccctccggtgtgcaggtccccaagtaccccaccgacccacctccgtgcggcattctcgctgaacacagcatactgcgccgctgtcatcacgtctgccacccggtgcttgagtgggtcggcgtggaactgtggtacagaatgtgctcggttggcaggctgggctcaggataacggcgttccaccagccagaccccagtattggcaatgcacctcctacccacctccatccagatgtcgtgaacgtgcttggcatcgtggttctcaaactctgcccgtttaacaatgtcccacagattccgactggaaggtgcggacactccacccagagagtagcatcgccgggaggcctgcagcaggttccatgcagacttggggccctggctccggggtgacatggtggtggtgggaccgatggcgctgggccccactcaagatgtccggatcaggaacaaaatgaatcatgcatggacgcgtattgagtatggagttgagatgcggcgatctccgaagtgctggctgtgcaacgtgtaatatacattgcggaaggaagcggcacttggcgggaaaatgcnnnnnnnnnntgatctctgaagtgctggctgtgcaacgtgtagtatgcattgtggaaggaagcggcacttggcgggaaaatgcatacgaacgcgcaaatctcaatttcgcagctcgagacaaaagaccccccaactccaactgcgacacaatgtgagatgattgcacatgggtaacctcgatgcctcactcatctatctgggaccactcaaagtgatcccagcctcgcggcgccactagctaaattggaacacaggaaggctgttttgggggttggaatggcagaccgggatgccagcgcggggnnnnnnnnnnccacatgggtaacctcgatgccttattaatatatctgggaccactcaaagtgatcccagcctcgtggcgtcactagctaaattggaacataggaaggctgttgtgggggtcggaatggcagaccgggatgccagcgcggggagtcggacgcccgtgcgcccttccaagatcccttctagttccagaagggatggatccgccacgcctcgtcgaatcgctgagcagtcgggaggtgcgggacggaaggagggctcttcgacaggatgcataatatgcgtgtggtgtccatgccgtggagagcagaaaccgacctgaaatgccttgcacccgaatcataattatcccatcgcagagagggtccgtgtcttcgtccgagttcggcctcccaagccagatggtgagacacccggctcgctgcgtcccaagccgggcggacagggcatcaacgtcttcaagccgtacgtgggcggggtcgtagatgtcttgctgaatatcggatgctgcagtgcttcagtggggcgagggaatcatgtgcgttattgttcgctgcagggtggaccctgctgagcgagatagcctagacttgctggaccgctctggcactctgacctgctgtgaccccctcgccacgacaggcagtccaatatctcagttggcgactatgactttgacaaggtgaggggtgcaggctcagggcagcaggnnnnnnnnnnacctcgccgcgacaggcagtccaatatctctgttggcgactatgagtttgacgaggtgaggggtgcaggctcagggcagcaggtggaggaacccctgacagggttcgaagatgcgtctgggcttcctccccgtcagtgctcaggagcatcatcgctcgcccttcatggccgctggacacagcgccacccagccggggggcgctcccactccacacaacacacccatgaccttcctcaccgctccaatgcccaggtgctgccccccagcgccagccaagcggacgtgtatgcggccgcggtgcggcccatcgtggaggacgtgctggccggctacaacggcaccgtcatggcctacggccagacgggggccggcaagacgcacacgctgtccagcgtggcaccggagacgattggcgccgtgccccgcgcggcggcggaggtcttcgccggggtccagcggggcggggaggacgtgcacgccgtctacatgtcctacgtccagatctacatggagttgatccaggacctgctggcgccggagagcgagaacctgcagatccgggagggggaggcgggggtgtttatcgcgggggtcaggcaggtggaggtcaggagcctggaggactgcctggagctgctgcaggcaggggacaggaacaggtgctgaggattttatttgtttgggtggggagggcgtgggtttatgggggtgagacggcgatgtacatttgcttgagggtcgagtatccatgctgggtcaagggttggggaacctcatgctcccaggtaggtcccaaggtctgggagtgatgagcgaannnnnnnnnnagtttgtttggggggggagggcgtgggtttacgggtgagacggcgatgtacatttgctcgagggtcgagtgtccatgctgggccaagggttggggaaacttatgctcccaggaaggtcccaaggtctgggagtgatgagcgaatcttgggctgcatggcgtagcattgtttgggactgagggatttgcttttgccacagtgggagtacagcgtcaccgcattcaccacctcttcgagaataatacaacataaatctccgacctccagccccctcccccgtgctgcatcacacccaggaccacagccttcacggccatgannnnnnnnnncatgatacaacatgaatctccgacctccagccccctcccccatgctgcaccccacccaggaccacagccttcacggccatgaacgcggtgtccagccgcagccacgcggtcttcatgctgacggtggtcaagcgcaagccggtgggggacggctccgacctgcaccgcgtccgcatcggcaagctcttcatggtggacctggcgggcagcgagcggctgaagaagagcggcagcacaggtggatctgggtgtgtgcgaggaaactgctgctgggtgattgtgggcccagggaagttggggcctgctggagcaggctctggcacctactgaccggcacaggtttgcccatggctttggcacctccaagacccgtcggtcgggcgagttgtggagcgggccatgctcagtggggacgacccacgcagattcgccagcccgatgaagagcctcccttcaacctgtgcagggctgcgtgccagcgaggccaagagcatcaacctgtccctgaccaccctgggcatgtgcatcaatgccagggccgatcccgccgccacccacgtccccttccgcgactccaagctcacacggctgctgcaggtggggcgggcgggggaggcgaccggtgatgctgatgccgccctgccgtggcagtgcagccgtcgcggcggtctccctgccaaaccctgtctcccatcattgatagcattccttgatgttctcccccctccataccctcaaaaggattcgctgggcggcaatgccaagnnnnnnnnnnggcccatggctttggcacctcccaaggcccgtcggacgggcgggttgcggagcgggccatgctcagtggggaggacccacgcagactcgccaggccgatgaagagcctccctccaacctgtgcagggctgcgtgccagcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtctcccatcattgatagctttccttgatgttctcccccttccatacccccaaaaggattcgctgggcggcaatgccaagacctcgctcatcgtggccgtcagcgatgcctacgagcatgtggaggagagcgtgcagagcctggcgtttggcatgcgggccatgcgcgtgaccacccaggtgaagcggcttgggtgaggattgaggtcccgtcttgggaaggtggcggcaagcgtctgctgcaggaggggctcgctagctcgccccggttagatccagcctggcacgcagaacgccacatctagaattgccgtccacacgcatccccatccacctgattcaccctggannnnnnnnnngcaagcgtctgctgcaggaggggctctctagctcgccccgattagatccagcctggcacgcaggacgccacatctagaatcgccatccacacgcgcatccccatccacctgattcaccctggattcaccggcccgctccctacaccgaatgacccgcagcccaaggtgaacgagcgactggactttgcctccctggccatgggtctcaaggagggtctcggccaggcctcagcagccgccgcaccccacgatgcacgtgccctggccctggagcgctcgctgctggcgcaggagagcgagctggagtacctgcagcatgccctgcaggtgagcgctggcgatgggaggggacttcaggaagagggagcggggggctggttccggctgcgcaatcgggtgatggagtgagcgatagcttgagatagaaaactgaccaagatccggccctcgccatccacgcaccagcatctgcgctgcactttccacctcgatgcgcaggcggagcgggagcgggtgcgtcagacggccgcgggcgcggctcatgacagggaggcgctagaccgagcgcggacacaggaggcggaggtgaggctgcaggttggaaatgtcatcattcttgaccctctccggtgcgagtcgcctggtgaggtgcctccccttttaaactccccccccccaaaatacacacgatgatgcaggcgctccgcnnnnnnnnnnccttgaccctctccggtgcgagtcccctggcgacatgcctccccttttaacctccccccccaaaaaaatacacacgatgatgcaggcgctccgctccgaggtggctgccctgcaggcggaggtggagcgggcgaggggcgaagcggcagccgcggaggcgctgcgacgggaggaggccgcgcggcacgccggcgagtgcgccgagctgcgcggcgccgccgccgcggctgcnnnnnnnnnnggccgcggaggcgctgcgacgcgaggaggaagcgcggcacgccagcgagtgcgccgagctgcgcggcgctgctgccgcggccgcc

SEQ ID NO: 40823 - DNA, 61 bp, Chlorella protothecoides
acgccggacgccgtggccggcgcgctgggcgcgctgcgcggcctgcgcgagctgacgctgc

SEQ ID NO: 40824 - DNA, 61 bp, Chlorella protothecoides
caccttgggctgggccaaggtgagcgctgcacgagtcctgagattggtgcactatgttttc

SEQ ID NO: 40825 - DNA, 119 bp, Chlorella protothecoides
ccccttaatgtacccaccaggtcgcccggctttcggcgtgagctaaagcctgtgccattccatgcacgcgagcccctgtttcccagttgcccttagagcctcagcacttttccttttcc

SEQ ID NO: 40826 - DNA, 69 bp, Chlorella protothecoides
tctgtattggcaaactccactgtgccgggcatgccagcgatgctggacatgccacgcgggctggcggcc

SEQ ID NO: 40827 - DNA, 64 bp, Chlorella protothecoides
cgcacgccctgccggccaggatcgcagcagactatacacgggggagtgagagcagcatccggtt

SEQ ID NO: 40828 - DNA, 80 bp, Chlorella protothecoides
ccctggcagtggaagggcagggtgcatgcacaagcccactcaagaggaggcacagctgccaggcggctccctgctccggg

SEQ ID NO: 40829 - DNA, 61 bp, Chlorella protothecoides
agcgcggtggccgtgtccaggcggggcaggggtgcggtggccgccgccagcgtggtgcggc

SEQ ID NO: 40830 - DNA, 479 bp, Chlorella protothecoides
cggcccgcccagcgcctgccaggccagcgagaccagggcctcgccggggtcaagcggcacgcgcgcgcgtgccggggcggcgcgcgcagttttcccggtcgggacgtcgagcaggaagagggcggcgccgtcccgcgccagcgccaccacctggcgcgggggctccacgcgcctgcgctctcgcgcctcccacgccgccagttcggcgcggcgcgccgcggcctccgagaccccggagtcgtcagagtcgtccgagtcgtcggagtcggcggagtcggcggcgccggcttcagaggcttccgtaccagccccccccgccgcggtggccacggcccctacgggccgcggctccggcgccgccgcgatgcgcgcgggcgggccagggaagatcgccaccgcgcccgcgtcggccagctccacgccgaacagcgccttgggcggcgccgcgcccgccagcttggcggcgtcgtagaccagca

SEQ ID NO: 40831 - DNA, 61 bp, Chlorella protothecoides
tgccgcttctattgtgcttaaactggcaggttgacatgttggtccacctcccatgcaccag

SEQ ID NO: 40832 - DNA, 66 bp, Chlorella protothecoides
cccagcgcccctccccctcccctgtatgcactccccccgcacacccatgtgactccttccctctcc

SEQ ID NO: 40833 - DNA, 62 bp, Chlorella protothecoides
gtcctggcgcgcaagcgccgcgcctgagggtttccgttggggtgagcctgaagaaggcggcg

SEQ ID NO: 40834 - DNA, 68 bp, Chlorella protothecoides
gactatgtgcctttggcggcgggtatgggaggaggcactgatctcaggtgcggcggggcaaggacgtg

SEQ ID NO: 40835 - DNA, 78 bp, Chlorella protothecoides
tcagcggcctgctaagatcgagcgtcagatcggcaggggcccaccttcacgccgcccgccccccggctggagggccgg

SEQ ID NO: 40836 - DNA, 122 bp, Chlorella protothecoides
tgcgctcgtcacatgtataggagagggctcaccatgcgcgacgcacctcccgacaccagtttttcatcacacacaagccacgttcccctaagactgccattgcgacagaacataatcctaaa

SEQ ID NO: 40837 - DNA, 74 bp, Chlorella protothecoides
atgggcccattcgctgtatctgttacacaaacatagcgtatagagtacctagtcactcccaagctgacattccc

SEQ ID NO: 40838 - DNA, 61 bp, Chlorella protothecoides
ggggtaggggccggcatcgatgccgccgtcacccggctgtgcacgctcctgtcctcctcct

SEQ ID NO: 40839 - DNA, 255 bp, Chlorella protothecoides
  modified_base (184)..(193): a, c, t, g, unknown or other
aaatgagcgtcaggcatctgcgccgtgggtaggtgggtaaatgggtgggtggttgtttggcagctgctctgccgcgcatgccgctgcaacctgtctgtggcaacgtgtaccagacagcttcatgccttgctgatcaaaccagcagacactacgagcagtcatgggaccctccttcctctatcannnnnnnnnntgtgggtgggtgagtaaatgggtgggtggttgttggcagctgctctgccgcgcatgccgctg

SEQ ID NO: 40840 - DNA, 77 bp, Chlorella protothecoides
cagggcgctacgccgcgccaggccggcggcgtgagggacctgcccgcgacggcgtggcgtcccttgccccccgtccg

SEQ ID NO: 40841 - DNA, 25687 bp, Chlorella protothecoides
  modified_base (611)..(620): a, c, t, g, unknown or other
  modified_base (932)..(941): a, c, t, g, unknown or other
  modified_base (1307)..(1316): a, c, t, g, unknown or other
  modified_base (2503)..(2512): a, c, t, g, unknown or other
  modified_base (3811)..(3820): a, c, t, g, unknown or other
  modified_base (5027)..(5036): a, c, t, g, unknown or other
  modified_base (5445)..(5454): a, c, t, g, unknown or other
  modified_base (5798)..(5807): a, c, t, g, unknown or other
  modified_base (6730)..(6739): a, c, t, g, unknown or other
  modified_base (7255)..(7264): a, c, t, g, unknown or other
  modified_base (7582)..(7660): a, c, t, g, unknown or other
  modified_base (7929)..(7938): a, c, t, g, unknown or other
  modified_base (8439)..(8448): a, c, t, g, unknown or other
  modified_base (8702)..(8711): a, c, t, g, unknown or other
  modified_base (8999)..(9008): a, c, t, g, unknown or other
  modified_base (9426)..(9435): a, c, t, g, unknown or other
  modified_base (10169)..(10178): a, c, t, g, unknown or other
  modified_base (10374)..(10403): a, c, t, g, unknown or other
  modified_base (10470)..(10479): a, c, t, g, unknown or other
  modified_base (10543)..(10552): a, c, t, g, unknown or other
  modified_base (10773)..(10797): a, c, t, g, unknown or other
  modified_base (11004)..(11013): a, c, t, g, unknown or other
  modified_base (11881)..(11890): a, c, t, g, unknown or other
  modified_base (12557)..(12566): a, c, t, g, unknown or other
  modified_base (13973)..(13982): a, c, t, g, unknown or other
  modified_base (14618)..(14627): a, c, t, g, unknown or other
  modified_base (14814)..(14823): a, c, t, g, unknown or other
  modified_base (15095)..(15104): a, c, t, g, unknown or other
  modified_base (15332)..(15341): a, c, t, g, unknown or other
  modified_base (16497)..(16506): a, c, t, g, unknown or other
  modified_base (16988)..(16997): a, c, t, g, unknown or other
  modified_base (17959)..(17968): a, c, t, g, unknown or other
  modified_base (18452)..(18461): a, c, t, g, unknown or other
  modified_base (18583)..(18592): a, c, t, g, unknown or other
  modified_base (18870)..(18879): a, c, t, g, unknown or other
  modified_base (21063)..(21072): a, c, t, g, unknown or other
  modified_base (22520)..(22529): a, c, t, g, unknown or other
  modified_base (23017)..(23026): a, c, t, g, unknown or other
  modified_base (23237)..(23246): a, c, t, g, unknown or other
  modified_base (23795)..(23804): a, c, t, g, unknown or other
  modified_base (24092)..(24101): a, c, t, g, unknown or other
  modified_base (24644)..(24653): a, c, t, g, unknown or other
  modified_base (25090)..(25099): a, c, t, g, unknown or other
cagcgccgcgccgccgcgcaggtcgggcggcggggcggcgccgcgcagcgcggccggggggaggatctgcgccccggccaccgccgcgcgcgccgcggcgtcgtaggcgggctgcagcaggtagcgcacgtccccgaacccagcggcgggggcctcccgcgcccaagccatggtctgcagggacttacggaaggtggcacggtccatgttggcccccacctcgccgatgttgcggttgcggttgacctcggggaccacgcagtcgcgaccccgggccacgccctccatgcgcatccagtggtcccagtgctgctgcggccaggcagggcccagctcctcccacagccgggatgacagcatccagcccagccccgggaagtaggacgtgcggaactggcatttgggtgtgtggatttgagggggtggggctgatgcggatggtctggaatgaggatggttgaggtgggaggcggtgatgacatcactgcactggcgcacatggagcgggcaatgacagccccacatggagcgagaaatgcgtaatcacaggaagcggggggcacactagataatgggccatgctcctcccaaagcgctcactagcctcgtcnnnnnnnnnnaagcgggcaatgacagccccgcatggggcgagagatgcggaatcacaggaagcggggggcacactagacaatgggccacgctcctcccaaagcgctcactagcctcgtcgggtcccagtcatggtccttggagaagccgttgtcgttctggaggagcacatgggaggggagtttctttggaaataccatcaaaggtgcagggcccaggtgcaggcaacgcaacctgcattcacatcgtcgatgcaaatcgactatcttgcccatcgggcacggcccctttttgatccccatcagcctccctcacccacgagnnnnnnnnnntgcaaagcaacctgcattttacatcgtcgatgcaaatcgacaatcttgcccattgggcacagccccttgtgatccccatcagcctccctcacccacgaggagatgcaccacagcgtggggtctgcatctagcaaccaccccgtctccatgaagagcgtcaggaaatctgtgtgggaaggggaataccagtagtcttgttgctgccccaaaggctgtgctgcagcttcatgtcagctgccagttgtcacctttgccacgacagacttccagccctttccttgtaagccttcaatctcgaagatggcgtaccggggctgaacagcatgtcatcctccacgatcacggcgtggctgtgcccgcccttcnnnnnnnnnngcgacagacttccagcccctttcttgtaagccttcaatctcgaagatggcttaccggggctgaacagcatgtcatcctctacgatcacggcgtggctgtgcccgcccttcaaaaagagcctgtctaggccccacttgtagtgttgcgcaagccaggcatgccccggctggcgcggtccaagctggggcactcgtggccgctgccagctctcaaagccagctgtcagggccgccagcgcggctcgatgcgtctcaatcacgccctggacccctatatggttgccgtcctgggagatgtacaaggtgaagtcggctagctctggcagggctgccagggaggtcagggtctggttgagatagccggggcggtcatagcagaatacgatgatggcagggttgagcagtgaggggggatctgggattaaaggagacgggggcttgattgatacggtgagggctcatcatatcatgcaagccaccttcggaaccgtgagcattcaatcagccccgagcatgcacgtcaccatgcctgcaaagcaggctctggatccttttgaccccaccttaccctggtgcagcggagcgtgggagaccccgacgtcccgggcaacagatttcacggcatctctctggttccccggcagcacggacgcaaatcggagctgtacccagaccagctccacgaagatgaggaggcacagggtccccgtgagcaaagaggcgtatggggggtccctgcgagccatgcctcgggcacctaggtgcccaacaccgtcgcccgcgcacatgggccaaggcaaggtctactggctgcgatgaggcctaaggatctatgacgagcatgcaacctcatcatacggtactccattaatatcgtatcatctctcgagaaataggtactggcctaaagcagcaaaaggccacacgcgatttggcgctttatttcaccgctcagcatgggaaagagtactttaaaaatacatagctgatgtagcgtgtggcgagaggacgcttggcatggcacacagcacgggaggcaccgcaggatcggtagctgcgggcgcgtgactgaatcttgatgatccttggttccggagacgcatacgctctgcttgccaatggctaagagcgaccgtccccgtgctttgatggtcaactctatgccaaatttgtgcgaatcgtcgcacnnnnnnnnnntctaggttccggagacgcatacgttctgcttgccaatggctaagagcaaccatccccgtgctttgatggtcaattctatgccaaatttgtgcgaatcgtcgcacatggatcgcatcgggattttaaagtgcaagctgttgccggtgtggcacttaatcagacagtctgagagctgcagcccatcttgaagtccatcaagtctcgagaacatgcgtgcaaatgtcgatcatttaaaacatcgctgcccctatgtattggtgggcagtcttactcggcgcgggggaagggcaccacgcgaaacgtgctcactgatctcgcccgcgcctccaatgctggtcgagtttcggacctacgaagagaagtcattcatctaaaccgagcacttgtggctggaaaagtaggcggtggcgttccacttcgtcatgcgttacgggaagaagctgggaagggcttggggtttccagacgcagccggaaacgcgcgcgtttcgaatcttcggtcagaaccctctacactcttcgccgtggccaggtcataagttagacccagccatgattccttcacaatttgctcacttccaccactcccccccccccagaacatcgttcgtatcccttaacatcctccctcaactctcgtactcgcggtcctagacacccacgtcaacaccatggcctacgtctacatgatgccgccctttgaggatttcttcggccatcatggcttcgagcactgtcccgccttctatcggatgcgtcggggaccttgcggacgccgtgatcgcgagggcttcccacctcgggaagctggtcccgacggacctgcccctccctccccgcaccacgcacgtggtcgcctgccccctcttccacctcctccccatggcgaccacccccaccctccacccccgcctccccacggcggccacttcccacccccgccccaccaccgccacgggaggcatcacgctgaggagggccccggccaccggcgccgcccccaccgccgggagccaacagagcagggaccctcttccttccccggattcggccacgtccagttggcccgcaccgggtctgcagccaggctggtggtcctgctgccaggcatcccccgcgaccagctcaagtgagtactgtatgatctctgattgtttgtcgtcgttgcacaaggggagtgtcctgatcttgctctgctatgaatattacccactgcatctcttgtgtacaaccagatcccttatgcaatcccagtcactcacccctcgatcccacgaccacactgcccaccaggttggannnnnnnnnngggcaatcccagtccctcacccctcccacgaccacactgcccaccaggttggaagtgctgaagcggactctgacgatcgaggtgcccgccggatcctcgcagcactcgcctgtcttcagccgcaccttcgagctgggggagacgatcgatgccgatgcaatctccgccgacctcgacctgggcctactcaccgtgaacctgccctacaagagcaagtccgtggcggtgccgcgccgcgtggcggtgggtggcgtcgggtcctcatcttctgcacatgaggctggcagtaaagcggccgccagcgaagcgcacgaagtcgaggcgcatgacgccgacgcgcacgacaaggccacggaggccagcgcgacggcggtgcaggagatggctggctcctccaagggcgagtgggtggatgtgcgggaggcggccgaggagaaagcgcggcgcagcgagcacagccccgcctccagcgacgatgaggacggctccattgaggactgccccgtggacgccgagccctgaagttgcacgaggccctgaccttgacaatggagtacttgacactgctgccatgccagcattttctcagatcaagctggcgtgatgtaccttgtaaactcttgtaccatacttttgttgaagagcctcaggcttggggcgtcacaatgggttacaggtccggtccagtgttctcaaaagtgctgtggttccagtcataggttgccggaaagaagctgcacagcctgtacctctcaaaacaagccattgcctagcgtcctgcggtcagcgtcatggtggtaaaggcggggttgatcccggtggtccctgccaccggtagcagcacctggtcgatgccatggatgacccagctgcagccgcttgccaggtcaggggacgtcacctgggccgagtcccctaccgcctccaggaccagcggggtgcccggggacacgaagagcaggtcccccgactcggtgggcaggttgcgcctggccgccagatcagcagcggacagggccctgccggacgacacgtggtactgcacgatgcgagacagaatgtctgcaatgtggggggcatcgattggggaagttggcaaggcagtccgggcatcgtgaggaatgccaaactgtcagtgtccaacaggcactgcttggaggcatgacagcacatttagacgagagctcaaatccgatggaccacaccnnnnnnnnnngtcgtgaggaatgccaaactgccagtgtctaacaggcactgcttgaaggcatgacacagcacgattggacgagagctcaaatccgatggaccacaccttgctccccatgatcaggaaagcctcccttcacacccagccatgccagcagggcacgttcacatacttctctgggaggaaagctggtcggcggtcacaccgagggcattggcggccgcagggaaggaggaggaagccgggacaaagacctgcggagtgtaggggttgcgaggaagaatgaagtgtgaaccgggtgatggcagcagagtggtggacaccaaggcccgcaactgcttctctcacatgccacaggtccacagacgcccacaccagtacagtacccctctccttctcactccacgcaccgtgatgnnnnnnnnnngaggggttgggaggaagaatgaagcgtgaacggggtgttggcagcagagtggtggacaccaaggcccgcgactgtttctctcacatgccacaggtccacaggcgcccacaccagtaaaatactcctctccttctcactccacgcaccgtgatgtcggtgtcgtagctggacagcagggcctgctgggcggaggtgttcacgatgctggcaaaggccgacagggagggctgggacaggatgtactccaacgccgtctggttgcagacgcgagggggcctggggggggcatgggggaatgcgtggcggccagtgagtcggttggatctcaggcatagaaggggagnnnnnnnnnngcgccgtctggttgcagacacgagggggcctggggggggaatgggggaattgcatggcggccagtgcgtcggttggatctcaggcatagaaggggagggaccttcaaaggagttggcagaagtgacacccatttaacaacaggcaaatcgctacagctatcacccttggacagagcactctgcaacagctgctgtcgcactcactcttctggcacctcaggcgacgggacgggagcggcaaccgccttggcaggcttggagaccactgtatgcaggcaaggtgatggaatgacttgcaggcggcggaggggaagctcctttccagcaaggcccgcatgcagtctgtctaagcagggcgacacctgcccacaaatgcgcacctccagtcggttcagcctctggggcagagtccaggacccaggatgcctccggcccctcctcctctggggcgggggctacggccacccttgagcgagtgatagggctggcagcacggcgcgcagggccctccgcactgggggcaattgcctcctcgaccacgggcgcggcaggcgtctttgcgactgccttggcggctgcagccttgggttccgcctttggctcagcagctgggacgggggctgcttccaccactgcagccgctggcttgcgcggcacaacagctgcaggcacctcggtggcaggctgggtcttagctgaaggagcgggttttgcaacaggagcctcagccttaggggctgcgaggaagggaactcctaggtaatgatgtgctcggtatcgagcggtagcttgagatgctcgtgctgttctcatagaccgtgctgtgcaccacctggctgactctcccattccccacacctggcgcaggagaggtgcagcgcccacaggtctcattgcagaagccgttgctgatcatccacttnnnnnnnnnnggctgggggagcgggtttcgcaacaggagcctcagccttaggggctgcaaggaaggggaaatctaggtgatgctgtgctcggtatcgagcggtagcttgagatgctcgtgctgctctcatggaccgttctgtgcaccacctggctgacgctcccgttccccacacctggtgcaggagaggtgcagcgcccacaggtctgattgcagaagccgttgctgatcatccacttggaatcacacttctcaaatgatttctgttgcaggattcgagaagagttttgtcagccaagcctgtagtgctgaggcctcccatggtttcctcggttcgtacaccccgggcacacgatgcggcggccagtcgcgacgtccccatggaccaggatcaggagcccgaatgcttgcaagagtaccagagaactcaacataaaaccaaagtacaagccttgcatacctgttgtgcgcatgtgtacttcttgtccgggggggtgtccgtgcatgtctctgccaagactgtggnnnnnnnnnncacctgctgtgcgcatgtgtactccttgtccggggggttgtccgtgcatgtctctgccaagactgtgggtgggaaagacatgcatggagctgtgatcgccggtgccacgcaaggtcgacagaggatgatgcgcgctaccatcataaagtcaacatgcagatcctgcactcaaaattacccgaggggctcagcacgaggcagaggagagtgcatgcgaggatgggacggatgcccatatcgggttactggcagcggtggactcctcgccggcacccaagtatacgagaagggcaggatataccttcctcaaaagtactnnnnnnnnnnnnnnnnnnnnnnnnnnnnnnnnnnnnnnnnnnnnnnnnnnnnnnnnnnnnnnnnnnnnnnnnnnnnnnnaaacaagagtagggtgggtttcgtgagccagaggtgcacagaaaggtggtcggtactggatctgacgatggaggcgccagatgatcactgtcggctcgcgatgggaatcaaaacatcgatcgtgccgtctgatgctatcagacatgcaccctgacatctcataacccttgatccagggctcacatggcattgaagatatagtatccgtgtcgtaggatcgtttgttctccccggcagccatggaagcgcaggcggtgctgggctccttnnnnnnnnnnaaagatatagtgtccgtgtcgtaggatcgtttcttctccccggcagtcatggaagcgcaggcggtgctgggctccttcgtggcggggcaggaggactacgaggtcctggaggagatcggacagggcaccttctctgaggtatgccgtttgatcgtgttcatggctcatggtcgatgttctcgagcgctgcgggcggtcacagcccttacccgcctccctccaggtgcaccgcgggcggaaccgatccacccaccaggaggtggcgctgaaggagatgttcctcacggaacagaaagccttgcccctgcatgtcgagcgggagctgcagctcctgcgcgctgtcagccatcccaacatcctgccccttcagggcgtgtactccaaggtggggttgcagctgtttggtgggctccaggacccgcatcgatgtttgtagatcgcgagctaccgcaccattgtaccccttttttaagatggcacgcagggctttggcatcacccnnnnnnnnnnccccaacatcctgcccctccagggcgtgtactccaaggtgggactgcagctgtttggtggcctccaggccctgcatcgatggttgtagattgcgagctaccacaccattatacccctttttcaagatggcacgcagggctttggcatcacccttgtcttcccgctgtgccgtaccgacctgtaccgtgccatggatgccggccctctgccggcccccattgcgaaggcggccttgaaacagctgtttgaggcgnnnnnnnnnncaccgacctgcaccgtaccatggatgccggccctctgccggcacccgttgcaaaggcggccttgaaacagctgtttgaggcggtgggcgccctccacgacgcaggtgggtggtactatgggctgcgctggcctggaagctgctctgtgtacttccttaacttgctggacggtcatcactgcatcatgtttactcccccccgtcccacgtaatgcacactcacagcgcttgccgctgccctctcgtcccccacccccgtgcccaggctttgcacatcgggacctggcgnnnnnnnnnnggaccccgtcccacataatggacacttgcagcgcttacctctgccctctcactccccacccccatgcccaggctttgcacatcgggacctggcgccctccaacgctctgctgactgacgatgggagggtgctgctgtgcgactttggccaggccaggcgcctagaggacggtcacccgcaggcagatggtgaggcgccggagcgcgaaggagcgctaacccccgtcgtcggcacgcgctggtgaggcgaatgaggaggagggaaggtatggcgagcaacaacccttgccaacccatggagagtgggccataccttcacaagccgcttgcaatggggaattgtgcttggggctcgccaggcctcttgctcctcagcatcgatgcccatccaccagtccaagtgcccctacttgccaccnnnnnnnnnntaggcgcctgggggacgggcaacggcaggcagatggtgtggcgccggaccgcgaaggagcgctcacccccgtcgtcggcacgcgctggtgaggcgaatgaggaggagggaaggtgtggcgagcagcaacccttgccaacccatggagagtgggctgtaccttcacaagccgcttgcaccggggaattgtgctgggggctcgccaggccctcttgctcctcagcatcgatgcccacccaccagtccaagtgcccctacttgccacccaactacaaaaccgccctcaacccccacctttcccattgcctcaaggtatcgcgcccctgagctgctctttgccgcgcggtcctacaaccacgccgtggactgctggagcttgggcatgatcgccgcacacgccctgcgcggcgccccgctctgccccggcgcgtcggacatcgaccagatctgccgggtgcaggcggcgttgggcagcatcgaggaggccagcggtgcccccgtggcagactgggcggactggggcaagctggtgttcccccccagcccgggccagccctgggaggcgctgctgccggggacggagcccgccgcacgggagctgtgcgccggcctgctctgctatgacccaggtgtgcgatggggcctgggctgcagcggtggaggacgggggctccccagcctgcctggcaggctggggacagttaaaacgtgggaaggccgacccctggcatgcannnnnnnnnntgatggggcttgggatgcagcggtggaggacggggctccccagcctgcctggcaggctgggcacagttcaaacgtgggaaggccgacccctggcatgcatgtactccactgtgcagcatgccctagcccgagcaggcgcttcccggccaacacccaaggactggggtgtcccattccctgccttcttccccgctannnnnnnnnnnnnnnnnnnnnnnnnnnnnnatctgccatcatcctctggccatgcagagcgcacggcacttcgtacccggctgtgacctcccccttnnnnnnnnnntgccaccatcctctggccatgcagagcgcacgacacttcgtacccggctgtgacctcccccttnnnnnnnnnngtgccctagcccaagcaggcgctccccggccaacacccaaggactcgagtgtcccattccctgccttcttccccgctacgctgcagcccagcgctggagtgtggcccgtgccctgtcatcagactactttgacggcgccgcggcgccagcagacgtggctgcgcaccttgcccacctgcctctctgaatcgcaggacgttttgaatctgcgcagcacatcnnnnnnnnnnnnnnnnnnnnnnnnngcgcttgcggagctgttaaaccccctattcaacgccacgccaggcggttgccctgccctgctgaccctgtgccggcactgttgtattgtacacccttttggagtccagggttcctggaacgaatcaggtccatcgccaaacgtctgacaaccccaccaccacgcctcagactgacaaccagcgcagtgcctcgctttcctcagtgcnnnnnnnnnngttttggagtccagggttcctggaacgaatcgggtccatcgccgaacgtctgacaaccccaccaccacgcctctgactgactaccagcgcagtgcctcgctttcctcagtgccgcggcgaggtgttgaggtgcaccgcctcgaaagcggcctccaggctgttgagcgacggcctgggcgagggcttggcctccctcacgcgctgccggtctgcaggagggggaggggggggggttgcaccggcacatgcatcacacggtacccttctcaatgctgtagacacacccccaagctcccccgtcccaacctgccatggctttgtccctcctccctctccgccttctccgtcaacccctcaagaaataaaaggagacccgcctgagtcgctgcgctgcaccgcctcgaagggcttgtaggtgtagccgatgaagttggggtccgccaccggccggctcctgctgctggcgctgccgggggagtgccccgcgcgcgcgccgcgttccgggtcctcgtattgctcaaagttctgggtgtccagctcgtgggtgatggccgggcggtagggcggcggcgactcgtacagccgcacccagtccacgccgcggaagaaggggtggcgcttgatctccgccgcgccgtgcccgccaaggcgccggtccacgtcgcagagcaggcgcatgatgaggtccttggccgcgggggagagcgaggcctccgcctcggcggggaagcgcaggtacgtggcccagttcacgatcttgctgcatgggtgcacggggaggtgaggcgtgagggcagcgtgactgcgacgactgggactggcacacggcaggtcgccctggccgaggaggaagacgtcgcccctgcannnnnnnnnngtgggtgctcggggaggtggggcgtgagggcagcgtgactgggaggactgggactggcacacggcaggtcgcactggccgaggaggaagacgtcgcccctgcacccacgctggcccaatccccagacctcaccggcaggtggtcatggggtcgtcggagtaaaagggtgggaagcccaccaccatctcaaacatgatggcgcccaggctccaccagtcgcactccatcccgtaccccttcttcatcaggacctctgggcagagggaaggggtgggtgggtggctggccggcgggtatggcaggagtgggagtggggccacctatgggaggcagtgatggacgctcgcacgcactcccttgcccctccttcccagcgcgacgccggggtcaagtccagcgtcacaagctactgcgccacaccagcgctcccacacatcccccctcttggagggagctcgctcaccgggggcgatgtagtctggcgttcccaccgtgctgaaggccagcttgcgccggttctgctgccagtgccgcagctgctcgctctgcgaggcggcgtcggggggcgagggcagctgcctgcgggagggagagtggatgtggatggcatgggacagatgtcgagaggttcggcgcgcgcacgggctgggacagcctggtctggaannnnnnnnnngtgggacaggtgccgagaggtgcggcgggcgcacgggctgggacagcctggtctggaatggtccccagatcatccctgcggcgtgaggtggacattcactcgtctgcactggagcacccgtgggctccccccctggacccctgtgttcggatcagtatcctttgtccgctgccccaactccccatcccccagctcgaactcccacctgaaggccacagggtcggcagctgctttgaaggccggcagcaggctgacgtccacgggcttgcacagcccaaagtccgacagcttcatgtgcccgctggcatccagcagcaggttatctggcttgatgtcacgatggatgtagcccgcggcatggatggcctccagggccaccaccgtctgcagcgggacaggtgggacggtgagcctgggtagagtggttagggtcacccatgcataacggcaagggcagcatagcgtgcaccgccgcccttttcgtacgcccctcagtcctttgtgcgcgaccctgtgtaccgacaagccatgccaccctttccaccccttcccaacaccatctcagaaacccatccacctgcgcgaggtagaagcgggccatgggctccggcaggatctcctgccggatgagcagggtcatgaggtcgccccccggcatgtactccatgaccaggtatagcatctcctcgtcctggaagctgcacagaagccgcaccacggcgcggtgccgcacctcggccagcacattgcgctccgcgcgcacatggtcgacctgcccgcgccgcaccatctccgccttcttcagcttcttcaccgcaaccaggccgccagaggcccggtcccggcaaatgcgcacctttattggtgatgcggaattggtggaggagcgggttgcagatggtaaagtaagacgcaggcatgcgggggaggtttatcatccgtggatcagagcagtacagaagagaactgtagggcagtgctgctaggctgccaccagcacggcatctcgaggaggtttggctcagcacccgaccaatgggaccatgttaccctctggatctgcacacgacagatgaggcccttctcccccacatccagctccacgcacctccccaaaggctcccttgccgatcagcttgaggggctcgtagtcgtccatgctgagccgctggcgctgcaggcgggaaaagtcccgctccctgcgctccagctcggcgcgggctgcatccctctgctcaggggtgagcccggggttctgcagctcctcttctagcgccttccgcctgtgaaggaggtgacagtgcgaggggttgggaggacacatggggtgcactggcgcgaccgcagataggcaatctatttgccaaggagttcctggaaaccctcagatcatgctccgcctcaccnnnnnnnnnnggataggcaatctgtttgccaaggagttccgggaaaccctcagatcatgctccgcctcaccggtccttgcgatccttgtggtgctgactctgaactttgtaaagatgttcgatgtacactttggcggtcttggccttggccaggacctcttcgctgaagtactcgtcctcgtaacccatcctgtgcctcgcgcccgactcgcaggccttcagcagctccgagggcaagaagagacacttgctatagatcagcgctcttgcatgatggataatgttatcacggatcgcatctcaatgcgcctagggctccagatcagaagtcgcgtattgcgtccaccagattgtgagaccatgtctttcgcgcgcgcaagttagttccgaggcttcacggggggctgctcccaaaggactctttcgtgccatttccagcaaagagcgttctacgaaatgtacctgaagcactgttcgttccagcagaataagttgtctgcaagtcccaggctgcgctgtgggagtgctcgaattcccctgcaatactggattccgccggttaccgacttcaagccaagatgatcccagagcggattgaaggatgcgccttggatgaaactgcgcatcccaagggaatagttttagnnnnnnnnnncacctgaaccactgttcgttccagcagaataagttatctgcaagtcccaggctgcgctgcgggagtgctcgaattcccctgcaatactggactccgccggttaccgacttcaagccaagattttcccagagcggattgaaggatgcgcctcggataaaactgcgcatcccaagggaatagttttagnnnnnnnnnnacaagtgcaaggtacaagagctgaaattgagaaaagtcgcctcgatgatgagtacccgagtgccaccaggaacgcaccaagatcgcttgagacgcttgggtgattgccagcaggagccctgcatgctccttggcgcactctagacatgtgcagatgtgagcaccagcatcacccaagctgcagctgaaggaggcaccatgatatactgacgactgaaggttctgagctccgttgcgaacttcgtcctgatattgatcggagtttgtgtcgtnnnnnnnnnncgacgactgaaggttcttaattccgttgcgaactacgtcctgatattgatcggagtttgtgtcgtagatgacacgtcggaagtgatctccggatctcgtaaggcaagctgacctggcactctctgctctggcataaggggtggctcctctcctttccaacgagtaaatatcttcgacccattttgaataacgttcagtcgccatggaccggccttcggctcgccgctnnnnnnnnnncccaacgagtaaataccttggacccattttaaataccgttcattcgccatggaccggccttcggctcgccgcttcgagggcaaggtcgcgctggtgacggccagcaccgctggcatcgggctgggcatcgcccggcgcctgggccaggaaggggccaaggtggtggtgtgcagccgcaagaaggccagtgtggaggacaccgtcgctgccctgcgcgccgagggcattgaggccgcgggccggccctgccatgtgggcgatgccgcccagctcaaggccatcgtggacttcacggtccagacctacggcggtctggacgtcctggtgtccaacgctgccgtgaacccggcatccggcgccctcctggactgccctgcccccgtcatcgacaagattttcgacatcaacggtgagtgggcgggtggtggttttttggatttgagaggattgaggaagttggactcgctgccgtgctggagggtcatgccgccatgccgtgacacagcacctgggccacgggtgggagtccagtgcttcttccaccccctctcaccccccccttcaatgaaaccctgcagtgaagtctgcgctgctgctgacccaggaggccgtgaagcacatgtcccgaggcagctccatcgtcttcatctcctcctattcggccttcaacccccccgcccccatcgcgctgtatgccatcagcaagaccgcgctgctgggcctgaccaagggcctggccacggaactgggcccgcgcggcatccgcgtgaattgcgtggccccgggcatcgtgcccaccaagtttgcgtcggccttggtggccgacccggagctggaggccgcgcagcgcgacgccaacctcatgcggcggctgggccgggtgcaggacatggccgcggcggtggcctacctcacctccgacgacgcctcctacgtcaccgccgagacgctcaacgtgtcgggcggcatgcccagcaggctctagggggggacagacacgcttggatcgagaacgttcagagggtgtgagggtctcacctttaccctcttcacagcgtgacatgccatttgtgttgtgcacgtcggccagtgctgatgatacagcgccagcgattgcagcacgagagattttcccctgtctgactttcgctgcaannnnnnnnnnattgcacatcggccagtgctgatggtacagcgccagcgattgcagcactaaagattttcccctgtctgactttcgctgcaacaattagccttgggattggggatggggctgccgctgcgtagtgagtgtatgcagggacacaccttggccgtgccagagagggaagatgtcccttcccaactcgattctgtgcatgtcggggctggctcctggcccccacaggcacatcaattcggaaataatacagctgctgcacatgccacagagagtctatcacatcggcagggtggggtatggcgggcaaggcaacgcataaattcataccacacagcggcgcaagatggagtggagctccggacgacacttttccaatgatcgggggccaacaaggagcagcaactctccaggcatttgcgcccacatttcggccgtgcagcatccaccactgccagcgcgcctggtcacccatcgacaccgccgcnnnnnnnnnnagtggggtatggcgggcgaggcaacgcatagagtcataccacacagcggcgcaagatggagtggagctccggacggcactgttccaatgatcggggggccgacaaggagcagcaactcttcaggcatttgcgcccacatttcggccatgcagcatccacctctgcccgcgcgcctggtcacccatcgacaccgccgccacctcacaccgcgccctgggcgagcacagccttggccaccttctcgaaggacgcaatgttggcgccgttgatgaggtctgtgtcgtactcggccgccgcgcccgtgatgtcgtcgtagatggccttcatgatgccctgcagtttggtggtcacgtcctcgcgcgaccagggcacaaaggagcggttctgtgccatctccagccccgacaccgccacacctcccgcgttggaggccttgcccgtgacaaaggccacaccctcggcggcggtgaacacctcctccgcctccagcgtgcagggcatgttggcgccctccagcacgatctgcacgccgtgcttcaccagtgccttggccgcctcctcccccagctcgttctgcgtggcgcaggggaaggcgccgaacacctccgtgtccaggaaccagggctgcgccgcgtcgccgcggtactccacgccctccagctccaggtcctccagcttgccgtcgtgctgcgacttgagcttcatcaccgcggccaggtcctcacggctcaggccctcgggcgcgtagatcatgccgcgtgagtccgacatggacagcaccactgcgcccttctccagcagcagctccacgcagtactgcgcgacgttgccagaaccggacaccaggcagcgcttgccctccagcgagtcgccgcggtctgccagcaagtactcggccaggaacactacgccgtagccggtggcctcaggccggatctcggacccgccccagcccatgcccnnnnnnnnnncgccagcaagtactcggccaggaacaccacgccgtagccggtagcctcgggacggatctcggacccgccccagcccatgcccttgccagtgagcacgccggcgcggtcgcgtgtgatgcgcttgtactgcccgtacatgtacccgatctcgcgcccgcccacgccgatgtcgccggcggggacgtcagtgtcggagccgatgtggcggtacagctcggtcatgaaggactggcagaagcgcatgatctcgctgtcggaccgacctgggcacgtgggtgagggttgtcatggaggtggatggggtggggggtgggaaatccagaggagaggcggagggacaagccggggacatacattctgctagcgcaagggtagtggcaaggtgaccagcacatgaagagggaatgcttctgctcaatgcatggagcaagggacctccacacaagcagaatgaggacacgggaggcctggcacacataggcannnnnnnnnnaggtgagggttgccatggaggtggatggggtgggggttgggaaatttagaggagaggcggagggacaagccgaggacatacattctgctaccgcaagggtagtggcaaggtgaccagcacannnnnnnnnnaatgcttctgctcaatgcatggaaaaagggacctccacacaagcagaataaggacacgggaggcctggcacacataggcatggtgtacaccatgagacggcagggacagcacgactattcgtgctctctctcacactggtgctctcatgctcctgtcagggaggggagagacacccccggtccccccctcacaccactttcccccaaccccgagccccagccaccgtcaccaacacaatccaagcaggccgctcacccttggggtcaaagtcggcgcnnnnnnnnnnacacactgggccctcatgctcctgtcagggaggggagagacaaccccggttcccccctcacaccacctccccccaaccccaagccccagccacaatcaccaatacaatccaagcacgccgctcacccttggggtcaaagtcggcgccgcccttgccgccgcccatgggcagcgtggtgagtgcattcttgaagatctgctcaaagcccaggaacttgatgatggacagggtgacagaggggtggaagcgcaggccgcccttgtaggggccgatggcggaggagaactggacgcgcatgccgcggttcatctgccacacgcccgcgtcgtccacccagggcacacggaagatgacctggcgctccggctccgtcagcatgcggaaggccgggaggtactctgggtgcttttcgaagacaggggcgatgctgagggccatgccgcgcacggcctgcaggaactcggcctgctccgggttgcgggagtagacctcctccaggatggcctggccacatgacaggagtagggtttgagtggccagctccagccgacggacaccgcactctccggggttgggagggagggtggatcaggcagtggagacaatagctcaggcatgctcagcagcacgcaccttcaggccgtcatgttggatgcccttttgcagtttctgcaggttgctgtcgacgtcgccctggtagtccttaccctacgggagagaaggggcgagaagtcgcagcatgcggtcatgtgtcgagatgtaagttgtcgagtgggccattcatgctcatagcggcctgctgcgcaccattctggctgtgagaggcaaccctagtgtgagggagggaggagggtttcacttgtgtccacgatttcctgagagcaacggcgaggcgacttgtaaacactttgcagatcgaagtaatgtgttagtttgggattagggttggtttttactacacctacaagccctgcaacgtgggtatgtatactcgggcacacgccgagtgaactggcaggggtcggcgcgctttctttttccaccggacaaggcagatcgcacgtgcgcgagagctgcgcgcacgtttttgtgattggctggcaacgccgcgaatctctgctcctctaagggggccaggcaacattcgtagctattgtggtgaaactacccgaaccaaggatttccagcacgaatcacatcgattcgacatgcgtgcaggaaggctgagtgtgcacgttcagggcgtggccctgaacgcaaacccagatgagcccctgcgattcgaggcagaactccctggtgtgggcaaggtttcctctggtccctcctcggatctgcgctgggagcaaggcctgaccttggagttgaaccctgcgagctccagcaccctccaggtgtccctgagcaccctgagcggcctggtggtcgcccgtggatccacctcgctcgactggaccgatgccgacaaacaggagctgcgtctgcctctggaaggggctggaggagaggtggacctcatcctgcgctacttccactgccgcactccgggtgagtggtgtcggggttcccgacgccgcgtgagaattctccggaaggggagctgcctggaagccccgtgtacagcttaatacgaacgatttcgagcccaccctgatcgtctggcaatacccagggaaaggccgtgacggtctgggacgggagcttctggacggggatcttttccgggagccatccttgagcggccacctgagccccgtcagctctcccagggcgggcctggaggccaaccgcgtgccgctgcgtccccgccgcggcttaccagaggccacctgcgcctgaggagagaggctttagtcccaagcaatgtgtcacatgtcccaccgagactgaacaggagggtaggagggcggagagctggagcggagaagtgagcgagaaggtgttggggcgtcgcggcgtaccaacagtgtacatccaccagccttgtatggaaggttttcagcctgcatggcacaccagtctgtgttgtatttttcggcctaccattgggggccatattttcataagccaggacgtgctagctgtgtagaggctgctgtctaggggccgctcctcggcggcgcgtaagttattcccctaccatgatggcctgagacgcgctgtcaacatttttgaaacttcaannnnnnnnnnacgtatcttattcccctaccatgatggcctgtgacgcgctgtcaacatttttgaaacttcaacaggaacgtgatgtggcagtcaagggggacacagtctcgtggggtctgtctggcagggggaaggtcagtgggtgtgacacctcatcgagggcgtccacccctgccccagcgaaggcacgggaactcacggtcacagcacgccgtacgccggctgcgaggggtcggccagctgccccgcggccagcgccccagactgaggccccacgggggtggtcgtggcggagggcaggaactcggccgcgccccccttggccagctccgccttgccctgcgcgctgggcagcccgctcagcaggccgcccgccggcacggggggcggctcgtgcacctcgtcgatgccgccctccaccacctccacgcccaggtggacaaacccagccgcggcgccctccgcacccgtcagggggaccttggtctcgtgcagaccagggccgtagaccagcgggatgctcagcgtgcccttccccaccgtcctgcacgcggggggtggggtgggggatgcgagggtcatgttcatgcacttcgaaggtctcatcccggtgggacaaggaagtggggcacccagagtctgcatcccaggagaatggatgtgcaagcaaccccccttcaacatcccacatcccctctggccgggttccctgcatcaccccacccacgcacttgtcgaatcggaggtagttgttctgcttcactttcactttgagggtgggcgactcctcgtcgggcgatgcgtcggcgagggggaacttcagggtctggttccagacctgtgtggaaggcggagggacagggggagggcgctgtgctcgctgcacgttgcactgaacatcacaatgtagtaagccatgcattacaacctatctcaccgggtacaagcccttggcaggcttggtgcgctccttctcgtcgtccagcctgagtatgacatacgtcccgccggactccgtctccaggttggcgcccgcccggacatggacgcgcaaatgtctcgagatggtcatcgtgagcagcttgtcaaagtgaattgtgcctcaagggtgtcgtgcggggttctcgatggacagggggaatgccgtggaggaacatcgggaagtcccatgaagcgttctgatggaatttgcctggaatctgtgcagctcctcatcaaatgtgggcgatgtattgctcagcagcctaagatcgtattattaacatataagacgacacaaaattgctgctctccaggcggccgaacttgggaaaacccaaggcacaagtaactccatgaagactctcgcacgtcatgttctacgacacactgtggtagcagctgggtatccgctcaatggatggcctgcaataatgccagtcgtggtttccatgatcaagtccagggcccgctgattnnnnnnnnnnagcacatcatgttctacgacacactgtggcagcagcttggtatcggcccaatggatggcctgtaataatgccagtcgtggcttccatgatcaagtccagggcccgctgatttttatgacccacatgaagctgtacctggcaaaatgctccaaggccacaatctttaaattggcttcaaggatgcccatatcatccaatgaaatggctacatattccagtcaatagcccaattcaggggcttcacatgatttggagacaagtactgttcacagccacctgtcacaagggcgtccagatgagtactgtggtcccatccgaccattgcaaagggggaaacgcgaagcacgactcttcgacaagatcaggtgtccagctcttgcattctgcgcatcgccgagcccatctgtacacgttagctacactggtctatttacactttttctctgccttgctgtgtctcccacagaggctggcggtgtcgggagggnnnnnnnnnncgggcgaaacatggcagccccagaccagcaggtgcaggaataaatgcttgcctcagatgtgtaggggtgggtgaaaacattgtgcgggatgttctgaagccccttacattcacctccgtcacgagagccctaccgcagggccccaacaactttggctccttcccaaaccagcccgggccccggaccttcacgtactaccccaacgagtccnnnnnnnnnncgtgcgggatgctttgaagccccttacattcacctccgtcccgagagccctaccgcaggcccccaacagctttggctccttcccaaaccagcccgggccacggaccttcacgtactaccccaacgagtccctgaggaggttgtggcaggaggcaaaggacgaaattgccatgacggagcctgacccagcccagttcaagaaccagaccctgcccctggcacgcatcaagaaggtgggtggggcgggcgtcggcgcaggccccaggtgcaccccctgtgagtcatggcccctgcacgtggattggcgtgccagtcacggtgcccagctgaagcacaccgttccctcccctgctctgtccttcagatcatgaagtcggatgaggatgtgcggatgatcagcgccgaggcccctgtcctcttcgccaaggcgagtggggtgtacggctgtgtgggggtgattgcgcccccccctccacccacccctcccttcaactcttgcccccctctcttgatccctctcaggcctgcgagttcttcgtgctggagctgnnnnnnnnnntggattgcgcccccctttccacccagccctcccttcaactctttcccccctctcctgatccctcgcaggcctgcgagttcttcgtgctggagctgacccagcgtgcctggcaggcggcggaggagaacaagcgccgcacgctgcagcgcaacgacgtggccatggccatccagcacatcgacgtcttcgacttcctgctggacattgtgccgtacgaggagcccgcgcccgacggcgccggggtcgcggcggcccagcccccgccctcccccgcccagcccggcgccnnnnnnnnnncgtgccgtacgaggagccggcgcctgacggcaccggggtcgcggcggcccaacccccgccctcccccgcccagcccggcgccggcgccccgcccaccaccgtacacccggtgcccgggcagggcgcggcatatcatgcacagcaggcggggccgggggcgtacggcaccagcccgcgcttcctgcagacgcagggcatgcagtacccgcagtaccacccgagcatgggccccccgccgcaggcgggcatgtacgggtcgggcgggggccagcagcagtttgtcgcgccctaccaccagcccatggcgcccgtgggggggtacgcgccgctgcagggtgcgtacccgccgtcgggcatgggcgcgccgccgggccccggcgggcactgacggcgcggtgtgacgctgaggtggagcaggcctccagagccgacccctgggcggccagtcaacctctcccctgtgcgttctgtgtactccacccctccaaggcgacctgcaggagtcgtttccgaagcgtccctcacccgccgccgtgcagcgcnnnnnnnnnntcctctccccagtgcattctgtgtactccaccccttcaaggcgacctgcaggagtcgtttccaaagcgtccctcacccgccgccgtgcagcgccgtgccacccacttttccacgtcttttccacgtaatgtgccaaggtcccacctccgtccctgaccctgtcccaccccctgctccatgcttccccctgagacgatccagcctgtcacatacactcttgcgatgcccaggaggggtggattcaggggcaggcggctagtcactgcgaggagcaggggtgactcattaagtgtacgtgtgttgagtccagggtacgacctggagcccatcaccagggactcggctgcctggggtggccggcatttgctcctggcgggcaacattcacaggctgtgcttttgaggaacaagagtcagctcaggcggcggtcagtcagnnnnnnnnnngttgctcctggaggcaacactcacaggctgtgccttcgagaggcaagagtcagctcaggcggcggtcagtcagcccggccagcctcaacactcctccggcccccccttgtcctcctcgccgcggctcaggtccgcggcggcaggcacccggccatggcatccatgaaggcctcggcgaagcgcgcgtcggagaagcggtcggcgcggcgccgggccgccgccgcgacctccagcctctccagctgttgcatgcccagcacccgggtcagcgcggcggcgtactcctcctcggtgacgcagcggaagcccgtgggggtggccccgcccgaccccgggccgccgccctctggctgcacgatgtcttcccgcggcccgcccgagtcgtggactacgggcaccacgcccgcggccatgaactccacgatgccgatgccaaagtgctcgtcgcgcatcgtgtgcaggcccaccaccgcctcgcccagcagcgcctgcagctccgggaaggggaggttgaccaggaagtcgacgctaccctcgaggcccagctccttcgccagggctgcgggtggtggcgggggggtggagggt

SEQ ID NO: 40842 - DNA, 3830 bp, Chlorella protothecoides
  modified_base (112)..(121): a, c, t, g, unknown or other
  modified_base (498)..(507): a, c, t, g, unknown or other
  modified_base (565)..(574): a, c, t, g, unknown or other
  modified_base (642)..(651): a, c, t, g, unknown or other
  modified_base (771)..(780): a, c, t, g, unknown or other
  modified_base (1096)..(1105): a, c, t, g, unknown or other
  modified_base (1174)..(1183): a, c, t, g, unknown or other
  modified_base (1346)..(1355): a, c, t, g, unknown or other
  modified_base (1428)..(1437): a, c, t, g, unknown or other
  modified_base (2371)..(2380): a, c, t, g, unknown or other
  modified_base (3082)..(3142): a, c, t, g, unknown or other
  modified_base (3207)..(3216): a, c, t, g, unknown or other
  modified_base (3375)..(3499): a, c, t, g, unknown or other
tcccacgtgggcgactggaacatcggtgagtagattggaggaggcggtggggtgacaccagaggtgaggtgtcgactccagctggaggcagagaatgggaagacaatgtccnnnnnnnnnnccaccagaggtgaggtgtcgactccaactggaggcagagaatgggaagacaatgtccagggcatggcccctgaagcaatttcttgattgcttgattcacagggaacttgatcggaggaaacgcaaactgtgtgtacaacaacgagaaagacagcctacagtgtaaaaaggcggtcggtgttgaggggactctgaacatgcgcagcctcaaggaagtcaaccagtctgtgctcgacgtttaccgtcaaccaatgccttcagtccaagcagaggcgtccttgctgatccgcacagccatgcctcctccaacaccccagaatgcgcctcaccttcctcccgagagaaagcctcctgaaccaccaggggaaaagctctcannnnnnnnnntgcttcaacacccaagaatgcgcccctccgtcctcccgaagaaaaacctcctgaatcnnnnnnnnnnaccactccccccgccgtcatctccgcccccccgccccccaccatccccatctgacgattgcttagatnnnnnnnnnnctatcagctacacctcccaatcctcagcccccaccgccgtctccaccacccagcccttcaccatcccatctgaggaatgctcgaacgcacccgtggtgaccctgaccacttgcggtgcgnnnnnnnnnncctccacctcccagccctccaacatctccatctgacgattgctcgaatgctcccgtggtgaccctgaccacttgcggtgcgagcctctacccgaatatctgcgtacgagcaggtgtccccactgccatctgcatcgcaacagttccaacaggtgtcacggtgtgcccggaggattctttatacccgtctggtggtgtatgccttgattcctattatcccaacctcctcatctgcatggtagaggaaggccaggataccttctatgatgccgtgtgcgtacaaagctccagccctccagctctcccttcccctccgnnnnnnnnnncggctgttcaccagaacaccttctacgatgctgtgtgtgtacagagctccagccctgcacctctccccnnnnnnnnnnttagggttaggtttagttttaggtttagttttagggttactaggccgcattttgggggaaccccggttttcgtttgcgggccctttttgctccctcttgcccaatgtcgtcacttgtatcagaagaatgatcaacataaagacgaaccaagcttgttagaggnnnnnnnnnnattactgccttcaccataaaaacgccatccctcgatttagcggagctctctgcaatcgaagtggccgccgccnnnnnnnnnncccccaccccatccgccgccatctcctccttccagccctccaccttcccagcccatctccctgaccggcacagtctccttcaactacccaaactcggcgggggtcactgtatacattgacatcttgtcggcaggctacaccaattatactgcccaggcctatatttggacctcctaccttgccaatccctttgttattgccttcaccataacaacgccatccctcgatttagcagagctctctgcaatcgaagtggccgccgcctttgggtacagcagtgttctagtctgggacgccaacaacactttattgctggtgcaagggttgacattaatcccatatgccacaacccctccctctacgtgcgacaactccccagtcttggtgtccatcagcgggacatgttctgagcccacccctgtcattgtcatctgtaccgtgtcgggggtacccacagccacttgcgagtcagggactcagcccgagattcccgattgtggagatcatccagggattgcggcatcgggtgtgtgcccaggcggtatgcccaccatgatggtttgctcgcttggtggcgtgcccacagcggtctgcctgtcagtctcccccccttccccaccggcggtcccgccacccccaccatcgctcaaccccatcttcggcgctgccaacttatcaggcagcacagttaccttgaccatcactgcttcaggggccctaccagacttctacaactgcgggttctttacaagcgaaggtgcgatgatggcatccgctcagaaacgccccacaaataaaatcaacccgcaagaatggcagcagacattccaagccagtatggtcccattcttagatcacgccctagttgtggcgggtactgatgcggggtcctactccctgctattgtgggggccccctctccggaggcttcccnnnnnnnnnntcctggttgtggcgggtactgatgaggggtcctactccctgcccactacaattgtgctctgatcagtcctttcttccatcccacacttggccttcggtagcccatgtcgaaggcagcttgtgattttggcctatcttgctgtcactcaccatgatgtacagcttcttgtgcagtgaggtgagaccagggaagacaggaatgataaggaaggagagattgattgagagtcaagatgagcacctgaacctcgcatgcacttcctcgcttactgccgggacagcacacggtccattggccagcgtatgtcgtgcatgctagcgggcaactggaggaacgctgggtacttgaatcccatgcagagccggtgggtacctgtctccgccgtgcattagatgtcatgggcacatggcgattgatatctggtcgtttcatgcatccctagaggggacggaggggcacatgagacgttgagagggaatgcgccttggcagagatgcgcagccaacatcttgcctctcagcacaggtgcgcggcagccgctccggatcaggagcccggcctagcgatggccactcacagtccccccattgacgcaccgtatggccatgtactggggccgcgactggtcggtgaacacgcacgagggcctccaggctggcccagccctctccacaacgccagcaagccagtgatggatgagannnnnnnnnnnnnnnnnnnnnnnnnnnnnnnnnnnnnnnnnnnnnnnnnnnnnnnnnnnnnaaatggagatcattcttttttgaggagtggcctcgcctcttgcgacgggcttgcacaggattggnnnnnnnnnnatgggtatgaggtgggggcgtgaagcattctgcgtgagcatggcgcaggtgtgcccaccggtgctggtctggattggcgtgtacatgaagcaggggaagtgagatcattccctttgaggagtggccttgcctcttgcgacgggcttgcacaggattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccatccccttctcccattcccttcataccctgttctcgttggtgccatgcgtagagtccagaaagacggctcgcttgtgtccatacttgagcaggatctcgagctggcgaggggtctgccagcagagcagggtcctcctcccgccctcgctcaggtgcccaaagtagtctgcaggcgcggcgtcgatcctcagctgcagactgcgcgccgggtcgatatctcgtctccagtccttggcggctgcatggcatctcagattgctgggtggaagaggaagaatcaaccgtgagccgttcgagaagttgtccagccaccacccgcccgccgc

SEQ ID NO: 40843 - DNA, 130 bp, Chlorella protothecoides
gagctggaaggccaggcccagcgcgcggccatagtcccaggccgcctgcgcggcgccggggccgggccccggccccagcagcgcgacggagcgcgcggaattggccatgagcgaggcggtcttgcagtag

SEQ ID NO: 40844 - DNA, 94 bp, Chlorella protothecoides
gcccgatccatgcgtcccaggaaatgcgccgatccccatgttaccaattcgtgtgcttgaaatccatcgcatcgcggccatgcccgcacctcca

SEQ ID NO: 40845 - DNA, 61 bp, Chlorella protothecoides
agccttgcattctatgcaaagacccaccgcacccccccctggcgcaatgccaggcccctga

SEQ ID NO: 40846 - DNA, 77 bp, Chlorella protothecoides
cagctgcacccaggaaagagcgggatgggagggaagtgatagccttgctgggcacgaacttacggcagggtgcagca

SEQ ID NO: 40847 - DNA, 93 bp, Chlorella protothecoides
gattggaggggacagggagtgaggcgtggcaaggtgtcaggctcggtgcgggatgagggttgggctcagggggcgagaattcagtgcctgcca

SEQ ID NO: 40848 - DNA, 122 bp, Chlorella protothecoides
gcggaatgagccaggagcggcaaggccccagtccctcgttctcctgcgcacccaccgccattgccgatacacgcaccgctcgattatcgccggaggcagacaccccatcgctgacgagccag

SEQ ID NO: 40849 - DNA, 61 bp, Chlorella protothecoides
gcttccctgcagggtgagtgccgtggctggggagcgatctcgggaagagaaaccccactgc

SEQ ID NO: 40850 - DNA, 110 bp, Chlorella protothecoides
agcccccgtgccaccccgccagctgccccgcggtgaagtggctcgccgctcgtcgcgggcagccggcgccgggcgggggtcgcgccctgggcgccccgggcgccggcgca

SEQ ID NO: 40851 - DNA, 118 bp, Chlorella protothecoides
cgcagcgcgagttcctggagggagggccgttggaccgctgggcggcggccagcgcagcgacgacggccggagaaacggcgcccgaaaacagcacgcccctgcgccgccgtttctcggc

SEQ ID NO: 40852 - DNA, 61 bp, Chlorella protothecoides
agcggaagcaattgtatactaagagaggtgctaaagaacatgttgtgctgtgtgagcggac

SEQ ID NO: 40853 - DNA, 6705 bp, Chlorella protothecoides
  modified_base (6437)..(6581): a, c, t, g, unknown or other
ggggtgggggggtgaggggggaagggtggggtggagcagggagagggtgcagaacatgacgaggcttcgtgagtcctcccagaccttcgcatgtatgaccctcaaccccgtctgggacgaccaccctcctacagaccatgaagaggctgatgacggtgttggagaggaaggaggccccgctggaccaggcaaccacctctgagtgggcgtcacgacaggccgtgggggcctcggccacgacgtagtcctcgcagtgcagctggcgcccggcacggcgggaagcaaagtcgttggtgagcaaggtgggcagatggggcaccaggaaggtgagggctgttgggatgtgggtgaggtggaggcgttctgtacctacctaggcaaggatcagggggagcacaggcctgggacaggtctacaacgaataaaagcttcagctcaaagccacttgacggggacctccaaagagggagcatcactgtgctcccatgcgccggtcttgggcagtgaggggtggccatgcacgacggcccctccacgacggcacgatacccggagacgatggcttgacgcggcctttgcacagcctactcgcctatcacatataaaaggatgagcgggaagaggcgccatgccctggactcccacagctccttccacatgcccttcgccagcatgggaggctgtgctgacgccatcccgttcactgccatgcgggtcccgtcgcagccatgtgttgcttcccgaatgcagccagactgccaggagtataacttggatatgattggatgttcccgctattgtcacgagtggtgaccagtctgcatgtcctccgaggtcacatgggtgccgggcgacgccaggtatccgccagtggtgccttttcggaagggccccaggatgctgcagtccccagctggacgatgtggtttctgcagttacattcgcctgagatactttccagcatctgagcaggagattgaaccagcctgttatgagaagaggcagaacattccatggtcaagatttgaagggagaaagagggggggcagggcaagcaattgtgtatgcatggggggacagggccctgggacatcagagcatgatcttgctgtcgaaggtggagagggccacggcgaaagcctgcagggcgttgacgcgcatggggttgaagtccaagatgtaaatgtcctggtccaccttgccaaactgcatgatgacggggccccccgggatcagggtgtccaccaactgcacagaggtgtgagggctaggctgagtgagggggtgggatcagggtaccacaatcccatgccaacaggcaggcagggcgggactaggaagcgtcgcccgcggcatgctgcagccgggcaggcgtcaagcatcgaccgggtgattgctcggtgcagcatgcctgtcagtcagtcaccgcagcgcacctggaagttcttgacggaggccagcttcacccggccccggaaattcaggcaccagcacctcaggccggagttccaagtgggggcattgttctgcagctggatcggggcggcatcctgcagcatggatgggggaggggcagctcgatggcacggcagggatgccttgcagagcgtgagagttgttgcccaggctggaccacacaatagttagagaactgctcgggcaggccctctctcatccagtcccgccagcatgaacttgaagactttcccgaccccaaacctcacagccatgcacgatggcccccaactgccgggcaccccaacaaccctcccacccacctccggcaacaaatcgggcggccggtgcctcggcgcgcggctcggcagtgccgccaggcggaagaggaagcgcgacacccggcccgaccccgacggctgctgctgctcctcccgggccgaggggcccgtcttccgtgcggggccgagcggcctctctcctgggccggtggtaccccagcggggcgcatccgcccctcccagggacgccacagagtcaacgctgacccagctgcggctggacgcctggggcgacaccctggggctgggccccgccgccaccggcaggccggcctgaggggggggcggctgcggcagggtcacctgcagccggcgcggctgcatgaagcccttcactcgcgcgcggtactgcagctccgccaggagcccctccccctgggggctgggccccgccgtcaggatgtaccgcgtggcaaacacgttggtgcccagctgcgcgcagggcggcgcgtcggcgcgcccgctggtgaagaaggcggtgtcggagcggctgctctgcagcgcggccagcaggaagcgggtgcgcgccgggttggccccggggctcgtcgggtcccggcccagccacagggagaagcggcgggggccgccagcgccgtgcgctgccggctcgcgccgcacgaagcacttcagcaggccggacttggagccgcggacagggcggggggactgcggcgcatggggcccggggggagcgtgggtgtgtgagaccttgatggtccatgcctcagattctgggccagcacagtgagaccccctggccctgcgatgccctgccaagcccctgcaccccgccacgcaccaggtggaagagctgggaggggtggcagaggacggaggcgcagtcccagggacgcgcgaagaatatctgctggcccactctgcgccaagacctgcacaccccacacctgcgtgatgtggttgggcgggcaggcggacggggattggcgtggccgttggacgaggcggccgccgcgagacagaggcttcccccatcattgcgaccgcttgtcagccaagcgtggactcagggcccctgaccctgggcagatcggtcaaccacagccgtgcacccacttctccaacacaaaacggtgagaccaccttggactactcacacgctgaactgatgcttcttcctcccgccctgcaggtacgagaagatgttctccagcaggtgttcggggagctgggaggctgtgctggcctcaggggggcatgggctgcccatcatggcatgcacgggctccgggaggtctgctcgcacagccagggcgggagcgcacgagagctgtgccaccgggcgacccaactcggtatacctggcgtgcccagagaaatcacgagaccagtactcggctcaccaagctcttgcctgccgggccgaggcagcttgcgatccgaggaacggtgcggtgagggtttcacacaggtgccgtccgacaccttccggcccggttcagcctcactcgcggcagtgttcaacgcgttgccaagtgtggaggcactgttccgagatcccactcgcgggtattcatctcagtggtgaatgcatgtttaagcgtgccgaggggggcctcgcccccctcgctcgatatcttgcgttccgaggggagtaggaaaggacggagcgttccgaccccgtcagcagctgatcaccgatagctcggtggggagagtggcccaacggctgatccacaagcgacttggatcccatacgcagccttggactaccaacaagttggatgcagcattgggggctaacattccctcgagcatgggacactctgcaacaagtgtagaagctcagggtggatattcatgttgcacaaacctgctctacatcacccaggggagcaggggcacactcactccaggctctacgagggagatcgcatcggagacatacagccccaaaggagccgttgctcaatgggcctacctagccaagcaggcgatccaatgaatgtgatgaagggatggtgcacgttccactgcagatgccggtctctggcaactgatattatcagcactggtcattgtccgacttggagtgcagaacactgtcaagaacaaatacggtccagtctgggtattgctagattttatgtgggggcagctctggaaggtgacccatccagtgattcgaagtggttcttattacactgcagcattgatgacatgctctgataaagacttctgtatgatgggtattccgaagtgctggcccagtgtcacatggatgaccctgccacctcgtctgtgtgtcgccttgaaagcctgcatccttggccatcacctcctttgtttattgtttgtcctttacaatccagggtataccagtgtcctgtctgtgggcccctggtgtcgagtcagcactccttcaacaatcctcgccatgccgtgcatgctgagggttagcgctggtccgctcggccacaccctccaactccaatgccagtgcgattcgagacacaaacgataccatatacaccatcaaaatcgcttggaactcgaatgcgcattcggagctactgagcgtgggccctgcaccaatctgcctcttggcaggtgagggcgaaaccacattcagtacttgcttgtcgggtgtcgggaaggaggcgaattgtaaggcgttcatttgtaacgcactgcccagtgtcttctcaatccctacgacacacagcggcccgtcctcacccgtccgtacacggctggctcgggctcataccggcgtgttccgcgtggtccaacgcggcacagggtggcgtcgtctcagacaccctgcccaaaaccggctctacatcacacctgcttccctgcaaacaatcttcatgccgggctcgggcctgcgatagggtgccgccccgtgaggcctgatctgcccgagaggctagctacccaatggcaggactggatgccacggtggccatgtgccgcgcgatccgcaaggcagcctttgcctccaagactgaggtggaggacctgaggtgagggcctgcagggtgggcgagggagccgtgctgaccagggctgggcggtttcagacctggcggccctggcatcctcgtgctccctggtgcacgcccaggcacgccggctctcccttcaacccgtgcaggacggtggcacggtttgtgggcaaggtgcagttgatcctggagggcctgcgcagcgtggagggcctggatgcccttcgcgcctggccggaggcacacggtgggctacgtgtttgggaggctgacgccagttgtatgccgactctcctctgcccaggttcctagtgccatgcacccgcagccggtctcctcgatccacagcgccatcctgtcacaggccaccccgcggccctggcttatcgtgcgcagatgcaggccccctcccctgcttgaattccaccaccattcccccccccccccccccccttgtccctgcgcaccatgagccttgcatcacacctacctggccttgctccacgacattccacccgttctccccctccaaacacccttccatccttgtaatcgttcgttctcaccccctccccctccaaaaccctccgtagcgagcctgcaggatgcgctgcagggcgtggccgacgtagtggatgccacggcggccatgggctccctccaggccgtgctcgtgacagaggacacggaggtgcggctgggcgcgtgcctcaaggagctgggctcggcgctggccgagctggcggcttgtgcgggcgacgcaccgcccgacgtggcgcaggacactgcgcgcgtcccgcgccagatcgccggcgccaccttcgccccccgccccggcaccgacctgctcacctggcagctcctgcgcgggctgacgctggcgggggtcgggcgaggcgaccgcgccgcgctgggcgcccagctgcgcgccgcgctgcgtctggtgtccctcggccgcgagggccttggcgtctggctggagcgggaggtgctcgcgctgcgcgccgccagcgtggccgcgcgcgccgcgggtgacgtcgtgctcgccttcttctgccaccaggtgctcatgtgcctgctggccgcggggaccggggcctgggactggctggaggagcccgtcgcgggggaagggtgtgcccaagacggcgctccgttggccaaccccagcgaggccgccgaggcgctggcctctgcgcgcaccacgcccgcggccagcgcctgcctgggcgaggccacgccgccagggcagggcaccccaccgggtgccggcaagggttctggtggtgcagaaggccagggtgtcagcgaggaacccctctccagggcggacgagggcagggccagctcgaacgtgatggcgcaccccgtggcggacctgacagacccagcggacatcgtggacggggcctcccccggtcctgcccccggcaacgcgcccgggaagggcgaggcacccggtacgccaccccgcgccgcgcccggacgggcgggcgaaggcccgggctcgcccgtgcgcggcgccgcgcgcctgctcggccacgtggcggcctggttcgcgggcatgggcggcggcgtggcggggccggtgccgcggtccggcctgccccttgcgaatgctttgtccctagacctggcgctcggcggctccggggcgctggggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccccggcagcgccgcgctttcccgcagcgcggtggccgcgctggcctcggacctgcgcgccgacggctggccggacgcggagctggactttgacgccgacgacgtcgccggcgcggtggcg

SEQ ID NO: 40854 - DNA, 20084 bp, Chlorella protothecoides
  modified_base (454)..(463): a, c, t, g, unknown or other
  modified_base (1104)..(1113): a, c, t, g, unknown or other
  modified_base (1934)..(1943): a, c, t, g, unknown or other
  modified_base (2191)..(2200): a, c, t, g, unknown or other
  modified_base (2891)..(2900): a, c, t, g, unknown or other
  modified_base (3097)..(3106): a, c, t, g, unknown or other
  modified_base (3845)..(3854): a, c, t, g, unknown or other
  modified_base (4322)..(4331): a, c, t, g, unknown or other
  modified_base (4870)..(4879): a, c, t, g, unknown or other
  modified_base (5075)..(5084): a, c, t, g, unknown or other
  modified_base (6883)..(6892): a, c, t, g, unknown or other
  modified_base (7348)..(7357): a, c, t, g, unknown or other
  modified_base (7625)..(7634): a, c, t, g, unknown or other
  modified_base (8084)..(8093): a, c, t, g, unknown or other
  modified_base (8657)..(8666): a, c, t, g, unknown or other
  modified_base (9382)..(9391): a, c, t, g, unknown or other
  modified_base (10017)..(10026): a, c, t, g, unknown or other
  modified_base (13092)..(13101): a, c, t, g, unknown or other
  modified_base (15931)..(15940): a, c, t, g, unknown or other
  modified_base (16104)..(16113): a, c, t, g, unknown or other
  modified_base (16488)..(16497): a, c, t, g, unknown or other
  modified_base (16807)..(16816): a, c, t, g, unknown or other
  modified_base (19045)..(19054): a, c, t, g, unknown or other
  modified_base (19713)..(19722): a, c, t, g, unknown or other
gggggacgccagcgccgcgcgcgtgcgcaggcactccagcgccaccgcgcggcccagcggcgaggccagcgcctcggcgcggcgctgcgcctcgcccaccaccgcgcgcacgtcgccggagacggagggcgaggcctcgcccagcgcgcgcagcaggcgcagcagctccatctgcgccgggcggggtgtcggtgggcggtcgcgggagcgcacggtcgtcgccgcgccttgcacaggcgcgcctggcttccgagcaggtgcgcagggagcgcgcctcggcatccaaaatctccagtcacgtaccccagatgaacccctcctcacgacccgcacgcaatcaaatagcagtcagcattcgaggcacaagtgcctcgcttcctctctcccccgccccctccccccgccccaaaaatgtaataatataacccaccgcacctgcaagaagggcgcaggnnnnnnnnnngagtgcctcgcttcccctcccccccgccgtcccctcccccccaaaacaatatacaacccaccgcacctgcaagaagggcgcaggggcgcggtgcagctcgaacgcgcggcccagcttcccctcatacgcctgcttgaggatggcggtgaggtagggcgccagcgcgccgtactgccccggttcggcgcggatgagctggcccaggcctgccagcgcggcggccatcagcgccggctcgcggtgtcccaggcgctccaccagcgtgcgctccaagtcggcccccgcgcccgggtccagctggaggaagcggtgcagggccagcagcgccttgcgcgccacgccgggggccgggtgggcgagcagagcggtgacggagggcaggaaggctgtgaccagctccggcgtggcgccgcggcaggcggcctgcagcgcggtggccaccaccagccagttgtcggaggcgaggtcggccaggatggtggccgtcagcatcaggcccagctctgagccgggggggaggagcagggacgccgccaggtaggcggcctattggtgtgttttttttgggggggggaggtgggcgcggggacgtcagagctatgagggggaaaggttgcagggatctacactgccccacaacnnnnnnnnnntgcagcctatcgggtgttttttttgggggggggcgggggggagcgtgggcgcggggacgtcagagctatgatgggaagaggttgcagggatctacactgccccacaacagaacaggatgaacgccgatccacagagcgacagcagggtgccagccagccagaccacccccacccaccttcttcacgaccaggtgcttctcgctgcaaagctggatgacggtggcatggccccaccgggtgtcgtggcccagcatgtcgatgtagatgaggtaaatgaggaagtccttggaggcccggaggtcccggcgcccgctcttgatcttggaccggcacagctccaccatgcgctgcacgatggcatcctcctcacccttgctcttgctctcaccaatgccccggaccagctcattgaactcgctggtcacgggcagggagcgcttggccagggtggacagggtggacgacagggcgctcatggtgctctgcacgaggccccgtggcgatccgcgtcgatcctcgacactgggtgcatgcgcctgaattatgaattcgaacgcagcaggcctggggtgtgaggtatgcccctcctctggatgccctgacaatcgtcaacccggtcgtttccgcgccctgcaggtcgggagtagaaagtgaacacccttgattaaacctcctctcaggaggtcctcttactatacaccaccaagccatgatgtatgagtatgataattaagcaatcgtgtgcaattcatattgtttacattgccaacttgtggatggacaacgaggttgcactcatctgtgactagaatttgcagcannnnnnnnnnatgtgcaattcatatcgtttacattgccaacttgaggatggacaacgagggtgcactcatctgtgactagaatttgcagcaggtgtgcgagggataagcagttcaagttggtgatgctatcagcatacatggagctggcggctcaatgcaacagttgtgggtttgtaaaactgcatttcagatacccagcagctccaggcatagctttgtagtgagtgagatgctgagctgtgcatgattaacgacannnnnnnnnngtgcttttcagatacccagcagctccgggcatagctttgtagtgagggagatgctgagctgtgcatgattaacgacaaggtcagaactctgacaatcacagactgggcctgtaaccttgtcaacttgtcgtgctatgtacaaatgctgtccgatgccaaggatcaggctgcaaaacttgcagatcgcgactgcatgcgaccctacagggaacgtcatccagcactgcagcatgcacgtcatggcctgaggttcgactggcgcatcaacactgagcagcacctgtgcttaatgtgagcaggctgaggccgtttgagctgttgctgggtcggacggggggcagtgaacatcatacagccctgctgggcgctttggcgcatgcaccaatctggatcgtccagcggtcgcaatccgccaggatttagtcactcatgggctgcccgcctccctcatcggggcaggtgggccatgaattcgttgtatgccccctccagctcgaagaggagctgccgcgcctcgccctcgtccagctcgtaactggcgggcaggccatgcagcttgctcacccaggccttgagcttcaggcggccgggcaggtctggtggcagtgtggggacctggaggcacgcaggaggaaggggatgctggcgtttcgtcacgtcggcaaaggatcacgagtggggagggcgatcnnnnnnnnnnagtggcagtgtggggacctggaggcacgaagaaggaaggggatgctggcgtttcgtcacggtggcaaaggatcacgagtggggagggcgatccacagcatgaccttcacccttcacggttgcacgagggggaaagagcttgaccacaagagcagccctgatttgtgaaggagcagcactgttttcgaaatccggccnnnnnnnnnntggggaaagagcttgaccacaagagcagccttgattggtaaaggagcagcactgttttcgaaatccggccacaggcctccacgtctgccaccctcaagggtatggagcgctccttgccgtgcctgagcagtgagaccgatgacttccggtgtgcaaactcctctccgccccagaggcatagatggccatactggccccccatccccttgcccaccttgttcagggactgggtcaaatctgagagcaggggaaacacctggtccacagccgccatgttcagcttgagggcgtccatggtggtgatgaactggcccacggcatccgccacggcggcggtgtaccctgcctccccgctgctggtggcccggccatgctccacggtggcgggcatgcccgactgggccaggcgccgcgccgccatggggcactgcatgccgtaggtggccatgaaggactgcaggctgggcacgctctctgacaccgtgctccacagggtgcggtaatgggcgatgaggcgctggcaggcgggctcatagtccctggcgctgatggcgtcccgcacatacgcccgctctagcttctccgtcgacttcaggatggcatacaggtctggcatcgaggaaggacgggtggtggtgatggtgtgaaggtgcaaggatcacgagccccaacactggggttccacatggttcccttcccagcatgtacaacctctacctcacctgcatactcctctagnnnnnnnnnngtggtgtgaaggtgtaaggatcactgagccccaacactggggttccacatggttctcttcccagcatgtaaaacctctacctcacctgcatactcctctaggaggtccctctccttctggcttgatgtgtaccgcgagatcagactcggcacatttgccaggggagggaactcggcggtcataggggccgagcacgagctcgacgcggcagagaccttacaccccacctacggcttgaagacaacgttacaccccgatgacgctacctttatgacccaagcatgtcactcagtatcttgggtgtctagcttaggcacaacggagcgtgcaggccgtcctcttcctaatgctcctcgttccggcagacgggatgggagtcgcgcgccctctggtcagattcgcattgccttccttaggtagaatttgcacaatggcggttcacaccaaaaggacattcatcagcagcannnnnnnnnnctgggtaaaatttgcacaatggcgattcacaccaaaaggacattcatcagcagcacagtaatgtctgtgacgaccaggaagcaggcttcaaacgcaaagcgcggggcaaagagggaccaggcgtagaggtggcgacgctggacggctgcgctgagcatggccgccagcgccgcagcgcagcggagcgttcccatcatcgctattgcaccttcaggagcatgttgcggggatggaaccggcctagaagactcctgggtcttctccgctgccccagctagccttgcttgggaggccgtgctgccccagggaatgcctgccaaggtggtaacgaggagcatgggcccaaaggtctccagtgccacgagcacacccgagcggtacagatggaaatcatcatccgtcacaaaccctgttggatggaggtgagcagggttgaacgtggagcgtcatgggtacactctaatgtcattctgtgcccttcagatcgcacatggaacctcacgcgtcgtccccccccccccccccccccccaccccccnnnnnnnnnngtccagtgcactcccgcaaactcgcacaggtgccccgaggcatagaaggcgtgcatggctgccagagcaagctgcagctgcgccaggcgcgagcgccgacggacggcgggcaggtacgcagccacccagccccaacccagcatgcacagcatgacgagactggttctgggcggggaaagcagggccaccagggctnnnnnnnnnnacaagctgcagctgcgccaggcgcgagcgcagacggacggcgggcaggtacgcagccgcccagccccaacccagcatgcacagcatggcgagactggtgctgggcggggaaagcagggccaccagggctgcaaggcccgcaggcaggaggccggggtggctcctgagcacacggcgattgagtgccaggctgaggagggccaggcccgaggtggaaagggacactcgcgcaaacaggcgggtggctggctgtacgtagcccccatcggtctggaagagacggcctggagcccaggccaggagggcggacagaggggcatctgaggctgcgaccccggcatccacagccccctgcaccacatgccgtgccgctgcagctgcaaaggatgctgccactgccagtctggaaggtgagggtcaaagggatggagggtgacggcaggatgtgtgccccgggcctttgcatgatacgatgccgagaccaccattgacactggttgcagagaaaggcccaccctcccactctggacagagcaactgccctgacccacctggcgaggcgcgcggatgccaggatatttgccgcggcagggtcaactccaggcacgtgcatgctgagtgcgcacacggccattcccagcagcgccacagggaagccagccacgagcaggcagcctgcccagctggagggcttgccggctaatcgggttatatgatctgtgcccgaggcaagcagctgggctccccagctcacgttggcgccgaggtgagcagcaggctccttgtcgtgcactgtcagcttctgccagaacccccagccggagtgctgagtcagccccaggcgtgcagacaggaggagcgcgagcagccccgccccgcccagcatgagtatcgccaggagtctctgggtccgaggtttcaaagttgtcagcgactcgagggtcaggagtacccaggcagctgctgcgacgccggcggtccaagtgcctggcgttgaagtaggggtgaagtttgtgtgtgccgagagggtagcatttgagttgtatctctggcacctagaccttgcatatcatttgtgctcccaggatgaatctggggagacacccccgcagacagcacgagtctttgccgcttgccccggccacccaccttcattcagcaggtagaagaaggagaagatgcccagcacaggcactgcagcacagatggctgtgccgaggctcagcagccttgggacacttgtgagtgtggaaacaggtgcctttggcttcttctcgataccccgaggggcaagggccacgtaagctcccatagcctgggcagccagggcgagggccaccgcgactagacccaggaccatggatgtcgtgccaaattgggtccactggggtcgggcaagccgcgaggcgagctccaggaagtccagcgccctgacgcggggattattggtagagggagtgttttgggggtggaggttgcaacattggtgagtacttgcacagtgacgggcgtgggattgcactccactctctgttggccttgtctgggtgtgcagtcatggaactgcctgaaaaaccggctgccccctcagtctcacctgccggcctcagcctcgcttcccttcttgctggtctcgcgatcaccgagaagatcagcatgctcctgcagcacccggccaagcacctgcttgggaaagtacgctgcgagtgcatacgcctccaggtatctcaccacctgctccacgtttgcccatgcggcgatttccagagccttgccgttggaagccccgagttggaagannnnnnnnnncctcaccacctgctccacatttgcccatgcagcaatttccagatccttgccgttggaagccccgagttggaagaggtcgcgatggaccctgccgaggttgcagtagggagtgggcaggcccagcagcggcgccagcgtggccgcaaaatcggcctgcaccatcacgcctgtgactggtattgggaagcctgctgatgcttgtgctgctgtctgggcgggcgggctcctggccagagctcccaggctgacagcgaccagggcggagtccacctctgggtcgcttccgcccccgtgctctcccgtgagggtctggcctgggttattcgaggtggccggggatggacaaggtgagcttgtgtgggctccatcaacaggatccctcgtggcaaaagcaagccacagtccgggattcctcaggaaagcccaggagcgtgggtcttgagtcgctggtcgccnnnnnnnnnngaacaggatccctcatggcaaaagcaagccacagtccgggattcccttggaaagccaaggagcgtgggtcttgagtcgctggtcgccacgcctgatcccacccatgccagcccctcccatcatctccgtgccacaccagtctctcacgctcaccatggtcccccagcaccaggagcagcgtcctctcataggtctggccgggccccgccgcctccagcatcgcatccacccaaccccgcaccagggcatccgtctgcgccagcttgcnnnnnnnnnngaggagcagcgtcctctcataggcctggccgggccccgccacctccagcatcgcatccacccaaccctgcaccagggcatccgtctgcgccagcttgctcagcatctgggccgaggcgacgccgtgggcatggcctgcatggtccacgcccagcgtgtggccgatcagcaagtcccaggaccccggcgcggccaggagggcgggcagctgggctgccactccctcgtccaccgagtgcaggtcccggacgttgaagcaggggaaggggtgcgcggccgaaaactggcgggggaagagctgggtccacgtcgcgtcccccacaaacgcctggaaagagggaatggcggggggcgggggtgtggaggatggagttgaggtcacgcagccgaggggcagcatcccatggccattacatgaacactcattcgagtgagtacagacacagtgacnnnnnnnnnntgtcccccacaaacgcctgggaagagggaatggcgggggcggtaggtgtggaggatggacttgaggtcacgcagcgaggggcagcatcccatggccatgacatgaatactcattcgagtgagtacagacacagtgactggaccagagaccagcagcggcctgggaggtgcctctgcgtgttctgattccgatgctgttggaatgcacaggagcttgtcacatcccagagccatcccaacacgccaccacaaaggcacatcccagtgcccctgccaacccaccacacgctttccggccgcgacggcctgatcaacgaggttgtcttcgtccaagggcccggcagaaaagctgttgccgatgtcaaagaaggacggcagcccgccggtcatgaggcacttgaggcgctgcagggtggtggtgggagcctctgccaggaagcggaagctgcgggctacctttgcctgcgttgagggaggggcccgggggcgagcagcagtaatcttgctgcagcaaggctctcgttgcagcgtcgagatccatcttgtgcctaggcgcacctgcagnnnnnnnnnnaaagctgcgggctacctttgcctgcattgagggagggggccgtgggcgagtagcagtaatcttgctgcagcaaggctctagctgcagcgtcaggatccatcttgtgcctaggcgcacctgtagctctgtttgggcacttgcagcagaccaccaacacccacttgctcccagatgcctctcacatcaggatgctgagccaggctgctcaggaagggcatctgcccttggtggcagggcactccaggctcgcactggtatcggccgtccgcaaacaccatgtcataccgcaaggcatcgatcaccaagatgactgcccggtcaaagggtgctgagctgttgcccgcaggtgagggtggagatcggtccgggaggtgcacgcgggtaaggagaaacccatttatgaataaggctatgcccacgagatggagtgcagtgtatccgagcaggcatcggagggtgcgtcggtggacactggggaagggagtggctgattccgtcctgcccagctcaagggcaggacgccgcgggcattcctgctgatcagcagcggcaagcatgcccgctgtttggatctggggtctacatgctacgacttatagtgagttgttgtcgtaaacccgtctgccagcatgcatgtcaatattcgaattgcatgctgcgcggaatccttgtcggcttctcattccatgatcgcaagggatgcacgcactgcacannnnnnnnnncattcgaattgcatgctgcgcgaaatccttgtcggcatctcatttcatgatcgcaagggatgcacgcactgcacagtgaacaagacaggattcaagaatggccattccgtgcacatctcgatacatattgtatttgcccaggacatgcctgcatggagtcggcgtcgatcctcgcgaggctctcatcatgtgcccatgcagggtcgaggcccatggatccagccatgccgtgcttgagagcacgctctgcacggatcaactctttcaaaaggcatttagttcaacctcagcgcgattccgtggcgcatgtcgacgcttcagaacggcaggagctcttcgactccatctcccccatgtacgaccgcctgaatgatgtgctcagccttggcctgcaccgggtctggaaacgcatggccgtcaagtggagcggcgcgaggccaggggatcgagtcctggacctgtgttgtggcagcggggacctgactttcctcctgggcgaggctgtggggcccaggggtcaggtgggtgtggggcctcagttctcgcatcggagagaggagatccccagcgcctgcgctgtccagggcccatcggacgtgcaggccgcaacccaaaccacactgatnnnnnnnnnnagagagaggagatttccaacgcctgcgctgtccagggcccatcgggcgtgcaggccgcaacccaaaccacactgatctccagccatgaaccctcgcccgatcccaccccaaggtggtcgggctggacttctctggggccatgctggccagtgcggcgcagcgtgagcttgaccggccccgcttcgaccgcctggtgccgcccctgcaatgggtgcggggcgacgcgctggacttgcccttcccagacgccagcttccaggcggccaccatgggctacggtcttcgcaacgtgacagacatcccccgcgccctccaggtgtgtgtgagaggagggaattggagattcgggcggacctggccccggcagcgtcagcgatgcaggagatcagcctgcgatgggtggacccctggaccaatgcagccctcagcacttttgtctgcatacccttacccgaataaagtgttctccaaatctctccaccccccttgcccgccaggaactgtaccgggtgctggcgcccgggggcgccgccgccatcctggactttaacaatgccgtggaggacagccccgtcgccgacggcgtgcagagcttcctgctggggacggtggtggtgccggccgcccgcgccctgggcgttgccgagcagtatgagtacctgcgcccctccatccagcgctttcccacgggtacaagcggcatggggatggtactgtgcgaacgttgaccgtctagtttctccagcttgctcttggagtgtcgctgtgacctcgtgccggtcccacgctgccccccactccacccccactcccttccacgcgcaggccggaagcaggaggcacttgcactgcaagccggcttcgcccaggccacgcactacaccctgggtttcggcatgatgggcgtgctggtcgtggagaagcgctgacatggtgcgccccctctattgatcagtctttctctgttcctgagccactcctacaacattctacagcctagtgtacagtcggcgagagggtaggagagccagccaagtgggcctctacgtctggctgaccacctggacccaggtgcctcgccggcctccgatcccctcacgcctgccccgccgcgtcggccttctcgccgtcctggaggtgcttggtgaggtagaactcgcccgcgcggtaggaggacctgaccttgggcccggcggcgacgtacaggaagcccatgccctccgcgatgtcctggtaggcctggaaggcctggggggtgacgtactcggccaccgccatgtggcgcttggtgggccgcatgtactgacccagggtgaccacgtccacgcccgcctcgcgcagcaggcgcagcgcggcggtcacctcgtccggcgcctcgccgcagcccagcatgattgaggtcttggtcacgcgaacaccgcgctccttggcgcggcgcagcacgcgcagcgactgctcccagttggcgcggcggtcgcgcaccagtcgctgcagccggggcaccgtctccacgttgtgcgcgaagacgtccaggccggaggccgccacacggtcgacgcaggcctggtcgccggagaagtcggggaccagggcctccaccagcaggcggccgtccgtctcccgcttcaggttggcaatggtggcggcgatgtgggccgacccgccgtcgggcaggtcgtcgcggtccaccgaggtcagcaccacgtagtcgatgccccaggccgccaccgcgcgcgccgtgttggccggctcctcggggtccagcggcggcggtgcacgcgaggtcttgaccgcgcagaagcggcagccgcgcgtgcaggtgtcacccatgagcatgatggtggcggtggccgtgtgcccgtccgccccgccccagcactcgccgatgttggggcagcgcgcctcctcgcacaccgtggccagcttcagctcgcgcagcttggccttgatggccgtgtacttggcaccgccggggacctcgcgcttgagccagtcgggcttccgcgcgcgctcctgtgtatggtgtacgtgtgtaaactcgagggatgggagaaccttttgcctcgtcactcaacatgatggagaatggaggatgggcagaagggagatcagccataccccctacgaacacacctttggtgcgggggcatggacagagtagccggtgaggtcgggcccctgcacgaaggtgtccagatcgggacctgcggcgagagagcaaagggagagggtggtgtggatcgcagcgcagggccatgcacggtcatggtgcaggtatcccggacggacatccactcccagaaacccacgggccacctgcataccctctgccaggcgcttgcgcagggcctccacggccagctgcacctctggggcgggctgagaggtctttgtggcaccctcgagctccgaggcggacaccgcgctggacacgaacatccgccgggccaggcacgagaggcccctcgcggcctcccgctggacagccaacatgctggcctgcaggacctctgccaagagccgttggcaacccccttttcggtaagaagagggtgtgtgggaaccgtttgagccctggaccggatcacatcaatcgtgaagctcaggatgtgcgaggcgagggtggtatgctgaccgtgcttcggcccacgtgggcgcgcgcatgcaaggggagatgggcaatggcccaccatgcgcgcgatgggagcgcactgggcactgagatgtgaaagagtgtggcttcattgacatatgaatttggagtggaccttctggtaagcaggcttctcgctgcttctgcgaagtgccccggctcgcagccccctggccgtgtcaggcacttgatcaccacagcctcgcggtccctggacgacaccgctgtgaataaaagcatctcaacatggcggatacagtcaggtgctgctggtgctccctgtcgtccagtgtcgagccaccatcactcccaccacctgcagcttgggggaactgcatgcatgtcaggcacaaacccagcaccgccagctcaacctgcaaagtctccgtaccccaatgcccaagtccatcccnnnnnnnnnncctcccaccacctgcagctcgggggaactgaatgcatgtcaggcacagacccagcaccgccagctcagcctgcaaaatctccgtaccccaatgcccaagtccatcccccaactcccctctccaaggtacctgctggagggcatggtgcccgagctggacgacctggagaagcgaggctacttctcccgcgccgagctggggcgagtggtgcagaagcggcaggagcacgagtacgcgctgaagcgctccgcggcgcgcctggccgactaccgccgcgccatcgcctttgagacctcgctggaggagctgcgcgtggcgcggcgccgcgcgcgcggcctgtctgggaagaaaacgctggccgaccactgcctcgtccgccgcgtgcacttcatctaccagcgcgcgacgcgccgtttccgcggcgacctggccctgtggggcgactggctccgcttctgccacgccacgcggtccgggcggcgcgccagccgcgtgctggcgcgcgcgctggcgctgcacccacgctgcgccgcgctgtggacccatgccgcggcctgggagctggagagcaacgcggacgctgcggcggcgcgggcgctgatgcagcaggggctgcgcgcctgcaagaccgacgcgcgcgccgccgccgcgctctggcacgagtactttcgcctggagctcctggtcgcggcgcgcctgagggcgcgccgtgcgctgctgggcatcgacgggcctgctggggcggggggcccggcggaggagcagggaaagacaggagatgccacaacagacggggcagggcgtcccgacgaggcagcggcggcgccagctaccaaagacagcgaggccgaggcggcgctggccgagatcatgcgcggcggcatcgcgcgagtggtcatgcgctccgcgctggcgcaggcgccgcgcgacgcggccttccgctcccgtttcctcgacatcctgcaggagatgggggagttcgagggccgcgccgagattgaggtgggctgaatgtgggggttggggtggttgggttccaagcgttttgactgtgtgggctggcggagtgtggcgagcaggggtgggtctcggagacacggttggccccctctcactctgcaatccctcccccggattcccactgctgccgtcgacgccctgctcgtggtcccgcaggaggagatctacgctggtctggcggctgacctgccagagagcccgcaggcgtgggcgctgcgcgcccggcatgctgcaccgagcggcgatgctcgggacgccattgccgccgggcttgaggtatttgagcggggcctggccgccgcgccctcccccggcctctactccgaggcggtggagttcctggtgcaggctctggagggcgacgctcctggcgccgacgagaccctggccacggcgtgcgagctgtgtcgcagggtgcgcagagctgtggctttttgggtgtggtttgggttcttgcgtgtgcatgctcgcttggcctctccccagatccattagacacgacgcctcgtcccacccccctctaccaacaggccggcgaggcggggcatggctccgtgcaggtgctgctgacctggagccagctgcgcctgcgcgtcggcgacctggcgggggctgctgaggtggcgaggaccgcggcgggcatgctcccgcaggcgcccgagctctgggagaccagcctgcgcctggccgtggcggtggcggcggcggcgtctgccagccgcgatgccgagcaggccagcggttgccctactacgtcccatggagacagcagtggcgatgacgaggaggccgatgcgccgggaccctcgggccgcgacgacgcgctgatcggcgccaccctggaggcggtgggtgcctgcccgaggagcgagggcctctggctgctggccgttcagtgcctggtggccgccgggcacaatccaggcatgctgcggacccagctcgaggtcgtgctggcccagggcccgcgggggcccaccgaggtgaggaacgaggggggagagcgggtatgtgtggggtggttgggtatgggggagtgcccctcctgctgcaccctctgcatgaacgacgggggcggccaagccgtttgcacttgaggaccgctgctgtgtgggtgatgcaccctagctaacactccagattgtgaatcgcacagggcggcatgggagcggtggcggcggcgctgttccgggcggtggcgctcgtgaggtcgccggcggctgcacggaagctttacgcgtccctgaggcacctgccctcccccggcggggagttctggcatgcggtgctcgacatggagcttgaagcggccagggcggggcgcggcgacgagctgccgcggccgcgcatcctggcgctgtttgaggtgggttggggcggcgagggcgctagggtgattatggggctttccttggttgccatatggcccaagttggggcattccctcccaacccctgtgcacaaggagaaccagtcctcgagtgggagcgagcgcgcatgtattcacggctattccccgctagccgctgccaaactcggctccatgctgatcgcatataaacctcgcccatggccacgcaggctgccgtggacgcacatgggcaggaggacgccgacatgtgggtgcggtatatgcgctactccgcccagccggggtccaagggcggcaccgggtccgtttactggaaggccgtcagggctctgcagaggcccgctggattcgtggagcgctgccagctggagcgactagcctgagttccaacggagttgatgcttcttagcatgcacctgagtccctcaaccccgtatnnnnnnnnnnggcctgagttccaactgagttgatgcttcccagcatgcacctgagtccctcaaccccgtatggcacaccccatgtatggcctgtgtgctgcgtagcccatgtagagaagaggtataccgtctgtaaagggtccgttatggagacgtgtcaatgacaagcagagnnnnnnnnnncaacccatgttgagaagaggtataccgtctgtaaagggtcggttatggagacgtgtcaatgacaagcagagctgctcagttttcagtcggcaaggggggtgtgggggatgcactcctggccctgcttggcgagtgggggacatcctcggcctctgcagcgggcaggggcggcggcgaatgccgctccaggtcctctgccgagcgatctctcccggagcgccgatctgcctctggtgatctgtcccttccagatcgccgatctgcctcaggtgatctgtctcttccagatcgccggtccgcctctggtgatctgccccttccagatcgtcggtccgcatcaggcgaacgtcgcctccttggactcctggaccggcnnnnnnnnnncttccctccgcgatcgtcgatccgcatcaggcaaacgtcgcctccttggactcctggaccggctatgtcgccgtgatttccggtctttcttgtgtcgatggcggtcttccctgctgtcgctgcgatggtgccgcctggaggtgcgatcacgggagcgatcgcggccgctgtgcttctccctgtgcctgtattgttgtgggaggggtggtgtgcctgccgttgtttggagggtatatggccgtcgccatgcggcatgtcaggctccccaaaggggacaatcccacacctacgacttgcctgctgacgccannnnnnnnnnggctgtgcttctccctgtgcctgtgttgttgtgagaggggtggtaggtctgccgttgttcggagggtataaagccgtcgccatgcggcatgtcgggctccccaaagggcacagaccccacacctacgacttgcctgctgacgccatcgtcgtcatcgccgcgcatgcgctcttcgaacctcccaccatcatcctcccggcgcagcctgtgcacgctgtcctccaggtcccgccgcgccgcatttgcctgcctgttttcctcatcccgcttggcctgttcggccctcagccttgcctgcaaggggaaggttggcatccagctgagtcgcatcaacttaacacagggtgatatatgtaccaggatccgcagcacatctcgtacaatcgctgtacatgctggacaccaggaggagctcgcaatattacaactatctccctacaatcgaaagcccttcaccagtattaccacccttcaaggctcacctggattcgctcatcttcctcgcgacgaaggcggagctcttcggccttctcatcaaggaacttctgaggaataccagtcgaggactgcgccgcgctgctcaacagcgtccagagttcctaagaatggtcaaggcgcagcggatgtggattgtggagggagggaaggggccacatacgcagactggcggggcaacttgctgtgcagaggcaacgattcaggaacactcatcatgatgccccttactctggagtacagacagcacactccactccctctccaactctgctcaccttgcaaaagaggctggtgttcttctccaagaagcctgtaaggtttatttggagcttgcgagggtcgatggtcttctgaccctccaactgcccaaagatgtacccgatgaggacatcgtcttcgatgcccagcaactccgtcactcgcttggcaatccagggcttcatcacatcccagtttaccctgctgaggtccaccttggtcttatactcctcagggaacttcatctgcttcatcagccggagctccttgttgcggaaccggccatcctgctcggccgacactccacgcaaacctggtggttgtaggattgtgatcggcctcgtcacagatgcaagcgatattgcatcgtgtccatcctgggagttcaccctccccagtcgcacctgccccgctcatcgcaccccccttgcaaggggatagtgcacagctttggaagccaggtgtaaaagggccggggaatcagtgtttgtacgaggagataataaaccaggttatgcttgctagcaggcttgcctcgctccccgtatggtctgcccggccgagtcgcttgccgcagtaccgatccagcaggtcctggttacgatggtcgtccagagcccgtgccccacgaactcgcccacaaagtgatcgcctgggtccccaaacggggcgaaagcatgtctgcatctccctccctgcatctgtaccgcagaattattagggaagcgtcctccttgacacctccacccctgcagcgaaagatcgccaggaacgtgagagaggcattccagcaccaccgcaccgcgcctgctgatcggttggtggagctgtatgatgccggagaggctgcgatcacggtgatccggtggatcaagcgcttccctcaggtcggtcgtgagcgtcggtcttgggtgggggccggtgggtgctgttgggcccagaggaggatgcccaatgcccctctccccagcccgccgcagaaacacagacatactgctgcgtagcctcccatcatccctccccctctcccactcccttctcaagcaggaggactacgccgtgttgctgaagcacttcctgcccgggacgcgatgaccagcccggcgagcctggtcaggccctgcctggagaggatcgcccagaacgccaccgcccgcaagcaggcgggcctgcgccaggatgtcctggccttgctggaggagctggactcggcgctgccgctgcagccggcccagccgcccgagcagcagcgtgccgcgtcgcccgcgcccgaggcgccgcctgcacggccgccgcgcggagctgcgcccggcgtgcgtgccgggctggccgaggacccggagtctggggccttccgcctcacactccgcctcgaagacgacgacgacggcggggaggcggcgggcggcgaagacggcgaggcgccgctcgccgaggaggcaggccggcagatgacgccgcggcagcgcggcnnnnnnnnnntggcggcggggaggagggcggcgaagacggcgaggtgccgctcgccgaggaggcgggccggcagatgacgccgcggcagcgcggcggcgagcaccacccgggcgcgctgaccgacgaggccgccctgcgtgagtctggctgaggcttgctgcgacaggggcgtggtggggcgggggagtgagtgcccggagctgatgcaatgctgctcccgatgagggcggctgggtgggtgtgggtccacgtatgagccacgatggtgcgcccgctgcagggccacagctgcatgagctggtaccggggggagtttctttgccacggtggaccacacccctcctcactccttcgccccttgccaccccacccaacatcaggcctgctggaggtgctggcggcggccgtggacagccggcgcaccgtgctggtcgaggcggcgctggacgcggtgcagcgcctgatcgcgcatgcctacatccgcggcacggtgaccgtgctgcaccaccgcgcgggggggggcgcgggtcccttggaccacggtgcagggggcgagggagccacagcaggcacgtcgacctccgcctccaaccccccggcggggtccgaggcgcggcgcccgctgccccccgccgctctggcggtggacctgatcgtgcgctgcgacnnnnnnnnnncccccccgccggggtccgaggtgcggcgcccgctgccccccgccgcgctggcggtggacctgatcgtgcgctgcgacgacctgggtgacgagggcgtggagctgcgcctgctgtccgcgctgctcacggccgtgaccagcgcggggctggcggtgcacggcgccgcgctgctgctctgcgtgcgggcggggtacaacgtgtacctgctgtcccgcagcgaggtcaacgccgccacggccaaggccacgctcacccaggcactgaacgtctgcttcgcgcgcatggagtcgggcgacgcgcacgaggtgcccccgcccatcatggtgagcccccgtggttgggggttgggggttgggggttgg

SEQ ID NO: 40855 - DNA, 103 bp, Chlorella protothecoides
ggcgaagaagtcgacgatgacctggaggagagaggccagggggggggtgtggggaggcagaggggaaacctgggacgcgcaggtagctcacgggcccagacga

SEQ ID NO: 40856 - DNA, 119 bp, Chlorella protothecoides
gaagcgatggtgcagaaggaagggtccggggcaccgtcccatacccacccacatacaaaaacacaccatagaagacatcggaccggtcgcacctgggccaggagattctcgggaagctg

SEQ ID NO: 40857 - DNA, 61 bp, Chlorella protothecoides
ggcgtgcagcgcgtccagcgccgcgcccccgcgccgcgcccccgcggcctccagggcgccg

SEQ ID NO: 40858 - DNA, 80 bp, Chlorella protothecoides
gatgatagtgcgctccagcctgaatttcggtaacactgctgatgacctggtgtttgtcaccctgattctctcatgcgcag

SEQ ID NO: 40859 - DNA, 70 bp, Chlorella protothecoides
gctggcgcgcatgtagcgccgggaagccgaaccgggacgtgaactcgccaaagctctcctccggacccag

SEQ ID NO: 40860 - DNA, 61 bp, Chlorella protothecoides
tcgagctgtgggaagcatggcatgggcggggggtggcgagcctgtccggtgctcgcgtcac

SEQ ID NO: 40861 - DNA, 76 bp, Chlorella protothecoides
tgggccgtgtgtgacccttccacgcattccatgaagaaacattgcccctacctgggcattgtcgagtgtctgccgg

SEQ ID NO: 40862 - DNA, 105 bp, Chlorella protothecoides
ccccccccccccccccccaggagcctcaaggacccacccactgtgaccctcccaaacctcatcctcctcctcctcatgcgcacaggagggcctggcgtacatctg

SEQ ID NO: 40863 - DNA, 129 bp, Chlorella protothecoides
cgtggtgtcctgaactgctgaggcaaggggccgcaggacgtccacctgcgctggggtgttgggggatggaggtctacatggagcggtggagagcgtgcatgtgtttttcactgtcgcaccttgcagtgg

SEQ ID NO: 40864 - DNA, 61 bp, Chlorella protothecoides
tagaacctttgcatccaggtacctagatttcgaagggacagaggtggttttggaggtttac

SEQ ID NO: 40865 - DNA, 68 bp, Chlorella protothecoides
cgccggggtcgcgcgtctccgaccccgccgccctctgccgtggcctggtcacgcacctggcgcgcgcc

SEQ ID NO: 40866 - DNA, 75 bp, Chlorella protothecoides
gtcggcggagaaggccgtgtcctccagcacacgcccgcagtgggggcagcacctggggggggggggggggggggg

SEQ ID NO: 40867 - DNA, 61 bp, Chlorella protothecoides
ctgctcggccacgcgagccgcctccctggcatgcctagcgtgggggaagggggaacttgct

SEQ ID NO: 40868 - DNA, 61 bp, Chlorella protothecoides
gcgacagctgaaaacaccgaaaccggggaggaggtcgcacaccgccatggagtcaccgcaa

SEQ ID NO: 40869 - DNA, 61 bp, Chlorella protothecoides
ggccgcccgccccatccaggtggagaacgcggtgcgcgtggggcagaagcgtgggcgggag

SEQ ID NO: 40870 - DNA, 61 bp, Chlorella protothecoides
cgtgagccagacgtcgctgcttggtggcaaggacaacaagagcctgaaggctgcagcaaag

SEQ ID NO: 40871 - DNA, 74 bp, Chlorella protothecoides
tgggggtgtggatcgggcgcgccatggggatgagttccccgaaagcctcatctggcttcccggggtcggcgacg

SEQ ID NO: 40872 - DNA, 1519 bp, Chlorella protothecoides
  modified_base (566)..(575): a, c, t, g, unknown or other
  modified_base (780)..(789): a, c, t, g, unknown or other
  modified_base (1449)..(1458): a, c, t, g, unknown or other
ccccccttccctctccacacaatcacagtcgttcattgaccgcggcgagctggtgcccgacgctctggtcctggacgccctgctcaacgcggtgctgaacccggagatcaacgacggcgcgggtttggtgatcgacggcttcccgcgcaccgcgctgcaggtggactttgtcaagctgctgcacgaccgcctgctggcgctgagcgggcgccacgcggacacggccgaggcctggcgcttcccccgcccctccttcaaggtggtcatcctgtacgtggacgaggcggagtcgatgcggcgccagatgcggcgcgcgcagatcgcggacctgcataacaagcgcgtggccgacgcggggacgggcgaggtctgggacgtgcgcaccactgacatcaacgagcagctgtgccgcaggcgctaccaggtgcggggggagttggttgggtgtgtgggttggttgggggtggcagggcaggcgtaatcgcactgttaagaggcgggtgtgaagtggttcgcgacttcctcggatggaacctgcctgtgtgcatgccgcaggcatacaccgnnnnnnnnnntgtgttggttgggggggtgtgctggttgggggtggcagggcaggcgtgaacgcactgttgggaggcgggtgcgaagtgtttcgcgacttcctcggatggaacttgcctgtgtgcatgccgcaggcatacaccgcagagcactggccaggtgctcctcgcccaggtattggacccagaaagtgagaggcccctgcagagcactccnnnnnnnnnntctggccaggtgctcctcgcccgggtatcggacctagaaagtgagaggcccctgcagagcactccccatatgctgcctcctccatccacccctcctctccatctctccccacacatccaggtgttcaagatgcactaccagaccatcctgcggctgaagcagttcttccccttctcgctgatcgacgccatgggcacgcccgaggagtgccgccagcagatcatgcgcgagctgcggtaccaatcctcgctggacctggatgcggcgacctatggcgccatccggcacctgcccctggcccgcgatctggtgcgtgtcgctcgccagcgcctcgtcttccgcctcgactcctacgccaagcgcgccgcggagacgttcggcgccgtcatcagcctgatcgaggcggagctcatcccgctgctgaagacctgcagcctggctgggcacgcggtgtaccgctcccgctcccccgtcctgctgggcgacgcgcgcgcggtggacatgatgatagacatcctgtcggaccgcggcttctcggtggcgcactcggaggaggagcgtgtggtccccctgcgcgtcgacctgggcagcggggagatcgagagccgggcagaaatcgtgcacgtgttcaggtgtggagggtgggggtggggtgggggnnnnnnnnnngtcctcgctggacctggatgcggcgacctacggcgccatccggcacctgcccctggcccgc

SEQ ID NO: 40873 - DNA, 61 bp, Chlorella protothecoides
attctgctgcatcgcagtctcgcaaatccgtagtcttcttcggcacaccccaggtcctcag

SEQ ID NO: 40874 - DNA, 61 bp, Chlorella protothecoides
ggtgccatggcatcggctgaccgagcgcggggccctgctccgggctcaccgcgccagcgtc

SEQ ID NO: 40875 - DNA, 174 bp, Chlorella protothecoides
ctgccgcacaccgccgcactgattgccccgtccccgggacacgcccctccctctcttgtccccccccccagcagcgtacagggccttgcctgcccaatctcacctgcccactgccctacaacctccgcaggccacgccccgggactctcccagcccgtccccggcgagtacata

SEQ ID NO: 40876 - DNA, 61 bp, Chlorella protothecoides
ttgggaggcacccgtgagagcggctgggtgtgcccctcccttctcacaggcgatcgggtat

SEQ ID NO: 40877 - DNA, 76 bp, Chlorella protothecoides
accactcccatcactctccctgacacccactgcacccccgcctccgacacaccctccccgtgaaaagcaggtttga

SEQ ID NO: 40878 - DNA, 67 bp, Chlorella protothecoides
aggcgcactggcacacacagtcactggcacgcacaactggcttcaagccaggcacctgatgatatca

SEQ ID NO: 40879 - DNA, 68 bp, Chlorella protothecoides
gttggcaggcggactctggcgctcaggtggttggcgtgggtgggtggcggagcacttgaaggagggat

SEQ ID NO: 40880 - DNA, 61 bp, Chlorella protothecoides
caccggcgtggacgaccttcgtcgtggccgggcagggcgcggccaggggcacgccggcgct

SEQ ID NO: 40881 - DNA, 69 bp, Chlorella protothecoides
atccgggttggagaagacgacgtgcacggggttggggttgcaggtccctgcgcccggcggcggccgggt

SEQ ID NO: 40882 - DNA, 3303 bp, Chlorella protothecoides
  modified_base (693)..(702): a, c, t, g, unknown or other
  modified_base (996)..(1005): a, c, t, g, unknown or other
  modified_base (2307)..(2316): a, c, t, g, unknown or other
  modified_base (2655)..(2671): a, c, t, g, unknown or other
  modified_base (2845)..(2854): a, c, t, g, unknown or other
ggctcgtggcgcgacctccacccgcccgccctccccgcgcaaggcgcatgagctggaaagggaggcggcggcgggcgccgcgcagcgctgggagcgtgaggccctggtgcgggagctgcgcgacaggctgggccgccccagtggcgtggaggggagtgggggcagcggagcagtttcctcacaaaagcttcccccgggtctggcgagggaggccgaagggagagcggaggaaagcggggaggtctggagcattgcagctgcccggcgcagaccgggctgtgatgccatggcccgagaagggcaggagtctcacggagcagcgagcggggaccaggccaggagccctgcgccgggaggcacggaggcctgcccagagcggtggatccagaatccgctgggcaaggggggcgggctcccctgcagcaccgggtccaggagtgcagctgcgctcgggccacgagattcccagccttcccacacagccaacactgatgctgcccgagaatctactggccgagcatgcagggaaccatgcccccttccgcagccctggaggagcacttactatgccatgcagaccggggcccctcatgaatgcgacgaccagggaatggagatggaggaggggtttgtcaccatagccctggcacggcgcggtcagcaggaggcggaggcacactccagggagctgcnnnnnnnnnngacggagatggaggaggggtttatcaccatagccctggcacggcgcggtcaggaggaggcggaggcacactccagggagctgctgggcagagtggccctcctacagagcgcactgaagcgggtgcggttggatggaacggcgcgtgttcccagcacagatggaggccttttgctcctctgtgcgacccccatgctgcctggtccggacacgtccagaagcggccagacacctcccatcttcactgacataccctgcccacacacacacaggccacgacagatgcgagcgtggcnnnnnnnnnncgaggcttcctgctcctctgtgcgaaccccatgctgcccggtccggacacgtccagaagcggccagactcctcccatcttcactgacacatcctgcccacacccacacaggccacgacagatgcgagcgtggcagagcggctgagtctggatgccacgcagcgacaccgtgctgaggtggcggtcctcaactccaccatccagggtctgcggcaggccctggaaaccagtgccacccccgtcagagtcgtcatacaaggtgggttggcatgagctcaggcggccccatcatgcaggcgggggtgcatgttgctgaaactgtcaggttgcctgacaatgtatggctctataacggcctcatcggacaaatttggacatggggttgttcaacagctgaccctggcgcagagccctttcgaccgtccactcacccacccccgccccattgcccgtgcagtggatcagagcgaggagctggaggcggagatggccgcctgccgggccctaagggctctgtgcgatgacctggagaaggagctggggtccaggcagcagagcacagggcgtgaacttgccaggtagggttgcgtggcagagtggcttgcagcgtcagttgcctgcgggggctggctggaccgtaaggagtcatgtttggccagggcagggtgtgccaggtcttcctcgacactcggtgctccactccagcatgatgccctccgtgccccctgccaccctttctttgctcgcagtgcggccctggcccgccaagcgctggcccgacgctgcctgctgacctggcgctggcgggctcggcgggtcggcatgctgcgcctgctgggctaccaggccacggcacttggcgagcagcgccggctggccgccttgctggcgggctggaaggctgccgtccggcgggaggcggcctgccgccgcctgcgcttggcccgcggcgcatggctgctggccgccgcctggcgcgcctggcgcctgcgtcagcgccagacccgcgtgctcgccgagttggaggctggcgcgcggcgccacgccgaggccgcgctggcgcgccgggccgccagggcctggcaagccctctgcatggacgagcgccagctggcgccggaagacctgccgccggatctggcggccgaggtggcgaggcggtctgtacgcgcggtggcgcggcatgcgtatcagcgctggcggcaggccggggaggaggcgctggtgcggtgcggggaggtgtcggccatgcgtgccctcgcggctcagcggcgggtcctccatgcatggctccatcgagtgnnnnnnnnnnggcggtgcagggaggtgtcggccatgcgtgccctcgtggctcggcgccgggtcctccatgcatggctccatcgagtggcggcgcggcgccacgaggccgcggtcgtcgcacagatctggagggcaacactgacgcgcttgctgggcggctggcggcaggcggccaccgctatgtgcagccgccggcgactgctggagaccgcgtgcgccatgcggctggaccgccgctcgcgggcctggctgcgcgcctgggcggcgctcgccggggcgcgccgccgcgagcgcctgctcgccgggctggtgcgccgtcgtgtggccgtcggcgcactgcggcgggggnnnnnnnnnnnnnnnnncgctcgcagcggcacgctgcgcatgtccagcaggtcatctgggagaggaaggatgccaggcgtgtgaggctcgcgctgctcacctggcgtggcgaggccctccgcggcgccgccacccgcgcccggctcgagctcgaggggtgtcgtgcgcagctgacgcaggcggcgtgggcnnnnnnnnnnacgccgccacccgcgcccggctcgagctggaggggtctcgtgcgcagctgacgcaggcggcgtgggcgctgcagcacagcaggatggagggcggcgagctggcgcgggaagtggccgaggcgggcgccagggaggaggctgccagggcacgggtgagcgaggccggcgaggccctgtccgccgcgctgcagcaggtcgccgagctgcaggagcggctggctgcggcagaggtccaggagggccggctctgggcgcgaacccactccttggaaactcgactggcttctgggcaggaggaggcgtcggagcgggagcggaacggcgaggaggagcggcgggggctgctggcgcgcctgaccgccgccggcgagcggtgccgggagctggagcggctgcgggaggcggcggaggccgccgccggcgaggcgggggcgcgctgcgaggcgctg

SEQ ID NO: 40883 - DNA, 78 bp, Chlorella protothecoides
ctgtgctgtcaggtggcgtccagcggacagccaacaccttcccagtcaagatgccgagcgcatgtgcccatgaggtgg

SEQ ID NO: 40884 - DNA, 82 bp, Chlorella protothecoides
caggatgcggcagggcatgtgggggagggctaccgcagccagcaggcggaggccgcgcgctgtgcacgctgcgcacctggcg

SEQ ID NO: 40885 - DNA, 61 bp, Chlorella protothecoides
gccagccccacgtcggtgcggccgtcgggggggaagacgcgcaggcgctcgtcggtgtcca

SEQ ID NO: 40886 - DNA, 161 bp, Chlorella protothecoides
agggccagggggtcggcgaatctgagcgggtccacatggggggccgacggcggcgttgatggagctgctacggatggagccctgaatcgcaggcaatcctggagcctttcacctttccttgcagggcgcgcaccgagcgtcacctccctcacccaggcccc

SEQ ID NO: 40887 - DNA, 61 bp, Chlorella protothecoides
cgtcgaaatgaggctttgaatggtggcattaaactgtgagccatcccaggaagaccggatt

SEQ ID NO: 40888 - DNA, 5124 bp, Chlorella protothecoides
  modified_base (1800)..(1809): a, c, t, g, unknown or other
  modified_base (2246)..(2255): a, c, t, g, unknown or other
  modified_base (2483)..(2492): a, c, t, g, unknown or other
  modified_base (3622)..(3631): a, c, t, g, unknown or other
  modified_base (4093)..(4102): a, c, t, g, unknown or other
  modified_base (4159)..(4168): a, c, t, g, unknown or other
  modified_base (4275)..(4284): a, c, t, g, unknown or other
  modified_base (4683)..(4692): a, c, t, g, unknown or other
cccccccgtcggcccctgcgcctcccccgcccagcgcaccgcagggagtggtacaggcccaccaggcgcaccacgcacccccctgccgcccgcacgctccgctctgcgcgcagcaggcggtcggtgcgcggcgaggcccccagcgccacgaccggcgagtcctcgcgcgccgcctcgcccccgtccacggcgtagaccgccgcactggaggtgaagacgaaggcgccctcgccgctccagcgctccagcgcgcgcgccacctcgccggggtagtcggcgctggcggagggtggggccgagaagaccacgtctcggaaggtggaggttggggggtcggccagggagtgcggcgcgatgcccagccgccgcagcctgtgccagaggggtggggcgtggagtgtgaggggctctgggctgtggaggagaggcgggggcgcgccctgcgtgttcccgggaggggtttcaaaggcaccctgcacccgtccccctgatgcctccatggtaccatgacgccgctcacacccttgcatggacaagggtgtacacacaccgggcatggttggagtccgtctgcgtcaggccagccaccgtgccggggccatgagcgtccatccacagcttggcaaggtgctggcctagcacacccgggcccaccaccagcagggacgggtcggacccaggtgctgcccctgcccttgatgccccagatctcgagtctctggaggtgctggtcgcgggaggggtgcgcagggccggggagaggccggtgccgtgcctggggagggcgccagggccgagtggcccggaggcccggaccccaccagtgtgaagcagaggtggggacatgtcgcaccctctccacctccctgcgcttggacacgactgctaatcgggaatgtaccgagttccgggttttcaatcaggcgatcagctgccttgttgggatcggtggggttggagatcgctccagcgcgctctgggcgggcggttcggataaggcccagggcagccagggcgctgggagccccgcgcagcactcgtgctcggacccctatgcatggagtggcacctgccgggaatcagcttgggtattggacctccactcatattcctcatatgcagtttgatctcgacaggcagtgtgtcgttgcattgctcacgccagaccaccggcctatcgctcggttctcggcagtttgcacacctccatcgccaggctggccggcctcatgaagcacgcctccgtgtgatcgagtggtttcccaatcattgaggccagcggtcgcatatcgcagcgctgtgcagggccacaggcggccatggttagcagtgtcaaggtgcactgcccgaggaccctccccccggccggccgagcacggcccctacctcctgcggcgctcttccgcccggggaaatggctgcatttgcccagtcatggacctgccttccgggcggagcgcccgcagcgtccagccccaaagcatctggtccatgcgctgagcggcaacaacaggaacggccatgcctcgtctgccggcgatgcagaggtggaggaaggtaggcagggagcatccttggtgggaggcgggacctgtattcggtcttggcctggcgcgatagtgggttgtagcgttgctgttgtgggcgtggacatattcatcaggtggccccagcacctgctggccttccttaacccccctctgacccccccgcatgcagcagtgaacctcgatgacatcctgggtcagggcgagggcaccccggctgcggcacaggcaggcgcacaggcgtccttggagnnnnnnnnnngtattcatcaggtggctccagcacctgctgaccttccttaaaccccctctgacccacccgcatactgcagtgaacctcgatgacatcctgggtcaaaacgagggcaccccggctgcagcacaggcaggcgcacaggcgtccttggaggacgagtatgaggatgacgatgaggtcatcggcttggatgacataatccagggccacctgggggacgaggagggcgaggacacgggtgaggagggcgtgggagccctgagggatgttgggtgggattgatgtgtatggcagccctccccctcgggtgtggtcgtctgatgtcgtggcggcggtcgctggctgcgccgagacccagtgctcaccttgagccgcccagggacaactccgaccctgcccactcccaactctaccatgcctccagacccggaggccgagtctgnnnnnnnnnntagccgcccagggacaactccgaccctcccccactcccaattctacccatgcctccagacccggaggccgagtctggggacgagctgctggatgacgcgccggagggcccccccgagctgcgtcgcaatgagtaccccgagccacccgagcggcgctggcggctgcacgacctcttgcaggcggccggggtggtggcgctcgggcccgatggcgcggagctcccattnnnnnnnnnngaccaggccctgtatgtctgcgtccccgccaccgatgccgacgccgacgggcacgactttgctgaccgggcgcccgaccagggcgccgtcgccgtgctggcccaggcggggcgggaggtgccggagtgcagcgtgcccgtgctgcgggtcgccgaccccgcggccagcctgggccgcctggcggccgcgttttacggtgcgtgcgagggagtttttcgttgatgggggaggtccttgctgcgctagcaggagagggtgttggaaggcgactcagctgggtgcaatcggacccggctggagtggccaatctcctgcagggtttccagtccctgaccctttgtccctcacatatggcggctgttcgtgccatgtttggcagccaggaccagccatcctggggggctgcacatgcgtgcgggtcgccggcctcggcccaggcccagacagggccctcgctcaccgagcctggcatccccccgtgtgcgcagggaaccccagccgcagcctgaagaccgtggcattcgtggggacgcacggcaagacgaccgctgcctggctgacgcggggcctgctggaggaaacgggggcgctgacgggcatgataggtgtgtgcggccagggtgtgccagaggcgtgtgctcacatcgcccgtcgtcacgtccttccctgggcgcctgcaacccagggcccgaagcagctgtgtctctgtcccgcccagccagcacggctcagtcgcctcttactcccccctccaccgtcgccagggacgatagagtacgcgatcgcagaggatcggctggacgaggagggggcgctgtgggcgcccgaggaggacgacccctctgcggacagggagtcgtcctcccccttccacatcctgccctacgagggcaagtacgggtgagtcttgcagagacagggactggggggctgttgtggcctggtgtggaaagacttggctttgtgaaataacaacaggttttggggcggcaaagcacatctcgtgcaatccctgggacgtgtcgtggacaggccaaagcggtttgcattgtttgcagctggaccaccacccctcttgtgcatttgcatgtgcacctctgtgatgctccgccaccctggaacctgaggannnnnnnnnncacttggctttgtggaataccaagaggttttagggcggcaaagcacatctcatgcaatccctgggacgtgtcgtggacaggccaaaacggtttgcattgtgtgcagctggaccactaccccccttgtgcatttgcatgtgcacctcagtgatgctccgccaccctggaacctgaggactcctccctccgtggtgcatgcgcaggtgccccgagaccacaccggaccccctacacctccagaaagtgctggctggggtcaaggaccggggcgccacccacgccgtggtggagctgtcgctccagagcctcatacgggacgagtgggtgcagggacgggaagggagggtggggatcatggagggggcattgctggacgctggccatctgtgactccacaaacagattcgtttcagctcacaatcctcaagtgccccccactctgaccacacaccagtccctctnnnnnnnnnntgtttcagctcacaatccttacgtgtcccccactctgaccacacaccagtccctctnnnnnnnnnntgacgacctgcccgtgggtttgaccccggcggcctgctgccaagcgattcagcaggcttttgcgcggctggcgcctggcagcacggccgtgatcaacgtggctggtnnnnnnnnnngcctcacagcccggtgccggagatcgcccccgacgtgctggtcttcacttgcctcctggacgacgacctgcccgtgggtctgaccccggcagcctgctgccaagcgatccagcaggcttttgcgcggctggcgcccggcagcacggccgtgatcaacgtggctggtaagggtggcggactcgcccgtgatctccggggaggggtatgcgtttttctttgccggcatgcgcccggggcggacgcggcgagggtcctctgcgccctgaatccccagacaaactcatgtttggttcataccatccactcccgtggtggcacaattcatcgactcccgcctccacatgtttcccctttgaatcatccccctgtccaagtcatcacgcagacgcctttggagcnnnnnnnnnnctccacattatttccctttgaatcacccccctttccaagtcatcacgcagacgcctttggagctgagctggcggcgtcggtcgcggcggcgggccgcgcgcgtgtcctgcgcatgtccaccgcccccaccccccccggctccccgcccgccgacgtgtttgcggagcggaccaagcacagcatctgggagagcgaggtggtggtcaccacccccgccggccgcctgcaggtcatcctgccactgctgggcgcggcgcacgtgggcaacgcgctggcggcagtggccgccggctgtgcgctggccatcccgctgccggcggtggtggcggggatggagggcgtggacgtcatccccggccgctccgaggttatcgacgagggccaaggcttcagcgtggcagtggacgcggcgcggagccccgccggcgtcgc

SEQ ID NO: 40889 - DNA, 70 bp, Chlorella protothecoides
gtgcggggtctgggcatcgcgcgggcgggggccgcccagggagccacgcagcttccagctggcgcaggcg

SEQ ID NO: 40890 - DNA, 64 bp, Chlorella protothecoides
ggtgccctcccgagcaagcgtcagtcgggggtgagtgggaaaacaatcggaaggtacacaagtt

SEQ ID NO: 40891 - DNA, 61 bp, Chlorella protothecoides
catcggcacgagggtacaggggctgggaggggaggtatgagggcggggttgcaggacaggc

SEQ ID NO: 40892 - DNA, 62 bp, Chlorella protothecoides
gttacaggcaagaccccgaatacggtgaggcccttgggtttcaagcacggtgccaggcggcg

SEQ ID NO: 40893 - DNA, 61 bp, Chlorella protothecoides
cccccagcccatctggtacgaggactgcgttgcggaggacctgcaccaggccagggtgagc

SEQ ID NO: 40894 - DNA, 61 bp, Chlorella protothecoides
cggcgcggagggtctggaggggggggaggaggccggcagccagtcgccggaggacgaggag

SEQ ID NO: 40895 - DNA, 119 bp, Chlorella protothecoides
aaggaggcactggataggtgtgtgtgtgtggtttggtcaaggggaggtctgcagcttaatcagtgtcccactcgattgagccgtgtggctgctgctgctctgttcacactggcgtcggc

SEQ ID NO: 40896 - DNA, 61 bp, Chlorella protothecoides
tcccaacttgaatgtacggcttgccagggggctggcttatctcacaggtaccgtgtcttgg

SEQ ID NO: 40897 - DNA, 6115 bp, Chlorella protothecoides
  modified_base (97)..(284): a, c, t, g, unknown or other
  modified_base (529)..(538): a, c, t, g, unknown or other
  modified_base (784)..(793): a, c, t, g, unknown or other
  modified_base (1049)..(1058): a, c, t, g, unknown or other
  modified_base (1542)..(1551): a, c, t, g, unknown or other
  modified_base (2256)..(2265): a, c, t, g, unknown or other
  modified_base (2706)..(2715): a, c, t, g, unknown or other
  modified_base (2785)..(2794): a, c, t, g, unknown or other
  modified_base (3711)..(3720): a, c, t, g, unknown or other
  modified_base (4950)..(4959): a, c, t, g, unknown or other
ccctcccccccgccattcgcacctggagcgccatctcggcctcggcctcgtacaggcgcgccaggtcggcctcgctgcgtgccgtggtggcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgggggctggtgcaggcgccgcggcctcctcctccacctcctcctcctccacggccaccacgctctccagcaccagcacgctgttcaggttcagggtcaccttgaccttgagcttggcgctctcggcgccggcgggcaccgcaaagggtccgatcttgaaggagcctgcacgaagttggtggcaaggaaaggcgtgagaggacacggcaggtggtgcgaccggactcagatgtggcacggtannnnnnnnnnaaaggagcctgcgcgcagttggtggcgagagaaggcgtgagaggacacggcaggtggtgcaaccggactcagatgtggcatggtatggaggcacttcccacagcatctggcaggcctgcccgtcagcctgcccagtggctgctgcctcggccatgcacgtcgggccacgactcggggcgacaccaagccggtgcactcctcgacagcacctctcgcagcacccgctgaggaggcatggcagccccnnnnnnnnnnctcggctatgcatgtctggccacgactcgggacgacagcaagccagtgcactcctcggcagcacctctcacagcacccgctgaggaggcatggcagccccaaacggcagtccctccggagccgtgcggccactctccacaccctcctctccaaacacgagccctccatgcccccaacacatcgcccctcccccctggacaaaccaaccgacccaccaatccgcgtgtcggcggtgctgggcaggtcggactccggnnnnnnnnnncctccaaacacgagccttccactcccccaacacatcgcccctccccccccccatgcaaaccaaaccaaccgacccaccaatccgcgcgtcggcggtgctgggcaggtcggactccggcgtgtaggccgcctcgatgtcaaagggctcggtgcggtagaaggtcagcatcttggcgcttggaacgtgggacccgcgctcaaacacggtgctggtcacacgctcgccctccttctgccaggtgagctggatgccgtaggggaaggtgtcctgcacctggaagtcacgcaccctgagatgggagtgggggtggaggggtaaaggcttgagtgcaggctccaggtcgtgcagggcacaatgatggtgtgctactgcgagcaggtaggagtgagaggggaggaccgcccaggcaggatgcattggggtaccgagcttgcagctcggggtccatgcattacatctgcatgtctgtgagcatcagcctctnnnnnnnnnngggtctgggtgcgggctcccaggtcgtgcagggcagaatgatggtgtgctactgcaagcacgcaggagtgagagggggggactgcccaggcaggatgcactggggtgccgagcttgcagctcggggtccaggcaccacatctgcatgtctgtgagcatcagcctctttcccactgaagccctcaggaccctctgtcaccccgcaccttcccacacagcctcagccacaccacactaccccctacatccctgcgccccacctcctcccccccaaaaaaacaacaacacaggccatgcagcgcacttgaaggccggggagagcatggcgcactgcagcgcgcagcctcgagacacggtctcggtggcgttcagcgtgcggttgggctcgcgcccaaagtagtcggtgacgtggcgcgtgacggccggcacgcggctggacccgcccacaaactcgacgttactcacggtctcgggggtcagccccgcgtcctccacagcctggagttgaagcaggaggggaaacgggggtggagtagcgattgggatgcgcaggcaggcacctgacctgctgagatccagttgtgcgcgctcgatgcagccaggccccgtcttcccctctccatggcaaccacagagtcgccgcccctcctcccccaccacaaaaacaaacaccagcacacaccttgcgcacggtctggaccagctnnnnnnnnnncccgcctctcctcccccaccacaagaacaaacaacaacacacaccttgcgcacggtctggaccagcttgtccagggtggccttggcctcctcctcaaacacctcgcgtgtgatggaccctgccacgtccttgtcgtcggcaatgcactccacgctgaccaccgcctcggggttggtggtcaggatcttcttggccttctcgcatgcgccgcgcaggcggaagctggcgcgtaggttgcccttgatgtccagcttgtacttggcatcaaactccctgttggttgtgagaatggagaaccgttggtgagtaggttgaaagcggggttccggcatgggagtggcatacaaccccagctgtgacggggaggagtggggagtacggcgatgcttggtggtgctcatgtgtccattgcagcctccaaaggccatgggcaccgcccannnnnnnnnnaacctaccaacccacctgacaaagtgctcgaagaggacgttgtcaaagttgcggccgcccagatcgcggnnnnnnnnnnaaaccgtcggtgagtaggttggaagcggggtttcggcatgggagtggcatacaactccagctgtgacgggggggagtggggagtacggcaatgcttggtgatgctcatatgcccatagcagcctccaaaggccatgggcaccgcccagatgctctcaattctgagcagacgaggaccggaaggaccaccccccacccacccccccacctgacaaagtgctcgaagaggacattgtcaaagttgcggccgcccagatcgcggtcccaggcggaggacaggaccttgagctcgcggccgcgcagcgccaccacgcagacctgggtggcggagtaccccacgtcgatgaaaacgacgttgacgggggtgtcctccggcaggtcggtgcgatagatgccccaggccagcgcggtggcagtggtgtcgttgagcaggcgcaggcacttgaggccggcggtgccggccgcggccaacatggcgtgccgttccgcctcggtgaagtacaccggcaccgccagcacggcgtccgtcacgggcgcgccctgctcgcgctctgccagctggcgcaggtccaccagcagtgccgccatgagctgctcgggggagaggcgcgtggcggcgcccaggtactgcacctccacctcgcagccgccgtcggcgccctccaccaccttgtacggcaggtactgcaggtcggcctggatggcggggtcggaaaacttcttgcccagcagccgcttgacctggctcacggtgttgcgtgggttggtggccatcgcgcccactgtgcgggagacaagagagggaggaattgagtgtcgggtggacgggcggctcatgaagtgcacacagggctctggcatgctcacagggagggagggccgcgggtgggtaacaatcagggtcccgtctctcaaatnnnnnnnnnngttgagtgtcgggtggacggacggctcatgaagggcacacagggctctggcatgctcagagggagggagggccgcgggcgggtaacaatcagggtcccgtctctcaaatttcatgacagcggctggccatgcaatctcagggaggtggttgcttccattccaacgcccagcagtcgtctgatcatgccgaacacccccggcccccaccctccagcagccgacctcgcatattccccacccaccagcatcggttcccagttggcgctgcttggcattgaaggtcagcacgctgggtgtctcgcggttggattctttattcaggatgacatccacacctgtggggcacagatgcatggactcaggggtgacgcatgcagccggggcggcaagtgtccggggcgatcaggacacggtcaaggtgccccagccaccggctgctcagcctcgctcacctcccttgcgtgccagtgccacgcatgatgttgaatctcctacgtcaatgcctgcgacagacatgatcacgcccgagctgagcggtgagagttggtgcgaagtggccgccgggggtcgctggtgccaggaataatatgcaggggtgcaggggtctgcgagtagcttttcagtgcgcgaatgtgtacaggatacttgctcctgatggccaggctccctgctcaaggccgcgaggggggcttggcaggtgcgctcattggctttggagtattctcgaacttccccagcgagcgcgagcgccaggatgggtgtgcttcctcccgtcttgatcccaggtgccccgtccaacagtatcatcggggttttaagtccgttgcatgcacgaccgattggaatacatgagtacaaaggaaacaggggtcacaggctccctgggcagtcggcacgcagtgtgagccaggggggggggacaatctgtgctgactggagatcagggcaatcgaaggggggtcaggggagggcggcgtccaccgccgcacgccccggcctgggggggggtctgtcaaaatccccctccagcatgtcaggtatggcagaggatatttcaaggtgaggagggagaggggggtccgggggagcatgggtcggatggcgaggatcagcgaggatgatgctgggggggggtccgggggtggagtgggactgtgctgggacgaggcgctgctgcggcgcgggcatgtcgctgcctgggtggaaggacggggccaagtgcccaccggnnnnnnnnnncggggggtccggggttggagtgggactgtgccgggacgaggcgctgctgcggcgcgggcatgccgctgcctcggtggaaggacggggccaagtgcccaccggcccgggccgcgccatcccctgcgtcaggctgacgcccgcgtcacagcctccgccctcccccccgcccgcttcttggagtcgaagatgccgccgcgcagggacagcgcggggtcgtagtcgtccaggcgctgcgggttgtcgcgcgtgccggccccagcccccgccgcggcgcgcaggccctccacgccggtcaggctgttgtgcgccgcgtaggccaggcggtccagggccgagtccagcgggcgccgcgccaggtcctcctcccgcagctcgctcacgtccaggaagcgctcggtggcggcctcccagctcagccgacgcgcgtcctcctcgggcaggggggccgggtcctgggtcattgcgtgccgcacatgccgcgcaaactcgtcaggggttctgccggggtgtgttgggggtgggggagaccatgggattgtaggtcggcgcgaggggcgcaggggtggggtggggagatgatcctggcccgagatgacccaacaagccgccatcgacgggacaggacctcgcaagggcctggccaatgactgtcctgcaaggtagccctcgtcctcccctgcacagaaagccacatgcaccaacacacgcagagaaaacctcaccctccttgacccccacacacacaaagaaagtaacaacacctgtagatgaggcaatttttgaactgggtgaagaaggcgttgcagggcaggtcggcgcagaccacccacttgcccatggccagcgcctcggcggtggtggtggccaccacgtccgaggtgctggggttgacgaagcagcggtagtcgtggatggaggggtccaagtggtcccgcgcgccgtggaaggccaggggcaggccctgcttcgcggcgcgggccgccacctcctccgcatcctcgcccgtgccgtagcagtccagcggcgcgccctccagcgcgggccccgcctgggacaccaggtccagcagctcggtgtagcccttgccccacaccaccttgccgatgaagtaggcgccgcggctgaagcgcgcggcgggggagcccgccgagccgcc

SEQ ID NO: 40898 - DNA, 100 bp, Chlorella protothecoides
gggagggggagggcggtgcttttggggagggggagggcgacgcttagacagaggaggaggtttgcgcttgggcggagggggcttccccttgcctactgaa

SEQ ID NO: 40899 - DNA, 111 bp, Chlorella protothecoides
gcctcgccgccgtgcacgcgcgcgccgcgccccgcgcccggggcggttgccgcggccaggcccagccaggcgccggccaggaggagccagagcggggcgtggctggcgcgg

SEQ ID NO: 40900 - DNA, 74 bp, Chlorella protothecoides
aatttcaccttcaaggctattctcggaaagtaacaagtaaaatctgagagaagatgcagagttcatatctccaa

SEQ ID NO: 40901 - DNA, 61 bp, Chlorella protothecoides
cagcttagacattgtacatccatcccttggaaacccagtgcagctcacaggagaaggtcga

SEQ ID NO: 40902 - DNA, 61 bp, Chlorella protothecoides
gtaagctggtgctgatggcgctccctgtggggcagggcgcttgcccagaatcaatgacacc

SEQ ID NO: 40903 - DNA, 188 bp, Chlorella protothecoides
gggggggggacacgcaagaatgtgagaaagatgcacggtgtggggtgggggtgccacttggtagggagaggaggtgggctgtgaggcacgcgagtgaggaaggcccagccgtgcgggcaggagccctgggcatgagggagacccacacgccctgtcacacacccagagccacgacacccaggcacggc

SEQ ID NO: 40904 - DNA, 7117 bp, Chlorella protothecoides
  modified_base (122)..(183): a, c, t, g, unknown or other
  modified_base (1290)..(1299): a, c, t, g, unknown or other
  modified_base (1641)..(1650): a, c, t, g, unknown or other
  modified_base (2185)..(2194): a, c, t, g, unknown or other
  modified_base (3644)..(3653): a, c, t, g, unknown or other
  modified_base (3855)..(3864): a, c, t, g, unknown or other
  modified_base (5006)..(5015): a, c, t, g, unknown or other
  modified_base (5666)..(5675): a, c, t, g, unknown or other
ccccccacctccctctccgccacctccccccccccaacctccccctcatagaggaggtgctgaaggcctggcgcaaggccgccaagcacgacgcggcggtgcgagtggcggccacgatgaannnnnnnnnnnnnnnnnnnnnnnnnnnnnnnnnnnnnnnnnnnnnnnnnnnnnnnnnnnnnngcgggcacggagggcgtgcaggccgcgtacgagggcacagcccagtttcacgaggcctggaagctgaaggcgcgggaggtgctggccaactcggagtggcgtcggcgcaagctgaaccggcggatcgaggaggagacggagcgggccaaggcggagcacaagcaggagaaggcggaggccaagcgcgcgcgcgaccacgagcgacggtgggagaagacgcgggaggggcgggtgggcacctggcgcgacttcgccagcaagaagcccaagaagtccaagggcgggtcggtggcgctgggggggctgaagccgcccaaggccaagcaggaggacgaggagaagcgctacattcagcgacccgtcggcgagcagttccggcccaaccagaagcggtgagaacgttggtgccggccgcgcgggggggcgctggcggccaatcttgactccttgcttcatcctcaacagtgacagaacatactctcttgtaacctgacctctacttctggctggggcagaggagtgtgctatttccttcgccctcttattttctcttatacttctcctgcctggcgattcctgagtctaaatccttgaaatccctgcactaccacggccaccgccgtgcaccaagcgacgaatttgccggttgaatggcgcacgcagcgacgccgtcctcgtcgcagtccagggcccgccacctcgcccccgccagcgcgcagttgaaggccggcttgcgcaggcgctggttgacctggttgtgtaactcgcacatgtactgctgcagctcgggcccactggccacccgcggcgggttgttcctaccccatgataggtttgggaaagagtgggcatgagtggtgtgctgctgatcctgccacctggactctggacggtcatggcaagcatgtcaacggcagccatttgggcccccaaggccatcaatggcccccctgtctacaaaccttacaagctccttgaagtgagctgcacattcgccacacggatacatgcgcgtgaggatgtcgatctgtagaacggctggacagatcaggtgatgccccgtctttccggaatagatcacgacccacaaggagtggcagtggcccnnnnnnnnnntgacagatctgttgatgcctcgtctttccggaatacatcacgacccacaaggagtggcagtggccccccgcaccagattcttgacgtcgcgctgctgactgggagccggtcgatccggaaactgggcagccattgtatggaggagggtccatgtggcccgtcccagctcctccttgcttcctgcatgagccccggcaggtgctgcgatcgccgcaaagggtgcaaccctttgagcttgacggcgccgagccccatgcgcccagcggtcctcgaccgcttgcctcgctctatctatatgcgactgtagtcccactccgaggacctgtgccctgtttccgagannnnnnnnnnttatctatatgcgactgcagttcaactccgaggacctgtgccctgtttccgagaagccgcaactgcatgccaatgtgatctggaagcgcggtgcctgtctctgtcgtcgggctgtcaagccccattgtctgcacgtttgcccgcgggcaattcctcatccttggcgagatcctctgacaatggtgacagtcgacacacaaggcgcagcacaacgaaactgtgatggggcgatcgtgcgacggtgatccggcattgctaccccagcacagcaggcacagcatctccaatccctctgcaacaggctcaagggtgctcctggggggtctggtagctgcccctctcgcgcaggaagccctctccacgggggttgtacgactcccgaggcgatcgatcgcccagagctggtggcccagagccatacttcgtagccccataaaacttcagcacatcctgcatcgtagcgaagaaggcgtgtcgggaagaagtgccgagtcacatgccatggtggattctcctgcatcccaatgatggaccnnnnnnnnnntatcgtagcgaagaaggcgtgttgggaagaagtgctgagtcacatgccattgtggattctcctgcatcccaatgatggaccaattttacattctccctcaggccaccatcgtccctggacccacctcggggtagatgcccttctcctcggtggcgccgtactttcctttggcctttgcgtacgagagaggggtccaatccttgggcgacacggcatccagatccgcgccatagtcatgcagcagcttggtgatctccacgcctgcacaatcggggtgggggctggctgtgaagcgtgcggcctccgtggctcatgccatcccccgccagagactcccgtctcgtcacactgcaggtcgcccttcccagcagaactccaactacagcaccctgcagcatgccccatgcactcaccgccgtccagggcccagaacagggtcaggtcgccgccattattgacaaagttggggtcggcgccggcacgcagcagcgccttggcacactccaggcgccccctgtgggctgccaccatcagaggggtgtacccctcagggcacttgtaggctcggccaaagaggaaattaacatccgcaccctcctcgatcttcttgtacacggtcttgatgtcgttcttcacgatggcgttgtacagctcctcggtctcccgggaggccttgaccacgccctccccggtggcctccgggtcgtaatctgggtggtgcgatccccgaccaccatcccactgtgcctcataggcctcatccagggccttctggcgcttcttcatgatctcctccatggcggcaggcaggcggtgtctgcaccatgacgcagatggcgcaagtttgacttcaggtcgagggaaatgtaggtgataggacaccgcacttatgagtcctggaatccacagtgcaccctatgcagaatcctaccacgatgtggggcacgaaggaggtcggggtgcccctcttcgtttgaagtggggggagagctcgcgtggcaggagagagtccagggtacaggcgccggcactttcactgacgccctctatgtaacaatgcaatgaatggagggcgatcaatggccctgccggccccagtcatgtgctgggcaggaggtcgggtctgcgccccgtcccctcctccagtactggggtccgggtaccgcgggacccgacggagtgagggtggggaggaaaactcaaatccgcgatgccccacgttgtcagtaggagattgtttaggtttctctgtccagagttaacgcatcattacaatctcgtacacgtgttctggtgctgggtggtgtgagctgaccactgccggaagtttgtgcagactggtgcaggccctgcaggtcaaaggccctgcaaaagggttgacccccgcggtgcacgccccacacggaccgatcaggccgccccccttcccctgagcatctcccaggccacnnnnnnnnnnacggtgcacgccccacacggaccgatcgggccttcccccttcccctgagcatctcccaggccacctcctcccgaccccatgttccgaggggggatggagggagggatgggcgtcgaccagggcaaggccatggtgagcatgtctgggtgctgtgtggaagagtgtgtggatgaggggcccctgcatgagcctgaggcagcgnnnnnnnnnntcagggcaaggccatggtgagcgtgtctgggcgctgcgtggaagagtgtgtggacgaggggcccctgcatgagcctgaggcagcggcagcgccattattctgattcttcagtctccgctccagcctcacctcgcgacctcaggccctccccgcccaccacccctgaaacaaaaacacaggaggccagcttcaaggagttcctggcccggcccgagaacgcggcggtggtggagaagcagcagcgcaaggaggtgcggcaggccctctctgcccaggagcgtgcccagctggagggcctgcgctccgcggtgctgggcgccgacttcgaggcgcagcgcggtgtggccccattcctccgcacgccctgcctgcggcgcgtggtgcagagcttcgccaacgacccgcgcggcgacttctccgcctgggccgccaacccgcgcgtgctggagatgctggcggccgcgcaggccctgctggactcggggtccatgaccgaggcggagatggagcatgtcatgctggcccaactgcgcgacccctcccacgaggcccacgccgagttccagcggaaagcgcggcgcgtggcgcgcctgcccaccgacgccctggtcggggcgctgaacgagcacgtgaggctgggtgttgagagagggtgggggggatgagtgttggtcgagggcgtggccggggctgggaaggaagggggaggggtgctgctcctgcatacagacgctgagcggaccccagccccagaccaagggatcggaagccggctcactccttctcaaccgcctgactccccgctttccaccaacgcaccccccgtttgccattccatcacgcagctgaccgagcggcgcaagggcaatgaactgtaccgggcgcggcgatacgaggcggcgctggcggcctacacccgtgccgccgcggtggtggagtttgtggagggcttgggcagcgccgaccaggctgaggtggtgctcaaccgcgtggcggtgtacaacaacatcgcggcggtgcacctggagcaaaaggttaggaaggaagggggtgtgagggagggttggtgaaggtgaaggtggatgagagtggcggctgggtgggagaggtggaggatgcgcggaggttcgtgaaagtagggnnnnnnnnnncggtgtaggtgggtgagagtggcggctgggtgggagagggtgaggatgcgcggaggttcgtgaaagtagggacagcgcgatacggatgcagggtggggcctgcagaacgagaagctttgctgcaatcgtccatctgggcggccgggaaggtaccctcccccccttgtcccgccccatgcaagcaccttgcgcaaggggtggggcggatatccacagaaaccggccagcccgccgacccaccgctggtacccccccaccccgctcgcaggactacggcctggcggtggaattctgcgacaaagtcctggccctcgacccagacaacgcgcgagcgcggctgcgacgcgccaaggccaatgtaggtcggcaccagtacggtctcgccgacgccgacctggcggacgccgaccgcgccagcggcggctggccggcggccggcgtggaggaggtgcgggcggcgctggcgcgggcgaggagggagggcgccgccagcgagcgcaactcctttggccgcatgtttgcccagaaggcctgaaccttggggggagctctgtcgggggtgcagcgtgtggtatatagtgcagagtgaagaagcacaggcccctgaatgcatccacccactgcatcagcaaacctggctgcgttacaggnnnnnnnnnntggggtgcagcgtggtatatagtgcagagtgaagaagctcaggcccctgaaagcattcacccgctgcatcagcaaacctggctgcgttacaggcgcaaagccccgtcgggggcacagaatgggaggcagagctgcaatggcaagcagggaagaggtgtggtgcagggcaaagtgttgcacgagaaggaggcatggtacaagcatgagtttggcaagaggggtgccctggggcgaaaggggcagtctggcccagcctggctgccaaccctccatgcgcatgatgtcgggagtttggggatggagccaggggctttccaagatgcatcacgctacgagctgcggggccgagaccaaaaagggctgctgtgagggcggcgacagcgtggaggagtccaggtcggctgaaccgggcgcgagcagccgctgctcctcggcctgggcggcggttgggggtcggagtgggggaacccagccctggggcaggaggcagtgcagggacaccgcaaagttggccagacggttgacctgcacacggggaaaggggcgtggcgagcctgagtgaggcttgatactaagtgggtgggtgtgaacctcccatgcctttcagctgcaggggagcagagatccagtaccacaaacaaggtgtactcctcatcacttgagcaagcgcagctcacaaaattgcggcaaacctacccatgggggtgccctctggcccgtcaggcgatagcagagctcgtcagaaaaggtgttgcagttctgctgcagcaggtgatatgcgttgcccctgaagatctggcccagctcctgcaccatggcatacacctctcggggcgtcatgtccgtctcccccaccagcacgggttcgcggaacgtcaccgtcccgggagcttgccggggattggtggcaaacacgcctgtggacaatcggaacgacggaggagctcctgagggcaggcgccgtcctgttcgagcagagccgcggggcccctgtgcatagccagaaagacacaacaatgcgacatcgcgagccttgcaccctggaggcccctgcatcccctggagcgcacctggggcatcgtactcatgtcctccataagcatactccacaccgtacacctcgactcctgagtggaagatgcccacgccgcaccagtaggtccagtcattgtgctctatgaggtcatacacgttcaggtagacggcggagctgggcataggggacagggtgccagccctgtcctcggcctcggcgttccgagccagggttcagagcgacgacttcctgcagcggaggctccacaggagaataactgggaagtctctcccagaaaaaggcagaatatgcagaatgtgagcgggatcctggcgaacaaggcgcctctcagtgtcgcgacgacgagcgcgctacccctgcgcactgcatcggcagttgcgggggg

SEQ ID NO: 40905 - DNA, 61 bp, Chlorella protothecoides
agtctcgcacgtgccctcggcgtcattggctggtcgatatgagctcctgatgtcttgaccc

SEQ ID NO: 40906 - DNA, 61 bp, Chlorella protothecoides
cgaccccaggcgactgcgctggaccaatggtggggctcagctctcccttgcaatccattgt

SEQ ID NO: 40907 - DNA, 103 bp, Chlorella protothecoides
aaaaggaagaaatcctcccttacccccaactttagcccctttcatctcttacccccccgaaaaaatcctcgcccgtgcgagaagagatgtgagacctgcagat

SEQ ID NO: 40908 - DNA, 30527 bp, Chlorella protothecoides
  modified_base (325)..(334): a, c, t, g, unknown or other
  modified_base (1516)..(1525): a, c, t, g, unknown or other
  modified_base (1863)..(1872): a, c, t, g, unknown or other
  modified_base (3298)..(3307): a, c, t, g, unknown or other
  modified_base (3600)..(3609): a, c, t, g, unknown or other
  modified_base (3849)..(3858): a, c, t, g, unknown or other
  modified_base (4484)..(4493): a, c, t, g, unknown or other
  modified_base (5459)..(5468): a, c, t, g, unknown or other
  modified_base (7275)..(7284): a, c, t, g, unknown or other
  modified_base (7340)..(7349): a, c, t, g, unknown or other
  modified_base (7426)..(7435): a, c, t, g, unknown or other
  modified_base (7970)..(7979): a, c, t, g, unknown or other
  modified_base (8671)..(8680): a, c, t, g, unknown or other
  modified_base (9427)..(9436): a, c, t, g, unknown or other
  modified_base (10400)..(10409): a, c, t, g, unknown or other
  modified_base (10570)..(10579): a, c, t, g, unknown or other
  modified_base (11738)..(11747): a, c, t, g, unknown or other
  modified_base (12034)..(12043): a, c, t, g, unknown or other
  modified_base (13814)..(13823): a, c, t, g, unknown or other
  modified_base (14383)..(14392): a, c, t, g, unknown or other
  modified_base (14734)..(14743): a, c, t, g, unknown or other
  modified_base (15433)..(15442): a, c, t, g, unknown or other
  modified_base (16113)..(16122): a, c, t, g, unknown or other
  modified_base (17156)..(17165): a, c, t, g, unknown or other
  modified_base (17912)..(17942): a, c, t, g, unknown or other
  modified_base (18134)..(18143): a, c, t, g, unknown or other
  modified_base (18222)..(18231): a, c, t, g, unknown or other
  modified_base (18311)..(18449): a, c, t, g, unknown or other
  modified_base (18850)..(18859): a, c, t, g, unknown or other
  modified_base (19212)..(19221): a, c, t, g, unknown or other
  modified_base (19432)..(19441): a, c, t, g, unknown or other
  modified_base (19939)..(19948): a, c, t, g, unknown or other
  modified_base (20210)..(20219): a, c, t, g, unknown or other
  modified_base (20877)..(20886): a, c, t, g, unknown or other
  modified_base (22567)..(22576): a, c, t, g, unknown or other
  modified_base (23150)..(23159): a, c, t, g, unknown or other
  modified_base (23440)..(23449): a, c, t, g, unknown or other
  modified_base (25915)..(25924): a, c, t, g, unknown or other
  modified_base (27261)..(27270): a, c, t, g, unknown or other
  modified_base (27847)..(27856): a, c, t, g, unknown or other
  modified_base (29464)..(29473): a, c, t, g, unknown or other
  modified_base (30052)..(30061): a, c, t, g, unknown or other
tgggtcgacgccgacgccgcgcgggagctggcgggcggcgcgctggcggccggggcgcgcctgcgcgacgcgccgcctggctcggccgaagcgctgagcacgctgcgacactgtgtgcgcgccgcggccagcgccaaggcgctgctgggcctgctgggccgggagctggagtcggaggaggtcgccaggctggctgggctggtagagcttttagaccgtacttgacatcgtgcaggtgggcgggcaccagcatgaaattgtacatgcctgtacttgctgctcatggattcccacgtgaggttgacaggcatggcatggtaccaannnnnnnnnngaattgtacatgcctgtccttgctgcccatggattcccaagtgaggttgacaggcatggcatggtaccaagggacgtgtgcagagctatgacaattgacatcgacgagcaaggaagatcacctggccctggcatgggatgcattgctggaatgggagtggcaactgctgctgggtcacttccaatggtagagctgtgttgcatactctcagccacgactcctccctaacagcccagctcttcagaatccccatcctccccaccaaaccccttgacaccctgccctggtcagtgcttcctacaacatcaaggtcctgaagacagagcaagggtcagccagtgtgtgtgtcaatggaggcatcgcagatgctgcgaagccccagtggggcatgctctatggggaaaaggagtgctggagatgcgccacacatggacgtaaacacaaacacagactgcgcaaggggaccacgacgtgaggcggtgaaaggtctatccaggcattgcgcccacgatttctcgctgggtccctgtgaatctagcctccccatgggagtcggccgcccggcctccaagcggcaactcatccggggccggcggcggcgtgcgcctggatgacggcgttgcgcactcgcgcagcgttcaccaggatgcgccaggcggccatggccgcgccaaacccagagtctatgttaaccacggtgacgcccggggccgcggagttgagggcggccagcagcggggtcacgccgccaaaggcggtgccgtacccggcactggtggggagtgccacctgcgatgtatgatgagaagcgagacgaggtgtgaggttggcggtgttgcctggtgaaagaggcgcagcgggtgaaagggtgtgactgcggcgttcgaagatctggtgtcaaagtgggaccatgtaccaacacgaaccgcccatcgccggctagcatccctcctcctctcgcgaatgcacgagcagcgagacattgccacatcaagactcaccacgggaacgtccacgaggccagccaccacggaggcgatgccgccgtccatgccggtgacgcacaccacgacgtcagcagcctgcacggcgtccaggttccgcacgatcctgcaggatagggcttgttggagagtgtgtgcactttaaagggtgctgagtgctgaaggcatgcatcccagnnnnnnnnnnatccagattccgcacgatcctgcaggatagggattgttggagagtgtgtgcacttaaatggtgctgagtgctgaaggcatgcatcccagcttcagacagcggaaggtgtgaagtaggccgagatgtagcccacccctgctccgttatcactgctcgccccccgtcccctgtccacccgttctgcgctactctggcctggaaacgccgtctccatgatgggagacgcatcttcctctcccactgtccgacccccttccaactgatggttccaatccccctccgctacgcccccccctacttcccctccaaaacacagaaacacacctgtgcatgcccannnnnnnnnncctgtccgacgcccttccacctgatggttccaatcccctcccgctacggccccccctactcccccccaaaaacacagaaacacacctgtgcatgcccatcacgcccgactccggcagcttgaaagcatagcagcccatggcctggagcaccaggcggcactcctccaccacctgcggcgaggccgtccccgcgcagatcagggctaccgtccccggcagcttcttggcgggccccgtcttcagcgtcagcatgtgcgccgccgggctgtgtagcacgcggtcgtccatgcccgtcaccgcggcggcggcctcggggccgacgcgcgtcgcggcggcgatgccctgctttcctgctatgcgctgcaggctggccagcagctggttgggcgtcttaccctcgccccacaccacctcggggcaggcggagagggccagggcgggcggcgggcgggggggccccgcctcgccaccaccgtcgccgtgctcggaggcagcggccgccgccgggcgggtcaccgcgttgagctggacggcggcgtcgctggcggacatgaccccggtggccacgctctgcagcagctccatgagcgcagggctgtggcccgcctcgggcgagccgttggcggcgtagccgtcgccacccaccgagactgggcgaagagagacggagggggggtccttgttgagatggggtttcagactcttacatagcagagagaaagagagtgatcatgtatgtgaggtgaggatcgtgaaatgcatggcaccccgagactgccggcaggtgggtcagcatccagccagtcatgaccggctggcccaggggagctctcggtcccgcccgcatccgccacccggacgggggtcgacactcactggctcgtggagcgacggccccacatcgcttcgatctccttgctcgaaccctgggtgttgtctggacccgcgtggaggagaggcaggggcctgctggtgcaagagccgcgagcatggctgagtgggtgggtggcagcaaaaacccaacaggggagggagaggatcagcgccgatctggggcaggacaaaagcgtatcgatatttcttgctgtgctcagcacgtgtgcgggaatgttgagactgttgccactggcaatgcccctcccatcaatctgttaaactggcaagggtcgacctcatcgacatgggtgagcgatgcctcccgggcgggaagccagccagggcgcgacgatgtacattgctccctcctcaggtaaactgccatgatactctgcaacttgtgaagcgtgcattgggtccgatagtctgttagactgaatgcacattgattgcgggtcctgcaggtggatcactggcgcgccggctgcccaccttcagagcaagcgactagtttcctgccctccccagctttctctagcgaggcaggatnnnnnnnnnnttggcgcgccggctgcccatcttcagagcaagcgactggagtttcctgcctccccagctttctctagcgaggcaggatggctcctgttgtagagaagaaggtcaaggctgagaaagcttcatcagataagaaggtaggccgtcggtggtgatgccagttcagagtcgaggtgggccgagcatgtgtcgctcaatgcccagcacactccatgccgcgtgtaggagaagaaggagaagaaggaaaaggtctcgaccgaagagagaacctcctccaaggtgaagagctcctccaannnnnnnnnntctcaatgcccagcacactgcatgccgcgtgcaggagaagaaggagaagaaggaaaaggtcatgaccgaagagaaaacctcctccaaggtgaagagctcctccaaggagaagatcagcagcagcaaggacaaaggtgaaggatgatctggggggggagggtttcctattgggataccactgttgcctggcaattggtctgcagtcgtaaccctgtccctcggaggcttctttgtgagctnnnnnnnnnngggatgatctgggggggagggtttcctgttgggataccaccgttgcctggcaaatggtctgcagtcgtgcccctgtccctcggaggcttctttgtgagctttgcgtcaccctcctttgtccaccaggcgaggttggcaaggatgggaagcccagcaaagacaagaagaaggccgacagcaagtccacagctgccccagcccctgccaagcccgtctcccgccggccgccgccccgccagatacccgagcccaagaaggtggtcaactcctacctggctgacatggacttgccgtcaagcgagtcggagtccgacgaggaggggccccgcaggaggggcgtgaacgagaacgacgcggaggatcgcctcgaagaggccgtgcgggtgagggtgcggtgtcactggggtgtcatcagtgcatccctgcaggacttgatgctaccattgttcgtcgcatagaatgcagcagaggggtgtgggagaagaaggagtggttggatgacttctttgcagctggcattgaagctccagggtgggtggcgtgcatggtgcttgcatggaatgagggcatggcgctgcctgaccccggtgatcacctgcccatcatcccctgaagccattctctcnnnnnnnnnntttggttgcatggaatgcagcagaggggagtgggagaagaaggagtggttggatgacttctctgcagctggcattgaagctccagtgtgggtggcgtgcatggtgctttcaccgaatgatggcatggcgctgcctgaccccggtgatcatctgcccatcatcccctgaagccattctctcctcccctccattgaatatcccccacagccgtctgccaaggagcagcgcaagctgaacgacaaggagcgcaagcagctggagaaggcggccgccgccaaggtcgccgcgctgcgggacgacgacaatgtgttcgatgtggctttcgagcagcagggcgaggggggcgagggcgtgctgtccgccaccgacatcaaggtgcacaacatgacaatccgcgccaagggcaaggtcctgttggagagtactacgctgacggtggcggcggggcggcggtacggcctggtggggcccaacggcaagggcaagtccacgctgctgcgcctcattgcgcggcggcaagtccccgtgccagacaacctggatgtcctcctggtggagcaggaggtggggtgctggggtagtattgagaagtgaaaggggtgtttcttttggggggaagaagggtgcgaggtgtctgtcaggcaatttagggtatggctggttgtgcgaggaagtaagcctgacgatccaggatctcagatcaggcctgcaatgcccctgctgctgcgcccttctacagctctgaacgtatccttggtttccatgtcccacgctttcatcctttcctcctccgccaggtggtgggcacggaccagagcgcgctggcctcggtggtggcggcggacgtggagctcatggcgctgcgggccgaggaggccgagatcaataggtggaagggggaaatggcagttgcgtgggagtgtgcgtttggtcttgatgcaaggcctctggtcagccagctgccannnnnnnnnncaggtggaagggggaaatggcagttgagtggcagtgtgcgtttggtctcgatgcaaggcctctggtcagccagctgccatcgcaatgcaccggtgctgtgcccctggaggctggccgccacggtgtgcactcgcgtcacaggcgctggccagccccttcttgtaaacaacccctcaccgcaaccgtcacactcctcccgccccgcccagcaagctgtccgacatgggccttgaagagggcgccgggccggcggccaacgaggctgaggacggcacagcggccgaccgcctgaacgagatctacgagcgcatggccgagatcggggccgcctcggccgaggcgcgcgccagcaagatcttgcacgggctggggttcaccgaagtgatgcagcgccgtgccaccaacctcttctccggcggctggcgcatgcgcatctccctggcccgcgccctctacatccagcccaccgtgctcctgctggacgagcccaccaaccacctggacctacgcgccgtgctctggctggaggcctacctgaccaggcacgcgctgtgctgtgggtttggtggagtggggcggcagagcggggggctgcgggtgctgagatcttcccttggcaatgggagcgattggttctgtggctggttgccatgctttgcgaactcgacccccttccccacccatcccgtttggcatcacaaacagatggaagaagacgcttatcgtggtatcgcacgaccgcgacttcctcaacacggtgaccactgacatcatccacctgcacgacgagcgcctgcactactatcgcgggaactttgcgcagttcgaggagatgtacgagcagcggcggcgggaggtgaacaaggagtttgacaagtaccagaagcagatgaaggccgccaagcgctctggtagggtgtggaggttgttggtcgaggtgttcctgcaatgtgagaggctactgataccttgagcaagccagccctgttgctggtactggctcagagttgtcagaccctctttaaaccctccttccattcccccaacaacacaatgtacaggttccaaggccaacgcggacaaggtggccaaggaggccaagagcaaggcccagcgcacgcagcgcggtaagtacgaggacgacagctccaaggcggccgacgcgccgcggcagtggaacgactacaccgtgcactttgagttcccggagcccacagagctgaccccgccgctgctgcagctcattgatgccaggtgggagtggttaccggtgctgtggggtagcctgattggtgagggtggacctccttgctgctgaagcgtctgatcaggcaggcttgctcttgttcagggggatgtgtaaatgccagacctcgatctctgccaagttcagccccctcaccacctcactctcccttttcaaagcttcaaataccctggtcgcgaggatttcggcatgcgggaccttaatgtgggcatcgacatgggttcccgcatcgccattgtgggccccaacggggcgggaaagaccaccctgatgaacctcgtggcaggtgggcaggggagaattgctcgggggaagggaacagcgaccaaacaagtggaacctgcctgcacagcgagtttccttggctcatctcaaacccgcaatctcaaatcccgttcgttcacaaaacctccaggcgacctccaaccgacgcacggagaccagcggcgaaatttcaagctccgggtcgggcggtatgcgcagcactttgtggacgcgctttccttcgatgagacacccgtggagtacctcctcaaccgnnnnnnnnnnacagcgacaaaacaagtggaacattcctgcacagcgagtttccttggctcatctcnnnnnnnnnncttccccgaggctggtgcgaactggtggcctggaacccttgggtgatggctgtgatatctcgaatggagactggggnnnnnnnnnntttccccgaggctggtgcgaactggtgggcctgtagcccttgggtggtggctgtgatatctcgaatggagactggggatggcagagcttgtgggagatcatgggctgcaggcacaggcccctctgctctatcctacacccggccgccgagcctggttaggtaagcaccccagtctcattcctccccctctctttcctctcatatcccaacctttcaggcctgcggagggaggacatgcgggcacggctggggcgattcggcctgtcgggccatcaccacctccagcccatctgcaagctgtcgggcgggcagaaggctcgcgtcgtctttgcagccatctcgctatcggcgccacacatcctcctgctggacgagcccaccaaccatcttgacatgcaggcacgtggaagtgggggggggaggaagggggatgggggttatgtgtgtgtgtgtaggttcaagggtcgccgagcgcatggctcgggggatgtttttagggaggcttgaggctggccgtgatacaatacgtgctgcnnnnnnnnnntggtgggggggggaagggggatgggggtatgtgtgtgtgtgtggaatcaagggtcgtcgagcgcaagactcgggggatgatttcagggaggcctgaggctggccgtgatacaatacgtgctgctgacggtcgatgcgcgctcacaatgccatgccgatcccacattgcccgcagtccatcgatgcgctggcagaggcgctagaggcgttccagggcggtgttgtaatcattagtcatgacgctcggctgctgcagagcatctgcgacgacacagaacgcgctgaggtgggtggggagaggggcggcaggggtcgcgctgtggtgggtgggccaggcgcatttgaggcctgcgactgcgtcatctccgtccactttcctgcatccctccaaccccccactcccatcacaggtctggattgtggaggatggcaccgtcgagcggtacgacggcgactttgaggagtacaaagaggagctcatcaaggagatcgcggcggacatggacgaggacgagaaggcaaaatagttgcttggaagcgcgcgctggcgcgcatggccagcccctcccccattggtggtcttggtactcagcgcaggggttgcagagcgctgtagggagcagccaaagcagtgtcatttaccctatcatcgttccaggcatccctgaagaggtcttgcacaccctgaatgannnnnnnnnnacgctgtagggagcagccaaagcagtgtcatataccccatcatcggtccaggcagccctgaagaggtcttgcacaccctgaatgagggcgtttcgcagatacgagagttttgggtgttctgtggtgagagagcgctccggactggagagggcgccattccggaagtttgagaatcgtgcccaatcgtaagagaaggtgtcgtaaggaacttccttaattacccaagcacccgcttccctatgcgtgatatcgtagaataattcatcatgatcacgctttcacaatacagggcttccgctggccgggtgcaagtcccatgccaccgctccaggtacgttggccatcccccacgcttcctcgaagaggcccatacagcagcgcgattactcttgcacgcgccctcatccccctttgaattccatatttcataggcctagagtgaggactttgccacgtcccttcgtctccggcgacaccgcgccgcgcaagcccctcctcggggtgcaggccaccagggagcacgctgagctggagagcagtaccggactggtccagcagacaacggatgagcagaccctggagctgaagaacgaagggtccactgagaaggagaagcaggagattgccttcatcgatgacgacggcaatcgcatccctgtcagtgttggagcgtgacctgcattggttctgtgtgagggcgtgtggaggagggttaaaatgcatcaggcctatggtgtgcctcccacnnnnnnnnnncgccttcattgatgacgacggcaatcgcatcccggtcggtgttggagcgtgacctgcattggttttgtgtgagggcgtgtggaggagggttagaatgcatcaggcctatggtgtgcctcccactgcatccagccaccgagctcgcctcctgctccagcaaagggagggttctgctgcgccttgcacacctccgtgtctgccgcgcctccacacgacccgtcttcctgttcgatgcaggtgatggcggccgactacggcttcaggtcgggttctgggaggctgtaccaggatggatacggctccgtgccctcgtcggccaccgcgctggcgctgggcaacttcaagaaggagttcatggagctgcgcaagtccgtgcgtttcaatgagtacaaggagctgtcgagcacgatggaccccaaccccctcagcaaggtgcgcaggcggccgactggaggtatcgggtgtttgggaggtggcatagtctcaaactggagagacaattgggctccatgcacatcgtacagactggccgatcaacactccaagctccacaagctcatcaatcctccctgtccctcccccaggccgccctggtggtgggctctgccctccagagcacgctcaccaaggccgacagctggctggaggggcggggcgtgctgggcaaggtggagcaggacactgcccgcgcctccctgaccccgaaagagcgcaaggtgctggagaagctgcaggcgctgcgcctggatgatcgccgggtcatcgcccgggagcacaagcgggagaaggaggggcgaggcgtgaaggcgccctggctcatcaagggctcctacgttttcctgtgctgggtgctggacatcctgtacgccaaccgccccatccaggtgtgtgttggggatggtgggaaggaggggatcagagggagggtccttcgtttggggcaaggaggggctggagggctggnnnnnnnnnnggggaggaagggatcagagggaggggtcttttgtttggggcaaggaggggctggagggctgggctcacgcctggcctaagtgggactgagggctagagcgtcttgcatgtccgcagaggtccacccccaactgcatccacacacactcgagcagccagacnnnnnnnnnngagtgggactgagggctagagcgtcttgcatatccgcagaggcccacccctatctgcatccacacacactcgagcagccagaccccactcccctgattccagcgcttctgggtgctggaaacggtggcgcgcatgccatactttgcctacatctccatgctccacctctacgagtccctggggtggtggagggcgggggcggagctgcgcagggtgaggctcggttgatggtgtttggaggttgtggcagggtttggaaggtgtggattggtgcagcagtatgaggtctgatgcattgcaagacccccagcgctctggctgagatgttgcactgatgccgactgcacgtcatagcacactgcatgccagcagtcccaatgtgccctccccactggtagatccactttgcagaggagtggaacgagctgcaccacctgcaaatcatggaaaccctgggtggcgaccacttgtggatcgatcggtgtgtatgggtgacatcggaaagggtgggacctcgggcattcaatgcccatgcagcgtgtagcaaatatgatgctagaatttgcctggagcgatgtgaccctgaatgcatcccccatcccccgaccacctctgcagtttcttcgccgagcacgccgctgttttctattactgggtcattatcctcatgttctttgcatctccctcggctgcatacgtgttctcggagctcgtggaggtgtgttgtgtgctgagggataggctatctgttccctttggatgagaacagatttgagcatgaagtggttgggccctgtctgcaagaaaggtatccatgcaaggggccctcattctctgaactggccactggagttcctttcccttgcacacattccagaatcatgcggtggacacttactccgagttcctcgaggagaacaaggaggtcctgcagggcattcctccacccctagtggcagtcacgtactacaagtcgggtgagagccagggctgtggcgcaaaagccgctgggtcctggcgcccgctctgccttccttccccttttgatctcaattcctaagggaggggcacccagcttgactcataagcttcattctccctcgtcgccatgccccatttccaggtgatctgtacctctttgacgccctgcacacggagnnnnnnnnnnattgccatgccccattcccaggtgacctgtacctctttgacgccctgcacacggagtgggagtcgggatccattcgacgcccagagtgcaagtgagcaacagggttgttggtccttgtcaccagggtattagttgtgttgtcgtcctgcaaatgtcacgacgcacagtcaaggaggatttgatcatgttgggcccatcggatctatgatcaaggtgaggttccaacaccccgtaacacgctttccactccccctcctctgtagcaacctgtatgatgtgtttgtcannnnnnnnnnctgccgtcctgcaaatgtcacgacgcacggtcaggggggatttggtcatgttgggcccatcgtatctatgatcaaggtgaggttccaacaacccgtaacacgctttccactccccctcttctgtagcaacctgtatgatgtgtttgtcaacattcgggatgatgagttggagcacgtcgcgacgatgaaggcctgtgccgagaacaccatcaagcccaagatggatgtgagcggggaggcggagggggggggatggggaacaacaccaaagtggtgctgtcgatggggggaagatcgggcaggtctcacagtccagggccccagggggttgctgtcaatcgtcgctgcatacccacagagcagccgctcagggtgcttgtgaccagcatgtgccacgtggcctccctttccttactcgtgtccagggtcccaagggtctggaggaggccaaagaccaggtaacgaagctcggcaccagcaacgtgaacaacaaggaggcacaggaagtgatttaaaggaggaatgcagcgaaccagcgaacgcgctgatgagcagcacaggggtgattgatgcatgtattcgctcgacctccttatgccttgagcgtctgggcgcttgagttgcgtgcaggcttgagtgattgtttcggcttcccaagacaaagcttattctttcacaacaccccacctgagtagacagagtccttggcttttacttttgtacggtattgttgacaacagaagaagcaagctgtaacgaggatcatgtacaaagggattacgtacttgcgtcgagtcgccagctggcctggctccttgattattcctgggcggcaggggccgaaggctcgttggcttcctcttcctcgtcaaactcatccacccccttggtgtctgtgacatcggtccctggcgcagaaaacgagtttatcagcgccatgatgtcgttgtagtctcttcgcagtgcctcgtccacgggggtttcgtcgcgcctgtatgaaaagggagttggtggagaggtgggcaccaggagccaagatcggagtacgcagtacactgccacggcaccgtatccttcacacattctcgtacccgttgatggcgctgggcgacgcgccggcctcgaggaggagccgaaccgcatccacctgatgattcatcgccgcccagtgcagggcagtgttcccttcactgtttgctgccgccacattctgtgacgggacgatgctgtgagggatcatgcctgaggcagtgcaccgacgcgcatagcattgtgctgcatgctcatggcatgtccttgcttcatgtccctctcaccgcgccatctttaacaaggagcttgatgatgttggtatgcccatttgcagccgccatgtggagggctgtgtttgtggaggggcctcagtgagtgttaccatggtaaataatagatgatcctgtgatggagagacaaaatcactcagtcacctgtgctgcctgtgggaccaggagcgtcaacatctgcaccctcgtccagagcgtgtgcgacgtcatcttcgtccccatagcgtgcgccgtccaggaggagctctgtcgcggcttccttgtccatagcgagcagttttaatatggaggcgaggcgagaacagtctccgactaggagagcccctgaggcgaccacccaggcagattacaacatacctttaatgggattcgattcaaaattacaaaatgtatgcagtaggctttcccaacagaaaaccttcgcatgaagcgtgcactgcgcacagagnnnnnnnnnngaggcagattacaacatatcttcaatgggattcgattcaaaattacaaattgtatgcagtaggctttcccaacagaaatcttcgcatgaagcgtgcactgcgcacagagagcagtggagggcgcgaggaccatgcagaattcgcgcccagggagatgtcggagccatgcaccaagaaaacttcaagagccgatacatgcagggtgaaaatggataaaacttactgtcattcggtgtaaggacgtaccattatcttccctcgcgtcccatacgcttcgagctcatactcagggcctctgctcaagccaccatgaacagtactttggccgtctcggggggacccctttccccaggaacatggcacgcccgatgttcgacgcaatgtcggagatgtcgctcaaggtaccctcttgaaacttgcatgactgctagatttggggacagaaccttaccatggacatcatggatcggctcaccgtgcacaggatcatgatggcatcatcgtcggaccggcaggacaagagctctgcccccagctccccgcccttgaagacatcctcnnnnnnnnnnctgcatgactgctagagttggggacacaaccttaccatggacatcatggatcgactcaccgtgcacaggatcatggtggcatcatcgtcgggccggcaggacaagacctctggccccagctccccgcccttgaagacatcctcgccgccccctccacttcccgatgaagaagaccctcctgtgaatgacctctccaacatcccacgccgcaacatactgctatcaatgctggcaggcactgtggcatggtggtggcttctcaaccgtgagcaagctcgtgggggtcaggcacgatgtgtattgcactgaatgtggcgcatcacccctgatgctgatactcannnnnnnnnnatcaggcacgatgtgtagtgcactgagcgtggcgcatcacccctgatgctgatactcaaagctcaggctgggatctggtccatgcatgcatgccgttgaccattggtgggtgtcattctccttgtttcctccttgttcccaggtgatggtcccaggacgtctaccgcaaggtatcgcagcaggacagtgctgcaggcagagcagggcggcagcatgatgctggtgagtcaggatgaggaggaggactgtatctgtagcgaatggttttggcaatgtgttcctccgcggttgctagccatgagtatgtcaatccgttgttgtgtggagtccttgcacaaaggcatactctcagtggtgagagaacatctatattggcaatgaggtgcttgctcatcttggctgtctggaagcaatctatgaacaaatcttgctgactctaatctcctggccacgcagactcacagcttcttctgttacactgcactatgacaggagtatcatggggacaaagtgccagagggcattgtgattgagaatacccaactggagcaaagatcaaggagcaagagacggcgaattcacacattccaggttagcacctcatgttgcagcagttctttctccttagcatggtggtagaagagtgagtggcttcttttgaatctgtgtgctatggaaatgttgaaatannnnnnnnnncgacaaagtgccagagggcatcgtgattgagaatacccaactggagcaaagatcaaggggcaagagacggcgaattcttacattccaggttagcacctcatgctgcagcagttttcctccttggcatggtggtagaagagtgtgtggcttctttggaatctgtgtgctatggaaatgttgaaatacagattgtgttacaggcctgccattcttctgtagatagcagagtgtgctacgttaacatcataacatctccaatgcaggctcaaatattgcctgcaggagaaggatagaccgtgccatggcactgcaaggcgtgcttcaccttcccactctcctgcaaatgggtgaaatgcaagtgcacctgccgtctccctgcaatcctggcaagttcctgcctggccacttgcatcctgtgccatttatgctgctccctggaacacagattgagcgggcgtaacccccctcctttatctgtattgtgttgcttacaagggctgtcctgattctccagtcttgcgttgcatcagtggttagagcagtaatgtacaagtgctgttcaacgatacaagaaaatcaggcgccagccggcagcaggacgctcaggccaattctgactgaaatccagctgcccagggaagagcaaagcgtcacagcaaatcccaggaggnnnnnnnnnnttacagattgagcgggcgtaccccccccttcatctgtattgtgttgcttgcaagggctgtcctgattctccagtcttgcgttgcatcagtggttaaaggagtaatgtacaaatgctgttcaacgatacgagaaaatcaggcgccagccggcagcaagacgctcaagccgattttgactgaaatcgagctgcccagggaggagcaaagcgtcacagcaaatcccaggaggtccttcgctctcatggcagcctggctccagtgctactgcaaccagggactgcccctgaaaacacaggccctcagggctgcatgctgtacttggaccgcaccacctctatgctgcgcgttccgagcggcctcacgtccgacatgtcggcgttgcggatgaagtcggcccacacgccgggcaggaggtcggccaggtgtgcggaatccagcccagcctcaatggcgtgctgggggtggatcggggatgggagtacatgctgatatctacatgctgaaaggcgcgggggcgtggcctggtctgcaccttcggccagcagcctgcgcactcagcactgccagccgtgctgtgcataatgaaaggcacacaggaagtcactccccccaaacgaagcacactgccagcccaggctctcctaaagcgctccccacctgcagcccgatgacctccgccagcaggcgctgggtgtcggtggcggcggccttcagccgcggcttcagggccgtgacaaagcgccgggcatcggcatggccaaaccacaggtgggtggagatgccggtgacgtcgtcctgcatcagcgtcagcacacctgctcgtgggcaggagagggagaacattgtgggggagggaaagatgcgaacctcagtacagtcgcgggaaaatgtcgcgcaatttacgcttggggttcactggcagcaggtgggagggaccatgctttcaggctatgggattcaaggccagcagattcctcaggctccctagggcgcccaggctccccttcacccacctcccaactcttcacccaccnnnnnnnnnntgttgcgcaaattacgcttggggttcactggcagcaggcgggagggaccatgccttcaggctatgggattcaaagccaggagattcctcaggctccctatggcgcccaggctccccttcacccacctcccgagtcttcacccacctcccaactcctcacctacctcccaactcttcacccacctctcaactcttcacccacctcccaaccctccccccccgcccaataccacctacccgccagcttccgcaggaggacggatcgcagtgcctcgacctcttgcgccaggtcaacgtcgggcttggcagaaaccgccacggcgcaggcgcgcccaaacagggctgcggcggcaggggaatgggttcttggtggtcgaaggtgtcccttcccctttctggcgacgtcggcaggcccaggggcagccctatgctttcggttcaaggctcataggtgtccccgccccacgttcaacccctcccatcacctgcccactcccacgcctcacatttgaggaggaagcggggctggcgcagaccgtcctccgcggcgatgtgctgcagcagccagttggtgacgtggccctcgtcctcggggcggtagcagagcacgttgcgcaggagcagggcgtcaaactccagtacgcggcgccggccacaggtccaggccgccacctgcagcagcaccaccgccttgaccagccggcggtcggagatgtaggtgggcggctcccgctcctcctgatttttnnnnnnnnnnnnnnnnnnnnnnnnnnnnnnntgcgagcctgccatgctggggcgtggcaggcatcaggcggcactcaggggccagggccgggtagagattcaaaactggccgggtgggtccagttcatggcatcacccctcctccgtcacctctctcatcacccctccacaccctgaacgcccccccagcaaaagcacctgcatgtgcttgcgaaggtcggcnnnnnnnnnnggttgggggtggatgggtggcggtgggcgacgggtggtcggatgggggcgagatgggtggggcgctggcgggctgctcnnnnnnnnnntggttgggggtggataggtggcggtgggcgacgggtggtcagatggggacgagatgggtggggcgctggcgggctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtcacctctctcatcacccctccaaactctgacccccccccagcacaagcacctgcatgtgcttgcgaaggtcggcgaggagctggagcacgcggctgggcacctccaccagggccatggcctcgccacgcagtcccgcccaggagtcatccaccaggagcggggcggctgtgtgcgtctgggagccggggctggccagcgccgtcgcctgcgggacctgtggagtggcggaggcggagggggttggaggagtagagctagatcatgtgttgttcctggggtcgccacctctggccagcgcagagactgccgagggaagcccagtgcccctggacaacccgatctcacactgaaccccacctgggaacgcggggaggaaagcagctccatgaggccgnnnnnnnnnntgccacctctggccagcgcagagactgctgagggaagctccagtgcccctggacaacccgatcccacactgaaccccacctgggagcgcggggaggaaagcagctccatgaggccggcgggggagacctgggcgacctgccgccgcagcaggaagcggtcgtacagcgcgtccagttcttcgctctccggcagctcgttggaggcgccgacctgcacgttggtgataaaggtggtggttgtgaggaaatagtagctggaggatggaccgggtctcggacaggcacagcaaacatatgggcaagtatatctgatgagtatgtgattctagaaagaaacccagcatgctgccggnnnnnnnnnnaaggcacagcaaacataggcaagtatatctgaggagtacgtaattctagaaagaaacccagcatgctgccggtgcagcatggcacacaatcaggagcccgttcccccctttcagactcgtcaacccaccaggcatcgtaggggaaccttctcccgcacgctaccgttgtcaaacaggcgttcgttgatgatggtgagcagcgagttcaggnnnnnnnnnnacgtccccccctttcagactcgttaacccaccaggcatcgtagggggaccttctcccgcacgctgccgttgtcaaacaggcgctcgttgatgatggtgagcagcgagttcaggatggcggagtttgccttgaagatctcatccacaaacgccacgctggcgctcggcaggtacctggtgcgcaggtgtgcatgggctgaatggcatgagcgattggctgggacatggcatctggcatccacctcaaagtggaggtgcgcagcatcgcaagctgcaccaccccacccaccccgtggtcttgcgcttgtactcgtcatgctccagcgccttcatggagagtggcccaaacagctcctccggcactggaggtggatatggtagcgggaggatgtcctgagaaggtcgtggactcagacagggtgggtatgtcatgcagagccgatgcccggatgcaggaaatgctggaggtgtcacagcctcctccgcccagccatgccannnnnnnnnnttgagaaggtcgtggacacagacagagtgggtattcatgcaaatccgatgcccggatgcaggaactgctggagatgtcacagcctcctccgcccagccatgccaccctggcatgcacctaggcaccagggtgcagttgccaaacccttgatggcccaacccacaggagccctctcgttgcgaaggcagtggttattcaatcactcaggcatactaccgattgctaaaagctaactcacccgagaacctggtgagcaggcgcnnnnnnnnnncgacggcccaacccacaggagccctctcgctgcgaagacagtggccatcccaacactcaggtacactgccgattgctaaaagccaactcacccgagaacctggtgagcaggcgctcgaagaaagcaccgcggtacagctgtgccagcctgcgcccaagctccgacttggccgtgcccggcgggcctatgaacaagatgtgctcctgggccagcgcggccagcagcagcagccgcacctccgtgtccctctccaccaggccccgctgcagcgcctcgatggcggtcaggagctgcgggcgcaactggggccggtcgtcgatgccctggctggcgtgagatgcgcgctgcgcagaggcaagcgcctcctcctgggcgcgggagcaggccgccgcgatgctggccttcagcgcctccgtctgcggttcagtgggtgaaagagttcggtgcgattgtggcacctttattcccacgagcgagctgaggccacatatgggtaaggccagtcaacatctcgacctcctacctgtgcgctggagtaggcagctgccatcatcagctttcgtccgcagcctgcatgaagggaaatccctgtaatgctgtagtgtcaggccaggcgcgcatgagtcgggaaccgacggcacgcctgccatgccgaccnnnnnnnnnngtgaagggaagtccctgtaatgctgtagtgtcagggccaggcgcgcatgactcggaaccgacggcacgcctgccatgccgaccacctcccattcccagcacaaacctcgaggtgttccatctcgataccaggcgcccatgggccgctgcataggccaagcatgccgctgcatgccgccctggcacggagctggcggtccacggaagggcctctgcgccgagctcgcgcaggagagtcttgccgtcgacattcagaatctgcgatacatcagtgtatatggccagtattgtgaagcgagccacagaacgctacccagcacaaggtgaggatccccctgcccagatctcgcgcccccacccgttgggcagacaacaggaaggacttggagtgcatgctcaataaccactacacagccttgatctctggggcacggccacgcaagatcttcaagatatacactcagcattgcagtgctctgcagacaaggtgaagcccgcagtgaggggcatgacaagttttggatgccaccctgcagacctctcactttcatgtgcagccactatcgttgtgagcaggcgccatgcagttattcaatggatgacaagtttgatgtttttacgattgctctgcatttgtggttgtttggcaccctctccaacaaggcaggttgggatcattccaagagctgtccctgcacctccttagtcatcgccaccgccgagctgacttgacatgcacgctaccttcccggccactcgcgggcgacatcctgcagtctgccctgtcgaagtgacgacacacacgagaatttgtaattcattgtcgtgcgactagaagcttggtgcttctccacttttttgtacagcagtcggtctcctccactgatatgtgccacccctccgctcgcatcctggtcctataactcccattgctgtcgcatgcgattccacccttgtagcgggtcacgctgaaggacccagagccattcgccagcctgccggccgtccgtactgggcgtgccatgggcaaggctgccctcgtccccagccccgtccccatggggggcaaggcctggctacacggggtgagttcatgcttttggattgcaatgacgtccatacgacgcctgagaatctccccccgtccgctccgccaggccgtggacctgatgccaaccacctcccaccccaccccccaggacccccaccagcggtaccgcttcctgcgagtgctgggcacgggccacttcgcggccgtgtacctgtgcagccacctgggcacgggggagctggtggctatcaaggcgctggacaagcaccacccggagtttgagcggcacacggcgctggaggaggtccgcgtgctggcggcggtccaggaccaccacaacgtggtcaccctgtacgaggtgtgggaggacgcgtcctacatcttcctggtccaggaggcctgcctggggggcgagctcttcgacctggtggtccagaacaaggccttcagcgagcaggacgcggccaagaccatcgccgcggtcttgagcatggtcagccactgccatgcgcgcggcatcctgtgcagaggtgtgtgtgtgtggggggggggtccctctagagagcaagggtacaaggacttgcgcggcgcggagtgtggatggttcatgccctggtcttgcctggacgtnnnnnnnnnncgcgcgcggcatcctgtgcagaggtgtgtggggggggtggggtccctctagagagcgggggtacaaggacttgctcggcgcgtagtgtgtatggttcatgccctggtcttgcctggacgtggtgccggggagtgagacccctgctgcgccgccgctggccgccgctgctgtgcaggcctggctctggagggtacaagcaatgctcccccctcatgctcctccctcacacccctcatccccagacctgaagcccgagaactggctgctcaagcgctcggagagcagtgtgcatcctgagaacctgagggccgtggactttgggctgtccaccttccaccaccccaccgcgccgtgcacggagcgcgtgggcagctcctactacgtggccccggaggtgctgcaggtgcgcacatgggtgggtgtcaggaaggggcgggtgcagatcgcttgtgggcgcccctgccccgctgtcctcgttctgcaccaggcctgtctgcgatcgttggcgtggggtagccgcttgccgaggtcggcagtggtacgcccgctgcgacccgccagccccagccccgcnnnnnnnnnngccgctgtcctcgttctgctccaggcctgtctgcgatcgcgggcgtggggtggccacttgccaaggtcggcagtggtacccccgctgcgacccgccagccccagccccgctgcacagctgcagccttgtgcgttctggcgcacgcccttctgtcctgcagctgccgcttgaaggccgatctccccaccccgagtgctgtccgctcctcacggcacgtcaaagcccccttcccccctttcaccccttaaaatacacaccatctcaaccctcctcaccccctnnnnnnnnnnggccttgcgttctggcgcacgcccttctgtcctgcggctgccgcttgaaggccgacctttccacaccgagtgctggccgctcctcacggcacgtcgtagccccctccccccctttcaccccttaaaattacacaccatctcaaccctcctcaccccctctcctccatccaccccccaccatcctcacagggctcctactcctggcccgcagacctgtggtccgtcggcgtcatggcctacgtcctgctctccggcttcccccccttctggggctcctccgaccccgtcatctaccaccgcatcctgcacgacgacctggactttggctacgagccctggcaggcggtcagtgccacggccaaggactttgtggcctccctgctccgccgcgacccggcgcggcgcgcgacgctggccgacgcgcgagcccacccctggatcgctgacgcccctgccctgccctccgccccgctcctgccggaggtgctggaccgcatcagcgccttcacgcgtcagacccgcctgcacaagctgctgctgacggtggcggcgcggcacctgggcggcgccgcgctgggcgcgctgcgtgacgtcttcaagactttggacaccgacggcgacggcctgatcgggctgggcgacctgacggccgcgctgcgcgccgcgggcgtggacctggccgcggcggaggtcgcgggcctggtggactcgctggacggcgcgttcgacggccgcatcgcggtggacgagttcctggccgccgcgctggaccagcgcaaggtgctgtcggccaaggcggtgaacgcggtgtttgcggcgctggaccgcgacggcgacggcctggtgggggtggaggagctggcattcgtattagaagagtgccgcgtggaggtggaccccgaggcgctgcggcgcatgatgcgcggcgagggcgcgctggaccgctccggcatggtctccgccgcctccttccagaacctgctgctgggcggggaggcgggggaggccgccgcgccgctggccatcgaggcctacctccgcgacgtgcgccgcttcgccgccgcctcggccttcaagaagctggccatgctggtcatcgcgcgccagctggacgcggcggaggtgggcgccctgcgcgatctcttcgcctccctggacccgtgcggctcgggggtgctcacgctgcgccagctccgcgccgcgctgggtggtcgcgtggccgaccccgacctcgccgccgcgctggaggtgctggacctgaagcgacgcggcacccacgtcgactttgacgagttcctggccgcggcgctggaggagcagcagctggtgacggagaccaagatgcgcgccgccttcgactactttgacaaggacgcgctcggcgtcatcaccccggaccagctggggtcggtgctgcgtgacgtgggcatgcagcacggcgacgtgcagggcctgctggccagcgcgggcggcgggaaggcgcggcagccctccacgctgacctaccaggacttccgacgtgtggtcctggaccaggcccccaacatcctcaccgtgagctgcggggggtgttttgggggggtggagcttcgaaacagtggcgtggtaaagtgtggggacagggtgaggaggaggagctctgagggggaggtttctgaggcaaggcgacggggcggggggcgtggagctgcacggtcatgccgcacggcgtgcacctctgtcgaggcgccaggctgggcacctgtgtccagacatggccctgtccacacgccatgccctgcataccgacacctcccctccctcccccctccaatccaaaccattgcaagcagtgctgcagtccgcggtcgtcgctggacgaggggcggcccgagggccaggccagctccgggtccgggccggagggcacccccgggtcccccatccgggagctggcgggcatgatcgatgaggcctgggagccgcggctggacacgcccctggacctgccgtgcagccccctgcacggccgccgcggcgaggccgcgctgggctccgtggccggcagcgccagcttctcggagtgggtggccaccggcagcgccgccttccgccaccgcgacaccgcccccgccccagcgccgggtgcggccaggaaggacacgctgctgtctggcacgccgcacggcgcacaggcctcgcccccgcccaggggccgcgccgcgggggcgcggtcgccggaggcgcggggcgccaagcccaccgtgctccagtccatgctgcagaagctggtgaggggatcatcgcgcacgccgcggcgcggcggcgtggaccgcacctccaccatcagctctgccagcgacggcagcacggccgcctacttggcgggcgactgagagaggaggggcctggtcccaggagctgggtcggaccggcgggccattttttcccttgagaacccgccccatgaggggcaaaaagtactgnnnnnnnnnntcgaggggctgggtcggaccggcggggcattttttcccttgacaacccgccccatgaggggcaaaaagtactgcaaacttgagagtcagttcactgacgcaagcgtgggtcaaaaggcatgtctggaggcagactagcaaacacgtgaggtgggggaatggccacgcacgtggagagatgccgaatctcggatttttgctggggcccgtaccttcgccgctgcgctcatgggggcaactgcgtccccatgcggatctgtgccctggaatcgtctcattgatgatgcttcattgggggtttaccgcatgcaacaagtcatctgggtccatctcggccgccatggcgaggcgtaccagccggaaccacctgggagggcatgcgtacgacatgcgcatggttgatatcgtctgatcggaacgtgcaacagggcgccagccctgcgagtacaagaagccgaagccgaaggagctcagcacctctgatcccaattttattctatataagtgtggcccaggcccccgtgcccatcttttcatacaaagtctttgcccgggtttcacaatcgctttgcgcgagcccttccacacgcaaagaccgccacccctcacccctcacccaacctccatgatgtctcgtacgatcaccctcgccctctttgccctggcactctcgtccctcagcgcaccatgcgatgcgcgcgtgccctcccgcgacctgcttgccttccatggccggagcctcctggagttcgagaacatcaccctgccggagctgccctacgagtacagcgccctggagcctgtcatcagcgcggagatcatggagctgcaccatgacaagcaccaccgtgccttcctcgccggtttcaacaccgcggtcgccggactgatcgccgcccaggattcgaacaacgtcgccagcatcgtcacgctcacctccgcccttaacttcaacggaggaggtgcgaaaggtcttgggctggcatatcatggtgacgagtgcgtcgtaaggcggcgatgtcgggccactcaccggtgtgtgctcgtccgaggtttgtggtttgtgcgtgcgactttagggttttgcgcgcatccccctctcgcaggttggatcaaccacaacctcttctggccatccctcacccccgtctcggtgagtcggaaaggggaggacgttctttgacagtcacaaccaatctgtatcatttggcagcaagttgagagttgtggaccattgcatggcctgaagcttgcggtactcgtggtttccacaactaagatgcacaccaccagcacatgtccttctaaatggtctcatcaccaccctcatccattctnnnnnnnnnnccttccgatactcgtgctttccacaactacgatgcacaccaccagcacacgtccttcgcaatggtctcatcaccaccctcatccattctcacagaactacaccgagctgtctgggcctcttggagaggcaatcgatgagacctggggatcctttgacgcctttaagaccgctttcaacactgccaccattggcatccaggtccgtgacatgattgtggtgcggctgatcaagagtttccaggttttgtctgcctcacccgaaagtctgactcaccagctcaactgctagttcccctgttggataaccccatgccacactttcttgtctgcagggatctggctggggctggctcgccgtcaaccccgccaccggcgtgctttccatcaccaccaccgccaaccaggatgcgctccagcccaggaccggcctggtgcccctctttggagtggatgtctgggagcatgcctacgtaagtttggcttctgtgcgaagtgttgttgtctgcataaggcttctggttgtggttaggcttcagctagtctggatttgggacagccgcctgcttttgtttctagnnnnnnnnnnaaagtgttgttgtctgaacaaggcttctggttgtgttaggcttcagccagtctgggtttgggacagccgcctgcttttgtttctaggtatggggctgtacacatttggcaacaatttgggtcaactcatgacactgtccccttccatccccgcctttgcagtacctccagtactacaatgtgcgtgctgattacgtcaatgccatctggcagatcatcaactggcccgaggtggagcagcggtatgcgactgccactgcctaagtcggtgatcatgcagagggaagtgcatgacatttttgatgtggatgcagcattggtactgtgaatagagaagaccaagttccaagtccccacttttgttgtaaaccttcatcaaattctcgacaggctggcaacctgcttcaagcagtatagagctatcatttgcagcgtttgcccacagcaggaacccgggacatgaatgtcagattattcattcacccggaccctttgtactgatgtaggaatcaatgtaggtggtgaatgggctctctcgtctgtttgcatctgcccatgtcggaggaggttagtcaaccacatgcactccagctgcaggagctcgcccgataaatacatctgacccaggacttgctgcacaacatcacaccctctttttatctctctcctatcaacaaatccgtcatcatgctgtcctgcgcggcgtcagccgtccgatctgggcgcagcaccctcgtccgcgatgtcggtctgaggggcatggccaccggccaggacctgaagctgcccgcactgccatatgactatgatgcgcttgcgcccgtaatcatccccgagatcatggagattcatcacacgaagcatcatcaggcttacgtcaccgggttcaacaatgctctggcccagctaaaggatgccgaggcgaagaccgacccaagcgcaatcgtgggactgcagtctgccctgaagttcaacgggggaggtacgtggcgtgcactgcctggcgttcccgcaaacccaaggctgccttcgtagatgcctgactcagtgtgcccaccagttatctatcgagtcctccaacctttaaatgctccaggccacatcaaccatgcgatcttctggaagagcctcattcctcccaaggcatggcctgccccaggcagggtttggggcgggcatgcagggttcatgctggatcgttcgccagcctaacgactgagttgcgactcaaactcccacacaatgcaggagttccagccacccagcggacctcttgaggagcagatcaaggctacctggggatccttggacaccttcactgccaagttcaacgctgcggccgccggagtgcaggtgggatatgtggatggtatgagtttcagatgctctccatggcaacagggccgtacagccggtgtcacaaagggcatggcattggagaatccttgccctgcgcagtccactgcatggctgtgcaagcacacccccaggcaattcacgttcactgcgttgcctgaggtgtgtatactctcactcatgcaacatcgcacacgatcccatctttccacatgccaaacctgtaccagggctccggctggggatggctggnnnnnnnnnnttacgttcactgcgttgcctgacgtgtatatactctcgctcatgcaacatcgcacataatgccatctttccacacaccaaacttgtaccagggctccggctggggatggctggcgtacaacccggagaccaagggtctgcagatcgccaccaccgccaaccaggaccccctgcagcccaccaccaagctcatcccccttctgggagtggacgtctgggagcatgcctacgtacgtggctgggcacccttggcgcacattccttgcttcagcgggtgtctgcctcgcgtgtggcacacttgcttgagtgtcagcaaagcgctccccgtcatgacatgcaggcatagctgactgtgcccagcgctctcctatcatgtccctcatgctttcctccgcatcgccaccttccaccctgcagtacctccagtacaagaacgtgcgccccgactacctcaaggagatctggaaggtcatcaactggaaggaggccggcgaccgcttcgcggccgcctccaaggtctgatgggcaggcctggtcgccagaggagcatgtacattttggcatggcaggatgaatgagnnnnnnnnnngtccaaggcctgaagggcaggcctggttgccagaggagcgtgtacattttggcatggcaggatgaatgagtccaccttccctccaccttttttttcattcaccatgtcgcggtgccgatacagcaagcacaagcgggtcgatgtgtggcaacaggaagcaggagggcatggtgtggtgtggagaggatcaggcaaacagagtcgaaagcaggattggaaggcatggatccacgcacccaggacatgcgaggacactctgcgccgatcagcgcgaggcccccgcctcgccggcataggcccggacccaggcgtcgggcgggcgcgcaaaggcgcggaccgcgagaaagtgcggcgcacccccctcgacgcgccacaccgacaccctccaggtctccgggtgatgcgaggcggcggcgcccggcgccggcggcggcggcggcgcagatccgccggcgcgcgcggcctc

SEQ ID NO: 40909 - DNA, 61 bp, Chlorella protothecoides
atgggaggggaagaagcaggcttggaggaatgggctggtcattggggcggcagggacggtg

SEQ ID NO: 40910 - DNA, 95 bp, Chlorella protothecoides
cccctgctgccatgtcgcgcagctgcagtgccgcaaaataccggtaggaggtgcgtgcgcggggttgcaggctggaccagccctcctgcaccggc

SEQ ID NO: 40911 - DNA, 71 bp, Chlorella protothecoides
cagatcagagggcaatgccgatggcctgcatactccaattggatgggcgtgccgggttgcggtgctgacca

SEQ ID NO: 40912 - DNA, 61 bp, Chlorella protothecoides
aggggccgcacagggcagaatttgtgcgggggccaagagtcctggtgatcgaggcccaacc

SEQ ID NO: 40913 - DNA, 459 bp, Chlorella protothecoides
  modified_base (113)..(350): a, c, t, g, unknown or other
ccgccgtgacgtcatccactggcagcgggtcccagtaccacgcacgcaatcggtgtggttggggagagctggccccggccgcagagtggagccagggtcctggcttgctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccaggccggagccggggtccggagggactctggtgggtttgaagatcgacgaagcccaacccccggtcaaggagtctgccggtggcgagccaagaaacgagcacccc

SEQ ID NO: 40914 - DNA, 61 bp, Chlorella protothecoides
caccacgagcgcggcggagagggcggcctctaggtctgccaggcggggcgtccagccggga

SEQ ID NO: 40915 - DNA, 77 bp, Chlorella protothecoides
gaggaggtggttggggggtggagtgcgtttgcaggtggctgggcaggccagggccgcatgggcaggaggtccgatgc

SEQ ID NO: 40916 - DNA, 61 bp, Chlorella protothecoides
ggccgcccgccccatccaggtggagaacgcagtgcgcgtggggcagaagcgtgggcgggag

SEQ ID NO: 40917 - DNA, 63 bp, Chlorella protothecoides
ccctcgccggcagccagccctgtgacctctccgtccccggcaggcagccctgcgacctcccca

SEQ ID NO: 40918 - DNA, 65 bp, Chlorella protothecoides
agcgtggtgtcacgatctccaacgtgctcatgcggatggcactcactgagagacccatgatgtcg

SEQ ID NO: 40919 - DNA, 101 bp, Chlorella protothecoides
gccagggggctgctgccggtgcttgagagtgagaaggaagtggctgggggtggcatgccccgcttgcaatcctggaaggcgtggcggactgatcgcagtgc

SEQ ID NO: 40920 - DNA, 61 bp, Chlorella protothecoides
gcggcctccctccagctcctggcggccagcaagatgtgtgccaccgccgcagacctctgcg

SEQ ID NO: 40921 - DNA, 74 bp, Chlorella protothecoides
tgtcctgctcctcttgctttctgcaagcatatgggtcccatgcaatgtgcccgtgttctcatgtgcgttaggaa

SEQ ID NO: 40922 - DNA, 347 bp, Chlorella protothecoides
  modified_base (108)..(271): a, c, t, g, unknown or other
cgcgatggcgccatactccttacatccaggtctctctgcgcacacggcagtctgcccgccatccacaggctcgccaagccacagcccatggcctgagaccgacctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcacgtaattcctgcccgccagggagtcatccgggaggactgcaggggcaggggcgagggttgggaaggcagca

SEQ ID NO: 40923 - DNA, 79 bp, Chlorella protothecoides
cgctggctgggacctgggggtgtactgaccgtggaagccaggccgcgcagcgcgctgcaaccgcctcacgaggtgcggg

SEQ ID NO: 40924 - DNA, 135 bp, Chlorella protothecoides
tggggtggagagaaagggatttggtgcaccaggatcatgcgctgagcagcgagccccaaatgcccttgcgctgaagggttcccgcgctcgcccctgcaccctcttgtccctctgtgtggggaccagggcgccatt

SEQ ID NO: 40925 - DNA, 65 bp, Chlorella protothecoides
tgccagggaaggccccccactcacacacagcgagattttccacacctgctcgtgagtcggattcg

SEQ ID NO: 40926 - DNA, 63 bp, Chlorella protothecoides
tgtgccaggccaggccccgtcgcaaggtggagccgatccacgcgacccgcgacaggagcacct

SEQ ID NO: 40927 - DNA, 67 bp, Chlorella protothecoides
ctccgcgggctggaatgcgggggcggcctgcgctgcggggcccgcctgtactgcagggcccgcctgt

SEQ ID NO: 40928 - DNA, 86 bp, Chlorella protothecoides
tttgtaacctgttcacttgttgcgcggtccgaccctgcgctgctgggacctgtgtgtgcgcccccccccccccccccccccccccc

SEQ ID NO: 40929 - DNA, 61 bp, Chlorella protothecoides
cgaagctgggagcagttaggccactgtcgggtgcggtccaaaaagggaccttgcacaagaa

SEQ ID NO: 40930 - DNA, 132 bp, Chlorella protothecoides
accgagggcgagggtgcaaaggccgtgccgcacggtgcgcccagcgctgctccagcacgacgccgaacccccatcacatgaggcctgcccgtgtcaacatcacaacgccacccgtcagcattccttgtaccc

SEQ ID NO: 40931 - DNA, 67 bp, Chlorella protothecoides
tccatgccttgctcccaggggccctgcgaaagggtctgcgatgattccctcgcccagctcctacggt

SEQ ID NO: 40932 - DNA, 26676 bp, Chlorella protothecoides
  modified_base (627)..(636): a, c, t, g, unknown or other
  modified_base (1127)..(1136): a, c, t, g, unknown or other
  modified_base (1412)..(1421): a, c, t, g, unknown or other
  modified_base (1665)..(1674): a, c, t, g, unknown or other
  modified_base (2595)..(2604): a, c, t, g, unknown or other
  modified_base (3084)..(3093): a, c, t, g, unknown or other
  modified_base (4063)..(4072): a, c, t, g, unknown or other
  modified_base (4522)..(4531): a, c, t, g, unknown or other
  modified_base (5332)..(5511): a, c, t, g, unknown or other
  modified_base (6322)..(6331): a, c, t, g, unknown or other
  modified_base (6419)..(6428): a, c, t, g, unknown or other
  modified_base (7212)..(7253): a, c, t, g, unknown or other
  modified_base (7369)..(7378): a, c, t, g, unknown or other
  modified_base (8291)..(8300): a, c, t, g, unknown or other
  modified_base (8960)..(8969): a, c, t, g, unknown or other
  modified_base (9682)..(9691): a, c, t, g, unknown or other
  modified_base (10298)..(10307): a, c, t, g, unknown or other
  modified_base (10927)..(11083): a, c, t, g, unknown or other
  modified_base (11174)..(11183): a, c, t, g, unknown or other
  modified_base (11421)..(11430): a, c, t, g, unknown or other
  modified_base (12840)..(12849): a, c, t, g, unknown or other
  modified_base (13766)..(13775): a, c, t, g, unknown or other
  modified_base (14474)..(14483): a, c, t, g, unknown or other
  modified_base (14914)..(14923): a, c, t, g, unknown or other
  modified_base (15163)..(15172): a, c, t, g, unknown or other
  modified_base (15883)..(15892): a, c, t, g, unknown or other
  modified_base (18537)..(18546): a, c, t, g, unknown or other
  modified_base (19834)..(19843): a, c, t, g, unknown or other
  modified_base (20114)..(20123): a, c, t, g, unknown or other
  modified_base (21048)..(21057): a, c, t, g, unknown or other
  modified_base (21239)..(21248): a, c, t, g, unknown or other
  modified_base (22762)..(22771): a, c, t, g, unknown or other
  modified_base (22867)..(22952): a, c, t, g, unknown or other
  modified_base (23035)..(23044): a, c, t, g, unknown or other
  modified_base (23196)..(23205): a, c, t, g, unknown or other
  modified_base (23609)..(23618): a, c, t, g, unknown or other
  modified_base (23939)..(23948): a, c, t, g, unknown or other
  modified_base (25029)..(25038): a, c, t, g, unknown or other
cacgcccgccgcgccgcccgcgccaccggcggacaggtgcgccatgatgcgggcctggaccgcagtgggcgacacgccggcgggagcgctggcgtcagggcgcggtgtgggtgcgcggctggaccccggcgaccccccgaccggcgacccgccggcgggcgtggacgcggcgctgggcaccaggctggagctggcccctggcgcgtcgtagggctggaaggagtggcgcatgtagaagtggaggtcgcccgccacggccagccgcgcgcggccgcgcagagggccgcgcacgagatgccgcaggttgttggcggtgtcggtgccccagaaccagtccaccagccaacgcgggcagtgcatgatcagaatggcctggtcggtgggggccatgcgcgtctccgcaacgcgcgcaaagtacctggcgtgggagtaggggccggagcgtgggtgtgttggagtttggatgcctcccaggccgccttcgcgttggtctccccgaccctgtggacacccccttttccccccgaaaaccaacagacaaacgcacatacttgtactggcaggtgtcaatgtcgtcgacgagggccaggtctatgccaaacacccaccaccccgccggcagcctgnnnnnnnnnngtcgcgttggtctcccggaccctgtggacaccccctctctccccccggaaaaccaacagacaaacgcacgtacttgtactggcaggtgtcgatgtcgtccacgagggccaggtcgattccaaacacccaccaccccgccggcagcctgagcgcccagtacgacttctcctggggcaggagccagccccccagccagccgcggtgcaggatgtggcgggagaaggtctccagcccatcgatccagtcgtggttgccggggatggcaaaggaagacggaccctcgtaccgccgcagcgccgtggccttgtggcacagcctgggtgggcgggatttttgagaggggcgggggaggagtcgccggcgaagacgggcgatggggcggggtgacaacaagatctcaaacgcgacgtccacaggaccggtctggccgcgctggaatgaggcctagaacacacacttttcccgccccagctctctatctcatcccttgnnnnnnnnnngcgcgacgtccacaggaccaatctggaatgaggcctagaacacacacttgtcccgccccagctctctatctcatcccttgaagagcagcagcgggcctgcaaagtatcacccccctcccctcacacgcctgcacacagggcccgccccgcgccggggacaagtgggcaggcagcgcgggggcggcgtccacagcccgcgcccgacgtccggcttgttgaccacgaggtggcccttgtgtacgtgggggggcggcggcagcgcggcctcgtacagcnnnnnnnnnnaacgtccggcttgttgaccacaaggtggcccttgtgtacatgtgggggcggcggcagcgcggcctcgtacagcgagaagaggcgcgtgcggtacgtctcctctggggggttggttgttgttcgaggggtgggagggggatgggtgggatcccgcacaccgctggcatggccggcaagtgtaaggctgggcggtgtgccagcgactgtgatactgggagcacccagggacatcaacgaatcgtcnnnnnnnnnnttggttgttgttcaagggtgggaggggggtgggtgggatcccgcacaccgctggcattgccggcaagtgtaaggctgggcggtatgccagcgacagtgatacagggagcacccagggacatcaacgaatcgtcgagctgatggtggcgatgctccccggggtttctatcgggatccacaacccgtcaccctttcacacaacccatgctcctccccgttctgacacccaccgcacccgtggggttgggataggccaggtctccgccgtgcaggagcacgcggccgcgcggcagcgtgcgcgtgcgcttggacggcgcgaaagacggcccggcgtgcgcggcggcgcccgccgccgccgcctcggccggcagcgccacctggatggagggcgcggcgagggcgcgggcgacggcgtaggtggggtcgccgccgtcgccggtgtcggcgcagaagtcgaaccagagctcgcgcccctcggccaggtgctcaaaggtgaagccgtcgccgtcctggggcgtggggtcgggcgccacccactcgctggcggtggccacctgcatggtgcgcatgtcgaagcggcccaggaagaccttgaccgagaccatgaggtcgaacagcgtcttcagcaggtccgccgaggtgcccgagtaccagggaaacatgggcaggaaggcgggggcgggcgcgtcgtcgggcaggcgctggggcgggggcggcgcgggcgtccgcgggctgccttccccaccctcgccccagcccagctccagcccaaagtcgtcgcggaagaggagggaggaggcggcgcgcagcttgcgcgggctccacagggaccccacgctggacatggtgcgcaccagcacgtcaaagctcgtcctgaggttgaagttggttggttgatgaggagggacatccaaacgggtgnnnnnnnnnngaagctggtcctgaggttgaacttggtcggttgatgaggagggacatccaaacgggagcgggtgcatgcgctggccctctccacgccggcaaggaagcaggcaaggaagaagaggcctgtgtcggccacaggcgccctcctcgaccatacacgcctcccccagtcagtcacagggaccaataaaaacagtacccaaccccctgccccacctgctgggcatggcgctgcgcccctgctggcccagcaggtcgtagctcaggtcggcgctgcgccggcgcacccgccgcgagcgccgctgctccgcagccagcgctgcgccacgacaggatgggagtgtgttcgtgtctggactggatgtatcccgtccgcggccctgggacgctggccgccacctccaggccctccgcagtccccagcctctggcatcccccaccccccaccccccgcccggccgcactcacccttcctgcgcgccagcgnnnnnnnnnnagtgtgttcgtgtttggcctggatggatcccgtccgcggccctgggacgctcgccgccacctccagaccctccgcagcccccaccctctggcatcccccaccccccacaccccgccaggccgcactcacccttcctgcgcgccagcgaggcggcggcgtgcatggcggaggcggcggcgtagtcgctgaggcaggtggcccccagcatggccaccagggtgagccagaggctgaagatgggggagatggtgccgccctcccggtccagcaccaggcccggggcgcccgggggcagcccctcccgcgcctcctcgctgtagatgacccaggaggagaaggcggggaaggcggccacgggcaccggggccaaccagcgctcgcagaccgccttgcgccagggcgagcgctggacgcccgtggggcggaagaggtggagcagcgtggcgcgcggcccggtgcccggcggcgcctcgccccccgcctcggcccccgcctcgcagaaattgtggtaggtggagcaggccagcgccaggttggcggcgtgcagcgccaccaccgaggcggcggaggggtgggccagccaggggcggacccaggcgagggccagcgcggcagcgtgggccgccgctgccgcgcccagcaccgccagggagagcaggaaagtggtgagcaggatggagaggtcggcgcggaggtcgatgcccaggctgtccagggaggggaggtggtagaagacagcggagcagagccagaggatgtacaggctgctccagctgatctgggcgctgcggcgcgggtcacgaggggggtggagagggggtcgctggtctgagggagcgggaggtgagcaagcacgcgaggaaggtgtcgacgagtcgccagccagggacagcccctttgcatctcagcaacgcctgcacacaacacaagcacccacctggcggcagaaccgaggcggaggttgatctgnnnnnnnnnnacgggaggtgagcaagcacgcgaggaagatgtcgatgagtcgccagccagggacaggccctttacatctcagcaacgcctgcacacaacacaaacacccacccggcggcagaaccgaggcggaggttgatctgggggcgcacatacaggtatgcgaagaggcacgtcgcgcctgcggtgattgcggccggcgagcgaggcgaggggtgagcgaagtgagggggcgagtctgcatgtgcggcgcgacggacgaccacctcatcgctccagcacgcaagagggcacaaaggcaacagcccacccatagaaacgggcaggcagtgcgtgcggcagcagcctaccgaagaggtagtaccagcgtcggttcaggttgaacctctccaccactccctaaggggttcagaaaagggagcgggtggtttggcgctagaatttggcaatggcagggccnnnnnnnnnnattcaggttgaacctctccaccactccctatggggttcagagaagggagcgggtgggttggcgctagaatttggcaatggcagggccatgaagaggcgcaatgccaccatagttgcaagtttcggagtcgtgagactgctgtggtgaggctctgtctgcgctatggaccgcccctgctgcatgcctgtgtcgagaggctgacatccctcaccctcaccccttccccgggcacccctctcccacctgtgcgctgtcgatcaggacgcatgcagccgagaatgtgatgaccaggtaaattgcatactgcgtatgcttgaacccagtcacgtgtgtcgccatctttggtggtctcggatgccacctcgctgccaggccactcactcgcagccaccccggtcgggagaggggcagaggggcctgtgggaaccctccaggacagtcatcgagggtctaagtttccacattccattcgagcggtctgtgattcagcacaggcattgatgggcgagcggggtgaaatgccgtggtcatgtgaggcagcactggagaatccgcatctcgacagcaactgttcaaatgttccccgatcccggtctgccaccacacccaaccaccccatcatctcctgctcttagattacaaacatccgatcagcagcgagggaatcagcacacatggtattgatcaaaacagtgctccgcccttgctccgtgcagccccgggcccaccctagggggtgaacttggtggcagccgcgaagccattgttggtccaggggtcggccaggtggtcgctcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaccggggtacagggggtccaggccttcgccggcgggcccgccgttcacgcggtagccctccaccaggcccatgagaatgacctgggagatgagggtggccacgatggactgggcgtgcaccagggaggggttgcccaggtagtccaggccgccggactggaagatctgggagccggccttgaaccaaacggcctcgccgaaggaggcggcgccgttgcgctccagcagctcgggggtgatgatgcccagggcgcccagcagggcccagcgggcgtggatcacctcgatctcgcggtagcgggcaaaggtctcggggtcggcggacagaccggcggtgtcccagccgtagtcaccggggtactcgcctgccagtgtggggggggagggggggcgggggagggtgagaagggttctggatggggggtggaatgcgatgcagctacaagattcagcaagatcgagctgcaggagctacgaggccaggcagggacacgatcctggcagtgccatcccatcgctcaatgactcaggccaaagtacaggatggcgaattcatcacacggctcccacatgcccccgctcacccttcaggtagtcgggggtggagtcgccggagaagggtcccagccacttcacgcggtctgcgaaggagtgagcattcggatgatgagcgcaggtgcacatggagagtgggtatcgagtggcctggggccaggccaggtcaggaggggatcacacgaccgagggagggcactgctccctggcccagggcaagggcaaagaaggcaagcgagcacggccagctannnnnnnnnngagaatggatctggatggggggtggaatgcgatgcagcgacgagattcagcaagatggagctgcaggagctacgaggccaggcagggnnnnnnnnnngggggatcacacgaccgagggaggggcactgctccccggcccagggcaagcgcaaagaaggcaagcgagcacggccagctactcactggggccgtagaactcggcggcggccctggtgacctggcgggtgccctgtaatgacaaagggttggggcaagcatgtgtgagatagggtcgggatgggtcgggacctgggagctgatcggggcccactgtcgccccgaaaccgttgctcgatcgagggccctggcgtcgcatgggagctagtttccaaaaagaaatgcaaaggcaaaacacaccagaccattgcaatcactcacccgtccagcggtggggacggcgctgcgcagggtggtgcccatggtggcgcgcatggcggtctgcatgatgaagaagaagccggttgagatgctagaaatgaaatagagaggatgaatctaccgaaacccggcgctgatgagctctatttgctcggggcacgctaccgcatcttgttccagcaggagtagatttggtcgggataccctggtgcggtgccctcgcaccagggtttatgctcccacaatcgtatcccaccctcggattttcccccatctgtcatcgtacgtcggccacgagatccatggggtggtgggatctgcgtgattcctgacgtcagcttgtcctatcaatacaaattatatgctcgagtgttcatagccctgcggtgcggtcgtgccccgtgcgggcctctccagatacccccagactccgcctctccgagcacgtgcctgggtatccgctnnnnnnnnnnnnnnnnnnnnnnnnnnnnnnnnnnnnnnnnnntcatcatggtaaaacctccgcattcagagcaccaggcagccaggatcatcccaggaccatgggccctgcccctgctgtgtccagagcattcaccgccgcctcggagagcaggctgnnnnnnnnnnaaggaccattggccctgcccctgcagtgtccagggcattcaccgccgcctcggagagcaggctggcaccctccgccgacccgccgtcgaagggctgggccatggcgcgcatgaactcccgcgcgatgcacaggagcatgtcggtggagaggttgaggtgcgcgtcccgcagctggctggagatccagccaggcaacttgtcgcgcttgtcgtggcgctggtagcgcttgtccgcaaacaccatcagcccgtagtcggccttggagcggatgacgcggcccacgcactgcgccgcctgccgcaccgcgtcaaaggccaggaagtccgactccttgatctggaaggtctcgcgaaggtattccagccgagccctgggtgggtgtggggttgcacggaagcagaggggtgggatgggatgggggggaaagtggacggaatgagattctgtgagatgttggtgttgggatgaacgaaagaagggtcgatgtgaggagctgtccgagctatattggggcgaggcccgggccaaggggccggcggctcgcgcggcagatcacgcccgcggcgcacccgtatctcagcatgtttctgtttctgcccagcaccttcaaccctgcccatgaacacccgggcagcacctgaggatgcggcccagcgtgtactggtagggcaccccaaacatgaccacgcagcggccgtagtgccggtcaaagtctatgccctccgccaccttgcccctcgccacactgcattggtgtcaggctggactggaacggggagcgagggagaaggcgagcaggtccagggcagcatgcatacaagagtgaggtgcacgagcaggggccgttgccaccaagtccccgcggaccgcaaaggccactcggccgggcagcctttgccatcggcgccgcccnnnnnnnnnnggagcaggggccgttgccaccgagcccccgcggaccgcaaaggccactccgccgggcagcctttgccatcggcgccgcccacttcaccccttgcaccaccgtcatgcacctgaagaagatggcgccccgcccgcagtcgcacgcgcgccggtagttgtccagcgccagcgtcgtctccaccacgtccactgtctcgatgaagaccagcttgtgcgtcatgagcgccgacaggatgcccatgtcgttccagcgtgacactatggagtccatgtaggagtaggagacgaagaagcagatgatgccgtcgggaaccaccgccgccaggtccaccagcatcctgcctgaaattgcgatggggttggtggaaagggttgaatggagcagagggtgtgatgctggcagatatgtggtgaagtacatgccaatcctggcgctccaggggaccaaaggatgcagagaattctggtcttgaggcagaccgcctgctgccagcccactcgggagaggccgaggagcggataccgcaactgaaacccctagcctatgatggacaccagtgcgcacagcctccacatgggtcaaatgtcacccacacaaaccgtgacagcattccccccaaactgcaacctgcccaccgtagttcctggtgacagccgggtnnnnnnnnnnacccgctgccagcccactcgggagaggccgaggcgcggataccgcaactgaaacccctagcctacgatggacaccactgcgcacagcctccatatgggtcaagtgtcacccaaacaaaccgtgacagcatccccccaaaactgcaacccgcccaccgtagttcctggtgacagccgggtcgtcacgcatgtcaaacttggtggacaccggcagctggtccccaccgcgcgtcaggaccacggggcagaggcactggcgcgtcaacgtcatggccagcgaggccaggcacacgggcttgaagtccaggatgcgggggtagaggtcaatgggggacagcgtgcccgaggtgatcaccacgctctggaacttggcaaacacaggcttgatggccaggctggcgtccaggcacgccagctggatcaccggatctggcacctgccgtaaggaaggtgatgtgggaattgagggatggacactgtttgcaaaggttgagggttatgggataggagcattgtcattgggtgctgtgaaagggacgtgcttcgaagtggcaaagcgatgcaagccacatccctcttcttcatgcgtgacagatacagcggcaggggctcgttctgcagcggaatggctgtaccatcagccgatgcagctttctcctcccacgtgaacacacacacaccacccccgccggctgcacatgccagcttggcgcnnnnnnnnnngtatgggataggagcattgtcgttgagtgctgtgaaagggacgtggtttgaagtggcagagcgatgcaggccacatccctcttgttcatgcgtgacagacacagcggcaggggctcattctgcagcggaatggctgtaccatcagtcgatgcagctttctgcccccacatgaacgcacacacaccgccccgccggctgcacatgccagcttggcgctgctagtccacatgcatgccacctcacagccagctgcactctcttccccaagccgccttccttccactcccaaatcccctcaccccgggcatgcgctcgtcgtagggctccacgatgatggcaaagcccttggtgtaggtgcccaccagcgtggcaaagtcggccacgcgatggatgggcccaaagtcgtcggtggccgagatctccaacgtcttcatgaggcttgtcagccggtcgtagcagaagcgcagcgtcttgccctcaatggcaaccacctggggaggaggggcgaaaacgagaagaaggggtggtcagggtggtggcctgcactgggtgtctgctgtcgagcgtgaggtgggtgtcccacagaggagtgtggcctccatggccnnnnnnnnnngatggcaaccacctgggggagaggggcaaacacacaaaggaggggtggtaagggtggtggcctgccctgggtgtctgctgtcgagcgtgaggtgggggtcccacagaggagtgtggcctccatggccagacacggccaccattccccagtcaggaccgcaatcacccactgggacttcctctcacgctctggaggtgggtgaggaaggaggtgggggtgtcggacaccacctggttgacgttgagccgcgtgcgcaggaaggagaggaagcgctggaggaaggcgaggaagtgctctgaggcgggtggggagtcgggaggttgggtcattgtgagtgactctgaggcacccaggtggtacctggcaccctcttggatcccccccaggccacccaccggcacggcggatgttccccggcaccgcttcctggaggatgtcggccggcagcgccgggttggcgagccactgctcgctctccccgccgcccctgagggccccctggctcgcaaggccctgggaagatgccgggcagagggagttactcagcaaagggcggcagtcagggggcaggcaactgcaagcatgccgagatacggccaccctgctcccatccctgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggggggttggtcggggagacagggtgaggggtccggtggtggccctgttcaacatccatgactgctgcgcatgtcacacaccaggnnnnnnnnnncctcagcaaagggcggcagtcagggggcaggtgactgcaagcatgccgtgatacggccaccctgctcccatccctgtgacctcccatacccacccacctgcaccaggcgctggtactcccgcttgagccggtcggcgtctgtggacttgacgcgctcgatctcggaccggaggcgagccacgttgcgccccgcggcatccaggccctgctgcctcagctccacgctgtgggtgccatnnnnnnnnnnacccgaggacgcttgctgggcgcgggtgtagtttcaaggggagactcaatccctggggggcccatccacagggtcatgcccggccagctgtctttgctgtactcctccttcacggagcgggtctcccagctgcgcagcgtccttaccacccatcctcaacctccccttcctgtactaccccccacccccttcatttcccccctatctcttcacctcagcgcctcgatgcacacgttgtcgatgttgtgggcctcgtcgaagaccacgatgcactcgcgctccatctcgcgcgacaccatggctgccaccttggggtccaacaggtactgatagttccagaccaccacgttggcgtaggccaccatgtggcgcgccaggaagtaggggcaccagcgccgcttgcgccccagcgcgcgcaggtcgtgcatggtgtagaccccggcgtccaggcggccgtcggcgcccgcgccctccaggccctcgaagaactcgcagagctcaatgtcaggcactgcggccggcaccgcggcggcggcgccggcatccgtggtctccgcgccggggcgggctgcgccgcgcgcccgctcccggacccaggaggcggtcaggcgcatgcaccgcgcgtccacactctctcgagacccctcctccgccacgcgcgggtggatgcacaggttcttgcgactggacaggcccagggccagcagcttgggggcgggggcgtcggtgaagtagcgggatcgatactcgatcaggtccttgacctccgccaggacctgaggggggtgggaagggagaaaaaagagggttggggggggaagcctcagggctaaggtgctgtacacctgcaggagcaggcaggccattacacccggatcagagcctcggtcccgcctcggcaactgccgctgcatagggcgccctgcgcccccgacacacaccatcaccttctccatctctggtacggtgcgcgtgcagtatatgagcttgccggtctcggggtgggccagctggtacgaggtgatgagggacagcagggtgatggtcttgcctgtccccgtcggcatctggaaagtatggaggaggggaggccggtctgtgatgtccaggggctgcaggagcgagtgcgcggcccacgagcccctgacatccgatggcaggacagagggcatgcccatgacatggcctccaccctcatccccacctccagcaggcagtggcccttggcgtccagagcatgcttgagctccagcatgtacttgtactgctcgggatagatgtactcataggggaaatagaccgtgaggccctccaggaggaaccgcatgctggggacccgtgcctgataacgtgctcgtgccgatcggtggcctgggcctaggctctagacacggcaatgacccctcatgnnnnnnnnnntcatgctggggacccgtgcctgatgacgtgctcgtgtcgatcggtggcctgggccaaggctctagacacggcaatgacccctcatgccatccactgtccaaagtccacgcgccaaggacggggactccgcctgtggccagcgtgacgacggcgtggcacaccctgtttcgggtggcgagagccttgccaactgcaacaaggctatgatggcggcgtcaatgacggtagctaaacgtgtcaatagttgaagaatccagtatatataggtgtgcgtccagccttgctgcttgggactctccaagcaaggagtgtcgacgatgtgatcaccgaacccacaacaggcaagcacccagttattatgtgggcacgttttcacagaggaggcatcattcggatcaatttcatcctctaagtgtcgctcctaatcggtgccaggcgcaggactgcaccatctcagacagggatgctgcccatgaaatgctccggaaaacccataatccatgtagtctccgctcggtcgatgggaagtacagcttgtcgccccccgccatttccagcatctttgcgcttggggcaatgtccgcgttaatgaggtctaaccgagaccggactattgcgaattgaaaactatattccaaagcccgctgcgatctacttcggtagtcgtagcaatttctggacaggactctcgcagtccttaaaacccccccacactatcctccaccattcacctccactgaaattcaatcaatacatgttgacaggtgttggtgtaagcagtcaatggtgcagtgtgccgaggagcggcggggtgtagtatcggtgacatacagcatgggatacagtgaaagaatttgcgcaaggacgcagggcgcagaaacaatacacacatcatctggctggtcgtacatcctgcnnnnnnnnnncgtgcaaggacgcagggcgcaaaaacaatatacacatcatctggctggtcgtacatcctgctaccgcttcttggcggctgcctggcctgcctgccacacgtccgcagccctgacttgcacgcgcagggcccccgccctcaccgtcagcacgtcccccgcaaccttgaccaccatccccgtcgcgcccttcagctgcgcgacagccacaatgtccccgacgcgcaccacgggcgctgcccgggggttgggcgcccccgggggctgcttttcccgtgccggctgcagccggccacgcatctgggtcagctcccgccgcgcagccttgccgtccaggagccccgtccttgtctcgtgcagcatggtacggatgcgagccttcagttctgcctcatccgcagcagcctgtgcaaattgaggggagggaaggggagggggaacccagggtgaaaggttgccgccagacctagccttcccccacagaaggagggcatccaagttgccgagcccatccgcccaccaccaccaccatccaggccccctttgcaagcgacccacctcctgggccattcgttcttcgacgtttgcggcctcccgctcgcaggccagcagctcagcctcggccgcggctcgctcccgcagcgccgcctccagcgccctttccgctgccgccctttcttcgcgcaggccgcccacctcctnnnnnnnnnntgtggctcgctcccgcagagccgcctccagcgccctttccgccgccaccctttcttcgcgcaggccgcccacctcctccgccaggccgcgcagcgactgccgcgccggcccctgcgccgccgagctcgccgacgcgccgccgcccgccagccggtcgcgggcggcggccaggatgtcggggtcgaagcccaggccctgcgcgatgctcagcgccatggagggccccgccacgccccaggtcaggctgtaggttgggtgcagcgtggatgtgtcgaagcccaccgccgcacaacagaagtcgtcgcgcgacgtcgccagtgcctgacagtggggacggggcttgtcgggtggcgtcggtggtacctcagcacggcagtcattttgtgcaggtgagaagggctgccgccttcagggctggggctggttgcatnnnnnnnnnnggcctgaaagtggggacggggcttgttgggtggcgtcggtggtacctttgcacggcagtcattttgtgtaggtgagaagggttgccgccttcagggctggggctggttgcatgacgagactgttccgtgcacaccagggactacatgtcagcctctcactgcagcgagctccccatgcccacccccgcaagcaccccactcaccagcaacccacacgctcgcccctccaaatcccctccnnnnnnnnnnggcagcgagctctccatgcccatccccgcaagcaccccactcaccagcagcccacacgctcgcccctacaaatcccctccacccacgagtgatccacacctgtgatcccccttcccctcccctgacacctcaacacccctctctgcttaccctgacggcggtgtggtgggtggtgacgagggtcagccccgcccgcccggccagccacgtcagcgtcgccgtggcgatggcggcgccctcgctgggctcggtcccgctccccagctcgtccaggaggaccagggaggatgggccggcgcccgcgcaggcgccggccacgcgccgcatgtgcgcgctgaaggtggaaagcccggcgcccaggccctggccgtcgcccacgtcggccagcaccgcctcgaagaaggggaggcggggtcctgggccggcgggcaggaacaggccagcgcgcgccatgaggcacgccaggcccagtgtcttcagcgcggcggtcttgccgcccgtgttggggccggtgatggccgccacgcggctggcaggcgggatgtgcagcccgatgggcaccgggggtggtgggagggagggggtgggggatgcggaggaagcctcctcgcagccgtttggcgccgcatcggcgtccgatgcagccgccgcagcgatcgcaccgtcactcctcgtcgcggcgccctcgtcagcacccctagcgccctctgnnnnnnnnnnacattggcgtcagatgcagccgccgcagcgatcgcaccggcactcctcgtcgcagcgcccttgtcagcaccccttgcgccctctgcgccggcctcccccccgccagacgcatgcccgaggctgacccccagcagcgccgggtggcgcatgccctccagctccacgcccgccccgaatgtcggccgctgggccccgagccagcgggcgtgcgcggcgcgcgcggaggcgaggtccagcgcgcacagcgcgtcgcgcgccgccagcagggcgccggcgtgccgcgccacctgtcgtggcatggagttgggtaatggggggggggtaaggcatgggaagggggggaagttattggatcgactggcctcatgcctttggacacaccaaactcagtacatcattcaccgtcatggggtgtaacccagggcccccgccatgcaaacgccacaagcaccgcccctcccacacctggcgagacagcgaggccaggaccgccgccacctcctcctcctcccgcccggccagggcggcgatggcgttgttcagcggcaccagctcggcgggctccatgtaggcggtggcgcccgaggcgctgagggccagggtcagcgatccgcgcggcaggtcgcccttgcgcgcgcggcgcacggggcagcaggcccggtctcggcgctgcaccaccagcgggcgctcggcgacgcccgacgcgtgcagccgtcgcgcccaggccgtggcggcatggtccagctctgcagcggcccggcgcgcggcctcccggacggcgcccagctctgccgatgcgctgtccagcaggtccggtacgccaggctggtgtgagagattgtggggtcccggggggagagtcgcagggggatttggtcagcatgcagacccgcgaccgcagcggcacagtcgaggaatctaccaaatcccccaccaaagtcccacaaagccgccacaccgccgcaccctcacggccagcgtcagggaatcgaggagctccgtcaggcggagcgccgggccgtaggccgccaggtctgggcgggcatccttctgagcagtcaggccatcgtgtgcggcctccgccagctgcagggtttggagcagggctccaagggcgtcgacgctcagcaccagccccgcacaagccccctccacagcgtcgaggtagtctgagacgcccgacagcctggagcaggtgtggaaggagggatggccgcaatatgctgtggcgatgcagcatcaacaataccacatgaaagtttcctcctctcctgactctgtactaccagcctcacggtgttgtgaggtgcagtgcttgctctgtctcccgcagcaggcgctcgctgacttccctggaagagcccaaggccaggccatgcgggccatgggcggcctccatgcccatgggggtccgacagaagcgtcccacctggacgcacacctcctgccaccccagcatggctagggagtccagcaccaggtcatgttttgtgagggggcttgatttcagggctgacaaggctgtgccttctgatgtcacctgggcagcactcctcaccacaggcgtcctgcctgcatggtgaggtcgtgctccatgccaccctgcattggcccatggggctctgtcaacgcgagcagcggcaccttgcggaggcatcgagctcgcagccatgcggtgcatgccatggtgcctcgctccaggtgtcacggcgcccatgcgggtgttgtgggtgacgcattgcagcatcgctcacgcggctgccgagcgacgagcccgccctcctacagtcaagtattgcggtaattcgcattcatatgtttggcaacaaccctgggattggatttcattcgcatctgcatgtccactccaacgagcagcagagcacatcacagcatggtggtttcgacacatcgccgacagtcgcaaccttgattaaatcagaaggcctgccttccttggccagataaggtctccacaatagctcatgaaaagcaattgaagcgcatcggtcctgcccgccatggcctacctcctcgcaggagcggcagggctgttctacttgctgtacaagggaaagcgcgaggccggcgataggtcactgcagcgaaagatattgaaagaggtaagatgcaagtgagtttcttaatgttcaggagtcttctcatgctgcgatcttgggttgcacggatgagactggcaagctttgatcttagatccccctccccttccttgcatgcacagtaccaagacctctttgatgtttcgacgcaaaggctgcgggacgtgcagcgcgacctcatcctgcaagtagaagcgggactcaggggcgacaaatcggggctcctcatgctcccaacctttgtggacatcctgcctacagggtgagcttggaggattggttgggcgagtgtgcaaggtctagttgcccttgtgggtggctgcgtgcatgtcgcggacatcatcttgatggtttctgacaacctgatcaatgttttccatctacagggatgagcagggagactactatgccattgacctgggaggaacgaacctgcgagtcctgcacacccggctcgggccagagaagggcgaggcgagtttgcggtgggggctgcaagcaggactactgtggctggaaggagtnnnnnnnnnnggaagggcgaggcgagtcagcggtggggggcgcaagcaggactactgtggctggaaggagttgatataagtatgtgttctttttcgtgacaggagcttcagcaggagcagatggtgccaggagaggcagctgctgacttgtatcaccacaccttcctctgccagggagaggagcaggacattcgggaatggcccattcccaaggagtgcttcaataccgactctggaaagctgctggagtttgtggctgactgcgtcgaggagatgctggtcgagcacccgccagcgtgcgtttcttggggatactgagggctgtgcgttggggctgacaggctcttcatcaaggggtgtgctgctggctggaattcgattcttggtcagcaggctgtagatgcttgcacactcgcttgaaatatctctccacacctccggtgccttgctctccaaagtgtggccccggctgcatgatcttccaacaaggttcaagctggccatgcatcactcctccagctcgccaccaatcctccatgctcgccccccccttgtcctttcaggtctggggccctgcccgttcttggcttctgtttcagctttggtttcaaccagaccgcgctcaacaatggtgtccttgtgcggtggacaaaggtgaggagaggttggcgatgttgaccgcatgtgatgaaagggtgggggccgagagtttccattgacagcgctgccgtctgtgcttgtagctcatttttgcatgccggattgtgagccacaagatccctttggtgaggacccactttctcgagcggcaaacattcccctccctttcacctcaacaagctcctcctgcatacattcaatccctacatccttggcccaccccccaccggcagggcttctacggcaagggcctgattggcgaggacatcgtgggtgcgctgcagtgtgtcttccgggcgcggggcagggcggtggagatcccggccatcctaaacgacaccgtggcgacgctgatcgccctacgctacgcggaacccgccacgcagctgggcatcatcctgggcacggggaccaacgccgcctatcaggagcgcatcgacaggtcagggattgtcgagcagtggggggaaagagggttccatcaggggactcaagacccacctctctcgctgaagcctagcacccacggtggctggacccatgagcaacagccctcctgacacaccctcacgctgcccaaatccacaggatcaagacgctcgaccccggcttcaaggggcgcagcgagcacatggtgnnnnnnnnnncgacacaccctcgcgctgctcaaatccacaggatcaagacgcttgacccgggcttcaaggggcgcagcgagcacatggtggtgaacacggagtggggcgacttcttcgcggcctccctccccgtctgcgaggaggacgactgggtagatgccgccagcgtcaaccccggccgtgggcggctcgaaaaggtgggtgattacagggttggtgtgatactgggccagaccgcttgatcgcccagggactgttgggtgacgagggatggagcgcnnnnnnnnnnggatgccgccagcgtcaaccccggccgagggcggctcgaaaaggtgggtgatcacagggttggtgtgatgctgggccagaccgcttgatcgccccgggactgttgggtgacgagggatggagcgcccattcctggacttaatggacggttgatggccctccaccacccctggttgcctgcccagactgcccatgaccccctctgactcctcctccccatacaactcccccagctggtgtcggggctgtacatgggcgagatcgtgcgccgcgccctggcccgtctgggccagcatgccggcctgttcggccgcgccgatgccctacccgccgccctgctcacgcccgggtcgctgggcagcgcggcggtggccgccatggacgaggacgagagcgccgacctggcggccgccggcgccgcgctggccacgctgggcgttgcccggcccacgaggcgccagcgccgcgttgcgcgcgcgctggcgcgactggccgcgctgcgctccgcgcgcctgagcgccgccgcactgtgcgcgctcctgcgccacctgggctgggatgagcgcagccgcgtggtggccgccatggacggctccgtcttctgccggtacgcggggtaccgcgccatgatgcgggacaccctcgagcgcctgctgggccgcgaggccgcggcggcgctggagctgcgggaggcgcgggatgggtcagtacgtggcgccgcctaccttgcggccgccgcctcccgatacgaccacgcccccagggcctaggcttttggaggggggaagctacgagaggggtgccgggggagctgatcgccctgcctcatggcatgcacatcggctgaccaatattccaatatgccccgcgtcaggctgcgtcctaggcctcgcaagcggaatctcccctgcagggccagcacatgnnnnnnnnnngggccttggcctccgctgccctttgctccagcatagccgtcttccaggcgtcatactcctgagcaccgcgacgcgtttggcaggggttgggggatgcgtgcgcagtgtgctaatcttaagaacatcgaccattgcatcccagcaacctggagcccccccgctggtccacagcaccctgtccnnnnnnnnnngacgcccggcctcatggcatgcgcatgggctgaccaatattccattatgccccgcgtcaatccgcgtcctaggcctcgcaggcggaatctcccctgcagggccagcacatgtcagcgccacctcttggaatcgaggaatggaaggagtatacatcaggaacacgggttattcacatacaggacgagcctttctcacgcgccggcgcgttgtaggtcagcgtggcctggcgcagggggccactgggcggatcgttggccttggcctccgctgcccttcgctccagcatagccgtcttccaggcatcatactcctgagcaccgcgacacgtttggcaggggctgggggatgcgtgcgcagtgtgccaatctcaagaacatcgaccattgcattccagcagcctggtgcccccccgctggtccacagcaccctgtccagccctgccttcactccacacccgcttctgctgcttgccggcatgcacccggcgccccacggcgccatcctccagcacctcttcgtcactgctgccgagctcctccagtctcgctgaagccgcaacagccaggcacctgcatgtggagaatgcgaggcatagctcctggggcttggggatgaacgctggggttgacacatggacctcgcacatggtggccagctctgagagtgcgagtcctgagcatccccttgccgccagctcacccatctgcagcctcgtcttctgcgccctcaggttttcgcctacgcttggcactgctgccggtgctgagctcgggcatcagggaagcaacagcagtggcagccgcagcaaattctgtaggtaggacacccaaaggctccagcagtctccgcttgtccacctgcgaccgatacgcaatcgagaatggacgaaatgaaaggtattggaattcgcaggtagacttttgtttgagaccgcgtggatgtggcgccgccgccaagcggaatcacagggtgccgctgagacgagcggcaaaacctccctcccgccacacctcttgtgtgtctcacactttaccaaacaggttgcacctgtttgcgtccgcacgtgcaaccctactccttccgcacaccttgactttgtttttctgcgccacagcgaggaagattgccgccacaaacacgggtttgttgagtgccaccgtccccctttgagcaatggcaacctgggcgacatatctctgcttgaaggttgccagcgctgcagccaccggccgctccagccggacgcagccaaactgcagacataggtcccgaggatgtgtctgcgtcttgaccccgagcaacttctgcagcatggcacgtgcattccggtatacctggggtatacagggtgattggtcaaacttgaggtgcaaacatcttgataagtgccctgctgtactgcgctagcccagccatcgaagtacgcagacaccagtgcagaggaaatgtgtacagtattgtagggatgcccaccaactcaccgttgcggaggctccactgtgtttctggagtnnnnnnnnnnaaagtacacagacaccagtgcagagaaaaatgtgtacagtattgcagggatgccaccaactcacggttgcggaggctccactgtgtttctggagtnnnnnnnnnnnnnnnnnnnnnnnnnnnnnnnnnnnnnnnnnnnnnnnnnnnnnnnnnnnnnnnnnnnnnnnnnnnnnnnnnnnnnnagcttccccctgcacagaaggtgttgatggagttgactcttgctgatgctttacgtactcttgccgctcaaaacccagtgccnnnnnnnnnngctccgctgtctatcgagtgttgcagcctgtgggatgccagacgacatctcaaacagatggcaacacatgtgaacaggctctgaaatgtcctatccattgaactgctggaaccctttcgacaactcacatcatacaggatagctccaggcannnnnnnnnncccattaaactgctggaaccctttcaagaactcacatcatacaggatagctccaggcatgctgctgccttgcaggcttccccctgcacagaaggcgttgatggagttgactcttggtgacgcttcacgtactcttgccgctcaaaacccagtgccgtcagctcaccgtgcccatgctcgccccagcaagtcttgtattggcaagtcgcatgtattccgaggctttgttctgcaccgctctgtcgctgatgccgattctgcgagccagcatggagatatccatctcaacagatgtgttgagccacggacgctgaacaccgcacacgccagcgaagccaaggagctgcttttcaatttatttcatcacatgtagcacgcgtccaatgtgcgtcttcagcgcgcagnnnnnnnnnntctgaacaccgtatacgccagcgatgccaaggagctgcttctcaatttatttcatcacatgtagaacgcgtccaatgtgcgtcttcagcgcgcaggctgctggtgcccggggaggacgagttcgtaatttcataccctacgcgtgcgttgcgtgccatgcgtctccgggtgtcacgcagggtggtaagctgtcggactcgacacctgcacaccacttacttcagactctgcggtgactaacgtatcattgccttcatcggaacgctctcgcattctagccctaataggacactgaagtctcggtagtcgaaccagcttcannnnnnnnnntggtgactaacgtatcattacctttatcggaacgctatcgcattctagccccaataggatactgaagtctcggtagtcgaaccagcttcagccgcaatgggggaggtgaacgctgaacgacgagaggataccgggctgactgcgtccaacagcgggtacgaagtcgtatgatgtgatggcgtgagcttactggcctctaccttgctgcatctccgtacttcatgttccatacagaactcattatcactccaacagcgcctctcttacatgtcaggatctccatcgaggaccagtcgatgcttgctcgggtggccttgagctctggtgtgcctgtcaagtggtctgatctgcagccggtggttcacgctgcgattgatgctgtgctatcacggtttgcggagaggggagggacacaggttgggcccccaccccccatgctggatggcagcgaccttgagaccttcagaaagcggctgcatgctctgctcgacgtgatggatggccctccattcacgatgcaacggctggcagagctcttgctaggcccagagaagcaatattcctcactcccaaagcttgtgagttgggagcacatgatattgatcgtggaggaaaagccttgggaggccatatggacctgattccctgagccagagatgtttcacagccagaattcatacccctgccctctcccctccaggcgtctgccttggaaaagctcctcatggtcgtcacttctgctcccgtgctggaggctgcagacgccgacgtgcagccgcttcctccagtccacccagccatcattgcccgtataaatgacaaccctcccagccactatgttgtgcagatctctgatggatccctggacgtgagcatggacacagaagaagatgtgcatgtgccagaagctgtgaacgctgaggctgtaaaagagtagttgttttattcgtacactggctgagagtacactcaaaacactggatatgtacatgtcatgagttcatttcaatttatccctgggatacctccctgttgacggatacacgaattcctcgctgtacggccgaaacccagggaacannnnnnnnnnaattcgtacactggctgagagtacactgaaaacactggatatgtacacgtcatgagttcatttcaatatgtccctgggatacctccctattgacggatacacgaatccctcgctgtacggccgaaacccagggaacacaaaatcgatcgtcacagtcggagcatacatctcgaatgaaacctgtcaacacaagagctcctaaacacttgaagtgattctgacaacacctagagagaggtgacctacgaccagggcatgaggatgtgatctgaaggtcgctgccagtgggtgtcgcatgccccaccggccgagcccccacgcgctctgcaacaaggaccgcagaccattgccatgttgtcaaggaagaactctagcattctcacggaagagcagagcttccctggtggggctctgcaggggtactttcctcactccaaggtgggcaggttatgagagccctggagttgctgctcctgatccctctgaaggcctttaacaagctgttccctccttcttctggaccctgcttatctacaggactgtctagaggaggcgctgacccctgacaccttgcttcatggctacagcgtgtcctaccagcagccctggggcatcgatcgctccgcagagttgtgcctgtctgtcctggacgaagcccccgaggggcgctgcctgcatggcagggacctggccgccatgcaagaggtgggagagtgggttttagggctggaccatgcctgtggggtgggttgagggtgcatgatggacatgattggtgtgccctgcttctgccatggctgtgctgggaatccatagtgcccctcacgctggggcctccatcagccgacccgccgccatgcacacaggacatgatgcgcatgctgcgtgccgccagggagcaggatacccgccggcggcggcgtgccgaggcgtcgttcgacgccccgctctgccaggcccccccgcgccccgcccccctgccctcccaggtggccatgggcgacgcggcgcgccgggcctggctggcggcgctggcgggaagctgcccgctgggcagcctggccgcgcagggcgtgccccacggcctgggcaagggccagctctgggaggcgctagcggaggccggggtccccctgccgcgcgccctctggctcgtgcgggtcgtgtacctgcagcgcagcaggtgtgaccgggtagggggtaaaatgggggtcgtggcaggcgggttggcaggcaaatggccacgcgcggtagtgggaggaaggtctgcttggtctgcctgctcttgttggtgaaggtatcgggctggggaggcatggctaccggccctgcgccgacctcggccgtgccacgactcgactctcccccactgacttctcctctctcctcgcatcaagaccccccccgccccacaatttctacccgcaggccgctgtcggccggcaagcaggcgcagcccagcgagggcgcagcggcgctagagcgcggcgcgcgctgcgccgacgacctggcctcgcacctggactcgctgcgtggcgggggcgggccggcctgggcgtactgcctgcgcctcgccggctgcctggcagcggagggcctggccgacgcgccggcgctggcggcctgggcggcgcgctg

SEQ ID NO: 40933 - DNA, 61 bp, Chlorella protothecoides
tcacagcagcatgtcgacaagccaggagaatcatccctagcagcacacaccccagtggtac

SEQ ID NO: 40934 - DNA, 68 bp, Chlorella protothecoides
acgacctacaggggtaggaaggctgggtgtaaacaaaggcactggctgtgcatgccgctcacagcgtt

SEQ ID NO: 40935 - DNA, 78 bp, Chlorella protothecoides
ctcggcgccaggctcaccttgaacgcccatgtatgtgctgccctggtccctccctgggaacgtgcatgccgtgacttg

SEQ ID NO: 40936 - DNA, 112 bp, Chlorella protothecoides
aagcttgggacagtgccgcctcgaggtcctccccggttggggtcacgctccgagcaacgcccccgaacgccccatcctaaacacacacacacacaccgcatcactcatgtgg

SEQ ID NO: 40937 - DNA, 344 bp, Chlorella protothecoides
ccccgctgccactccagcaccaccacgtccagccaggcctcaccgtcaggtaccggtcaaaggtggcagagacgtcgtcgacctgggaggcattgcacggcagcttgtagtcgaagatgacgtcatagctgctcgacgggtagatgaagcgctggtcggtctgcaccaggcagtggcgcgccgtcaggatgtagatcttgtcacctgggcccttgatgagggtgcctgcagcgattacgtggcagtcgggtggtgcctggggagatagtcagccaccagggggtggggagcggcaacactgattacagtgcacgtcagcccatgggatgtccatcgtgcacatg

SEQ ID NO: 40938 - DNA, 7588 bp, Chlorella protothecoides
  modified_base (101)..(110): a, c, t, g, unknown or other
  modified_base (785)..(794): a, c, t, g, unknown or other
  modified_base (3259)..(3268): a, c, t, g, unknown or other
  modified_base (4982)..(4991): a, c, t, g, unknown or other
  modified_base (5477)..(5486): a, c, t, g, unknown or other
  modified_base (5828)..(5837): a, c, t, g, unknown or other
  modified_base (6520)..(6529): a, c, t, g, unknown or other
  modified_base (6604)..(6613): a, c, t, g, unknown or other
  modified_base (6885)..(6894): a, c, t, g, unknown or other
  modified_base (7057)..(7066): a, c, t, g, unknown or other
  modified_base (7140)..(7149): a, c, t, g, unknown or other
  modified_base (7361)..(7370): a, c, t, g, unknown or other
gccagcacacttgagaaggtccatgctggccatgttatgggacctgagcacggccaggcagccccctgactgcctccttgacgcggggtgagcctctgcannnnnnnnnncaggttgggttcaaagggagggcccagggagtgggtgaccctgaaagaggcagcaacgaaaccgtgcggttgccagcacacttgagaaggtccatgctggcaatgttatgggaccggagcacggccaggcagccccttgattgcctccttgacgcggggtgagcctctgcagcgccaaactcacagcacgatcgccggcgactggcatcccatcccccctctggccagtcgtcgcccccaaccccagaccccacgccacccgccagccctcaccgcgtcgacgatgccggaggccatggaagcctccagcgctatgaagcccgaggcgtggcccatgagcttcaccaccgcgatgccatgccaggtggagagcgcctccaccttggcggcaaacagggcgcgctgggcctcattcaccgcagtctcgaagccaaagcacctgtccacctggcagaggggggaacgtggaggacgcaatggtgtcgagacccgtggcctccccttgcacagtgaattgctgggcactcatgcccaactagactgcacaagcgtcaaccgtgagcagcagtctctggctgcagacccagctgcattgccattgaccccagagctgccacaggacctcgccccacacagcctcccgccccaccagcaggatgctgttgtcgatgctcnnnnnnnnnnactatcgaccccgaagctgccacaggacctcgccccacatatcctcccgtcccaccagcaggatgctgttgtcgatgctcttgggcacccccaccaccacgcagcgcacaccgtgctgagtcagcagggcctcgagctgggtggcgcccatgtggccaccggcgccgccgatgacaaacagcatgtccaggcccatcaggtcaatcatcctcacgatcttgctgaggggtttgggagaggtaacggagggggagctcacacacaagagggctacagacggctcgaggcagggaatgcacacagtggagcacaccacaacctccaggctccgacccagccacacaagcaccccccaccgatagtcgggcgcgatgctagatgtgccaaggatggagccgccctccaggtggatgtcttccacgctgcgccccgtcagcaccaccgggcggtgcttcttggagtagaacccctggaacccgtacctgccaaggggtccggggtgttggttggtgtgaacctcaatcccaagactgatgcatgctgtccaggccaagctcgccgtcgcaccgcctcctacgcaagcacaccaatcccccctcctccaaccgcacacacctgatgccaaaggtactgccctctgggaccccgtaatcccgcagcttcctgaccagcccctggatcacgtcattcagccccggacacaaaccgcccaccgtcacgactgcacagcaatcaagggggacccgggagtttgatcctgatggaggggattgacactggccacccaggtctcccacacacctcccactccccactcccccgcgccctcactcgcggcccgagtcaacgacggctcaaagtagatggtctccctcggccccgcacgcatgccccaggtgggcagggggatgcagacgtcctccgcctccgcctcgcccccggaggaggtggggggcaccaccagccccgccttctcccccaggcccgccacgggcgccgagcaccgcacgcggtcggcgctgggggaggaggaggagaagtagatggcgttcagcatcacgcgatcctcgtcagacacgaagcggccgctgaagtggctggattcgttgaatggagagtgcctgcaagggggagtggcgggcctgttgcaggcatccttgttgggggttctccctgtaggcctgcatggggaaaccctaccccccttggcctccatgcagggccattccccatcctcgatcgcaacccaccgggatctcagatgcggacgcagggtgttgcactccaggacatcactgggaccaggaaggctctgggtaccgggacccgctctgcatgcgacctgggcgggaggggttcctgacttggagagcaaaccccagagaggtctactgggggggatgagagctgcatggggcccgcacagcaggcgcatggtttgtaatggaagtcgattgtgtatggaagaagggttaagcgggacatgcgtcgcccttgacagtctgcgggcctcccagtgcggccccagacggagggcgctctcagatacgaaatcatccctcccgcctccggccagagggtcctgcctgggccgtgcccaacctcattccctctcccccgccagccagctatccattcgtatcggctcgcaattcagcccagctgaaccgcacggatcgctggtctcgattggattgctggaggctgcagctggtcggagggtgcaacccacccctccccaccccagccagaaatcgaaccactgccctgttcccaccccagcacccccggcaggcccgggatctgagtgcctgtcatgcagatcgcggccataccggtgggctgcgggggagcattgggtcggaccctcccccgacccttcagggccagtccccgccctcgccccacccaccccgcgcatgcaccccgctgccgccgcacgggcggcgttaccatggcatctgtgaaggagagccctgccaccagcgagcatagcgtcaccgtagagaccaccgaggagggggcactgatctcgctcacctgccccaaccgtgccggtcagtgatggactccgagccgagggggcatgcgcacctggtgctgggtccaggggtggcagaactggacatgcaaggcgctggacgggggggctgtcatgggtgtgctgccctgtttatgttgaggggagggggggggattttagatcagtgacccagccccatatgcttggtgccctcccgtcccgacctcccttccggcaacccctcctcccccgcgccatcctcatcccaaccctccttcacccccaggcctgctgagccggctgacctcggccttcgaggcgctgggcctggacgtgaccaaggccgacattgggggcgatgctcgccacgcccacgaccgcttctgggtggccaagcccggcggcggcgccgtcacccccgccgaggcggcctccatcaagnnnnnnnnnncgcttgaggggagcgtggccggggcgggggcccccgccgcgccgccccccgccgccaagacccggccgctgttggcggtgcccggggcggcgcgcgaccaggcccacctcctgcacacgctgatggacacgtacacgagcgacaacgtgctggccatccagcaggccatcgtgcaccatgtggaatacaccctggcccagacgcggtacaagtttgacgacctggaggcgtacatggccacggcctactccatccgcgaccgcctgatcgagtcgtggaacgacacccagagctacttcaaggaggtggaccccaagcgcgtgtactacctgtccatggagttcctgatggggcgcagcctgctcaacgcgctgaacaacctggaggtgcggggccagtacacggaggcgctggccgagcttggctactcgctggagacgctggtgacgcaggagcgcgatgcggcgctgggcaacggcgggctgggccgcctggcggcctgcttcctggactccatggccaccaccaacctgcccgcctggggctacggcatccgctaccagtacggcatgttccggcaggtgctgcgcgacggcttccagcacgagcagcccgactactggctcaactttggcaacccctgggagctggagcgctccgcctccatcgcctaccaggtctccttctacggccacgtgtcggtgcaggacgacggcgggcgccaggcctttcgctggaacccgggggagcaggtgaccgcggtggcctacgacacccccatccccggtttccagaccaacaacaccaacaacctgcggctgtgggcggccaagccggaccgcgagttcgacctgcaggccttcaacacgggggattacgtgcaggccatcctggccaagcagcgcgccgagacgctgtcctcagtgctgtaccccgacgaccgcacctatgagggcaaggagctgcggctgaagcagcagcacttcttcgtctccgccaccgtgcaggacgtggtgcggcgctaccgcgagcaacacgcctcctgggacgccttccccgacaaggtggccttccagatgaacgacacccaccccacgctgctcgtccccgagctcatgcgcgtactgatggatcacgagggccttggctggacgcgggcctgggagctggtgaccgagacctgcaacttcaccaaccacaccatcctgcccgaggcgctggagcgctggccggtggccatgatggagaagctgctgccgcgccacatgcagatcatctacgacatcaactggcgcttcctgcagcagatgcgcggccgctacggcgacgactgggaccgcatctcccgcatgtccatcatcgaggagaccccggacgccgacaagtacgtgcgcatggcctacctcgccgtcatcgccgcgcgcaccgtcaacggcgtggccgccatccacagcaacatcctgcgcgacgacacctttgcccccttccacgagctgttcccgggcaagttccagaacaagaccaatggcgtgacgccgcgccgctggcttgccttctgcaacgagccgctgagggagctgctcaccgacaccctgggctccgacgcctggatcaaggacctggaccgactcaaggtgggtgcttgttttgcttcttgcggtgtgtatgagagactgtgtgcataagtgtgtgtgtgtgtgtgtgtgtgtgtgtnnnnnnnnnngttgttttgcttgttgctgtgtgtatgagagactgtgtgcgtaggtgtgtgtgtgtgtgtgtgtgtgtgtgagtgtgtgtgttatataggagaggggatgggtggcacgctggtggtttaatcgcaactccctcggacccacttcacaagtatccaaaagtaaatccacaggtgctgcgcgagcacgcgagggacccggcgctgcagaagcgctggcaggaggtcaaggccctggccaaggacaaggcgctgagcaccatcgaaaggctatcgggcgtggcactgcccaaccgcgaggccatgctggacgtgcaggtgcatacgagcagggctgggtgggacggggaggagaagagtatcaaggggaggcaggtgtcgtgaggagccgtctgggccgcgcgactgtcctgggcattgccacctcggcagcaaatgcttgctgccacgacgccggcgagtctctctccatctgcagcgctgccctcnnnnnnnnnncagcaccaagggaaggcaggtgtcgtgaggagccgcctgggtctcgccactgtcctgggcattgccacctcggcaacaaatgcttgctgccacgacgccgatgagtctctctccatctgcagcgctgccctccccctggacccggatcgccactcaccaccgacacgccccaccaccaccacactgcacaggtcaagcgcatccacgagtacaagcgccagctgctgaatgtgctgggcatcgtgcaccgctacgacaccatccggaagctgccgcgggcgaagaggggaggtgtggtgccgcgcgtgtgtgtcatcgggggcaaggccgcgccggggtatnnnnnnnnnntgacaccatccggaagctgccgcgggcggagaggggaggcgtggtcccgcgcgtgtgcgtcatcgggggcaaggccgcgccggggtatgagatggccaagcgcatcatcaagctcgtctccgccgtggccgagaaggtgggtggttcgctttgctggggggggggtgcatgtgtgtgagttcaggtgagcatggggctccgacaccgtcaggcaccccccccgattcgctccagcccgcaggacgcccattggcgcacaaccgaccaccccgttcctcccccacatgcccctgtttcgcaggtcaacaacgacccagaggtcggcgacctgctcaaggttgcctttgtgcccgactacaatgtgtcggtggcggaggccatcatccccggcacggagctcagcgagcacatctccacggcgggcaccgaggcctcgggcacggggaacatgaagtttgccatgaacggcgcgctcatcatcggcaccatggacggcgccaacatcgagatcgcagaggtaaggtttgacgtcttttcaacagggggtgatcgtgctcgaggcgcggtctctttgacaagggctgcatggaccggccactgggggttggtcaggcgaagtgggcgtcaagtgccgctcccagctcgcaagcctatgtgctgggcgcggccctgcatgcacactnnnnnnnnnnttcccccgattcgctccagcccgcaggccgcccattggcgcacgaccgaccaccccgttcctcccccacatgccnnnnnnnnnntgcgcaaggccccgctttccacgcacctgggcctcgatgtaggggccgaaatcgttggcaaccaggtagtagtccgagtaggtgatggagtccagcagcggcacaaagtctgcaggttgagcgtgacgtttggtgtgtccctgagctgggtgagaccagacaggaggggccagggcagtccccattcccttcagagcgaagccacccccgcattcctgccacagcccccgttccttccccttgtccagaaacggcctcaaaactcacagtcnnnnnnnnnngaggtttgccgtcttctcagcgggggcggtcgtgctcgaggcgcggtctctgtggcgaaggctgcatggtccggccactcggggttggccaggcgaaatgggcgtcgagtgccgcacccagctcgcaagctcatgtgctgggcgcggccctgcatgcacactnnnnnnnnnncagcaccccccgcattgctgccacagcccccgttccttccccctgtccagaaacggcctcaaaactcacagtcnnnnnnnnnncaggccgcgtcttcccttagggtctcgcccctcaaaccaccgtgcaggaaatcggggaggacaacatcttcatctttggcgcccgcgcaagcgaggtcgcaggcctacgcgcagcccgggccgagttccaggcaagttgtcagaatgaagagttggatggcagcgctccctgggggactgtgtccatggtgcagagcgccttttcactggannnnnnnnnnctcccagccaaaggtcccactgcggatcaggtccagcgtgtgcaggaagcgcgggtccggctgcagaagatctcatgggtgagggtggggagcgatggtgagctcaccgcaagccagtcttggagtccagtgaaaaggcgctctgcaccatggacccagtccccctgggagcgctgccatccgattcctcattctgacaacttgcctggaactcggcc

SEQ ID NO: 40939 - DNA, 61 bp, Chlorella protothecoides
cagcttagacattgtacatccatcccttgggaacccagtgcagctcacaggagaaggtcga

SEQ ID NO: 40940 - DNA, 74 bp, Chlorella protothecoides
caccgcagatttgtgcccttgttgttgagagcccaattcaggtatcccttgttgtagctccctgcgcatgatgg

SEQ ID NO: 40941 - DNA, 61 bp, Chlorella protothecoides
acggctgccagggcacacacggccgcggggtacattgctgcctcggccgcctgcagctggc

SEQ ID NO: 40942 - DNA, 94 bp, Chlorella protothecoides
gtcaacaactatgcttacctctgcgacggcctttccatcgcccttcgccagagcctgcgcgaatcgagataaggatctcgcacggtcgggaaca

SEQ ID NO: 40943 - DNA, 169 bp, Chlorella protothecoides
ggcttagattctcagctgggaaaccattgcagactgaataaggtgatggaagtgagggatgacaaacacactgggggaaagttcttgcaggcagcgcagtctcagctcccttcccatgttgccacagcagcacatccagcccccacctctcaacctcccggccacagcc

SEQ ID NO: 40944 - DNA, 61 bp, Chlorella protothecoides
ctcctgtccctcctcctcctgcttcccctgcccctgccccgcccgactgttccgcaacccc

SEQ ID NO: 40945 - DNA, 68 bp, Chlorella protothecoides
tgcggcgcgggagggggggtgggggggtgggggggtgatgacgagatggggccgatgatgagaacgcg

SEQ ID NO: 40946 - DNA, 78 bp, Chlorella protothecoides
tgagtctcacagacgcacacatcccttcccccctcagctccagcacgccagcccagccggcggcaggcgccccagccg

SEQ ID NO: 40947 - DNA, 77 bp, Chlorella protothecoides
ggtcggcccaggacggagggggcatcatgcaggggactccggcgagcccctggatacgttccttggggcgcctgcgg

SEQ ID NO: 40948 - DNA, 61 bp, Chlorella protothecoides
cctggttgagtgtgagtggcggtcataagggaggaggaatagacgtccaccatagaccagt

SEQ ID NO: 40949 - DNA, 72 bp, Chlorella protothecoides
cctcggcatcagtggtcgggctctcctcggtggcagaggcgcggctctcctcatcagcggacgcagggctct

SEQ ID NO: 40950 - DNA, 100 bp, Chlorella protothecoides
agtgcgtgcaggtgagagagctgggctggggggggctggaatcgagttggtgcgggagggagacgggctaggcgctcccgcttcgccctgccctgcccgc

SEQ ID NO: 40951 - DNA, 79 bp, Chlorella protothecoides
gaccccttgacgcagatcgtggacgagctgcctcccccccgcttcccgtgctcgcagttggaaccgacgcccatcgaca

SEQ ID NO: 40952 - DNA, 75 bp, Chlorella protothecoides
gtcactgggaggcgaggccgcgcgcctggacccgggacgcgcagactcctttccactcgactggcccccccagcc

SEQ ID NO: 40953 - DNA, 61 bp, Chlorella protothecoides
aaagaggacgtcggtgtggagggtgcgctcatgcgcctcatccaccatcatgcagctgcag

SEQ ID NO: 40954 - DNA, 97 bp, Chlorella protothecoides
gagggggccatgcatttgattttgggtgaccccccccagaagcggcccttcatctgtggctcaccgcgcattatgcagcctgcttgcccttccgagg

SEQ ID NO: 40955 - DNA, 79 bp, Chlorella protothecoides
agagattcgaggatccctcacccagaccccctaccctcccaacacaccgtgcagactactccaccaagtacaggtattg

SEQ ID NO: 40956 - DNA, 61 bp, Chlorella protothecoides
cgacgccgcaccagaggagctggtccggcgtggcgaccgcgaggctctggccgacggcgag

SEQ ID NO: 40957 - DNA, 231 bp, Chlorella protothecoides
caaacatcccacaccagcgacaggcatggccctcggtcccacctcccccccacctcgctcaccctgagggcgcgcgcatcctcgtggctgtgcacgaggaagttgggcagcgtccggccgattgcgcactgcgggagcaggcgggcggggtgtgttgagccaccaaaaatgggcggccgaggggggatgtgctcccgctgacccaacgagcgctgcggcacggcggcgaag

SEQ ID NO: 40958 - DNA, 61 bp, Chlorella protothecoides
agcgggaggttgagaatttgctccaggccaaatgtcagtcagcgtcgtacagcccaccgga

SEQ ID NO: 40959 - DNA, 94 bp, Chlorella protothecoides
gggctgctgggtgggggtgggcacgtcctcggacgaccggtgtcccgcctgttcggaggatgcagttgggctccgctcgctgccggccttggag

SEQ ID NO: 40960 - DNA, 61 bp, Chlorella protothecoides
ccagccctgtgccctcacgctcgccggcgggcagccctgcgacctctccgtccccggcagc

SEQ ID NO: 40961 - DNA, 71 bp, Chlorella protothecoides
gcggccacaggtatgcactattgtgtgctgggggctcggagcccggggatctagatccgaaccgtttccga

SEQ ID NO: 40962 - DNA, 418 bp, Chlorella protothecoides
  modified_base (117)..(342): a, c, t, g, unknown or other
cgtcgaccaattcatggacctggtggatgttgccagcgtggaggtgggtctttccttctcagtgactgaccaacggcaggctgctgggggggggggggccggggcaatcgagctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccctccgtcccctccaggtgaagatcggccagggcagcagcgccaccgggccgggccaggcgctcctcccaggc

SEQ ID NO: 40963 - DNA, 68 bp, Chlorella protothecoides
cgaggaggatgcccttcgaccctgcaaacacaacatgtctcccactgtcactgccagttgaggcccct

SEQ ID NO: 40964 - DNA, 61 bp, Chlorella protothecoides
ggccaggcctgcggaacacctgccccggcaggcagccgcacgcgcaccccggccggggttc

SEQ ID NO: 40965 - DNA, 112 bp, Chlorella protothecoides
gtgtgagcggcggatgcggggcgcggcaaagcgagcaggggctgcggccccaccaggcctgcctccaacctgaaacaaggcctgccacccctcaccagtcatcgttggagcc

SEQ ID NO: 40966 - DNA, 64 bp, Chlorella protothecoides
gctggcgcagttggttgcctctaatggcgaccggggggggtgggggggtgggaggaaaggaagg

SEQ ID NO: 40967 - DNA, 87 bp, Chlorella protothecoides
ccctccacagagtccgggtcacgccccaccgacacagcgcccctcgcctcgctgatgtgcctccagcgcacccctggagagtcggcg

SEQ ID NO: 40968 - DNA, 122 bp, Chlorella protothecoides
gtctaaaggagaccccaacccatcccccctcccccccgccccctggactctgccttcccaggtgcaagccgatgtggctggagcccagaaccccggcagcccctactggtacgatcgtggag

SEQ ID NO: 40969 - DNA, 111 bp, Chlorella protothecoides
gggtctgggacaatacgaatctccatccgcgggctacaagaggtcaggagctgtccttgcaattgtccctcactcacctgcccccaaggatcgctgggagtgggacctggc

SEQ ID NO: 40970 - DNA, 981 bp, Chlorella protothecoides
  modified_base (412)..(421): a, c, t, g, unknown or other
gagggcgtcggctgcgcggcccgggcgctgctggcgcgagcggccccgggcgcgctggccctgctgtgcacgctgagcgtggcgtgccccgatgcggtgcaggcggcgctgctggcgccgccggccctggccgcgtgggaggccgcggcgacagcaggtcgagcctgcctccagcgcacgctgacgctgctggcgacgctcgtcaggagtcagagagccggcggtccgacagctgcaggtcggcaccccacgcccgacctgcaggcctgcctgcgaggcctgcagcccctcctcgtgcgcctgatcctggacggcagggatcgggctggtgtcgcgtcggcctgcgcagccctgaccgccacattggaggcggccacatcgtctgcgtcagatcccaccgcccctcccgcgnnnnnnnnnnccgggctggtgtcgcgccggcctgcgcggccctgaccgccgcgctggaggcggccacatcctctgcgtcagatcccaccgcccctcccgcgcccgagctggtcaccctggcgacgcgcctgccgagcacggccccactcccaggccgcgccgacgccgacgacggggcgtcggacgcctgggccgccctcctgtcggagctggcgggctcggacctcggcgccgaggccgacgccggcatcatcggcgcggcaagctcggccctggttctgtgggtcgacgcgggcgtggaggggcccggcacactgaggcatcccgctggcaccgcctcgagccccgccacgcggccactgctgacggcgctgcagcgttgcgtggatcgcggcgcgcccctcccgccatcgctggcgcccgcgctcgtcgcctgcgccgcctcggcgcgacatgcgccccccgcctcgcctgcctgggacctgctcctggcggcgctggcgtccggggacgagggggccatgccccgctgcctggcggcctgcgacgcgctggtcccggccgcgctgg

SEQ ID NO: 40971 - DNA, 97 bp, Chlorella protothecoides
ttttgtggacaggcgtggttcagggccatgcggaagggccgtcgtggtggcgtcggtccaggccgtcggtgcttgcacagacttgtgcatgtgtccg

SEQ ID NO: 40972 - DNA, 61 bp, Chlorella protothecoides
gagccgggtctacgcgtccggcttgagaccatgaacaaccctccgacagtcgggatcgcag

SEQ ID NO: 40973 - DNA, 100 bp, Chlorella protothecoides
aaacggcacctgccggtcagcctactggcctagccccaagactagcatcagctcatgtgttccctccctatgtccacacccctctgcacgtgcagtggtc

SEQ ID NO: 40974 - DNA, 61 bp, Chlorella protothecoides
gcagtccagacaaggtgtgtgggggtggggaggacctgcgtggatgtcatgtcctatgagg

SEQ ID NO: 40975 - DNA, 95 bp, Chlorella protothecoides
ggggtccatgacatcatgtacgatggccccaaagaaagccggggtgggggggtgggggggggggggcaaaagcccagatgcgaagcacgatcgcg

SEQ ID NO: 40976 - DNA, 71 bp, Chlorella protothecoides
gcagcaggatcggggccgcccctcgcagcaccggcgtctgtgacatgcgacgaccccttccgggtcccaga

SEQ ID NO: 40977 - DNA, 61 bp, Chlorella protothecoides
acatgcaaaaccccttctccgccccacagtttgcccacctgcaatgcccatggccagtcca

SEQ ID NO: 40978 - DNA, 73 bp, Chlorella protothecoides
agcgcgccggccaggcgcgccgccatgccggggccaggttccaccctttccacagccgcgtgaagagcggcgc

SEQ ID NO: 40979 - DNA, 74 bp, Chlorella protothecoides
tctacacgatgcgcgcagggaggatgtgcaaggccccagcatactgcgtgccgccgcctcgcggcagccgtccc

SEQ ID NO: 40980 - DNA, 61 bp, Chlorella protothecoides
gagcgcgcgcgaggtccccgggcgacgggaagagggcggccgcctgctgctcggcgccgcg

SEQ ID NO: 40981 - DNA, 35460 bp, Chlorella protothecoides
  modified_base (829)..(838): a, c, t, g, unknown or other
  modified_base (1062)..(1071): a, c, t, g, unknown or other
  modified_base (1822)..(1831): a, c, t, g, unknown or other
  modified_base (2311)..(2320): a, c, t, g, unknown or other
  modified_base (2433)..(2442): a, c, t, g, unknown or other
  modified_base (2811)..(2820): a, c, t, g, unknown or other
  modified_base (3315)..(3324): a, c, t, g, unknown or other
  modified_base (3634)..(3643): a, c, t, g, unknown or other
  modified_base (4080)..(4104): a, c, t, g, unknown or other
  modified_base (4187)..(4196): a, c, t, g, unknown or other
  modified_base (5337)..(5346): a, c, t, g, unknown or other
  modified_base (5422)..(5431): a, c, t, g, unknown or other
  modified_base (6142)..(6151): a, c, t, g, unknown or other
  modified_base (6339)..(6348): a, c, t, g, unknown or other
  modified_base (8154)..(8163): a, c, t, g, unknown or other
  modified_base (8731)..(8740): a, c, t, g, unknown or other
  modified_base (9016)..(9025): a, c, t, g, unknown or other
  modified_base (9470)..(9479): a, c, t, g, unknown or other
  modified_base (10406)..(10415): a, c, t, g, unknown or other
  modified_base (12265)..(12274): a, c, t, g, unknown or other
  modified_base (12675)..(12684): a, c, t, g, unknown or other
  modified_base (13154)..(13163): a, c, t, g, unknown or other
  modified_base (13247)..(13296): a, c, t, g, unknown or other
  modified_base (13582)..(13591): a, c, t, g, unknown or other
  modified_base (14434)..(14443): a, c, t, g, unknown or other
  modified_base (15101)..(15110): a, c, t, g, unknown or other
  modified_base (16197)..(16206): a, c, t, g, unknown or other
  modified_base (16663)..(16672): a, c, t, g, unknown or other
  modified_base (16952)..(16961): a, c, t, g, unknown or other
  modified_base (18680)..(18689): a, c, t, g, unknown or other
  modified_base (18905)..(18914): a, c, t, g, unknown or other
  modified_base (22795)..(22804): a, c, t, g, unknown or other
  modified_base (23391)..(23400): a, c, t, g, unknown or other
  modified_base (23981)..(23990): a, c, t, g, unknown or other
  modified_base (24535)..(24544): a, c, t, g, unknown or other
  modified_base (25036)..(25045): a, c, t, g, unknown or other
  modified_base (26239)..(26327): a, c, t, g, unknown or other
  modified_base (26795)..(26804): a, c, t, g, unknown or other
  modified_base (28012)..(28021): a, c, t, g, unknown or other
  modified_base (30132)..(30141): a, c, t, g, unknown or other
  modified_base (30752)..(30761): a, c, t, g, unknown or other
  modified_base (32251)..(32260): a, c, t, g, unknown or other
  modified_base (33001)..(33010): a, c, t, g, unknown or other
  modified_base (33213)..(33222): a, c, t, g, unknown or other
  modified_base (33841)..(33850): a, c, t, g, unknown or other
  modified_base (33937)..(33946): a, c, t, g, unknown or other
gccgccgcgggcgtgcatgcctcgctggcggtgacgggggtcacggcgcagaactcgcacggcgtgcacgccatccacgtcctcccacccgccatgctggcgcgccaggtggaggtggtcatggccgacgtcggcgcggccgcggtcaagaccggcatgctccccgacgcagccagcgtggtggcgctggccgccgccctgcgcgcctgccccgccccggccccggccctggtcctggaccctgtcctgctctcaaccacgggggacagcctggcgcagccgggggtggaggccatgctgcgcgagcacctcttccccctggccacgctcatcacgcccaacctgccagaggccgctgcgctgctgggcgacggccgcgcgatcgtcgacctggagggcatgcgcgccgcggcgcgcgagctgcacgccctggggccctcctgggtcctggtcaaaggcgggcacctgcccgccgaggcgcggcgcgaggcggcggggcgcggcgcggccgcggcgtcatccggaccggagcagccgtcgcggcagcagaccgtgaccgacgtgctgttcgacgggcgcacgatgctggagctgagcgagccgctggtggtgtcggacaacgtgcacggcacggggtgctgcctggctacggccatcgcatgcgagctggcgcgcgggcacagcgtgctggccgcggtgcgccgcgccaagcgctacctgtggcgcacgctggagcgctcgcgcggcctgccccttggcgacggcccgcagcgcaccatgaactttggctgggccaccgcagactgggccgccgatctggccgccgcgnnnnnnnnnncggcgacggcccgcagcgcaccatgaacttcggctgggccattgcagactgggccgccgatctggccgccgcgggcgtgcccatgccgccgcgcgtccccaacgccgccgacctgcgcctctacgccatcaccgaccctggcctcgacgaacgcgcggcgcggagcctcgtagacgccgtgcggctggccatcgacggcggggccacgctggtccaggtgcgcnnnnnnnnnnccctcgatgaacgcgcggcgcggagcctcatagacgctgtgcgactggccattgacggcggggccacgctggtccaggtgcgcgacaaggactcgcccgcccgcgcctttgccgccgccgccgccgaagccctggagcacgcgcgcgcgcgcggcgtgccgctcgtgataaacgaccggctggacgtggcgctggccatcggcgccgacggcgtgcacctggggcaggacgacctgcccgccgccgccgcgcgacgtttgctgggacccgaccgcatcctgggcgtgtcggtgaagacgccggagcaggccgcgcgcgcggcggccgacggcgccgactacgtcggctgtggcggcttcgcgcccaccaacaccaaggcgggcaacctgaccgtcgggccggagggcgtggccgcagtcgtgcgcgcgcgcgtgctccctgtcgtcgccattggcggcatcggcgagggcaacgcctcggccgccctggcgaccggcgccgacggcgtcgccgtcatctccgccatcttcggcgcgccggacgtcgtgcgcgccaccaagcgcctgcgcgcggtcgtggacgcagcgctcaccgcgcgcggcctctcggaggggggggaggaggcctgagcttggaaggcgcgcagtgagggggggtccagatgcgcgcgggagcgtgtgtgggcgtgggagatccgcgttcgtgggcgcgagagggatccataggtgcgcttgcgcatgagaggcgtgcnnnnnnnnnncggaaggcgcgcagtgaggggggggccggatgcgcgcgggagcgtgtgtgggcgtgtgagatccgcgtctgtgggcgcgagcgggatgcataggtgcgcttgcgcatgagaggcgtgcgcgggcacaggacaggctcccatctccccagtcctgtcaataagaatgtaccgagtggcgcgagaacagtgtgtgccagttttccatcgcgcgtgtaatgcagccgtctggaccctgctttgagtacatgaagcaggagtacagaccggcagtggcacgatgcaggccagcaggattattaaacaaggccaatgagacagggctgtcagggcagagacagcttggcggcggtggccttggacccggcggcgtcgcgggaaagcgtggcggggtcgcaccagggcgtgcgttttgtgtcgcaggccagactcacaccaatcatcacggcgccctgccagggctgcatgcgctccagcctgaannnnnnnnnnggaaataacggggtgatgggctgtgtcgagagcaagagggtggagttgattgggatagacgcgacagcttggacttgtctataccgcagccgccttccctcccaggcacgccnnnnnnnnnntaaaataacggggtgatgggccgtgtcgagagcaacagggtggagttggttgggatagacggaacagcttggacttctctaaaccgcagccgccttccctcccaggcatgccagtgaagcattgccacgccgctaccaagaccccaacacgcctgaagcgggtggtgctcagtccggtggcggtgtcgcgcaggaattggggctggctgctcatgatcttggccgcgccaaactctttagttggcagcacctggaagtactccatgcccaggtcacccccccggtccttgccgcgcagctgctcatatgggcatggtcagtgaggagggtgaggcccggaatgtgctcgaggatgtggtcccaatgctnnnnnnnnnnatcagtgaggagggtgaggccctgaatgtgctcgaggatgtggtcccaatgcttggcaaaacgtcgtctggttgccgatgtcagtacagccaacgcttcacatcatgccccaagtgcccatccaattgcaggtagcgcaggagccctgctcgacatgttacacctctcagcgatgacaatcaccactcacctctgccgcctgtttgtggcgctggtggatgaagtaagggccatgttgagtgcccctgggcacgtcagggtactggggaggccacaaccctgcgcaggaacagcaagagattcgaaaatcgttgtacagggtgccataagcgcgcagacccgtctggcagcctcaccgggtgttggcgattccactcgctgctcacaagcaacaagcctcgtccccaaagcccactacaccccccaaatcattcaccatccgcaagggacacacaccatggttttgcaaccgcagcttcaggttgtcatcctccnnnnnnnnnncgctcacaagcaacaagcctcggccccagagcccactacaccccccaaatcattttccatccgcaagggacacacaccatggttctgcaaccgcagcttcaggttgtcatcctccctgccccacccccagaagtctgtgccaaagccgtcgacacggctgatctgctgctggctgatgctcaggatgcctccaaagaaatcctgcgagggtttgatggaaacatagagatcatgctcctgagttggaacaagaggggaaggtctgccatgcatgcaaacttaacgttgtttcattgttgcaagcaaatgnnnnnnnnnnaaaatcctgcgagggtttaatggaaacgttgagatcatgctcctgagagggaacaggaggggaaggtctgccatgcatgcaaatttaacgttgtttcattgttgcaagcaaatgcagcagcatccccaaagtctggctcgcactgtacccaccatgccggattcctagaatcagcccactcagtcaggctctgcatttgcccacacgaggcaatggcgtcatgcccctacgccccacacatacctcaaagttggccttggggtggatgccaaaaggggtgagatgcagcggaactgggcccgatggaaatgcataccgtattccgctgcccggcctggggatggtgtcgacatcctggaagatgaagtagtcgtaggcggagccttgcaagagcagcatggcggcattcaacagcgctccccgattgaagagatacnnnnnnnnnnnnnnnnnnnnnnnnnttgcacacccccctgtcatccccacgtcgcacctgttccactatgaagatgtcatacgtcagtttttgttcgtccaagtgggnnnnnnnnnnggcagctgctggcatccaagtttgccaggatccggagaacactcatcaaagctggatttgacatagtcggtctcggtgcccagcaccagcacgtcaccctgcacaccctcgtgtcatccccacgttgcacctgttccactatgaagatgccatacgtcagtttttgttcgtccaagtgggttctgagggcaggcatgagcttctgcaggtgctcctgccgatctcggtatggaatgagcacagccagggtgtgctccgtggtgttctggggtgcctggaccccaagccggcagaaccgctgcatgggaacgttgcccaatcgttggctcctgtaggctcgctccaggccctccccggatgaggacaagtcaaggcccaggggctgcagagggcagcaaggagggggatcccgtgctgagcctgccacagattcacttggatgtggtggctgaactacgcgtccatgggctggacgtaccgatagtctgagcaccaagagcaccactgctgtacatactaggccccctgccagcagcgtgccccgcctggccagcacgggcactcctggtcggtgtggtcggggtcccctcatcgttcaggtgcaggcggacgctcacgacccatgcctcagtttatatatatggaccaaaataaattcccatatatcgcgagaaggaatcactgcatctatctcacaattacgcaaaattacactgatacacagggtttcgggtgtcgcaccgagtacccctcagcacgcacagcactcgcacttgcaatggtcacactcatttccggcactttcaccccactaccctgtgctcacataatactaggtctctctcaatggttgttgacatgcagtagaatgcacgttatggtggagcgtcgttggtagtactgcactggaatggcaactcccggtcgggcgaggcagaaaagcaagaggggagcgacgagcaccattgtgtggcccagtgatctcacacaggatgtaagttactcgttttaggtgactcgcgcattatatgtgatcaaatgcatgcatgtcgcgctcaggctgctgtggcttccctgcccaggtcactgccttgtcagaggatgccggcgccaagcttgcggcctttgctacagcctggcnnnnnnnnnntctctctcaatggttgttgacatgaaatagaatgcacattatggaggagcgtcgttggtagtactgcactggaatnnnnnnnnnnctactcgttttatgtgaactagcgcattatatgcgatcaaatgcatggatgtcgtgctcaggctgctgtggtttccctgcccaggtcattgccttgtcagaggatgccggcaccaagcttgcggcctttgctacagcctggctggagatgtccacatcccccccccctgcctcacgcgtccaagccgtgtgtagtctcgctgaaagggcagctctcgaggtggccggaagagcaggagttgcatgatgcatggggtcacatcttgtgcacgacagccacccacggaggttccccttgcagagaccaacatactcgcactctttactccacaggatgatgggccgggttccaatacgacacaagtgataggcattctcgggcgcacactgctcgtgcccggcacaaagcccctgcaccagcccatccaggccctcctgcgacgcctgcctgacaccccttgggcgggagcccagctttcagagctgctgcactccgcctgctctgctgattcccttgaaaaggggaccactcaagcagcccccggaagtcggtccggccttcccgccgcactggtatcctgcctggggtcctcagccctgaccagccatctgaggctgcaggccaccgacctcctgccggccctgtgcgctatcatcgagcatgcacttccagtagcgcaggaccagggccccagccgactgacccaggatnnnnnnnnnngccagccatctgaggctgcaggccaccgatctcctgccggccctgtgcgctagcatcgagcatgcacttccagtagcgcacgaccagggccccagccgactgacccaggatcagctggaggatcttctggacagcagtgagtccctgggagggctatgatactgggtgcctcaggcactgaaaggggnnnnnnnnnnccttctggacagcagtgagttccagggagggctaggatactgggtgcctcaggcactgaaaggggacatacaggccgatgactggtgctgccagatgtcattactttgtgcaacaatcacttgcaggctgtccataccccttacaacatgcccatcagtattggcatcagcatgtcccagagaatagcaacacgctgacccatgcatcaccccccgtcctccttaaccctcagtctcaggactgcacggagtcctaacagcagcagcgagcagcgagccgctgcctttccatctcctgctttgcacctccgccactctccatgccgtgctgtgctccagcatggcgctgcgggaggtgctttcctcggcagccacggccatgctcaccacactgcgcgcagtccttccctctcaggcggccacggccctgcactgggcccaggccctgcagctgggagcgcagaggagccttgctgagcctggcgaccttgtgtctgcatctgagttggaggcatggaggcagctggaagagtttcgcgccgaccttgcagctcgtttgactcccatgtcacgcatctgcgcctgtcgaggtgaggttgtacacgttgggtccatcacctctgtcgccgatacaggtcctgcccagagtggaaggaatgctatatacttgagtgttggggttgatgctgctcccgtgatctcacatgatcgcagcacccacaggtgcccccatccccaccactgcattgcaggtgtgattgaggcggcacctccaggagttctcagtgccgatctgtccagcagcgccgcaccagaggcacatgcatggcagctccttgtgcatggtgcactgccgttcttcatcgatgcggtgcaggtacgagatggagtgggaatatccggcaccgatgtttttgtgagcatgctgcacccgaccctggccgaatgtgtcatcctccttacagcagtcactctaatgtacctcccagcatgacccagccatccactccatcgtaccccccaaaacccacagacggcccaggatgcgccattccgctacgtggcggtcaccgccctctccgccggacttgcgcgactgaagaaagtatggcagtgtctgcaggctgagaatgggcaggctgtggactgcccacggccagctctgcttgccaaggatatcctggagcatctccttgccgtgctgtggccctgctgggaagtgcgtataggagttgtggatttcggagggggcggctgctgtgtatctggtcaaggtccgccatcacagcacgcacgagactggcagcatgcaagcctgcaattcttgctagagtagccgagccgccccgcagcactgagggtcacagcgcgtgtgctggccctgctgtgccgccaccacactcatgcatctccctctgcggtcacaggaccccatgcgccaggtggccaaggaagcgcatgccacatttgcggtgctgctggacatactggagctgcagtcggcgagggaggggactgtcgtaggtgagtgtttcttggaaggggtgccagatgaactccacttttacgcatgcacatgagaggagattgatacttcacaagtggcagtacttcttgacaccttctgcatgcccccacaggtgccttcctcgaccaagtggcagtagagttgttaaatcagggtacgagcctgggccaacaagggtgaaggcttccggacaatgacttggcagcatgtggccccgcttgcatgggaagaaacctctgacacaaagaaaattcaggctcgcatcaatggtctggggnnnnnnnnnntcccgcttgcatgggaagaaacctctgaccccaaaaaattcaggctcgcatcaatggtctggggttcacctctgccccatccaccaatcacaggtgccgggcacaaggggaggtacgcccccctggccgccatcgccccccgcctcggctaccaccgcatcctggcgttgcgcccccccctggtcctcgaatccctggcccagctgggcaacaaccggctgtgcacctccgtctgcggcctgctgagggcattgtggactgcagcgtcccacgatccagaggcatcctgggtgccggggacggtgcaggacacttctacagcactcatcgacggcccagacgccctgcgggcaaacctggcagcccatgtcctccctctgctcttcggcatccatcccggggcctgcgccgccctgctggctgccctggactcgcagggggcaggggcccccgcgaccccagacctccagtcggcgcgcatggccgtgctcgccgccggccacgccagcgggcttgttacctgggagaaggccgcatcgggcgtgaccccggaacaactgcacgcccnnnnnnnnnnttcgcaggggccaggggcccccgtgaccccggacctccaatcggcgcgcatggccgtgctcgccgccggccacgccagcaggcttgttacctgggagggggccgcagcgggcgtgaccccggaacaactgcacgcccacgtcttcgccgccctgcaaaccaggaacggagagcagaggtgacctgggtgtggattggtgcaggagcgtgcagggaggggaccaggtttgggaaccggcaaattacgaccaacatgatgtcgatgcgcagcagacgnnnnnnnnnngggagcgtgcagggagggtagcagatttgggaaccggcagattaggaccaacatgatgtcgatgcgcagcagacgccacccacgactcccacgtcaggctggctgcggcgagcctggtgtgcacccatcccaaggcgctggcccccttcacccctcgggagctgggcctggtccagctctgggcggagctggagatggtctgcgactccacgccgcaccgcgagaaggtgctgcgcctgctctccaaggcaggcgccagggtgcggggtctcgcggccgccgcgcgccagaggggaggtgcgtaggagggtgtgggggggaggacgagggccatagtagacaaggctgggtgggtgggggtggggggcagctcttcaagtagagtgaaccatgctcagctcccctgaaactgcccgagggacctgccctactgcctccagacttnnnnnnnnnntgtaggaaggtgtgggagggaggacgagggccatggtagacaaggttgggggggtagaggggggggggcagctcctcaagtagagtgaatcatgctcagctccgctgaaactgctcgagggacctgccctactgcctccagacttgtttgccaggccactgtccatcaaactgcggctcccacatgactccatgcacccgcgtgcagacagagcggagctgcagcggctggcctccgccatcacccaactctacgacctggcagttgccagggtgcggcccttcatgccccatggcaccaagatcatgtccctgcgcctcatgcagcagctgttggccgagttccaggagctgtggcgcccggaggtggtggagagcctgccctccaatgggtcccgggcccagagcaagcccctggacgtcgccggcttcgacccctttggcccacagcgcatgaaggaggccaccatgcaactcgttagtgagtcgggctttgggatttgttcttcttgttctgggatctgtgcatgcctggtggtgacaagtgtgcactcattaccctgcatgcctttgtagactgttactattacttgccctggccttctcacatcccctgcagatgccagcatcgactcgtgggacgacgtgcgatgggcggccatgacgtgcctgcgcctcctgccatctcccttgcctgggtacgaggaggagcagccagccgcccgattgctagatctcgcgtttgagttcgggctgtctgacaacgaggccgaggcagagtctggtaagggggcagatctgtgtgctgaggtcttgcttggaatgctaccctcgagtacatgccgatcagacatctacagttcccttgtgccctgacatgagcacacatgaatcagtctttccatgtcaccaccttcccttaccctcnnnnnnnnnngccctcgagtacatgccgatcaaatatttacagttcccttctgccctgacatgagcaaacatgaattagcctttccatgtcaccaccttcccttaccctctggttctcaggtgcgatgctgctgggggtgctgctcagcaaggaggactgggcgccaacgtttgcgccctgcggcagtcaaaatctgaacacctccagcatccagggaaggacgctgcaggaggcaaggcggcggcttgaccttgccaagaccaacctggacgaggcatgggatcgaggcttcatgctgcagccctttctcatactacggtgagacatcatacgggaggaggaaggggtgaaataatgtttatgcctctggccaggggccttgtctctatgtgagcatccgagcttatgggaaggtataaaggctccgtcaaatttccctgacctgccgccgtagtgtgtattgttcggctcctcagtcctggacgagcctctttgatccacctaccacatccttgccctcctttccaggcacttggtgcctgagctgccatggtccaaaatggcagctactggcaatgctagtctgaggagcgatctgctgagtaccgcgtcgtgcatccaccagctgatcatcgaagcacttgccattaccctacagatcctggccaagccccaagtgagaaggacctaggacgcgagggctggtgtggcagatgacagtcatgaatgtggccgtctgtagagcagtgctatattgactcacaggagctccgagttgctacaggagctgtgcacaacattacccctccccctccctccgcctcctcaaaggagtatggcgtggatgcagagggcgtgctggagggcgatcctctcacagacggcgagaatgtggaatgggacgcagaggcctctcggccccagctggtcactcgcatggcatggggaagctgccgagaggctgccctcctgtggatgacgcttgctgactcccttccgctgccaggtactgcgcagggggggatcctggctgttgttgtacagcagtgtctggcatttgagtggagggtttgcaggttttgctgaacatgaacgctggttgagcacagtctgcagcacaccctgcacctccaccgcacaggcgccgcggaccccggcctgcaggccgccggcgtagcgcttctgctggacgtcggggcgcgtctggtgcagcagctcaccctcctgaagcacaatggtgccatcgaaaagtgctcccaggcgctctcggctgtgtgcacgaggtttggtggcaggctctgggcctttggagtccttcatgctgggctggaggtcactgggcctcacactcacaccatgcaggccccgggtccaccactcagggtgtaccttcctctgtacagcagggttggggcagagaatgcggccttgtgttactcacatcctcatcgccctccaggcacccacaatgcccccctccccatggtctgtccagggtgctggcctctggggtgaaggagctggacgtggctcccctggcctggctggatgccttcctcgctttcctctcgcggccggggcagggccgctccgacattgtgcgccgctctgcagggctgccggccggcatcctggcagtcctcgctgctggcagcagcggcacatggcgggaggtgaggggggctttggggggaggggcaggctggatggtagagtattcacacctgaccaagggtttcccatgcctcaaggtgtatcctgattcagcattgcgggtggcacctttgcctcagcattgcggcggcagcactgactggcatgtctggccactcaccatctgcgagcccagcgcacagacnnnnnnnnnntggtggcacctttgcctcagcaatgcggcggcagcactgactggcgtgtctggcaactcaccatctgcgagcccagcgcacagactttccctcaccccaggtcctcatttctcacaccctgccccgcctgattgctctggcacaccccgagaccgaatcgacggccgactgggcgcctcgcgtgcatgccctcaacacgctacgcatgctgttctccgcctcggagctggcagacggcacggcgcgcctcctgccccagggagtgggcgcctgcctggcagggctgtctgcctcccgatgggagatccgcaacgccgccaccctggcctattcagccctgcttactcgtgtcctaggatttaggaacgacgcagtccaggtgtgttacccctcgcatgcannnnnnnnnncgcagccctccttactcgtgtcctaggattcaggaacgatgcagtccaggtgtgttacccctcgcatgcagccaagaccgtgctaagggatgtgtgtggggagaaggttcaatgacttgccctctcgctgggaagatgctctcccagcaggagcgtctgtacctgcgtgcggggccagggaacaggaagggacggtggtacggtggatcccctgcgggacgcatgggagtcatgagcacacattaagctttacagcaagatgggctcctcactctcatatgccatgccaaaaccatccctacacattgcgtacaggaggcagcaggcgccaggaggggcgttacggcaagggacttcttcctgcgctttccaacactgcaccccttgcttctacagcatgctgaggaaagcgcagcagcactgggaaaggggtcagacctgcatgccagcaccttcccagtgctggtccnnnnnnnnnngcggcagtatggaggatcccctgggggacgcatgggagtcatgagcacacatcaagctttacagcaagatgggctcctcactcnnnnnnnnnnnnnnnnnnnnnnnnnnnnnnnnnnnnnnnnnnnnnnnnnncctgcaccccttgctcctacagcatgctgaggacagcgcagcagcactgggaaaggggtcagacttgcatgccagcaccttcccagtgctggtcctcctttctcggctcaggtgagcaaaggctgccatatacacaagcctggttttggggagtgccctgggggagcctgtgggtcaactgtgctgattggacaggcacttgcattgggcttaagaaacacaccacctgttacccccaagggtgatgatttgcaatcttgggagcatgctcgtccaccttttgcannnnnnnnnnaagcaaaggtttccatgtacgcaagcctggttctggggagtgccctgggggagcctgtgggccaactgtgctgattgcacaggcacttgcattgggcttaagaaacacaccacctgttatccctaagggtgctgacttgcagtcttgggagcatgctcgtccaccttttgcaatcctgaaccgataatctggcttgcaatctctcacaccatccacccatcgctccatctgcagacccgacacagaggacggcgtgccatccccaaccgccgaaaatgagccccgcagcccagccgccttcctgcccgccgttgctgcctttggagcggcagcaccactggctgtgcgggagctggcggcacgcgccaccctgtcactgctccccgcccacggcaggggcgatgccgccgcagccttggccaaccagctgcttgctggggtagatggcaggacggcgggcctaaaccaatgtcatggctggatgctgcagcttggcgccattctgcccgttgctttggaaggcaggatagtggaccagaggatgccatggctggaagctgttctggcggccatcaggtgaagctggagtgtgtcctgctcctcttgctttctgcaagcatgtggggccaatgcgatgtgcccgtgttctcatgtgcgttaggaatcagattccaaagcaagcgtgtatgagtttgctggttttgcccacccagccagagtcaaagcacggtttgctttgctagctcctatccgccccgcaatttccttttaaatattgcaggcgcctctcgcccctgctcctcacccagctctggtgccctcccctgagcttggcctttgtgnnnnnnnnnncctcgtatcgcccccctcattttccttctaaatattgcaggcgcctcttgcccctgctcctcaccgagctttggtgccctcccctgagcttggcctttgtgaaggtgacggagacgctacgactgcacaatgatagcctgcccggcctctcagaggttgttgcacttgtgacccagtcagcccatggactcctacaaaggtgtgttgcagggcaatgccttggggagagaccctgcgatgccatggcatgctggtcgacactcactcgaaatggcagccgaggccccgactgggtcttgcgtcatggaccggagcgcagtccacgacttcaatagggcctgcatgacctccttgatacctgctcaacgtcaatggccgccaatttttactccttgacccgcatcgtcgttatggcaggttcctcacgtgccgggagggccaggagtggcaggctcccatggctgccgacgtgctcgaggcgtgcgccaagctctgctggcaaggggcagagcagggcgtggctcgtgctgcaggtgggcgtggactggaggcatctgctgggttgaatcgtggccatggtctttggccacgaatcgtttgctccacaacttagatgttgctgcacgttttcatgaagcccagttgctctcccatccannnnnnnnnngaggggaagagcaggtcgtggctcgtgatgcaggtcaacgtggactggaggcatctgctgggttgaaccgtggccatggtctttgaccacgaatcgcttgctccacaagctagacgttgctgcacagtttcatgaagcccagttgctctcccatccacgcaatattgcaggcctcgcgcctgccctgctgacgtgcagcctccccactgtgatggcgacggtggctgataacctggacccctgcgcatttcacacactccctccggcgacccaggccgccctcgcggcgacggcgagcggggagtggcaccagcgggcccgtttggcggcactgcgcctggtcgcgtggcctcgcccatgcagtgcccaccctggcgccctggaccccatggcctcgctggacctgctcacgctggcgagcggggggaccgacgacgcgcgcgcgcgggcgctgacggcgctggcggccgacgtcgctacacgggcggctccagggcctgatctgggggcgggcatgctcggctcaatgaagcacgacctcgaccctccgaccttcgccgacgcgctggaggccgtggcggcggccgcactgccctccggcgacgaggcgctgcgggaggccgcggcccgcgcgctgggcacgctgggcgccgcctggcgcctgacggcctggtgggccgccctgctggacctgctccaggacgaggagcccggcgtgcgcctggcggccgccgcagcgctggacgcggcgtgtgcggcgaacggcgcggacgtggagccgccgacggtgcggctgtgcgacgcagcggcggcccggcgggccgtccaggccatgggcagctttggcgtgacttcccgccacgccccgctcatggcgctcacctggggcgggggcggcggcgaggcggcgaggcgcgcacggcgcgggaggccttacgaggctgacgccgcgagcacctacgggcatcccatgctgtttccatgggtatggctttctggtgtttgcgtgtgattagggggctgtttggtcttgggcggaggccatttggccaaataggacatgtactgcagtgtacagtgagtgcannnnnnnnnncttccatgggtatggccttctggtgtttgcgtgtgatcagggggctgtttggtcttgggcggacgccatttggcccaaggggacatgtactgcagtgtacagtgagtgcagccatggccggcacggtgcgccggtctgcggaggacctccgggattgcaagggaaataaccgtacatgattcatcgtcccatgcagttggcagccgaattcctgcgtggaatggcacccccgagagaggacatcggctttccaagggaatggggtgcatctgctgcagcatatgtgcagcagcacccacttgcagcgggtgatcagcccggctttgaattcctgcgggcgatgctggcactggatatccaacgagggtggcagagggagccatttgcctgaaccccctgtactatgcaaaaggaccatgcacctagggaaagacatttggtctctctccacgattannnnnnnnnncccccctgcagtatgcaaaaggaccatgcacctgtggaaagacatttggtctctctccacgattacaagttgccgccagggccgtgattcgattgcattggaccccactctgaggaaaggcgcgcacttcgcaagcaattgcaccgggctcacaagtttgctacactatcagcaacgtttcgaacttgtaatgtagatcagattcgggttgtcctctctgtgttctcccatgggaagaaaacggaggcgcgagccttgccaggagagtggcagtccgggnnnnnnnnnngacaacgtttcgaacttgtaatgtagatcagtttcggtttgtcctctctgtgttctcccatgggaggaaaacggaggcacgagccttgccaggagagtggcagtccggggctaccagacgcacgagtagatgctgtgtcatcccttaacctcatggagctgccgctccccgttctcgccaaaattttccggttgaccttggatttataccgcacaccatacaagcagcagaaatggtgggaggactcctgccgcagccccttaaggtgtggccagcctcctaaatcagacctgacgctgttgtgtggaccttgtctctgacgagcacattgcatggacaaatgcccaggcacccaattctacatatccatacgaatgccaccttctgcaccccacagcacccttccaccgctctgcaaggctgccatggctgtgtgtaaagccgctggtttctatgatataatgcaaataaacgcgctgcacactgaggtggacgtgctccgagcctatcaggagtttgtggagcgccacctcagcaccgtcaaggccttggaggtccgggaaccgctcgagtgtgactgtaccagcaagtacaaggatttcagggcctggttcccaaccttgctgaccagcgtcaaggctccatgcctggagcaagtcattggcgtggtcttgcccagaggagagcagctggatgtggcttccttgccccggtccatccgctccctaaacttcagcctcgccggcgctgacccggtgacggacgtagagctgctgaggtcgctactgcagctccccaatctcagcgagctcaggctgctcgtgtcaaggtgcggtgctgactattggcttgggtgccgcaggctgtttgcccacttgaatacctcccgacccagactgtaccttgaataggtgctggaaggcttgtgagagtctggtggtttgcaggcatgggcctgagggagagttgtctgccctgacaatcgtttgccgtgcaaacactgccaccttgctttactctcacgcctcagcactcagccaaagtcctctccgcccagggaggttcaccaagccctgctggggccagggacatcgctgggctcttggacgcggctccgagagctggagctccaagcatgggagctggggcccagtgatacactggagagcttgtccctggcatgccccaacctgacgcacttgcaagagagtagtggcaggagcctgccgagtgacatcggaggcttgcagtctctactccacgtggccatagattcctggtcttcaatcaaggacgtggaagggattcagcatctgggcccgcatcagtccctgaccctccgtgtcaaaacactaggaagcacacctccccttcagagccactgccagtggctgcgactggaccggatcggtgaggacctgcagtccttgatctgggagcttggacggatgcagaagctccgtggctgcttcatcaccaaccccttcaacggcagtaaatctttccagagaagctggctggagttcccctggaagcatctgcaggtgttgcaaattagctgccacgaaggccttcggctctacctaccgccgcacctccgtgtcttggagataatcgatggcgtttttaacatcgagttctccaggaggaagatatgggcggacgacgatgagcttgcaaaggatgattgggatgctcggccgtcgggtgtggagtccnnnnnnnnnncgcctgccggaggtgatgctaattccagaggaggaggaagtacttgaggagtttgaacgtcccctcaacatcaaatcggaggaggaagaagtgaactctaggtacagagcatgttccatatggaagttgttggaaatactgctccagctaaatgtatttcaaagccagcatcaggatgtccagagtcatgagtcagtaaacgtctgataatacaannnnnnnnnngacgttgagttctccaggaggaacatatgggcggacgacgatgagcttgcgatggatgagtgggatgctcggccgtcgggtgtggagtcctggtgggacaaggaagacgaccacacggagggcctctttctgccaaggagcctggtggccctctgtctgtcatgctgcagtgagacgatatgcgttccagagagtggagttaagcgcaggctacgactgctgggaacgaccccaggtcgttataaaacggttggtgtggaggcggagcaggtggtctttgaccggagtgaattttggaaagcggtggcatgcctaccagagatcatgctgacccctgcggaggaggagattctggaggagtttgagcgtccccgcacattctggttggacgaagaggagaatgttgacaccgaggataaaaaatgttatgaatgtggcgacatactgtactactgaagtatgttttgtttttttgacacactcataggatatcatgtaagagtagcagacacgtgagtttatgcccatctcctcaaagcattgaaggattgcattctcacagtttgtcaggaaacgaatcaaatccagctcctcagtagaggttcatcaagtaagtcatatcgtttcagctgggaggaatcgacatttacagacgattcatgcgttgctcactcctggcatagatggagtgtacgatcgagaccctagacagctgccacatcatgtttgtgatggaacagatgccctgggattgggtctggcattgacctggagcaggatgatgctccatgctccgcatgctatggggtagagatgaagatcagggcaccacatatgacctgctcgatgctctgcacggcgaggatgcaagatctcaacatcaaacctgaccggtggcttgaggtgaagcaatagtcaacctcttggtacactaaagcaaaacttccagggggtcctctggatcttgttttgattgttatagtgcagctttgaatccagcttggaggagccagccacccttgttccacacccttccgagccgatcttgaacaggtagcagcgtcgctggacatgtgaagctcctgagtgagcaaaatgacccttcgcacgccccgcagctgatggtgttgggtaccatcccaccttaaaactacatcgggcacaacgatgtgtcgcgcatagcacgcatacagggttcggggattagtatgatcatcgagccgctttgcaatattattattttcaagaaggattgtgtttggaccaattcgtgctccatcatggccgaggaccgcggatgcgaggttcaccatgggcctgctccatcgggtcagtccctccaaccaccatcacaatctacatcatctcccagtctgatagatctgccgccctctgttattgcgcacatattttgtttgaccgtgagtctgcacaacgcatcccatcctttggaaagccggtggagaaagcaaggggatcagtggtgcagccctcactggtgtggtgacccttgggcagcgttgatgccatgcccaacctgccaattgcatcatcaacgggagctgcatgggagtgcactgagctacagtacgtctagtctctcaagacaataacactccctccgcatcccacagcgtgcttccgtagctctgcaagtctgcactggctgtatgtaaggccgcaggattctatgataagatacgaatgcataggcggtacattgatgagtacaatctgtgaggcttccagagattcgtggggcgccacatcgacaaagccaggactctggaggtgtgggaggtccgaccctgttcttcagactgcatctgggggggattcaggatctgggttccagccctactgaccgcagccagggctccctacctggagcgcgccactggcctggtcctgagatcttgggagcagttggatgtggcttccctgccccggtccatccgcgccctgcgctttagctgttacatcaacccagtcacggacctggagctctctaagtgcctgctgcagctgccaaaccttaacaagctccggctgtccgtctcaaggtagagtgctggtgtttggccacaacaggacaggctacctggccgcgctaccatgccaagatccgctccatgcctctgtgtggcagaggtgggcttgggcgcacccctgagcacattgccagttgccttgacccggcatcccggcctcactctgcccagggagctccaccaagcccttttggggccaggagcgtcactgggctcctgggtgcggctccagaagctggagctggttgtgaaccgagggcatcccagctacaccctggagggccttaccagagcctgcccaaacctgacacacctacacaatcatgaagccatgaacctgccaagcgacattggggacctgcagtccctgcgccacgtggcggttgcgtgctcagactcgacgcggggcgttgctggaatcgagcacctgggcccgagtcaggccctgacccttcaagtcgggacagtgggcgatcttccccctgcacagagccgatgtcggtgggtgcggctggacgagacggacaggtacctgcaacacctgatctggaggctggcaggcctgcagtccccccgcggctgcgccatcacaaatcccttgatcttcacggacccccaccgagggcccagactgtacatcccctggcagcatctgctggtgctacaaatcacctgcaggcaccacatacaactctgcctgccaccaaacctccttgtcttggacctactgcacctacccccgctagatcaccagggcaggaggatgtgcatgccgtccctgacggctgatgagtatatggaaactgaccaaaggaatgaagaacccctggatagggaggcccgggattatgctgaggccgaacgatcgaagaatctcttcctgcctggaagcctggtggctctgtgcctcacatcaggcaccgcggctgtcagtcattccagcagcggcgtgaagcgtaggctgcgactccttgggacgacaccagatcgttgtgaggcggtcggtgtggaggcagagcaggtggtctttgataggagtgatttttggaagtcggtggcacgcctgccggaggttatgctaactccagaggaggaggaagtgcttgaggagtttgaacgtccccttaacatcaaatcggaggaggaggaagtgaactctaggtgcagagcatgttccatatggaagttgtaggaaatactgctccagctacttgtattttcaaagcctgcatcaggatgtccagactcatgagtcagtaaacgtctgataatacaatcacgcaggcgttccctcaatgaaagacttgccagcgaattcgcttcagaggtgtcatgcgcagattccatagctcctacaaacagggaggcgttgagggagatggggtagggtcgggggcaactcccttggaccgctcatgtcaagcaaggagttgataatgatcaaacatgatagttgtagtcttgcatccaaaaatggatcttaatttgccaatcgtgccgagaagtagctagggtttttaataaagcagtaccgagcctatacgaagaggacatgtgcagaggacttgaccttcatgcttatgaagacacaccgaactctcattcttaaccttgcctgtacctcgagttctggcttggtacaatcctagagaaagttcacattacatgagccctgacctgttatttgtctgcatgagtgcaactgtagattttgcaaggcagtgagcatcggcacaactccactcccgaaagttgccagatccaggcgtcaacaaacaagtggcccaaggagtggggggacgatcgccagaccgataccaaatgaccagnnnnnnnnnnattatttgtctgcataagtgcaactgtacatttggcaaggtagtgagcatcggcacaactccactcccaaaccgaagttgccagacccaggcgtcaaagaacaagtggcccacggagtgggggtacgatcgccagaccgataccaaatgaccagagtatagaatagataccaatcctacacgaaacccgacctctttcgcctggtggaggaataatcgtgagaataggcccccctgcccgttctggagcacttggcttgcgtcgtcactatggcgctcgatggcaccctccgcaacagagagcagtggaacacaactgaaacgactagatggtagactcaatgcgatctcttatgccctggatctcggcatgggcgggcgtttgcaggctgcccgcatgggcttctggcagccgtcggcgtcactcatggaggtgcctcgcgacgaagtccagcaccccatcagccacaggtgtgtgatgggaattgggtagagattacaccggtgccttacagagtaccccgtgctcccccctcggcggctgcttcaggacacacgcaggcataccctgctcagcaccaccaacannnnnnnnnnttacagagtaccccgtgctcctccctaggcggctgcttcaggacacaggcaggcataccctgctcagcaccaccaacaagcaccctcctgcaacgcagcagcgcaagactgtgatgaggatgccacgccgctccttgtgcccttcagcgtctctcccgctgcggccaggttcgagctcctgaggtggcagcggcagagctggcttgcgccctggaacgtcctggcagagggcacctggaggctgcgctctgcctacctgcccttttggtcgttcagaggctcagccactgtgcactggacggcaaatgtaaccaggtggggtggactggggaggtgactcgtgcgatcatgccgaggttggaggttgtcatgcgttacaccagcagggccgcacttctagtaggagtggttgggacaagtctgggagctgccttccgaacaggtgcctgacatctgcccgaatcaccttccccacccctggcgccctccctgctttgcagcgggggggggttcacctcctgccagcactggagtgggagcagccccgtgagctttgggccctgggaacccagctccctgannnnnnnnnngacaccagcagggccgcacttctcgtaggagtggttgggacgagtctgggagctgccttccgagcaggtgcctgacatctgccccaatcaccttccccacccctggcgccctccctgctgtgcagcggggggggtttcacctcttgccagcactggagtgggagcagccccgtgcgctttgggccctgggaacccagctccctgatctacgccagctatcggtaccgccgggattacgtcgccgccctgccccaccccggctgggagcggcagctgcgacgagagccctgggcggccgcctgcgaaccaggccggctgcccggcctcagccccgaggcggaccccccggacatgaagcaggccatcgcctgggagctcgccgtccaggccatgacagaggaccaggtgaggagctgcctggaaggcgctggccggtgggcggacgggaagcctgctccgtcctcagccgtgcgctcagcccggtctcggggaccttgcgtgggtgtaccatgggcgatgagtcccaccggacctgcttcctgccnnnnnnnnnntggtgggcggacgggaagcctgctgcgtcctcagctgtgcgctcagcccggtcttggggaccttgcgtgggtgtgccatggccgatgagtcccaccggacctgcttcctgccgagtgaggctcttcccccctcacccctccctcaacagtccaggaggggcagggaggagctgtctgccaggctggagcccgggtccagcgtcgcccacgtccacgcccgcctctccttccgcgagcgcagcgcgcagctcgtcttcctccccgtgcacgccatcgcctacgcctggggcgagaccttcaacgtgcacagcgagcgggtaccagacacctacatggcgctggtgtcgggaggtggaggtgcgagtcctgagtcgtgtggcgctgggggctggtgggggagggggcagccgcagtcgaggccagcgagtgggagcggggcgtgagcgagtcgaggccaggggcggcgatgcccccctggcgacactcgcccannnnnnnnnngggcgctgggggctggtaggggagtgggcagccgcagtcgaggacggcgagtgggagcggggcgtgagcgaggcgaggcaagggtcggcgatgcccccctggcgacactcgcccatcgcccaccacccttttgcccatcgggcagcacccgccccagttgccacctcggacacctccctgcccccaggcccggtgcacgtggcagggcagcggcactacagccgggtgcggtgctgcggcctggctgcggcggcgacggcgctgggcgggtccctggcctcctgggcgtccggttcgagcgcgccggggctgtggcccttgaccctggaaggggccttttgctggggggtcgccggagcggtggccggtgcgcggtggggttgtgatggtggagaatcgtctgtgcggtctggcacctgcgagggtgtgcttgctgggactgtgattgagttccctgggcgacctgccgtcgcctcccctggctgccctttcctggtcctgctcaccccccattcctcccgtctccccacaactctaggtgtcatgtcgagactggggcccgcccaggcagagcgcatggcggaggaccagaggatgagggaggaggaaggggacctggaccgggcgctggggtatgggatcggtcccatggccgcaggatccgatgaacaggaggtgacgctggtggtgctttccaggggaatggcccatgggctggaggtgggagtgacgtattcggtgcatcataccgtggcacagtcgcgatgagcgttaacccctgacaggctcaagctggcatccattcctgtgcctttctcacatcaggcagccattcacgtgcagctgtcccccactacatcctgcctctgctgcaatatcacatcacttctccccaacccccctccccccacccacacatgaccgcattcacacctcacccctgttcaggcgctgctcacagccaccgagtggaggcggtgggagagctacgaccggcggcgctgggaggagcacaagcggcgggcgtgggcagaggacctgtggctggcacaggccaggaggcggcgcgagcgacgcgaactggcctccaggatggccgcggcggatgcgcgcgccgcggcggacgaggaaagggagaggcggcggagcatgaagtatgggcccagcagccgccacaaccgcatgcataggtannnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctgtgtgcccctcaccctgacccaggagtatcgaagggccacaccgacgcacaaggacatcagcccaccgcatttcagaagccaggtccgtatgcaaccccctccaagcctcaggccccaaccccccccctcacaaactcacacagtcagcgtccgcatttcagtggcggacacagggcgggggggcgctctgatttcctgggttactatgcggcactggaccttcagctgtccggcgggcccgtgacgaccgacgagatccgccgcgctttccgaagggcggccctgaggtcgcacccagaccatcaggcccaccagcagcagcagcaggtgcgtaagctgccctgcctgggaggcgtcagggtgtgtgcgatggtgattggggtgagttttggagcatctggtgccaacacgaggtccccagtgaactcttggtgacgctcaagccaaccccttgaccccagnnnnnnnnnncaccatctggtgccaacacgaggtccccagtgatctctttgtgacgctcaagccaaccccttgaccccagggtcggacactcagcaataaggaggcccgggagaggttccacagggtccgagcagcgtatgaggtgctgagagacccccagaagcgagcacagtacgatgcagggcagcgcccagacgagtagagtttgattgcggcccaggacagcgaagcagcagccttccatgcgcacattctgctgtgcggattgtcgaaggatccctccctcctaccgtcagcgatacgtgcctcttcgttatgactgacactgcacctggactgcacagtctccttttatagttgctctgcaaagctatgcttggacacacaagtcgccatcaaatcgccaaggcgcacagacccttcatctctgttacaatcaggagccaggtgtaaatggaagtgagtagggcactgcactgctggtatcaggcacaaaacgaaagaattcgggactcttttgctgggagtctggatgtcatgcagttgcaatcaagaagccaggagaagggggatgtcgatcttcaccatgcatagagaggagagggtcgtctctcgtcgcaggtttcctccgtatcttcaaggtgatgattggaacagcgaaaaaatgcgtgaggaaaaccgtgcaaacatcacctgagggtcaactcaaggcgtgggtcatgtcgaatcgacacatcgcagcaaggagcggctgtgggcttccaaagctcaccagggctcaggcccggaaaccatcctggaaccgtccctcaccccagatcaaagacttttcactgcctgcccttcctggccgccagccacgccgccagccccgcctgctgccgggcgttcagccgcacgcggggcctcgcggccacgagcatggccaccgcccccgcaacgtcggccgcgtcgccgcgggctatcaggatggccgccagcatggcggcgctgcggccatgcccatgggcgcagtgcacgagcacgccccggccagccgccacctggcgctcgctccacgccacgccggcctcgatttgttccacggtggggcctgtgggggtgtagagatgcgagttgctcatgtccggggctgggaggcaaacaacagtcggggtgcagcctgatgcacacgtcggcatgtcgcggcaggggctcactccagcttctcccctccnnnnnnnnnncggagatgcgagctgctcatgttcggggctgggagggcaaacaacagtcggggtgcagcctgacgcacacgtcggcatgtcgtggcaggggctcactccagcttctcccctccccaccccccttcccattccaccatgcgcacagtgggtgtcccaggtgggcaacgccagataggcgggggcggccacttgaagtggaagctcgcaggtcacgtcaagcactgccagctgggcggccggcaccagggcctcctcggatggcctgccggggacaggggggcgggggagggtccataccagtcgcttgacggccagctagcctgtcaaaacaatgtcctcgggctaacactgcatagagtgcataatgttccttttcaattcattggcgcgtccctacgcccagccccgtccccctcccgtttccctcaccaggcgccaatgtagtagtctgcggtgaccctgttccaggcgggttcggacgatagctgccgctgcagccccagcttggtccgcagcgcagcatggtagggccagaagagggcaaggttgaggggcctgagtgatccgtgaggcgtctgcacacggtggcagaggtggccgattgttgacagcactttgcacctttttatgctgagagcttgcaatccggtccccgccaatgtctcttcatctggccagagtcatggctgagtctggatctccccattgcatccccctaccttgccaagcatgccggtggtgtgacgggctaggtggctggaggcggctagggccacgagcaggcccgcgccggcagcgtgccacagcaccagggtcgctgccttgggcaatgtcgacctgccggcataggccaggagtgccggtccaagagacgcgccgccgacgaccccactcaaatgcatcgtctcccagtcttcaaaggacgatggcgctgttggccactgtaggtttctaggctgacaaccgcttaccgatacggggggccaatcctccctccacactctaaacaattccagtgctgacaaatatttgtatagatgaaagaattcctgaacatttcgaatcgctcggtgatataataagcaacttatcggcagtgtctcatccggagcatgcgtcgaatgctgtctcggaagaatgatcacctcggcgcgcgttcgtgcttgtgcaagcagtgtttggcagtccttgatcctgagatcttcaattttgcatcatgacggctgttatgattctcagatatcgccaatgtcattccacaccctgatgaccatgcggtgacaggagcgtatggacccccagctgcgacgtgcgctccagttccgagctcgcgtagagggaatgtgagaccataatgttgaggtggtgcgcttggatcaacatccagcactgccgtcgaatgctcttagggcacctggctgaccctctttatacaccgttacttcagattcaacaagcgggaggaggacttcgagtctaagcaggagtatgatgactacctcgaagagcgagaagacatcagtgagctgccctgattcaagcatgggagtccccaagccccaccatcttgacccacctacttgccatgccccctgtgcggtcacgaagcctcttcctggctcatccttgtagacctctcctcctaccccgaccgccctgcagtcttcaatctctccgagggcatcgatgtcaaggccaacgaggccagagtggaggcgtatcgcctggccaacgccgacgcgattgcggccgcggacgcgcggcgtgccgaggaagtacgccgcgaggccgcgctggagctgagccggggggacccgggcacgggtcagggcgctgtcagcggcaccgcggcagccttcgaggggggccgcgacgctgagccccaccagggcatggactacaccgcgaccctgccggcaggcctgctcaaccacgagtgcgttggggggtctagtacggtgtcgttaccaagctttggaggtatggttgacttgattgggtggtgcgagcagcgctcgtgcgtcaagggtttcacggccacacctatagtgggagcagatgcgcccttcgccaagctccaaaccattctgaccgcatccttcccaagcccnnnnnnnnnnctttatggccacgcctatagtgggagcagatgcgctctccaccaagctccgaaccattctgaccgcatccttcccaagccctcctgcgtccgcaccgaccaggcctggccagccgccccctgcgactgcggcggggcccttaccagacatgctgggcatgctccgcgatggcgacatctcccataccgatgctcggacgcccatggacaaggcggcctggcaggccatggcctcggccagcggctggaccccaggtcagcggggcacccattcatccaggcagtaggggcagtgaatggtgcttgagtatgtacatggagttgagatgatccaggtgcaatgaagctgtatgggctctttgttatcctgggagtgctgtgcttgtcgcggcagattttggccaccctcctcttttcaccacagttccccacgccctaataccctttgcccccagagtttctgcggacaaagtgcagggaggaggcctttgacagcgtgctcgtcttctaggttcatcccctgcacggccacgcccatccccgctcgcatctctgctagtggtccagatgcacggcgtctaaagtgtgtgtactttcgatccacatgactcnnnnnnnnnnccatcccctacacggccacgcccatccctgctcgcatctctgccagtggtccagatgcacggcgtcttaagtgtgtgtactttcgatccacatgactcaaatgactactgcccagggcaagctgcgccccagatgctgggtcgctgagaactcggaaagcaacagcatgcgtgcattgccaagagggtcagcgccgcctccgtgggctggggcttggcgacgcccgccgccgccggcgaggcgggctgctggagctcgacctccccgagctgctgctggaccagctgctgttcgacccactggaccggctgctggagccgctcgagctgctgctgctcctgccggaggacgaggagctggaggggctccggcccctacgccggccacgcaccggtgaggggctgtgctcccttcccttggacgccagcgcacggcctgcctcctggcgacgacgcggcggcgacgggctccctctccgtctcccgggtgagcgcgggctcagggaacggcgaccccgggccggcggggtgggactggcagacctccgtgccttgcttgctgccggcgcacgtgagcgagacccgggctgcggcgaggcctccctggcgcctcgcctcctgggcggcgagtcggcgacactgtcccttcgcctcggcggggaatcttgccgcgctggaaggcgccgagggcccctcgcatcctccacgtcggccgcctccgtcctcgcccgtccccgcggcggcgatgcgctaggatgccggcgtgccgccgggctagcccccgctcgccgctcgcgggccggagcgtcggcgagccccctcgaacgccctcgcttgggtgcccggctgggagagtcgtccctcgcccgcacgcctgcgtccttgccccctgcatccaaagctcccctgttccccacctcggcccctccccgccgggcctctctggacggcgagttggaggcctctggccggtcctccagcggaagggggggctgggggttgtacctgtcggttgcctccacgtccctggtgtagtatccctcagacttccaccgcttctcctcagcctgcgcaatgggtgtgtagtttgggacttggcctccctggtgagagggaggtggaagtgctgcagctcctcacgcacgcaggccgccggcacgaccctggcggcctgcattctctgctcgccatgcacgctccctgtgccccagcttcccacgccgagtccacaccagccacgtaccaggcgtgctgcctctgcctcttctgcagccttcttggcatccttgatggtctgcttggcggccttctttgctgccttggctttggacttggcctcgcgttcgcgttcgcgctccgcccgccgcttctccttctcggcacgcttggcagctttcctgttcattttatcatgcgacttgggtgctcactgctcagaagtcagctctgagaggaaggcggtcgtttgcatgcctggaacaggataccacnnnnnnnnnngactcagctctgggaggaaggcagtcgtttgcatgcctggaacaggataccaccaaggagactgcagcaggtttcgatgagactcgccacgggcctcgagccaaaggcctccctcgcacctcacctccgctcctgctcgcgattctccctctcggcgatcttctcctggcgccgacggtcctgcagctccctgtcgaacgcgtcgccctccttggtctccccgatgccaaaagcgcctcgcaagcgacccatctgctccaccttcctggctgctatctggtgcgtctcctgcttcagcctgtttgcgttgaaatgagggaagaaactggtaagaggcacaaggtgagaccaacactgcacacagagcacacccaactccagctgtgaacttcacgacgagccggatcgcagaaaataaacaaccacagatccatccccaaattccatcccctttgcaagcagcagtgacaaaaagacccacagctggccaagggcactgacccaatgccacgcactgttcatccttgtgttgtagggctacagcgctagcttcctccttgagctttgcaaggagctggctccggtaggcattgagcttctcctccacctcgtcctcgggcgtgctgcggtgcgtgagtgggaaaagacgagcaatgacagggtagtgcagctgtgcgagaaatcaaaagccatccgaggaacggcagggaggttttcctgtacggaggccccaccatcgcnnnnnnnnnntgagcaatgacaggatagtgcagctgtgcgagaaatcgaaagccatccgaggaaaggcaggggggttttcctgtacggaggccccaccatcgctctactatgcagtatggtcttgacatcagctgcccaatcacgtgccacttaaaaactcagccctagcagccttcataccgtactctaaaacccatacccacccgtcgtcnnnnnnnnnnatgacatcggctgcccaatcacgtgccacctgaaagctcagccctagcagccttcatacagtactctaaaacccatacccacccgtcgtcctctagctgagcacgcatgacctccacctccagctccaccgcccgcttcttgttgtgctcaaggatgcctgcattgggctgccgttggtctgggcctcgctcctctcgctgttcgtcccggcgctggaaggcattccctcgcaggttgaacttgttgttcgtgacatacccactggtgcccgaccctcgtgcggtcaggagtccgatgcctgcggagcataagagcaactacacggtgagcactgatttgcacatccatgcttcatgcagggtccgaaatgcagtcggggcgctaatacacgtaccattatacatcttgaaggacgaggcgaggcgccagggacccgcaaggcgctgggcacctttccacgaacagtgggtgccccttgcaggtcagcaatggtctgcagcaggcgataggtcctcggcaacagcgcgagatttgatcttcaccgttccaaatttcagtatatatatccagagggtctgttgtgtgctcgtccaccctgcactgggctggcaagcatgnnnnnnnnnnccacgtaccattatacatcttgaaagacgaggcggggcgccagggacccgcgaggtgctgggcacctttccacgaacagtgggtgcnnnnnnnnnngttgaggctctcagacacaccagcctgggtacctcagtacccccttcgttctcccaagccagctcatctgagtgttatggtctggtgcgctgttccccaccgcagaaccccgtcaaataggtttgacaaatatctggttcgactggcgaagaaaatcgactcatcctcgcccaagagggcacgaggccatgtcaggcctgcagggtgacgatggctttgtcggagctaccgtcacccgcgacgaggttggtcaatgggaatcgcattttgatgatcctagaagcttgagatgtatgtttgccggctcatctcatggctctgatcgaccattgacgaggcacgtttgatctctcgttcgcagggccttcccaatgacttcttcgatgcctcagcctactccttcttcggcaccaccggagacgatgtcgggggcctggagggagagctggaggtgagcgggtaacggcggggaggccctcggctggggttcttgtggcagcctggccagcttgtgatgggcatggaatacatccattcccccccttgcctgcagctggggttggagggcccgcccgaggaggagagctgcgtggtagaggacgacgactactacctgggctaccatgcggaggggccaagtgatgaggaggacctgtccctggccagcctgtatgccgtggctggtgtcagcacgcaggtcctgcccaagcccgccgccgagcccgccccgcccgtgccggcgcccccgcccccgcggcccagcggcagcatcgccttgggcggtctgctggccgcgggcggcgaccgcgccttctacacgccgtcccccccggccgcaggcgcccgctcgctggagtcacggcccggctctggcggccccccgctgtcgacctcgctgctgggccagggccccctgccgccagagccgcagcccagtacctactaccaggaccagggcggcgctttccaggaccccagcgttgtggcggggggccctggcctcctccgccaccagcaggcactcgccggctatgcagcggcgccacccccgccggtggtgagactcgccgggcaggggctctgctgctggcctgcatggtgtcgaccagtgcgcctggaagccagctctgtgtttttgcgccggctgtgcatcgccccccaccatattctgtcagcctgccacaacacccattgaaccccccctcatcaacaacaccccttgtctcattcctcctggtgcagggcatgaccgccagcgctcttgaagcctcgctgctggcgaggtcggcggagccccggccgccgccccagggccccccctcggggcaccccgtgcacggctaccccggcccgccgccgccgccccacttccccatgccgcccccgcctcccggccacgtggatcatcggggtcacaggcactcaatgcccccgcccccgggcttcccggcgcacatgggcccccccccgggcttcagcggcatggccccgccaccacttcgcggccccgcccc

SEQ ID NO: 40982 - DNA, 61 bp, Chlorella protothecoides
gcagcgtggtattcttggggtgtggctgggtgccagggaggggggagggggagcagtccag

SEQ ID NO: 40983 - DNA, 78 bp, Chlorella protothecoides
tcctgttggcacagggtggcgggcgttggggtgatgaaacctgcctggggacaattgccatgcgactgcgcattcccg

SEQ ID NO: 40984 - DNA, 61 bp, Chlorella protothecoides
cgcctgggtctgggcgctggacgccacctacgcccggcggcaggccatcgtgctgcccgcc

SEQ ID NO: 40985 - DNA, 142 bp, Chlorella protothecoides
ccgcgccgcgccccgtcgaagccgagggcgggcgcgcgcaggcggccgccgcggcgcacgccacgctgcgcgccggtgccatcgcctgcctgtcgcgtgatgtggggcgcctggtgggcatgctggaagtgggcgacggcga

SEQ ID NO: 40986 - DNA, 76 bp, Chlorella protothecoides
gggcccgctgccagacagcaaggaagggagtgcaggtgacaaaggtggcaaaacttctcgggctcaacaccctggt

SEQ ID NO: 40987 - DNA, 78 bp, Chlorella protothecoides
atcaggtaaatttacacaggcatggctgatccgcccaccccatgctcaatgcaggcttctcttccttacctgtacatc

SEQ ID NO: 40988 - DNA, 27774 bp, Chlorella protothecoides
  modified_base (137)..(185): a, c, t, g, unknown or other
  modified_base (670)..(679): a, c, t, g, unknown or other
  modified_base (1233)..(1242): a, c, t, g, unknown or other
  modified_base (4378)..(4387): a, c, t, g, unknown or other
  modified_base (5271)..(5280): a, c, t, g, unknown or other
  modified_base (6945)..(6954): a, c, t, g, unknown or other
  modified_base (7204)..(7213): a, c, t, g, unknown or other
  modified_base (7967)..(7976): a, c, t, g, unknown or other
  modified_base (8261)..(8270): a, c, t, g, unknown or other
  modified_base (8698)..(8809): a, c, t, g, unknown or other
  modified_base (8924)..(8933): a, c, t, g, unknown or other
  modified_base (9048)..(9057): a, c, t, g, unknown or other
  modified_base (9228)..(9305): a, c, t, g, unknown or other
  modified_base (10152)..(10161): a, c, t, g, unknown or other
  modified_base (10565)..(10574): a, c, t, g, unknown or other
  modified_base (12318)..(12377): a, c, t, g, unknown or other
  modified_base (12920)..(12929): a, c, t, g, unknown or other
  modified_base (13194)..(13323): a, c, t, g, unknown or other
  modified_base (13385)..(13394): a, c, t, g, unknown or other
  modified_base (13615)..(13630): a, c, t, g, unknown or other
  modified_base (15621)..(15630): a, c, t, g, unknown or other
  modified_base (15794)..(15816): a, c, t, g, unknown or other
  modified_base (16034)..(16043): a, c, t, g, unknown or other
  modified_base (16806)..(16815): a, c, t, g, unknown or other
  modified_base (17420)..(17429): a, c, t, g, unknown or other
  modified_base (18009)..(18018): a, c, t, g, unknown or other
  modified_base (18806)..(18815): a, c, t, g, unknown or other
  modified_base (19128)..(19137): a, c, t, g, unknown or other
  modified_base (19490)..(19499): a, c, t, g, unknown or other
  modified_base (21535)..(21544): a, c, t, g, unknown or other
  modified_base (21747)..(21756): a, c, t, g, unknown or other
  modified_base (23003)..(23012): a, c, t, g, unknown or other
  modified_base (23258)..(23267): a, c, t, g, unknown or other
  modified_base (23553)..(23562): a, c, t, g, unknown or other
  modified_base (23796)..(23805): a, c, t, g, unknown or other
  modified_base (24526)..(24535): a, c, t, g, unknown or other
  modified_base (25961)..(25999): a, c, t, g, unknown or other
  modified_base (26607)..(26616): a, c, t, g, unknown or other
  modified_base (26845)..(26854): a, c, t, g, unknown or other
  modified_base (27422)..(27431): a, c, t, g, unknown or other
  modified_base (27538)..(27547): a, c, t, g, unknown or other
cggcgagcgcggcgcgtcgcagcgagcccacgtcacacagcgcgcgcacccggccatccagcgccgcgcagtcggcgcgcagcgcggcgcagcgcacctccagcgcggccagcgtggcaggggccgccgcgcgggannnnnnnnnnnnnnnnnnnnnnnnnnnnnnnnnnnnnnnnnnnnnnnnnccgcgccagctctgcctccaggaagcggcgcagggcggcgaagccgacgcgggtaccgaaccgctcctcgtcgaacccgcccgccacgccctcccgcaggccgcgcaggacctcggcgtccacgccctggatggaggcgcgccactcgcccgcgcagcccaccgccccgcggtcctgcaagagtgcatgttgtggaataccagggtcggacctgtgctgatcccctgggagcacatggagggcctgcctccatgcgagccctcgtggcaagggggtcacgccgcgtcccctgaacacctggcctccagcccgctgccgcatcttcagggggggctcaacaccccaaatcagagcttgcatcccatcaccccacccagaaccctgcacacgtgacgatcaagcaatgacatgccgaggatgcctgcccccgaagcaaggaccacccacttcccccctccacaccggatgaccttgggcagggcgannnnnnnnnntctgaaccaaggaacaccctccccccctctccacaccggatgaccttgggcagggcgatgaagaagggctgcacgctgggcggcaggtaccccgctgccgccaggtaccggtccacctcccagcgctccccaaactctttcagccggttgtcgaacttggaggccacgaccacggtgcgggagaagtcggggtccacatcggtgagcacatgcatccacaggctgctcgcccactccacgctggactgctgcaggaagagaatgaggcggttggagggggcgcactgcgccttgaccatggccaggatgtcgtcgggggtggaggccgcctcgcccttgcgagcctgcgaggcggagggtgcaaggtggtgaggatggtggggaggcggtcacaacgatagaactctgcaacgagctgaggaagttgcatggaattagccccgtgtcgcaacgaaacgcaaggccactcggggttgcaacaacgacagaaaccccagtctcaggtaccttgaggatgaagccaggggtgtcgatgatggtcaggttggggcagnnnnnnnnnngaaggtggtgaggatggcggggaggcgctcacaacgacagaactctgcaacgagctgaggaacttgcatggaataccccccctgtcgcagcaaaacgcaaggccactccgggttgcaacaacgacagaagccccagtcccagggaccttgaggatgaagccgggggtgtcgatgatggtcaggttggggcagtaggcgtactcggcccgcatgacgatgggcacactggacaccgcacccccgacctttgccaggtgctcggcggtgcggtcccggatggcgtctgccacggccgagggtggtgcgatcactggcccgtactcttcgccttcctcgtccttcagccggcagcggggctcctctgccgtcgagtcgtgcaccatctggacgatgagggggcgccgagtgcccatctccacctcccgcacgttgaagcggaactgccagggatggtgagggggctgtgaggtgacagggcaagcagcgagttgcaatctggaatgcaatcgaaacaaggtggcccgctcgtcccagcggaacgaaactccgctcaccccgaggaaagcttccagtagggagctcttgccatcgctctggccgcctatggccacgatctcaggtatcgggagggactctccaaacgccaccgcggctgcctgcaaccggctggacgtgcggaggcaggagacgggtgagccttcgttttcgaggaatctacagaatcaaatgcatgtgcaccatgcactgctgttcccacccatgcacctgtacgcctcgtatcgaagcctgctcgtggcattaccgtacaggtcttccgacccatcgtcgacggaagacattaccgtagagacctgtgttattgtgtttagcgcaggtctggcggggcgatcgtcacatcgttgcgtccgcgcgcatcccctccatggagcatccgtcgcgagctgctatgcgtgattcggaactcgaaaagaggaaagcgcctcgccctgcatccgttgttacgcaaggcacgggcgatgcaaagtctgattcgcgaataatgcctgatgaagttcatgggcggtgtgggcatttacttctgtaagcttacaaggtgcaaatcttaaacctagccaacggcctgaaagaattcacactagtcatccagaaagggcgctgctgcggcagccttgcgtcccactccagggtcctcagagggaatgtccactgcagggatgggcagcccatctctgaaacagaggagggacctttccttggccttggcctcgatcatcacgtccacctcggcctcaagcccatacaggttcatgggtcccttgatgtagtctgagtgggcgtgcgggatgcgcccctcctggctctcgctccagtggacgacgggcctgatgcccttgggccaagtggcgattgctgcccgcagcgcctcctcctgagtcatgtcgcctgaggtggcaaagtttgggcagggatgatgagtgccaggatctgcatgcactgctggtacgaacggaacacatggcgtgtcatacccgtaccaccatcattaccagaaacaaaagcaccccaaaccctcagtcaccttcgcaaaacttccagtggtggaagtcaaagacgattggaaccccgcaaaggcggtgtaactccaacaggtctctgacgctgtaggagttgggccggtcatcgttctccactgcgatagagaatggagtgctttgttgacgacccgcctcacatgcagatcacctcaaatggctcagcaaagcatgcacggctggcgcgcagagtctgccgcagaatgcaattgggttgcctggatcgagcatcaggcccagtttctaagcaggaccccttgacatgattattggtactcacctgtcatgcgcagacggcagctgggtgtgagtcggttgtaggcagccgcccatcgctccatggtggcctgcttgtcgccatacgatccccccacatggatgttgatcttgttccacacggagggggtgtcgtagcccatgaggtccagaatctgagggatgtgtgttgagcagggtgggactgagaagtttgtgaaataagtggaggctgccttgccagggtctgtactcccaaaaattcgagcagagtcttgttatttctgctgcatagtcgctctgaaaataaaggaatcctgtgctggtacaaccaaatcatgcacatgcaccgctccccatcttgctgctgggaactccccagctgtgcgcgcccaagaaaagacattcccacatcatcacctgtgcatggccctccagctcgttgatgctcttctgggtgagcgcctccactggcccgcccagtttcacaaagtgggagggatggaacgtcacgcgctgatcgtaggctcgcgccagcttcccggcaaaggccagggcctgcttgatctcctcatactggggcagctccttggggtcaaaggaccccatccagggccagatcacgctggacatcctggggaaagcgggaatggttgccggggggggcagaatcaaggctccactgtccttgcacaggtacaccagcgagcgtggtgcggtgggtccagagtaggaatctcccacattccgcctacgtgcccagcagccttacctgaagaagcggatgccatgctcctggttccactggatcaggcgcgcaagatccctggagttggccaggcacagctcccccaggtatggaagccctttctcatccagcgtccgcttgatgaggtccctttacaggatagtatgatgctctggttcaagctgcagggtggcagtggtgatgctccaacgtcacttgacacaccttctgcaccccttggctcacctgctggtgaagatgggaggcttgagctcacgcagagcacagcacaggcaggcataccccaaattgggaatgggccgaggccctgggacaaaatccttgagcccctccagcagctctggcgtgggatctgtgtaggtgtgtggagggtgtgaggcaagggcagagcagcacgacctgaacacaagggaactcgtgagcacaggacattacaaatcagctgatgaaaacctgcagccctaccgttcccacctctcacccgtgaacgggagtggatccggctcctttttcttgcgtnnnnnnnnnnaacaagggaagccttcagcacagaacattacaaatcagctgatgaaaagctgcccccctaccgttcccacctctcacccgtgaatgggagtggatccggctcctttttcttgcgtacagccttcttcttcaccacctgcgtggctgccacctcgacacttgctcctgcatcatccagagacagcgagtctcccgtcttcacttccacctttatgctctgtctgacgcgctgggtgattttctttgttattttcgacgggctgccttctgtgtctgccggcacgtggggctccagatctggctttactgcagccttgcctgccctcggcgccttcttctttgcactaccctccggctccagatgctcacccttcactgctggctctgttgtggcagaggtgggtggcaatgttcagcatatcatctgcataccctacaaaatgagcgccaaatgcaaccagggacgccatgaaattatgctcacgatctcagcgcacctttggccttccggcccctcttcgctttgggtgttggcactggctctatgatgccattcaccgagctggcatggtctggaatgttctcctgatctagagcgccgcccaagtcctctgactttacaagtggaacagaggctctgggtgccagtctcctggactttggtttgggtggctcggtgcagaactctgacggtagctccacatcgagtattatgtcttgaactaaagatgcagctgatgatgttgtcttacgtgttctggccatgtatgaatgtgtgaggtactgccccacacagggccctcctgagaatacttgagaagcaagaggaggattaggtttgagaggcctgacagatccaaaagggtagcgaggtgatgcatgaannnnnnnnnngcccacacagggccctcctgaggatactcgagaagcaaaaggaggattaagtttgaggggcctgacacatccaaaagggtagcgaggtgatgcatgaacagaatgtcacaggagtataatcacatcatgccttgagtcatgagattccccttgtgtcagcataatgtgcagccacacacctctgcggcttgagcctccacagagggcaagcgcgcgcctcaagagccccgccagccccacacccgccaagctcgcctgcgagacatgcgaatatctgattttagtcatgcacacacaataatgatacgactcaacatgaataacgaccatcggctcaccaggaccactcgggcacaacgagagggctctgctgctggccacaggtgtcggtggagccctactgaatcaaagaatggtgcaggctccttcggaatgctacttcgtttaggtaatgatttaatatgttttaatgcacggggatgccgtcatcgaatcgctgttggaggtgtttcccgaaaattaggggtattgcctggcccacacggagggacttcgcgccagcttcgaggactggctgtttgaactgcacgggaggacaaatgtctaccaacgataatcaacagctatcgtgttactagatgaaggtgttcgcataacgaagcgactccaacgtaagctcgcacctccaaagagacgatacgagacatttctgtgcaatttgcagtacctgccgtcttgactggtcctgttcatagggaaccaggaattcattatgagagtggctaagagcacgtgagccccgaagtccaaccttgccataggctgcaccttccaacacgacctcctaaacatgttctcttcgatgattgtacacgatgttttgaaaaccctcgatggaacttttattcaatgacagtagttcatccgcatatttggaaatttagtcatatagtcttatagtataaattgccaagggcccactatgtgtaccctgggccgcctggaaaagggatgtcaccacgcagtgccaggagagcagtcagcccacctccagcctcgaccatgacatatgctcgtcgtccaaacaagttgatgggtcctttcacgtactttgcatgggaattaatcctcttgttccaatctgtttcactgtagtgtaccaccggcacctcgccccttctgtggaaggtgtctgttgccgcgaggaatgcctcctcctccgtcatgccatctgtatgcgagaaggggatccttggtgggtatttcaggagccagttggagtgacagactgtgtgactggagtaactgcagtcctggatgctgtatggaatgacttgacgcccacgtcactcccttaaaggcagcgcgcaacactttgttgttcacctgggttcaggggatgatgatgtaggtcgtcgacgatgggcacacccgtggcatggctgaatggcaaaaggtctttgatactgaattgacccttgaactcgtcgttctcaactgcatgcgggatggtgtggacgttatctgtgaagattgccgtctgtcggagatggcattgcaatctatgctgtcagctaccgaatacaacttggctaccacgcaaatgcccatcattctcaccctctgagtaattatgtcctcggcatagtgacccacctgcaatcnnnnnnnnnnacaaatacaacatggctaccacgcaaacgcccatcattctcaccctctgagtaattgtgtcctcggcatagtgacccacctgcaatcgaggctcgacagccgggactcaaccactgaagattcttctccagctgatctagagcgccgcccttgtctccagggaatccccgcacgtgcatgacgattttgttgtagacccccgggcggcaccccatcagcaccatcatctgagcggggagggcgaaaagannnnnnnnnnatgcatgacaattttgttgtagacccctgggcggcaccccattaggaccatcatctgagcggggagggcgaaaagacatgcacgtatatactttgttcatggaagcggcgttcatgattcgagtgtccattcgatttctaaacttgcatcaatgacgggccactgacccatcgatactgacttgatggagagcctccaagcgagcgacgctcgaacgtaaaacggcctcatgaggacttgcgagactcgtggtgatgtcactatgtaacgtcatacggatgcctgcatggcttgcaatgtcctttatgtcccggaagccggcccctatctgtgcatgttgaggcagatctgagactgggatgtctcctagcgtaatcaataaatgaggtagcctgcagggatgtgtagaagagcattgcggcatggaaattctccagatacaagacttggaagaaatagaagtcgagtgggctgggccctgaacaatggcattccaggaggcggacctgagcagggtaatgttcctggccgccgcctcctccacggtggctcgaagcttcttcagtttgaggaggagttggtgaccgaggacgcagatctcctgcttttgcgtcagtgcatgccgttgcctatagtccggccatttcggagtttgctagggtgttgcagctgacgcggaacgttgtagacacagctctgtgcgcagcagcgacacattttctagggtcattctcatagtcagacacatccattnnnnnnnnnngtagtccggccatttcgaagtttgccagggtgttgcagctgatgcggaccgttgtagacacagctctgcgcggggcagcgacacattttcttgggtcattctcatagtcagacacatccattctcacctagggtaaagctcagcagcaacgtcttgaaaagccttgactttaggggagtccactttgtacccgagattggcgagatctgtggattctacatcaagaagcgacgggatgagtttgtgtgcggatgatgtgcatgcagctggaggtgagcactgacnnnnnnnnnnaatctgtggattctacgtcaagaagcgactggatgagttggtgtgcggataatgtgcatgcagctggaggtgagcactgaccgtcccacaagagagcatctgtggcttgatgaaccattcaaccgccacagacaccttttattttgtaagtcggactcgtctccttagaatcatttaccggcaagacgaatctgcgccagatcgtgcttggggtgaatcggggaatttcaaccgggtaccaccctgccattgtagatacctacagattccccagaacacacctcgactccttctcatgaggcttcacaagctcattggttggaaccactatcgctggaacagggagtgaccgtttccctcgggtgtactctgcaaatgtggccagcgtgcccctgttggacgatcgggccagcgccgtcatgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccctttcactaagagtttgtctactgtaattctcatttctgggagagtcgtgattttttgctcgggaatcgcacggcctatgttccctcgagcttgcaaatgctggcgccgnnnnnnnnnnacgccctttcactaagagtttgtctactgtgattctcatttctgggagggtcgtgaaattttgctcgggaatcgcacggcctaagttccctcgagcttgcaaatgctggcgccgnnnnnnnnnnaagtgaccgtttccctcggttgtactctgcaaaggtggccatcgtgcccctgtgggacgatcgggccagcgccgtcatgttttgtacggtcatgtcggagaagtcgcgcagaattttggatctcgacgatcccaggctggaatgaggtcaccacttgaattgagacgattnnnnnnnnnnnnnnnnnnnnnnnnnnnnnnnnnnnnnnnnnnnnnnnnnnnnnnnnnnnnnnnnnnnnnnnnnnnnnnccatcccgaaacgccatcgttcgtgaggatgatgacgtggacgatggagcacacttcctgggttctcattgctcttgaatccaagtcgaatatccatgcttcgtgcttcattcctttcaaacttgccccaggccgagcaatggcttctggacacaaagtcctcggtgcgatccagctgctcctgtagaaacaaatgcatgagatgccccaagtgtatgcaagagggcccaatgcacccaggccgagggctcttgcccttctacatcaatcgggcagcagccacaggtgtcgcattgtggggcgcccatgcgggcagttccagggcgatttgaggccagccagggtgctcaccactcgctgcatggtgctgtgggagaggtgcttcccgatcatgatggaagaccggcaggccctggatgccaggacggcccgaactctgtgggaacggtgccaacgcatgggatgcgtgaagcgagacgcaagtcttcagaaagagtctgtatcagtttctgcattcaatagtggtcagctcaccttaaatgtgaaaacttcaggggctggaacggcccatgggctcccccagccaacccacctggagggccggagtaggctcccaggagttctggaagggatgccggcatgcagccctgcctccaccagacctatgagctcttggatgtctgcctctccgaataccacccccttgctgcatacagagatgggggttattgattgacagttcaggactggaatgctggtcaacagtgtcattgcagatctggtcgtccctgcagcatgaccggaagtcaataccactcatgcgtgagatcccatgagacccatcccnnnnnnnnnnattattgattgacagttcaggactgggacgctggtcaacagtgtcactgcagatctggtcgtccctgcagcaggaccggaggtcaataccattcatgcgtgagatcccatgagacccatcccagggacgtcgacaagctccccacctgaagggaacagccgagagggccaaatgaccctgtgcatcgtcgacaaactcaaagccattggccttgaagacatccaggttctccctggcaaatacaggagcatgggaagtgagtgtcagatgcgttgagcatggtcagcagatcatgcattgcagatagaatatgctcctgtgtcccatatggaaaactcctgggagcttggaacacctgcagacagaatggcctggcccgttgcctcaccggacatgcagctccnnnnnnnnnnatccattgcagatagaatgtgctcctgtgtctcacatggaaaactcctaggagcttggaacacttgcagacagaatggcagggcccgttgcctcaccggacatgcagctcctccaggggggcaagctccaggcgccgaggctggagcagcggctggcagttcagcttcagggaagcttccagtcgctcaaagttggccttctcgtctggaagatggagaggggtttgggtgtggcggcttggtcgaggagcacagggagcactctcctcggcacggaccgtgacccaatccattcctgtaggaatggcacatacccacacagcctggtgtaagtcttggggcactgtgatgcaaagcaaaattagtccatcgggcacccgcaccagaggcatgctggtcgatgatgaagagatcctgacccaggcgggcaatgataaagcccaggttgaactgccccaggatttgcatccgcgcaaagtcggccttgtcgaagacacgctccagctcacgctctgtgttggggagggaggataatggggaagtggcctggcttgggaggggtccaaggcactaccatggatgacaagttgaggcttcagcaacgccacaaccagcagatatctggccaaaagactgcgccgcctccttgcgcccttgacaccaggcccgcattcggcccccccagtcttcacaagcctgccgtgccatggcaggctcaccctctcccctccgccaagtcacctgcggcagggtcggcggtgtcagtcccttcatcacttgctgcagccacagcacacctctgcagcgtcgcggcccggaagcgcgctttcttcccagtgtcctccccatggcctgacttccggcgggcctcctcgctcctgcgtcgcagagcctccaggtccacacgcatcttaagcggccctgcttgccggctcagaggcggcgtgacgacaggcggcacctcctcgtcctctgatccccctttgacccctccggtttcctgagcctccgtgtcttgctcggccatttccacctgggggtcatccccctcagacaggtcgccatcggtgtctgcggcgcccaggcctgctggcgtcgcagggtccccggcctgagagggttgggggaacgggtgcagcccctttctgctcggctcggctggctggtcatcagtctccgagggctgggactcctcttgcccaaggcttccttgggccgcctcatggaccggcgcaggggcctgggctgccgccctggtcagcgtggcagcacagacccctgccacgtctgcaggctgctccccgtctgagtcgtcttgtgtagacatgggcccggggtcgctgacgcttgtgcccccgggcctggccagcccacttggtggagagggggtgggcaggaaaccaaacgcggccaaggggcccatcctcatcggccttggcaggctctgggcaggctcccccgccctgccaggggcggctgtcacggcgcctgagccagccttcctcccgctccttgcccctggcatggcgaacgacgcgaggcccggcgcgacggggctcctggcgccgagggcgctgggcctccctgtgtcgcccggcctagcggtctgctcctcctcctctcctccctcctcctcctcctcatcgtcatcatgaccagcgccgtccccaccctggctgtcctggctggggggggtgagggagaggcgctgccgcttgacggcatgcagcccgctggtgagggnnnnnnnnnnnnnnnnnnnnnnnnnnnnnnnnnnnnnnnnnnnnnnnnnnnnnnnnnnnngttggtgctggagggaagtgtgagcgtggttgttgggttcagggcaggggtatgcacgccaggaatccaacacggctctcacacacagggtggtgacagatgtgcagagtgacttgagctgctccagatcctgtgcgcctggatgacaaggtgtcaatcccccacctcaccccacaccacccacaaaagccacaaacagacctcctccctcggagccgcacctccttgaaccgtgccagcagggcgttttcgccgtgcagcgccacctggcgcttgttgggcgccaggttgatgtcgtaggcgtccgtgggcagcaccaggtccagcaccgcggagggccgtgcgtcggcgctggcctggctggagagggacctgaaggcctcgttcagggccttggcgaagcggggcaggtccacggggcggccgttcagggagaagaactgccgctcgcctgcagcaatgggagggaagaggtggagggcagggccgaggagggagcattgaactggacggggggatgtatagggaacgatgcccgcaacnnnnnnnnnntgaggagggggcattgcactggacgggggatgtatagggaacgatgcccgcaacaacctctgcatgccaagatggggggggttctcgcagggggcggccgaggtcatgccatgggccccttcatggccgagacctactatcctcctgccaggcttcagctggccccccctgaccgagcctggccctgacgccctcgtccgcccttgacgtgccaggctggcggagacatggtccatccgcatacaacacaaccatccctcgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccgcatctgcgctgccaccacaaacatcctcggacaggtcggcggagaaggtctgcannnnnnnnnnccctgccaggcttcggctggcccccccatgaccgagcctggccctgacgcccttgtccgcccttgacgtgccaggctggccgagacatggtcaatccgcatacaacacaaccatccctcgatccaccgcaccttgcatccggccgcccatgcccggccgcgacacgtaccccgtgaccctgaacgaggggtcggtctgttcagtgccaccctcccgccccnnnnnnnnnnnnnnnnggcctgctgctgctttaggcccaaacacggcgatgacgtcgctccaggcgtcggtggagccctgggtggccaccaccgtggcacggggcccgctgccctgctggtgggtggcgatgagccgcacgccacgcgccaccagcgcgtaggcctgcaggcagtgcgtgagcttggagaactcgcgcctcaggccggccttgaattcacggtgcctgggcaataatgtgggcgggaggaaaggggggaaacgggggtttccagggtagcaggttgatcggccgaacgaggagcgtggtgtgcttgctccaactccccacttcccaaatcccagcccgcacagcccgcccgcccgcacattcaatctccaatctccctcttcctcagatcgtgcgcctcatggccaaccacagaccaacacgagccctctcacctgacggggaggcgggcaaacaggttgcgcaccgccaccgtcgtgcccacggccctcggcacggcggcgcgacccgccagccggccccgctcgtcaaactccagccgggtgccggccgcctcgccggcggtgcgggtgacgacagagacatctgctaccgtgcacagggaggaaagtgcctctccccggaacccatagctggagaggccctgagattggttggtggtgggccgaggcgcgtcggcttggggttgtgaactgaagccagaacgatggattgggcgcaatgagggccagcttgtaccatggacccatcagcccagacctcccctgttccacgtatatactcaagacggctggaatcaaatttacacagacctggagatctgtgaactgggagatcttggaggtgtggtacttgagggtgagggcctcgtaatcggcagggctgaccccagtcccattgtctgccacctcgatcagctcagagccagactccttcagcttcacctattgatgaatatttggacagcggcgcgtgtgtgcacagggagccacactggacgccttggcatcagtctaatttgtatgcgctgggtccttggggtgggtcctttgggtgtagatgcgtgaaactcatcatgcacttccggtctgatacctcgatggcagtcgctcctgcgtccagggcattttctaagagctccttcactgcggtggacaggtccaggatgacttggcccgagcagatgcgatgcaccgaggtcgcgtcgatggctcgtatcgagggtgccatgattgtccaggtgcaccttttcgaagaggcctggcgccaccttgtggcatgggcgattcccctatcagcccattggatgttcaatgcaaaggagcgcacaggctgcttgtgccttgcatgtgcaacggcttgattgccgagcctgacgatttcgaacacgcgcgcgaagacggaggtggaccatcgctacaccattacccctccctccacaaccggtacacaacgcgccaccccatccagtgtctgggtgcagcaatacaacgaatgtgccatcaacttcaagcttcaagtatcgcagcactacaaaggatgaatggcagagggttggcagcccagcaccgacatggctgagtcagcacgcctggtccacgagcctgccgatgctcagaaatcggcgtccgtggtgaagacatgctgctcgccgcgtacctcgccgttggccacggccgcactccgcatcacccctgcccgctggtactccccgacccgtcgctcgaagaagttggtcttgcccctggttgatgtgaggggtggtgacaatgtcgagggcgcaaaaggatcaggtcagctcggtcagcaacaagctcgcgcacaggctcgcacgccttccctccacatgcccatggcctgagccgctgctccaggcacccaggactcactgcagggagatctggtccatgaagtcaaaggggttgactgagccgtagagcttgtcacagcccagggcgacaagcaggcggtccgccacaaactcgatgtactgcaggnnnnnnnnnnaacgatgttgagggcgcaaaaggatcaggtcagcttggtcagcaacaagctctcgcacaggcacgcacgccttccctctacatgcccatggcctgagccgctgtcccaggcatccagtactcactgcagggatatctggtccatgaagtcaaaggggttgactnnnnnnnnnnnnnnnnnnnnnnnatggacagtgggagcgagggagcggggttgaagtgctcagccatgcgagttgcatgccctccaacccctttccgcgggtgccacaccctgatgtgcccctcggcccttctgcaatacgagctggtcgtcacacatcccgtcctacgacgcacgccaccattgcagacagagagcgcgacgactcccacctccccaaccccactcagcggcacccaccnnnnnnnnnngtggacagtgggagcgagggagaggggttgaagtgctcagccatgcgagtcgctcgccctccaacccctttccgcgggtgccacacccagacatggccctcggccctcctgcaatgcgagctggtcgtcacaactcccgccccacgacgcgcgccaccactgcagacagagagcgcgacgcctcccgcctccccaaccccactcagcggcacccacctggcccatggcctccgcgttcatccccaccagcgccacagacagcgcgtcgcagagaaaaccgcgctcgagcgtcactgcctcggccacgatggcgtgcacgagggtttggtccagggggtgcctcaggcggcggtacaggaggcaggcaaagtcggtgtgcaggccctcatcacgggagatgagctcgtttgagaaggtgaggccgggcatgaggtgccgcttcttgagccagtagatggcacaaaaggagccggagaagaggatgccctccacgcaggcaaaggccaccagccgctgcgcgaagctggacccgctgccaatccatctgagggcccactccgcctttttccctgtgttggggtttgggaagggggggggtgggagcgtgacactgtgtgcgtctgtgctttggcatgaacgtggtcccagagatgggagtggtggtggttgaagtaaaacctgctgagtgacccgggcaaagaatgcaaaagggggtgctgatgggacaggatttttgtggccttggttgcagcgcatgctgccnnnnnnnnnnggggggtgggggggagcgtgacactgtgtgtttgtgctttgacatggatgtgctcccagagacgggagtggtggtggttgaagtagaacctgctgagtgacccgggcaaagaattcaacagggggtgccgatgggacagattcgtttgtggccttggttgcagcgcatgctgccatgtatgcgatcgacataatcaccacagggaagtcaatgagtagcagagatggccggagctaccctattcccaggcaagcacattgttgtaaacctactccattccacagtcccaaccaaggattgcacatggcaactcactgacgcaggggatggtctggatggcacggaagaggccgtctcgctcgacagggtccagaatgtacgactccagcagcaggccatacatctcgctgtgcacattctcgatggcggcctggaatgcgtagaatgcacgggcctcagggatctgcacctctgcacaggaaaggcaaagggggacagggataggcaggagtgagaagtgggcagggcaagagctatatggagatcacgaggaaagacctgccttctggtaaatggcagcgggatatggccttcaacgcagcagnnnnnnnnnnagggatgggcaggagtgagaagtgggcagggcaagagatatatggagattacaaggaaagacctgccttgtggtaaaaggcagcgggatatggccttcaacgcagcagcccaacaaccccaatactccacactgtcctcatcatcacgttatctccaggcggtgcttgcaccagtctagttctccaaggtgaaacaagagtttcacacatcatcggacaggcgaatgtgaccccctgacatccgccagcacgcatactacagtccctaccatccacctgcgccccaccttgcatgaagcgtgcagataggttctcgagcacgataccgtcggaggccgcaaagaaggcgagaatgtaggagatgaagtggcgctcgtcgtcggtcagtcgcacccaatcccgcatgtcggcggataggtccacctcctccacagtccagtagctggcttgggcctgcttgtagaactcgtagatgtcggtgtgcctgttgcagtgaggtgataagggggtaggggctgaggggccgccatggcagggggcacatgtagcttgcatgcgaggtggccacacccaggcctcnnnnnnnnnngaggggctgagcggccgccatggctgggggcacatgtggtttgcatgcgaggtggccacacccaggcctcccatccacaagcaacatgaaacggcgcagggttgcgccgcttgccggccatgctcacttgacggggagcaggcagaagcgctcatcattgtcctggaggagaggctcctccgcctcgaatgtcagctgccgggcggtgaagtcatccgtggggaagcgacgcccagcccctactaggcccaggtccacctggttggccaacaccacggggctgtcaggtgacgaagaccgagtttgtgacttttctgtgctttgcgggggggtagaatgagcaaatgctgctggggcagtgcgtgcgccctcttccttctcgctggcgaccatcgccgaggggcgggaaggtggtcctgcgggcagatgcgccaatgcttcactgattcttttcaggagcttaaatcagtgtatagagccgcggtgcgcgaaagtccacaggagtataaggtatgtgtgaggtgtgctgctctttgagggcggcatgcatgcggggcgtggtttgctcatctctatcgcatcacacagtctcgtttgtaccggcatgtatgatgcgttctgcccgccgtagggcgaagatgagtcttttaggcactagtcatctctttccaggcttgaatacacccatgggggcatgcaagagcaaacgacctgaagggagcaatgcgggtcacagtgccaagacagccctaacttatacatatctcctctccccttcctctgagacnnnnnnnnnngcgacctgaagggagctatgtgggtcacagtgccaagacagctcaaacttttacatatctcctctccccttcctctgagacagaatgtttggatcaaaccgtcaccctcgccagcctcaagaacggcactccattctttgatctggggcataaaggaacccaaagaaaattacaacaatacccagatccgtgacagaatccaagaaaaaactcgcactggggagagcaatgtgcaatgtgtcttgcggttcccctgattctagggagaggagaagggacaaaatggagaatcagatcccgtacaccctccaannnnnnnnnntagaaaattacaacaatacctagatccatgacagaacccaagtaaaaattcgcactggggagagtaatgtgcaatgtgtcttgcagctcccctgattctagggagaggagaagggagaacatggagaatcagatcccgtacaccctccaacccccgggattgacggagaatgtgtgcatggaatgtcatcgaatattctcgagtcgcgaaaacactggacagggtctcctatctacgatttgagattccgggtttagcgtgtttgtcctggctgagaagcagcgagcgacttccccttttccccacggacccacgtggctcccacccacgggcacgtttcgttggagctcttnnnnnnnnnntgacttctccttttccccatggacccacgtggttcgcacccacgggcacgtttcgttggagctcttaatattctccgcgtcctcgaagttggcatattcccatccccggtgccgattcggtgcttgcgccaagatgccatattctatacactgattaacattgtagttagcgggagaagagacgggtcaagatgcttctagcgcctgctctggtggccgccccaacctccctcctcaaccccctgcgacggagtgtgagcaccaccgctgttgcctctgccagcttgaatttgagtcaaaacatggctgtggcgcacgccccactcgtgagtacggtcgaggacggcaggaccctggcacgcgacgttgagcccttgctggtaagtcgttcggctggcagcttggcaccacgggttggggtttcagtgtccagattggtccgtgctgatcccggggcttcccccggatcgagagagtgggcttgggcccctgttcgggacccccaacgcgtctccgcgccggaacggacccgtttcggagctgcaggcgtgccccactccggtagccggaccaacagattgcaaccttatcacgtggtgcagggcaagccagggaccggtttcggcaggctcctggactacagatccaatgtggtcgccctgggcggccatcgcgggtgagatgggtggtcgggaatgtttttttctctgaggcggtagtatgcgcatggatgattcgctcggtgggatgacggttgggtccccgaggcctcgcctggcggcaccctcctttccattcccaccgccgctcgccctccatctgtcctgcctcagggatgctcacccccccctcccctggttcacatccatgcacagcctgggcgcgaattactgggacagcgccgcctcgcccaccaagccctcggccctgcgcttccccgtccgcgagaacaccatcccttccttcctgaagtctgtcgccgcgggcgccagcttcatcgagtttgacgtccaggtgacgggcgacggcgtgcccgtcatctggcacgataactacgtgatcacgggcacgcctgaggcccccatcaaccgcctgatcgccgacctgacctacgccgagttctgcgcgctggtgcccaccagcgccgacctgccgctgcagaaggcgggccaggtggcggggcttcgcgccgaggacgcggcggccgcggagcgcgcgcggcgccgcacgcgcctgctgcgcgcgctgggcggggacgagcccgcccaccgcgacgaccccaccctggccggctgggagtgcgacaccgaggagcgcctgccctcgctggcggagctcttcgcggccatgcccccacacgtcgccttcgacatcgaggtcaaggtggccgtgcccagccaccgcgcgcacacgccctcccgcgaggtcgaccgcctgctggggcccatcctggcgggcgtggacgcagcgcaggccgcggcgcgctccgcgggccagcccccgcgccgcgtgctctactcctccttcgaccccgacgtctgcgcggagctggcgcaccgccgccccgacgacgctgtcatgttcctgtccggcggcggcgcgtatcgccacgccgacccgcgccgcaccagctttgcggccgcggtggcctgggccgccgccgccgagctggctggcgtcatcttccacgcgggtcgcctgcgcgccgagccgggcgcggtgcgcgccgcgctggacgcgggcctccaggtcatgacctacggcctggacaacgtggacgcggagtacgtccaggaacagtaccgcgccggagtgcacggcgtcatcgtggacgacgtcagccgggtggtggaggcgctgacgcaggcgggcgccggcgggccgtcgcgcggcgcctcgcccccggccgtgcatgccgcacccgccgtctgacggcgggctggacgcgcctacgccggggcgacgcaggggggctgcgccagcccctgcgcgacgacgggcggccgacgacgggcggccgacgatgggcggccgannnnnnnnnncgccgcacccgccgtctgacggcgggctggttgcgccgacgccggggcggcgcaggggggttgcgccagcccctgcgtgacgacgggcggccgacgatgggcggccgacgccgcccggccaccgagtgccgacctcacgacctcatgacccccacactacccgtccacatacgtggccgacccaattttttagtaaaagggannnnnnnnnncgccgacctcacgaccccattgcccccacactacccgtccacataagtggccgacccaattttttagtaaaagggaagagagctcagtggtacctgtttgttcctccttttgccgtgcacccctccacacagacacgactaccctcctccctgtgcaccacctagcgacagcaagataacatttgtgtgagtaatgcttttgtctgcaccgctgccacgtctgatcccatcctcaggtagtgattgtaacatcatttttacccaatcacgtggcgcgagcacggcctcgtgagaatcggaaaggggttgtccatggaaaccttgtggttgcggcaggcaacagggagatctcgctggcgcaggagggcgcaggggcacgattctcactacaaacacccagctgaagagtctggcgcgcatggtggggcgtcaacccagaaacaagcgtctaatcccttcacaggcacacttgtgaagcgcagcgggcgaagtcaaggactcggcacgggggtctcgactgtcgactccatggaaaagtcaccgctggtggtgctgcctgacggggtcacggcccccgtcgacaggtttctagatgtgccagatggacagctggtctcgtctttcgagtgtgagcacccatgccgatacggctgagcctgcgcccggccgcatggacaggtggttagggctgtccaggcaccgctctcactcgcccactctcacccccaaaccgcccatgcccagccgcctcgcctccccccaccggtgatcgttccttgatgcatatatacgacatcatgcagcgcgtcgtgcttcaagaggacgtccagatcaagcggtccgtgcaagtggaggaagggttttgtggtggacagctccttggtcctcctttgtgggcatccggaggggcatgccgcctacacctcggtgaaatgctaaagacctggtcattccttctccaaacctgttttccaccactctttcctcttggcagacgtctggaggatgactttgcatacttctcgggaatgggccaagggagcaacgtgacgctgggatccagcgacagcgccgactctgcagccacccacgactgtgaggcccgattcctcaacaacttcctgcacctggcaaaccgtgctcacttcagggtcctgaatgtgggggagctggaagcagcctttgcagatgatttcttggtgcggagaaggcaacctctgggtgaagggcctggttgctcttgggtnnnnnnnnnncgatttcttggtgcggagaagacaatgtctgggtgaagggcctggttgctcttgggtcgcagaattgtgaggcaggtattcacccattgccgcacggctggatgccgtgcaatactttgttctgagcaaatacttggaaaatggacctacacgatccgacaagtctgaatgaaatgatgtccatccgcgcctctggtttgtgcatgcagcgctcgtcatcgtgatgtgctgacctctctcccttcnnnnnnnnnngacttggcaaatggacctacacaatccgacaagtttgagtgaaatgatgtccatccgcgtctctggtgtgtgcatgcagcgctcatcatcgtgatgtgctgacctctctcccttccctgctttcacaagttcacgctgccggtcaccgtgaactatgatgcgatggaccctgggcttctctcccggtactgggagagtcggccggaagctgccgcagcatctcgcttgccggagcctctgagcgaccgcgcaatcattctgcaccgtggcgtggatatggtggggnnnnnnnnnngctcataatgggatagtgggttggagaaatcacgtgcttcgtactgttactgggcatttggggaggtgaatgatgcagcgtgcctgcctctgcccaggggaccttgggggatccacatgcgaagtgcttgagcaaatgccattccaagccccgaagtcaaatgattaaaagtgccttgcacccactctgaccccccctaggtgacggtagaggatcaattcatccagcagaagnnnnnnnnnntggaccttggggatccacatgcaaagtgcttgagcaaatgcaatcccaagccccgaagtcaaatgattaaaagcgccttgcacccactctgaccccccctaggtcacggtagaggatcaattcatccagcagaagatcgactgcctaatttccttctacatcctccagcccctttggaccgcgctcatctccgtcgcccgcgtgtttggcgcagacaaggggctgcaggagaatgcacctccgggcctgggcgacagcccctacgtccagccggatgcctcagacactgggaagcagtcctcatccggctctgagagccccgtcaagtcgtcagaggacctcgcggagtccagtcagcgtgcggggccccggcacaactggatgctggaccgccagactttccgaacgtgggtgaagcccccgggagcaggcgctgttgaggaggggtttgggaggggggcttgggggacaggggagtctgtcccttgtcagcaagtgctctgggttctgatcactctgggttgatctggaaattggtatgctggaatccacggtgccttgtgcagcagctgcaactgctctatgaatgccttgctgacacttcttacatgggtggcgtctcacatttttacctttcatgtagtattcacaagatgcatactgggtttctattcgactctacctcctccctcccctcatgcagtgtgttcccaaacggcannnnnnnnnngttcaccagatgcatcctgggtttctattcgactctacctcctccttcccctcatgcagtgtgttcccaaacggcaaggcggtgctgaagcagcttttcaagccgattgctctccaggaggtctgcctgcgagacatcatcttgctgtatcgcccagccatggccaaggacggggaggagccaaaggacgtgcctctatggaagagagggggccaggtggaaggcatggacagggtgcgaggggtttgtggttggggccgggtgagcttttggcttggaggtggccatgtgcaggttccctcgcccccacagatttccatcaccagagtacgctttcctcacccaccgcctcgcgctccataccttctgaacaggagatgctgaagcagacgatggtgctgaagcgcttcaggtctgtccccctggcagacctggagatgatgctgcccgacaagacagtgtacatcccccccaaccagtacgtgtcggttggcatcaccgtcatctccggcctggtggccctgctgaccaccttcctccaggtcaggccacgagggtggcgggtggggcaattattcttgacggggtgttggtgtgcttgccccagggactcaatcaccttacaccaagtgtccatgattcccggcagcaaggttcgctcgctctccaccccccctcccccgtctcgccgcagtctgagtcgatgggcgtgatcttcagcggcaacctgctcaaagcactgggcggcatcctcctgtctcgagccggccaggtggccatgcagctgcaggcggagaaggcgtctgtgtcccagcaaatgacccaggcaagggactgacggtgccctggggtgcactgtgacggggtgatggtatgtgacgctgggtgacccatgctgcagtggcccaagagtgcctggggccatggccgacgtccccactaccctcccacccatgcacacgctcaccgccgccagatgatgtatgagaagaccctggctgcacagcaagccgtgctgtcgggcctcaccgacgaggtcacccggtgagcatggggatgacagatcggccggtgctcgtgggcgtgcgcagacgctggtgtccctccccgcgtatccctgtgcgtcggcgggggtctgaaggagaatgctcccttgacaacaccacaggcagcgcgtgcgcgagctgtttgtcgcctactgcgtccttgagcaggccaagaaagccctggccagtgagtggggttttggaaggtacctctccagctggcactgcaacgttctgtacggtgccgacttgcactgcgctgcatgattgcctgggcggcatggatctctgcgtccatggcagccatccgagaccctctaccagtccgccgctcccgaaatcccctctccgattcccccccccccccccccccccccccnnnnnnnnnnnnnnnnnnnnnnnnnnnnnnnnnnnnnnngccgaggacttggcgacggcctacgccgagtacctgagcaagaccttcgacgcaaacgtggagatggatggcgagcacacgctgcgcacgctgcgcacctggggcctggtgaagcaggcgacggacggcgcgtggctcgccatccccgctgagcgtgcggaggaggcgctgggccgtgtgtggaacgacctgtacacctacaagccggtaggactggagggagggagcgcatggtgatgtgcgtgtgagtcacaggtgctctgctgtcgacattttgtgcgcacgcacccagtccgtccctcagctggctctcctcggcaacccctgcagggcgacagtcctgacgactggcagaccagcaccaccaccaatggcgtggtggcggctgccggcagctcgagcagggccactgcaatcttgcgtccgccaggcgggacacaggcggcaggctttggggggaaccggagagccagtcgccgcacgcatatggcgcagctccatgtgtcagggcctgcacggctcgccgcgtgtgctgcgagcacgctcaggagtcctcgtgcctacggtccccgtttcttatgaccatctcgaccagcacgcttcccctnnnnnnnnnncgtcctcgagcttccggtccccgtttgctatgaccatctcgaccagcacgcttccccttagacatggctcctggggtgccttgctcccagaagttttgctgtgatccgatgcatgtcgtatgtatgtgaagactgcagggacggggcatggctgtgtcactgagcctacagctcaagagcctcaagcttctcgtgcatgttcctggctcgcatgacactcaggccgcannnnnnnnnngtgctcccagaaattttgctgtgatccgatgcatgccgtatgtatgtaaagactgcagggacggggcatggctgtgtcacggagcccacagctcgagagcctcgagcttctcgtgcacgttcctggctcgcatgacactcaggccgcagccagttcctccaggccctgcctctccaccgccctgagcatggcctccagcttggcagggcggcacgccagcagccctgggggggcgtcgacagcagggtcgtcggggcgcgagagtgcagcctggagcagccgtgtggcagccggtttgtccagtgcggccaggcccatgaacgcctgcagcacgggtaatgttgggggcgggacgtggggaggctgcagccccccatgcgcccttgagaccgcgaggtgatccggggtgacaagatgccccaggcctgtgatggcacatcgcttcatggatcatggaatgatcaagggctctgatgaggccctcccctctctcctgacgcatcgccctccatttatcctgggttttcatctccccccaaaactgtgcccacctttgtggcggcttccnnnnnnnnnncaatgttgggggcgggatgtggggatgctgcaggcccccatgggcccttgagaccgcgaggtgatccaaggtgacgagatgccccaggcctgtgatggcacatcgcnnnnnnnnnncatcccgggctttcatcccccccaaaaaactgtgcccacctttgtggcggcttcctgcagccgcagctcggacccaccaccgagccaggcggccacggcctcgagcagggatggcgcctccggcgccagcacctcccgcgccccgcccccgcccagcgggtcgggcgcctcgcccgcgccgtcggctgcatccgccaggcaggcgcaggccgcgcggcggacgcgcg

SEQ ID NO: 40989 - DNA, 423 bp, Chlorella protothecoides
  modified_base (101)..(341): a, c, t, g, unknown or other
aagaaaaccgggtcgcatggcggacagggcttcctcaagcggcgccagcagccgcactccaggcagcctccgcctgcccccctccatccttgccaacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgaggtgtgattgcctcgcaaccccaccttgagaagatgagccgaaactcccccctgccctgctctgcctgttccgaag

SEQ ID NO: 40990 - DNA, 97 bp, Chlorella protothecoides
gatggtggacgtcgggtccgcggccgcccgtgccgcacccccgctgccgttcgccgccggcgcccggcgcggcgcgcccaccgcgaccaagggcgac

SEQ ID NO: 40991 - DNA, 94 bp, Chlorella protothecoides
caggcgcgccgtcccgcgtcacgccagggccccgcggcggcgagggcggcgcccaccgccgcacctccaccgcccccggctggggccccgccag

SEQ ID NO: 40992 - DNA, 95 bp, Chlorella protothecoides
agcagcagctcctgtggcggaggatggccggcacatccctcctcaacaaccaatccacacctcttcactgccacaccacaaccctaccctcccaa

SEQ ID NO: 40993 - DNA, 70 bp, Chlorella protothecoides
gacctatcccccgagcagcagcgggcggtcgccctggtccgcgccgggaagaacgtgttcttcacaggtg

SEQ ID NO: 40994 - DNA, 131 bp, Chlorella protothecoides
ggacgaagcactgggcggcttgcgctggttgatctgtagggaaatcatcgtgtccccctctctcgaccagctctttctcgcgcccaaccggggtctggccagtcccttcgacacattgcttgctcagctgc

SEQ ID NO: 40995 - DNA, 61 bp, Chlorella protothecoides
aggggtttcgattcgcgggccactggctggggcacagacataccacgatccgccattaatg

SEQ ID NO: 40996 - DNA, 103 bp, Chlorella protothecoides
gggcggggcctggggcgagcccaggctcacatacgcgtccacgcgatgcgctgcgggcgggcgcgcgcccaagtacacgcgccccagccagccgccggcggag

SEQ ID NO: 40997 - DNA, 76 bp, Chlorella protothecoides
gccagcatagggcatcacatagatctgagagcgttaaaaaaacaagcatccggcgagcgagagcgcatgcatcctg

SEQ ID NO: 40998 - DNA, 61 bp, Chlorella protothecoides
atacagcctggcggccggcctggccctgggcctcatccacctgagcaagggcacgcaggcg

SEQ ID NO: 40999 - DNA, 429 bp, Chlorella protothecoides
  modified_base (156)..(316): a, c, t, g, unknown or other
ccccctccctcccccttccagcccccaagcaaagctcctcaccgtgcggggtgacgggggtcttgggcgccccgtcggccgcggtggtcgcacgccccgcccgccgccccgccctgaccgccgcggcggcggaggcctccagctgcgtgtagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttctggttctcgggcttgccctcccccaggatgacgccgtgcgtcgtctcccggttctgcggcaaccggatcctgtgcggagagaggggggttggggttgggggttgggga

SEQ ID NO: 41000 - DNA, 61 bp, Chlorella protothecoides
tccatcaggtcatcggcccgcggcagcggggaccgattcttgatggtggccttggtccgtg

SEQ ID NO: 41001 - DNA, 61 bp, Chlorella protothecoides
gtgatgcgcgctggcagcggcggtctagggggttacacggcggcagtgtacaggagatgct

SEQ ID NO: 41002 - DNA, 61 bp, Chlorella protothecoides
accaccctgcacacccgccgcaggcgccgccagaagcgtatccagggcccaggcgggggcc

SEQ ID NO: 41003 - DNA, 76 bp, Chlorella protothecoides
ttgatgagctgtgtgcgggaggagtgcgatggtgtaacttcagtgtatgggatggggacaaactaagctggatggc

SEQ ID NO: 41004 - DNA, 33124 bp, Chlorella protothecoides
  modified_base (650)..(659): a, c, t, g, unknown or other
  modified_base (1771)..(1780): a, c, t, g, unknown or other
  modified_base (2067)..(2076): a, c, t, g, unknown or other
  modified_base (2303)..(2312): a, c, t, g, unknown or other
  modified_base (2814)..(2823): a, c, t, g, unknown or other
  modified_base (3050)..(3059): a, c, t, g, unknown or other
  modified_base (3247)..(3256): a, c, t, g, unknown or other
  modified_base (4268)..(4277): a, c, t, g, unknown or other
  modified_base (6123)..(6132): a, c, t, g, unknown or other
  modified_base (6448)..(6457): a, c, t, g, unknown or other
  modified_base (6564)..(6573): a, c, t, g, unknown or other
  modified_base (6631)..(6640): a, c, t, g, unknown or other
  modified_base (7551)..(7560): a, c, t, g, unknown or other
  modified_base (8026)..(8035): a, c, t, g, unknown or other
  modified_base (8253)..(8262): a, c, t, g, unknown or other
  modified_base (9033)..(9042): a, c, t, g, unknown or other
  modified_base (9258)..(9267): a, c, t, g, unknown or other
  modified_base (9733)..(9742): a, c, t, g, unknown or other
  modified_base (10480)..(10489): a, c, t, g, unknown or other
  modified_base (10648)..(10657): a, c, t, g, unknown or other
  modified_base (10733)..(10742): a, c, t, g, unknown or other
  modified_base (12488)..(12497): a, c, t, g, unknown or other
  modified_base (14034)..(14043): a, c, t, g, unknown or other
  modified_base (15633)..(15642): a, c, t, g, unknown or other
  modified_base (15804)..(15813): a, c, t, g, unknown or other
  modified_base (17658)..(17667): a, c, t, g, unknown or other
  modified_base (18115)..(18124): a, c, t, g, unknown or other
  modified_base (19207)..(19216): a, c, t, g, unknown or other
  modified_base (19323)..(19332): a, c, t, g, unknown or other
  modified_base (19563)..(19572): a, c, t, g, unknown or other
  modified_base (19862)..(19871): a, c, t, g, unknown or other
  modified_base (20057)..(20066): a, c, t, g, unknown or other
  modified_base (20605)..(20614): a, c, t, g, unknown or other
  modified_base (21299)..(21308): a, c, t, g, unknown or other
  modified_base (23423)..(23432): a, c, t, g, unknown or other
  modified_base (24013)..(24022): a, c, t, g, unknown or other
  modified_base (24160)..(24169): a, c, t, g, unknown or other
  modified_base (24526)..(24535): a, c, t, g, unknown or other
  modified_base (24679)..(24688): a, c, t, g, unknown or other
  modified_base (24767)..(24986): a, c, t, g, unknown or other
  modified_base (25445)..(25454): a, c, t, g, unknown or other
  modified_base (26092)..(26107): a, c, t, g, unknown or other
  modified_base (26335)..(26344): a, c, t, g, unknown or other
  modified_base (26422)..(26523): a, c, t, g, unknown or other
  modified_base (26596)..(26783): a, c, t, g, unknown or other
  modified_base (26888)..(26897): a, c, t, g, unknown or other
  modified_base (27046)..(27055): a, c, t, g, unknown or other
  modified_base (27420)..(27429): a, c, t, g, unknown or other
  modified_base (28061)..(28070): a, c, t, g, unknown or other
  modified_base (28291)..(28300): a, c, t, g, unknown or other
  modified_base (28474)..(28483): a, c, t, g, unknown or other
  modified_base (28545)..(28554): a, c, t, g, unknown or other
  modified_base (28756)..(28826): a, c, t, g, unknown or other
  modified_base (28898)..(28907): a, c, t, g, unknown or other
  modified_base (29291)..(29300): a, c, t, g, unknown or other
  modified_base (29613)..(29622): a, c, t, g, unknown or other
  modified_base (30531)..(30540): a, c, t, g, unknown or other
  modified_base (31553)..(31562): a, c, t, g, unknown or other
  modified_base (32285)..(32294): a, c, t, g, unknown or other
cagcggtgcagcgggttggggggggggtcctgcaaggctctgctgtcccgtcgggggtggaggaaggggctgtggtgcgtccgtcgacccccccgcatctctgccgccctgctggctgagtggggggctgggtgcagaggcagtggtgggcaaccccgccgcgggcatgggtgacggggacccgaccgaggttccggtgatcgcaggaagagcaggggatgccgtgaccagggaggggggtggttgagcagggatgtggaggacggccggggtcgatcctgcccgtgcaaggggagacggcagggcgccgggccctcccccgcctccctctgaagacggaggaggcgggggcggagggttgcgggaggtgagagactgagcgtcgacgggtttgctgtctgcaggcacgaggccccctgccaggcctctccggggcaggctggaccctcgcagctggatgctgtgcattccttgtcccaggaacgtggctgcaatgtggaagaggggggcaagtgacagggatgattaagtttttgggtaaatgatcgcatgccgtacagcctttattcatgctgggattgattagggggctctgccacacttccaggcatccagcagatgaccgaggcagtggcaagcagcgtattccnnnnnnnnnngagttttggggtaaatgatcgcatgccgcacagcctttattcatgctgggattgattaaaggggctgtgccccacttccaggcatccagcagttgaccgaggcagtggcaagcagcgtattccagggatacggggacagcctttgaggtgatgggcagaggccaacatggcacatgatcccctggattccagtgggcaacaccgatcacctgcagaaacaaagaggacgatgcatagggctatcaaggtgatggaccgcctcggcatgcgccccttgctgggggtggagggcgcatcccggggactccgttgctgtccgagcgcggacaccggcctgtggataggagggagggtggataagggcaggcaaatgaaggcagtgctactacagggcctccaagacatcccaccattgggagggcatgcccccagctactgccacccggggaacctggatacccgtgtgacactttcccacaacgcccgacgcaccgtgcatatatattcgaacgggaagttcgattcccaatcatcttgaggccgcgctggccttgcggctatggccacggacagttcgggatctgttgcagcccgtgggccctacgattcccaagtccacagctcacacatggagcggcgcggatctcggatgttgaacttcatccatgtccatagcataggtcggaccactctggcgagtcgtgtgtacggcaaactcagcgccaatcgcaaggctggctggtacacaagagcttgctatgccatgcgtccagcccgctcatgcagcttcttaatcgacaacttacaattctgcgtcggcaggtggtgtctgagcgatccgatgtggggccgggcattgcttgggcttgctggcaactcccacacggtaacccttccctggtaccgaattcacccaattcaccgcgtgcgtcaccaagttcggtgagaaggaaggggggttgggggggttgattcttcggggacacttcatcaagcatgcggccaagtatggacgctggacagcctcacttgagcattctacaccatcaagaatgtatttaaataagtttgaggcgacgtttgtatgtatcggaacccatccagcgtgctcnnnnnnnnnncttaaaataaatttgaggcgacgtgtgtatgtatcggaacccatccagcgtgctccattcccttccccgtcaggggttgactgtcctccacagcggccaagcgtgcatgggcgatcggccgatactgtttaagtaaactcaattaaaggtatcaaagcatctatctggatttgcccggttgatcgctgatggtgacgatctagtctcagccactctcggggggtgtaccaccgacggcttgagtcttttacgacatcggcgaggagcaagagcacgggatacgcaannnnnnnnnngtgaaggcatctatctggatttgcccggttgatcgccgatggtgacgatctagtctcagccactctcggggggtgtcccaccgacggctcgagtttttacgacaccggcgaggagcaagagcacgggatacgcaagggcggagggttgatcggcacattcatatgaacagatacccagcaaatcgctttgaactacgcatctgcaggaccaccacttcgggcacccnnnnnnnnnngacagatacccagcaaatcgctttaaaatatgcatctgcaggaccaccacttcgggcaccccgacatcttggcatggtgcttcaagcacactccagtgacactggagcccagaacaacgacggcagtgcccgattggaggcaatgcgccacctgatcgactcgaaggatgaagagatcgagtgtctgagacagcgactcgcggccgtgctcggtggaggcagccggctggcagacccctccatgcgcgtgaatgggggtggtgaggtcgcttgtccccgaaccaggtgcagtgatccggaggccgagaagctgcgggtgcgggtggatgcactcacagccgctcacgccgctcaggcattggagctgaaaagggcagaggagagagcagctgcagcagaggtattcatgttggtacagggctgtgtattgtggaccagctgtcacattttctccagggaagccacttccatcacttggcacttgcagcaccaaccaacacannnnnnnnnngggattcatatcggtacagagctgggcattgtggaccagctgtcacaatttctcccgggaagccacttccaccacttggcacttgcagcaccaaccaacacaatcctcaacttcagaccttcaaacgggatgcatctccatgctgagcatgtacctttgtgtcactcgtaccagtaccggaattgttaacccctcgcctaccagtgcatgagcactggggctcaccnnnnnnnnnngaacgagatgcatctccatgctgagcatgtacctttccgtcactcgtaccagtaccggaattgtcaacccctcacctaccagtgcatgagcactggggctcaccatctgaattcccaacccccttctccgaagatggctatgcttttcccctgtgttaggggtcctccatgtcccgccagcaaagaannnnnnnnnnttaaccccccttctcagaacatggctatgcttttccactgtgtcaggggtcctccatgtcccgccagcaaagaatcactgtcactccctatcctctgtgcacagactcaggccaaggccagggcacaggaggtccagaccctgacagcacagctggcagacgtggacggctggaccctgtcggcccatgccaaggcccgggacgccatcatcgccgacctgacctcccagctccaggcggccagggcggaggtggaattgcgggtgcccggcgccgagcacgcggccgtggtcgaggaactggaaagcacaaaacgcggcctggcggccgcgcagcgtgccgcagaggcgcgagaggccgccgtgtccctggcgcaggccggtaccgccgagctggaacgacgcctggccagccgggaggcagcaagggagaagctggccgccctgcaggcgtccctggacgagagccgcgagaaggcagcggggctgtcatcccagctggcgacggcgcactccagcctggcagacgtgcgcggcacgctgcagaggaaggagggcgtaatgcagcggcaggccgcccgggccagggagatggaggccgagctggccgccctgcgtaagaccctgatgcagcagcagctgagcttggcagccagggcggggctggaaaggggggcaggcgctgtcggccatggcccggcaaaggtgctcgaagcctcgtcccgggcgtcgctgccgagccccggcgcggacgccgcggccatcgcgaccttgcgccgcgagaaggcttccctagagagggcggcgagcgcggcggagggccgggcagcagaggtcgaggcagagtgcacgcgcctgaccaccctcctcgagcagctgcgtggcaacgatgtcatggcggcgctgagggggacgcgggcacagctgcgccagtgcactgcacaactgggccgggagactgcggcgcggtcacaggtggccagggagtggggttttggaggggtatgtggagnnnnnnnnnngcagctgcgccagtgcaccgcacaactgggccgggagaccgcggcgcggtcacaggtggccggggagtggggttttggaggggtatgtggagccggtctatcctagcacgagcgactatgtgtgaatgttgggccctttgggatcggagcacgatgccccaccagcacaagcgcacgcccccacgaggcacagatacgagaccattattgtttccattacatcccctgtgcaggcagagacagccgccagtgctgcgtgcgcagacttgcgccaggctctggaagacaaggagggcatggagcggttgctgcgggaggcttcactgtaccaagaaaggtttgtggtgttgtcatggtgacaacctttcgggggaggggcaggattccttcctccatgcacatcatctgatacatcttacatggtgtctggaggaaatccgcgctcgtcagacgcagtgggacccacaccaatccagcccactcccaccctgttgttctcctccctcgctgtccttgtgcagtctgtcccaacgtctggcgcagtcagagcaggctctggccagtatgcgcgcggagaatgcgaagctccaggggtgcaagcagggcctggccgctgccgaagctgctgccgaggacgcagctcgacacgccgctgagctgtccctgtgagtgccgccatgtgatgggagggtgtacggaatggtacatgatagacttcaagagtaataaatccggcacgatttgtgcagcaagcatgcacacaggttgtcacagtaatgacccccccccccccatatcccatgatgcacccccatctccaatcacgtgcccagaaggaatgaggaggccctggcacgcttgagggccatggacgaacacctgctggagcatcgtcgtcagattcaacacctggagtcgacggtgcgcatggcatgggggtcatgattccactgcgagggtttcgtgtgggataccaacccaaccctctgtcccagcctgggtgtgataggatcttgaatggttggatggagacctgatctgagtcccaggcctcgctgtccttcctcacaccttcctctgttctttcatttttccaggtgacggcattgacatcggagcgagaggaggcgaacaaagcctgcgaagccctgcatgcagagctggaaaggaagaaggaattgctggccaccactcagcatgacatggaggtctgttgggtggctggacattgtcatgggagtggaccaggcctcctcctcccaccggctgcaggctggacttgcacactgcaaggtaaagcccgcacctcccccttcgcccttgcgacatattccacaggcgcaggaacgccagcgcagaagggccctggaaagcacagccagcgagctggaggcctgccagcagcgttgcgaggcgaggcggggaaggaggtgaccagcaataacaagaaagccttgatttagacggtgctgctcaccctcccctgcagcacacccctccgccgcaggccctggtgcagtccaggcaggaggctgaggaggagctggtgtctctgaggtccagggccctggaactcggcaggcagctggcggaggagcagggctgtgccagggctgcagagagggagagggccggactggaggcacagcttgctgcgcagcaggaggccctgagccgcagccgtgaggagcatgcctgcaagctcggagaattacaggctgcgcacgctgaagaagtgcgggtgtgtgtcagaggaagatccatgacaagttggtttgtagcaggggaagtgagcctgatttgattcatactcatcctgggctcaagtcaccctccctcccatctnnnnnnnnnncgaagaagtgcaggtctgtgtcagaggaagctccatgacaagttggtttgcagcatgggaagtgagcctgatttgattcatactcaacctgggctcaagtcaccctccctcccatcttgcaggaggcggtgtgtagggctggggcggctctgcagtcacgcattcagcagctcgaggaggagtgcgcagctgcagctgctgctgcagctttaaagggcagctcagcaccgaaccaagtatgtcccctgtgactcctgcgctgccaggtcactcactaatgcagcagggggagctctggatgggacaacagtcgccnnnnnnnnnnacaaagggcagctcaacaccgacccaagtatgtcccctgtgacccatgcgctgccaggtcactcactaatgcagcggggggagctctggatgggacaacagtcgccnnnnnnnnnnaacagcgtcagccgatggcaggaggcagctgcctcatggccgggcccctcgaagctcnnnnnnnnnncacatcggtccacgcccacgcagaccatgccacagccttgtgcactgcacagcacaagctgctgggcggctgcgctgcccgggcagcgtcagccaatggcaggaggctgctgcctcatggccgggcccctcgaagctcaagtccctcccatgccaggcgccaacacagcagcatgcacagcagaggaggctcgggtgagcgtagccaggtggtaatcaagcatgggctcttgatgctagccgtaaggagggccaggtacacaccactgtcagcatatctttgcctggtacagctcgtgacgaaggctcgcctcaaatgcacaggcggctgatgaattcgaaagtctgctggccaagctggaagacattcacagccggttgtcaggatcgagatcggaaactgctgtggctagtcttggcacgccacattccatgatgccagctcagcaaacaggaagacgggctgttgcaacgtaaagaaattcagtcggaatgacacgtacccaaaatgcagactgctcccaattcatgacaacgttgcgtgtgtcaacatatcctggtgcatgttaccaagtacacagtcttggtatgtttgacagctcaagggcacaggaagggacgggcttacttgcagatgtagtcaaaaggtgaggctaacacacatccaacactttgagtgccactgccaatgggtgtggaggcgatggcattcccagtggaatgctggaggtttcccataacttctcaagcgatcactactgcagcacgctcatcagtccaagaggggctccgggctggcactgggtccgttgctagaaagtgcgaatggcagcaggacttcatcgatcaggatggccacgcctgatgcaggatgtgatgggggggaggttgggctgagagggagtcgaatcnnnnnnnnnnaatcaggatggccacacctgattagggatgtgatggaggggaggttgggctgagagggagtcgaatctggacatggccagggcgaccagtcgacacagctcaaagctctcagctgccgccattgagctgggcactccattaagactccccgacccctccctttccatgactcaccattgtacccggccagcgagccccgaaggttgacctgggcgctggacaggccgtccacgctgtcgaggctcacggatcgcaccgtggtcactagggtctctcctgtcagacggttcaccccgagtggcaggctcgtgctgttgctcacgacagtgatgttcttgccctcgtacagggtgcccagggtcgtgtccgacacctggaaggggccagcaggttgatggtgggacacggggtgtgctgtcaaggttgcagcatcgagtaatgttcttggacgatgcctttcctggcnnnnnnnnnngtcggtgaaaattcgttcagtgatgcacagggggagactcacgcaatactgctggggaagcactcaggaaagaagcggagcagatcctcctctcatgatctctaccttcgtttgtgctcaggaacaaagacagactcacaaaatctcacaatctctctcttccgaatcagaaatttctccctgcccatcgccggcaaccctgtgtacctctggcagtnnnnnnnnnnaggctgacacgggggtgtgctgtcaaggttgcagcatcgggtaatgttcttggacgatgcctttcctggcagccttgttcctctacccgcttgaaaagactctatgcgaatggtcagccaccccctcgtcaagctccaactgttcacatgccagcaaccgcacatctcaccatctgctctggagcgatggggctggtcaccagacctgggtctgtgaagtggtagagcagaatgtccgacaactgcggcgcggagagggggggtccggtgaaattcgtttagtgatgcacaggggggagactcacgcaatcctgctggggaagcatttagaaaagaagcggggcagatcctcctctcatgatctctaccttcttttgtgctcaggaacaaaggcagattcacaaaatctcacaatctctctctcccaaagcagaaattcctccctgcccgtcgccggcaaccctgtgtacctctggcagtgccaacaggccctccacatcgacccccaggtcggacgccagctgatcaaaagcgtcattggtgggggcaaatgcggtgatgggcgagtacttgcagatggcggtctctgggtcggggcagtcctcagacaggagttgctgcaagggaaaggggcgggggggactcttcagtgttgaaatccttgtgcaacatttttgaacactcttggaccttcaaaccaacaatgagatctctaagatatgtcggagtgtagccaacctcagcagcactgtgcttgtaagccttgccaannnnnnnnnnacaacatttttgaacattcttggaccttcaaaccaacattgaggcctctaagatatgtcggagtgaagccaaccccagcagcactgtgcttgtaagccttgccaaaaaaactcaggccccagctcatatcacatgcagcctggtaggggcagccagtcggccccacccccagaacccacctcgatgccagacacgttcagggcttgggtgaaggtnnnnnnnnnncccccacccccagaacctaccccgacgccagacacgttcagggcttgggtgaaggtggacagccggggctcgttcccaacagccgtgacgacatcagccaggagcgcgatcacgttgctgattatgtacaggtgcccgtttcctgcatcgacggtgtgagattgggtcgggcatgcgtcgctgtttgtcatcaaggaggcgaggagcgcgggtgagtgctggggacaagtgccgcaccgtgcccgagcacgatttcctcttcatcatccacaagcggctccggacagcgccgtgtggctgggaaagggtgtcgcattcacggccccttcaataccaagaggtctgacctgctgcaacatcggctgtcgcgacggtgccctcgatgatcccctcggcgccgtacaccgaattggcaaggacgagcgcctggaatgcgggaagggcgagaagggaggccatgggtcgnnnnnnnnnnaacagcgccatgtggctgggaaagggtgtcgcatccatggccccttcaataccaagaggtctgacctgctgcaacatcagctgtcgcgacggtgccctcgatgatcccgtcggcgccatacaccgagttggcgaggacgagcgcctggaatgtgggaagggcgagaagggaggccatgggtcgagctgggtgcggagatgagcatatgcgaggggaggcagtgatgagataccatgggaggaggctggccggcgtgggcaaatatcactgcccccaagctttggttgacgtgctcgcttgcaacacaagaggcaagcgcagctggacactgctgactcggtgatgccatcatatgccaccccaattgccaacctggaaggggacggcgtcggtcggagtgacggtgaagccgccctccaggctggcctggatgtcgctgaacagcccgggggacagggtagggatcccaccgctggaccccgcctcatcagcctgagtcgcattgtacgtgcctgggtgatggcggcgggggtgcaggcagctcagtcacgatgcagtcgactggacccccggctgcgctactgggatgaggggctgtgccacctgcggcagccacccacgcttgcgcagacccctgccttccctcccgaccacgtgaggcatgccggtgctctctccccagtcaacacacccccgcaccacctgatgtcacgtggttgagcaggatggccaacagcnnnnnnnnnncctgggaggaggggctgtgccacctgtggcagccatccacgcttgcgcagacccctcccttccctcccgaccacatgagacatgccggtgctctctccccagtcaacataaaccccgcaccacctgaggtcacgtggttgagcaggatggccaacagcnnnnnnnnnnatggtgtatggcagttgacacgggggaccccacctccgcatcccaacacaaacgacgattgcaagccgccagcatnnnnnnnnnnttgggtgaggccaggaactgtccgatggtcgtgttcgtggactccaggaacgtggcgatggcatagttgctgcgggagggaagcaggtccggcgtgcattggtgcatggcggttgacacgggggactccacctccgcatcccgacacaaacgacgattgcaagccgccagcatgacccaggtccccaccaagactccaaagcacacgcacctgggggcaaagagggtgtacccctgaccgtcaggcccggcggatgccagggtgtcggtgaggttggcgacctccagggcagtggccaggaagctgaggctgggtgactcggccaccagctcccagagcgtgaaggagtcgggggctcctgcgaccacggcgtccacttcagggttgcagcctcggtagcccgcgccggagaagcggggactggcttggacggcggggcaggcctcggggctgaccacatagcagtagtaggtgtcgtccccctggctgctcaggaagttgtcgcagcccaggaaatcgtctacagaggccacactgtgatggtttgggtgtgtagggtagggtgttggaagggcggactggattaggagctgcttggtgggtggcatggtaagtccgagccatggggacaaacatggaaccagcgatctccgcgttggcagagggcagcttccgagcccccaaatcgggacagcatttgcctccgcgcacccgctgatccccgtgagcgtacagttgcaggctccaggcaaatcctcgatttctgatgcgggggtgatcaggtccaagacggcggtgcctgtgcccgggtgggggtgatgtttcgctgggtgaaatgtcacgagtcggtggcctctggcgtacgatctggggtcgcaaaacccgaccgacccggctccatgcatggggtcctgcgcattgctacttccgggaacggcacataatgtaaggcagcagtcaagccgtcattcttacccgaagagttttgaccagcgacggagagcgagagggcgcacagaaccgcaaggactaggactgctggggagccgtcgcgctgcatcatcacgtccgagtgctctgcaggccgattctgtatgatctgaatgagcacttcagtgaacaaggattcggaatcaagcgggttccccttttaaatcttccagatctgggtgtagtgtcagagggatctgggcggcccgcgtgatcggcttcaccgggagttgaagctgcgtgcctacgaaagggattcattgttcaactgcgaccgaatttcaaacttcctctgatagcctgcctgtccctctctacaatatctctgtgaccaatggaagcaaacccaggccgtgcatcgaaggggagcagaccgcagcacagaagagcacttgagggcgatacgggcgctgcgacctcagcccctccagcctccggagagcgccgccctcgttcagtccaggcctaccgccccggcgtctgccaccaggatcgaacgcccatgcaccccggcctctgccagcctctttgccagctcggcgccctgctccggtgcgatgccggacagcaggacgcaggcctcgcgagccctgggccccagcagcgcgcgcagtcccgccggccccgaccccagcagcgcccccagctccggcgcgaggcgggcctggccgtcagaggggctgagcaccgccctggcccccccttccccccccgcctcaaacacgctgtgcagcttcacccccgcctgccgccacnnnnnnnnnnggaggggctgagcaccgtcccggccccgccatccccccccgcctcaaacacactgtgcagcttcacccccgcctgccgccactcctcccactccaccacaaagggcgcggcggtgggcgagggcgcgagtacgaccgccaccacagggtgctgtgcggcgtgggccagcaggggggtccaggaaagtgcggaacggagcgccgccacgccgccagggctggcccccagcaggaggagcggccgctgctcctccagcgccgtcgccaggtcagcccccagggagagcaccgaggagaagctgcggcatggtggggtgggaaaagggtggaggtgtgcataggttgggggtgggggtgagggtgacactccgatgacgccttccccacccaggcgattccacatcgccctaatctcgcatgtgattctcagatagagccgattcggtgcagtgggcttacacgaccgcccaggagccggatgtaccgcaaagccaccacagggcctggccctgctcacccccgcttgccccagggaacatatgaagaagaagaacgcacggcggagcccccaccctccgcgactcacccccgtcccagcacctggctgacctccagcggtgtgcccggctcctgcgcggccaggctggcggcgctgtcccgcgcgcgcgtgtccagcagcagctccaccagcgtggcgtccagccccgccgactcgtttcgggcgctggtgggggaggaggcaagggcgaagcgcaccgtggccgagccgtcggcggcgcagccgtccacatcggcggcgccggggccggggcagaagcgcagggccaccgactggcccgggaagcggaagtcgtcgcgccagcgagggcggcgctgcacctgccgcactttcctcccgtccaggtactgcacccggtcctccaccgagagacgcagcaggcgcaggcccccgtccagggacgcctccctggccacgcggtcgaagaggggggggaatgcgtaggggtaaggtgagtatgcggacggggtggccgtgaggaggggagccatcgcggccatcctacgccttggccggcaaccggagtgttgcggaaccccagacctgctccgagagcttccccgccgtattcaacggatcttgccgatgctaaaccaaaaccatctaccgccctcccgtctcacttgttctccacgagggtggcggacgtccagatcaggtcggggtgagacgtggtgccggtcctggctgcctgaaacacccagcgccgaggaccatgcggcctgccagccggctggcacagaggatgacacactctgggagaatgcgagacttgacagccatcaaaggatcgctgcatgatcctcgatgtgaatgcaccggggtgcagtgaaccagtcatattgtgagcgcggtccgccgcacggtggctcacggcccgcgatctactaagcctcagctcagatccgatcctgcttgaatcgacacttcgataccgcgctaacatgccccatggacagggccttgcaccagagccccnnnnnnnnnngggctcacggcccgcgatctactgagcctcaactcagatccgatcctgcttgaatcgacacgttgacgccgcgctgacatgtcccatggacagggccttgcaccagagccccatgcagagaggggcaccgcggatggcctgaccggacccactaagaaagcacggcgtgatcatgggtcatgggcggggagtggacgtccctcaggttctctcgagccgtcccatcacttggcttggacagattcatgtttctagaagtgtagtatatttgggattgactgcagcgacatagagcgtagaatagctacggatcacttcgtggtgtaaagtgccgcaatgtcgaccttagccccaaccgtgagtgccactcgcgtggttgccgcacgatgcgaggcaccacgaatgttgccttccatgtccctgcgatctgtgcgaccctcaggtgagcatgtgcagccccaccagggttcgcaccctcggcccgtacttcagtctggcgagcactcgattggcccccgcacggtgatcacgatgggctcgcagcccggtaggatatccgacgctcaccaatctccatctttcctgtctcagcatcaggccgctgggcccctgcaaccgcccacacgcgagccggaggtctgcgcatgaggcgttgcccagcctcgcacatttgcgcggcggctggggcagagccggagatcacctcctctgacacggtgcccgtctcgctgcgtgtcacccagcacgtcagtttcggggaagtgctgaagattgcagggcagccccatgccctgggagggtggcggctcacccatgcaccaggtgggtcgcttggggggcgcagggttcttgatcggtgggaatggtggcattgaaatggcatcccggggtgcctgacgtgccccaggggccggtgtgcatggatgaaactttgccgggcaggcacaccactcttgcctctcttgcgctcaagtagatattgcgccctcggcttcccacgcatctttgcaccttcctatcatcccttcaccttatccaccccccaatccccttccaatgcagccctcagatggtcggaaggcgatgtgtggaccctggacctggatttgccagctggaaagcacgagtacaagctggtgatccacaacgagagtgcagatgtggcgtactgggagcaggggaacaaccgcaccttcacggtgtccgagcagtctgatgcgcccctcgtccttgagtttaattccgtggaagtcatcacggagaccgccgatgagctgagtgagtcaaggccgcggccagggtgtcctggcatgacccttccttccgctgcgcgtccgtgcaatgcttcagccatggggctgcatggatgtgtgaagcgactgctccagatcgagtccaaggggtgtcttgagctctcgagccttgagccaatcaagctccagttgacccatcaaacccccaccaagccccctccattcatctcccctctctccccttcagacgccgtctctgactcgcagctcaccgctgacaaggccaaccccccgactgctgctgctgaggagcccacagcggccaaggcagggtctnnnnnnnnnngcgctgacgaggccaaccccccgacggctgctgccgaggagcccacagcggccaaggcagggtctgctgcccccccagctgcagaggaagccagcgaggcagccatcgatgcccctgtctcgtctcctgctctggagaaggaggccgaggcgccgtcggcannnnnnnnnnaacgccccggtctcgtctcctgccctggagaaggaggccgaggcgccgtcggcagctgccgctgcggtttcttcttcgacgaagaaggaggaggccggtgcgccttccacctcatcgggtgccggggcttcatccagctctgagccatcgcagacgctctccgcgagcaaggccgagcccgctgccgcgcaaaaggaggccgccaagcatgcggccgtggaccccgccgcggacgccttcaaccccgcgcccaccccgaccaccgccgcaagtgagaaggaggaggccgccgccaccgacgcagctgcgaagaagctggagtccccggccgcgaagccagagaatctgggccagcgggtaaacaagttctttcaaaggtgccgcagtatgcccttgtatgccctgccacgccccttcctatgggcgctggggagtctctgtggcgcctctctggccctcgggaaggctgtgctgctccgcccaccatcaagcacccacaccttttccaagccaaggatggttgcgccgccgcaggccctccacgcccagaggaaggcccagcacacgactcttcaccaacctaccctctctgccgccttgcgcagactgctggagtgaagaagaagggggcaaagaaggcgacccgcgcccagaagggcaagtaggatgaccaaccagcgacgaggcgtctgaggctgcatctctgacatcgtggggatgagatgctgctctcgagggggatcgccatgcatcccacacggctggtcgcgcccagggtcctgttcagcgcgaatccggccccaggatttgactgacgtgtctcctagaatacctgctgatccattctactctttctcgttcacatgtcgcgagcagacccaaaaaccgcctgcatggggtgcgagctgtgtttctcccgctgattggtgacagtcctgctcattgaatgtgcccagctttaagatctctgcctgccatatggagtgtaatgtacgcgacggagcatgttgtccgggcggcgcataccaccaacatggtgtcacccaagcggaatccatgatcatgaagcatctctgcgataacgggcagtctccgacacccggaccatggcgtccagtcggccagtgtaacagcttcggcacggaccgatcaatcttagggtacctgtcatgtccggttcgaatctgggcaggtgaatctgccgctgcaagtactggcaatcaaggggcaccttcggagcaagagcgaggcagctggcgcgtgacgatcccgccacgattttggttgggtcagatcctcatcccccaccagagcaccttcatacgacacatacattcccccctgcgcaccctcatacaccctgatcagacgccatgatgcaatctatcgccatccagaagcccttcgtggcctccacgaccgccacgcgggtgacctctcgcagctctgctcgcactgcctccaccaccgtgtgcgccgtgcgtcgcgataaccagcatgccattgccaaggtgaggtattaaaggattttatccggagtctcctggtcgagagcaggcctgccaggcattgactctggctcggatcatgtcggcccgcacccgcctggatgcgtggtcctcaacccggtccacatccttgcggcgcaggtcggcatgggcctcgctggcctcctggccgctgcgcagctcgccaccacacctggtaagcagtggttgggagtagaacgtgaccctaccacgccggcatgtgcttacctgactctatacggagcctgcatcatgttgattcctgtgccaaccgccaaggccccaccccaccctgtcgttcctccctcccacagcnnnnnnnnnnccatgttgattcctgtgccaaccgccgaggccccaccctgtcgttcctccctcccacagcccaagccttcgatctgggacaggccatcaactccgtggggggcaccgacctggtagagaaggctaaggacgccgtgggtggatcaggaggagtccaggatctggtgcagcagggcaaggatgctgcccagaacatcaacgcccccgacctgaaggacgcggccggcaaggtcggcgaggtggcagacaaggcctctgacaaggcctctggtctggccgacaagatccccggcgtgtctgagagcaacctgcagaacgtcggtgagtggccatgggacgtggattcctcttcagagtgaggggcactccaagatgctgcattatcatgggagtgcacacaatgatgggaggatgagcgtgcatgacagcacataggcatgtttgaggcnnnnnnnnnntgggattcctcttcagagtgaggggcacttcaggatgctgcatcatcatgggagtgcacaccttgatgggaggatgagcatgcatgacagcacataggcatgtttgaggctggatgctttgcttttcctgtcggtgcattggcactgattgtgtatgtgggtctgcatgcccatatgtcgggcaatggtcagtggtctgcctgcatgcgaaccaaaacctttcttctgtggccctcttgacccacccctccttgcccctcctttcatcccccaggatcctccatcaagcaggccggtaaagaggccgccaatggcaacctgaacgaggtggccaacgacaccgtcgacaccctgggctcgcgcctgggtggcggcgaggccaagaagggcaccggctccaacgcgggcaaggaggttgcctccaaggccaacgacgcgctgaaggaggccgccaaccagggcgattccttctccggcttcgtcggcaaggacacctccaaggacaagctgggcaaggatgccgccctgggcgggcaagaccgcggcactggcggcctgtttggcctgtttggcaagaagtctggcgcggctgacctgaagctgcagggccagactgccctcgggggcgcccagtcccaggcccggggcgtcgccaacagtgctaagactgcggtgaacgacgcaggtgtgtgggtgggggtgggtgggtgtttgggtgggtgtgggtggggcgtttctgttgggcgagggtgattttgtctggtgaggaggattctgcagtccgcttctgggatgggttgaggttgagggcggcgatgaagtcgtcgtcctcggccccagcagccgctggattttggttttgcagctggattttggagccccagtataattgaacccccacttctgttcagagctcttgtcacacatttcttgcagcaattgcagcacccctcacccaccatgtaccccattcttgcctccaaacaggcacccaggccaagggtgtggccgaggaggtgaagaagtcggtgggtggcctggccaagaaggctggggcggtggagatcccccaccccgaggtgnnnnnnnnnnaggggatgaattcatcgtcctcggccccagcagccgctggctgttggttttgtagctggattttggagccccattgtaattgaacccccacttctgttcagagctcnnnnnnnnnngtgaagagcgccatcaaggagggcaagcgcaacctgtctctgaccaacgtcaagagtgtggtgggcaaggtggcggacaaggtctccgacaaggcggatcaggtggcaaacaaggctgccagcatctcccccagcaagggtaacttctcaggcgtggccaagactgcaggtgggcgtctgttttggagggggagagtggggtaagcacttcatggtctggtgtggaggggnnnnnnnnnnagtaacttctcaggcgtggccaagaccgcaggtgggcgtttgttttggagggggagaaagtggggtgtaagcacttcatggtctggtgtggaggggtgttttgcattgctggcaagggcttgctccgtgccgtggtcaaatgggtaattgtactcacccagccctcgtcaacaatcatccttgcgcaggtgattctgtgaaggatgcggggcgtaacgcgaagcagggcttcaaggacgccgcggcgcagggcaaggacgccgtcaagcaggccacccaggtgggtgatnnnnnnnnnncccttgcgcaggtgattccgtgaaggatgcgggacgtaacgcgaagcagggcttcaaggacgctgcggcgcagggcaaggaggccgtcaagcaggccacccaggtgggtgatgctgagggggggcaggttatcaatgacaatatgcatgcacccctcgtttggcacattccaccccccttacatcnnnnnnnnnntgggggggcaaggatattgatgacattaggcattcatctttcgtttggcacattccaccccccttacatctacagatgacggcctgcaatctgcccgtcgatgcaccccataacccttcctttcacactcccaccctgcagtagggggatgatgtggctgtcgtaggagaggacacgcctgccaagattgccgtggaaggcagcaggaagctgttgcaggagcagggttccttgaagaagctgggggtctgagatcccatccacatgctgctgccactccttcttcctcttcattgagaggaattttgaacctcacagagcggtgtcaagctgtttttgagagagggtctttctcgtgacctctcactgtgtgtggtttccaaccttcttgaaagtgctgatggtgttaccaggcagacttatacatatgaaaagggaactacagggagtactgggatcgggggttaagcgcaaacattgacaagcctctcaatggaatgcgtccgctgagtgtcgctcagaaccaccctggacaggtnnnnnnnnnngagggggcactgagatcggagattaagcgcaaacattgacaagccactcgacgggagtgcatcagcagagtgtcgctcagaaccaccctggacaggttagccagtcgagaactccaacctgctcaagcaaaaaaatcaccaactgtcaggttcttcatcagtgcgtcgccgcccgtgctcatggaagacacggtggacagcttgacatccgattgcaggttggccaggaggtcatgcagcgtcttggaagcagcccccggctcccccagccgctgccccatggcatggctgaactcgtcgacaacatgcaggcccagcaggctgtctgcgctcttggcgtaggagctctgccctgccacacgtgcagggaggggggtggatgggaccaaggtgaggtgggtttacgtgattcgctcttgtgagggatgcaaaggtcaggaggtcctgggacatgggatgacgccaccacagcagtccccagcaatgtgcagcagtctcaagcgtgcctgcttcatcaactcaccaagcacgctgctggtgatgcagatgacgtttgggaaggacagggtggaacagagggtggccgcctggcatgtgtcgatcaggatgaggaggtgggcgtacctgagtgaggggatattgggtgcaacaggagtgacgagggaacgagagatgggttgttctnnnnnnnnnncgaggggataatgggtgcaggaggggtgacgagggaacgagagatgggttgttctgctccccctgctcttgttgtattggttggagctagaaagcagcatgctcgaaacatggggattctggccggccaggcgcaatcatagggctgccccagtcctcccagcaggggcccacctgcccaaggcgtgcatggcggcgatggcggcggccaggtctgcctcaaggaactcggagcgatcgtgcatcttcaggaactggtcgcccccatgacccgtcaggaacaccaccacattcgatttccccgtgctgagcaggcgctgggaggcaggcgtccccgggggatgcacgcctggggcaaaaggggcagggaggtgctggagggcaggggtggtttgcgccagtgagaacacgcgtttgtgcgggagaagcacgtatctccacttggaccccaaggcttagacctcagaagtcggccaggaaagcagggcatcgcttgtcgcacaggctcaccgctgagcagctgcagcagggctgcctccgacacatcctctccccgcgcggagatggccgggtgcagcgccgagacctcacccctgggccccgcggcatgcagctggccatagcgtgcattccgcggattgcaggacagcgggtcggccagtagcagccggatgcggcgatctggcatgcccaaactgcgtcgtggacggctgggctggtcagaaggacttgaggaggggttgcagcaagcttacaatgctgctcaagatgtggctcacgaggagagggcacaacccaacgcagggctaccgaggtctaccccccaaacgcaccctcgagccgaacgatagacctccagggcgttgagggtgtgcctgtaattcaaccatccgcgagaagcagacaaaatgattgcgtgcggtgggtgggctggctgtcgcttcagggcccagcatcggcatgcaaggccgagaagaacggcgatcacacgcgcgatccggcccgagacgtagctccgccttgcatgaagaagtggtgtggcacgcattccaggtcttacatgccgcgatgccccccggagctatacgctttcagggtttgccgcacccacacgtcaggggtacagcatgatcatgtatgtgctacttccaattgcgatgtgggcaacgcataaatcgcaaatgtcgtagtggcaatcacacttgatctcacggaggagtgtatactcctcttcattccctggatcacatactcattctgctacagggaaaatcggacggaaacaaaaaggtaatcatgaatatcaaggaaaggacggcttacaattttctcggtcgacatggaaagccattcaagtgaagcgaagagctcccactaatgggcgtgttgaatccctgaaagtggcatgtgctctacatcgatggcccgagatgcgtgtgcgaaggcgtgcggctcgctgcacctccacaggacaaagcagtgtgctccatgatgctgtggggcatggagggcgctgcataatgtacaaaatctgacagccacccacataggtcaagctcatcgcctgacacttccttttattcctagaaatactacccaagtgctacttttgtgtggctccaagcaagctcattcctggagctgtgagtcaggtggaacctccagccaggtccttaagttgaggccagacccgggacgatatgtccagagcggtctgctccagccccttccctccccaaaaggccctcaaccccctggatgctgatagagattcagaggatgagcttcccagctcacccccccccccttgtcacgatgcaccgccatatcatcatcagatactgacacagcgtttgaggatgagctcaacagctcctggggcccctcctcagacggcaccgctaaataaggctcagaacctgacatggaatcagagtctgagctctccggcacctcatctcctgcttcaggcggctctgccagatcggcagaggccactccagcaggcactcaagcctgtccctccctggcggctccaggacctaacgacgaggtggcttctgctgcgctgcttaccatgctcgtgtcggcgagcaccgcctcgccgcaccctccnnnnnnnnnntcggcacctcatctcctgctccaggcggctctgccaggtcggcagaggccactccagcaggcactcaggcctgtccctccctggcggctgcaggacctaacgacgaggtggctgctgctgcgctgctcaccatgcacgcgtcggcgagcaccgcctcgccgcaccctccctcctccaaggtctccagggaagcacggcatgccacctggatggcgcataagatgaagggtcgacccctcggctacgccatggtttcttgccacaccatcaggcagggggtcagactggctttgaggcacccaggtgagacgactgcgggggcgagggggaggtggacatccagaacagctggggctcatccatgcagtcgctcgccgtcgccctccttgctgagtgaaacgccccggcgcccactcctccctctgtgctgccggcagtcgacctcggcgcggccctgctcggctcggactggactcgtagcgtggcggccctgaccggcagcctgccctccaaatcacaggaagcgggtgagtcatttggtgaggcggcggggtagcagcggactgcatgtccacgcccgnnnnnnnnnnatcggcgcggccctgctcggcttggactggactcgtagcgtggcagccctgcccgacagcctgccctccaaatcacgggaagcgggtgagtcattttgtgaggcggcgggtagcagcggactgcatgtccacgcccgnnnnnnnnnnttccgttgatccatgagcactgcgcacctcccagcctctccctcccctcacccccccaccccctgacaccgtgcccagtgattctggacggcagtatggcgtgggggtcgctctacatcatcgtccgccgggggaggctccacagggaggcatggctcacgcacctcagccccctcttccaccagcgccaggtcaccacctgcgatgtgctggcattttgggcggtgggccccggcgcctgcggcctagcggtgctccatcgacgtactcaggtgcgctgacggcctcctcctctgaggagcggtgggagagggggttgccggccgcccccgcaagcgactgcgcgtgtgcaggctnnnnnnnnnnccctgggcggtgggccccggcgcctgcggcctcgcggtgctccatcgacgtactcaggtgcgctgacggcctcctcctttgaggagcggtgggagaggggggtgccggtcgcccccccgcaagcgactgcgcgtgtgcaggctnnnnnnnnnnggggggaggctccacagggggcatggctcacgcacctcagcccccacgtccaccagcgccaggtcaccacctgcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccaccctccctgaatttcccatccaacccggccgtccaggaagccaaaagcatcctggagggtctggcccagcaaggctgggcagccgagatgctggagccggaggtcggggatgctgtggggcggaagaggctcgctccccgccagcccgaggctcaggggcaggccgcaaagaatagtgcttgggaggaggcatgggcccaacgtatgggctggcgcagcccaccggcggccaaggctcggagggagctccaggtcagtgaacttccgctgcaggctggcgctcccgtggccggcgtggcgcatgctggcgggccgtcccgcgggccccccacgagttccctggtccctgggagaaccggagctgcccccggcttcagccacggcccgattgaattctgccaggcgcctgggtcggggccccagctccccattcctcggaccccagcccgcccnnnnnnnnnnttcccgcgggccccccacgagttctggggtccctgggagaaccggagccgcccccggcttcagccacggcccggacgatttctgccgggcgcctgggtcggggccccggctccccattcctcggaccccagcccgcccgagccggtccaggtggacgaggttggccccgggcgaatgctgccggcggaatccgcactggcgcatgccattgccctcctgcacagtcagcacctactcctgcacaagcagcatgcggcgtccaggatgctgtgcgccatgatctctgcgcgggcggcggcggggcgaggcgccgccgcaggccctgctggcggcgtggagccgcctgctgtcgtcccacaggaaccaccatggcccatgctgcagcctcagcagcagcagcagcagcaaccgcctcagcctcagcctcagcagcagcagcagcagcagaagcagcagcagaagcagcagcagcctcagcagcagcagccccagcagccgtctgtgaagtacatgctctggtcgcagcagccacagcagccttgtaatataaatctcccgctgcctgggcagccgcccatgctgcccaccgcgtggccacctgtgcagccagtcgtgcagccacccatgcactcgccccnnnnnnnnnnnnnnnntgccagagctggacccctctgctctcgcactgtttgcaagggtgatcgtgcaccttcgcaacctgctgatctgcagcgttcctaccgccgtccgcctcctcaaaagctgggaagggcagggggacgctcctgggggcggcacacggatcgcaccttgtggcggcgtgcggattgcacccgggttcgagccgcgggaccccaggaggaggtcaacggaatggtcgactnnnnnnnnnncgtagtgttcccatcgccgtccgcctgctcaaaagctgggaagggcaggggacgctcctgggggcggcacacggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggttggcggagggatgagatgccagtggcggccccatggggactgggcaagacgcacaaggcggccagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctggcccccgccggcccagggatccgcggcgcagaggaggagcgcagctgcccaggcgagctctggtcaaggaaccgccgtgcggggtttgacggcgctggcnnnnnnnnnnccggttggcggagggacgagatgccagtggcggccccttggcgactgggcaagacgcacaaggcggccagtcggcagagggacgagatgcggacgctggccagtgggcatagggatgaggcgtgggcgctggcgggccgcatcaagtcnnnnnnnnnncgcggacgctggccagtcggcagagggacggggcgtgggcgctggcgggccgcatcaagtctctgaggctcatgaggggtcccaggagcccatcacccccaacacccagaggctgggagagactgcacccctcggccctgctgctggcccccgctggcccagggatctgcggcgcagaggaggagcgcagctgctgaggcgagccctggtcaaggaaaccgccgtgcggggtttgacggcgctggcgacaacctgcaggtcgctggcggggcgcctggagaacgagaatgtggaggtactacagccggcgatggactccctcgctgacgtcctcctgcagatgcaggcatggatttgctcccagnnnnnnnnnntggggcgcctggaggacgagaatgtggaggtaccgcagccggcgatggactccctcgctgacatccttctgcagatgcaggcatggatttgctcccagccctgggagctggggtcggcctgacgagccttgctgttgccctggtccctgcagccgactttgaatggtgcagcacccaaacgaacaagcagacaggcacgcagatggggctgatgggggaggtacgagcagtccggggatgctcctcatcagcgtgccccccggcgggtccgcacccgcccagcgctcagccgtctgaccgtacggggagcttgaagctgaggctcatggagtcatcgtaccctgcagagctctccgggtcgctgtatatgcaaagcaagtgcacaaagccaccgtcgcctgcagtccggatgagtgggcccgctcagctggggagagcacgggccatttgctggcatgcacctccttcaggaggtgggcatccccaggaggagtgcggctgcacaaatcccatcgtcaacctgccctttgcagcccgactccccagtctgggcaccccagccagccacagtgccccaagcaccaccctccggcaccctccggtgcccacctgctatgcccaggagaagctgnnnnnnnnnntgtggacccgctcagctggggagaggacgggccagttgctggtatgtacctccttcaggaggtgggcatcctcaggagtagtgcggctgcacaaatcccattgtcaacctgcccttggcagcccgacacccccgtctgggcaccccagccagccagagcactccaagcaccacccctccggcaccctccagtgcccacctgctatgcccaggagaagctgnnnnnnnnnnacgaggaggggagtgcgtgggtgcgggcatgggtagtaggcttggcttgcctgactgcatgggtggcacatgggaggggtgtgtgtgcagtcgcacaggcagcatccctcgcaacaccaccaggggatccagcaccccccgcaccgcaccttgcgctgggcaccgccatggacnnnnnnnnnngagaccaccaggggatccagcaacccccgcgccgcaccttgcgctgggcaccgccatggacnnnnnnnnnnggcgggtcccgtgaactgggaggcgaggagggcgcgggacaggtgcttggccagcgtgcaggcgccggcggcgtggcccgtggcctcggccgccgccagcctctccgccgggtctgtttgccgggacgacgccctgtgcaacaagtggcgaggaggggactgcatgggtgccgggcatgggtagtaggcttggcttgcctgnnnnnnnnnnnnnnnnnnnnnnnnnnnnnnnnnnnnnnnnnnnnnnnnnnnnnnnnnnnnnnnnnnnnnnntctccgccaggtgctgtgacgcggaggggtgcaggggtccacacaggctcagtcaaggcagggcagcattcnnnnnnnnnnaccggcaggacctgcagggctcccgtctccgagcccagctccagccctggcacatgggcgctcatgtacgccttgccgtggcgggtggtggaaacgtggagctccgccgccaggcccttcagccgctccgccaggtgctgtgaagcggaggggcgcagaggtccgcacaggctcagtcaaggcagggcagcattcagcacagggacagagtggagcctggcgcctgctttccgacgtcaagcgtcgacccagctgctctgtggagacatgcatgcgcactcgggcccactgccccaacccccacaccctgcgcactgcagcacagtttcccgagatcgcctggagctgctcagagcagtgccatcccatgacgcggccagtgcnnnnnnnnnnggccccgacccccacaccctgcgcacttcagcacagtttcccgagatcgcctcgggctgctcacagcagtgccatcccatgacgcggccagtgctcgatcgcaaacccacctggaagcgtggcatctcaggctggatgtccaagtagaaaggacagagggagttgaggtcacgcagggacaccagctgctcgacctggggggtgcgcagggtatgcagagatgcgtgtcatggatgtgaaagcctggagagcctgcgccgcaggtatgcagcatccagcacaacatgtgattgtgcagaagggccgggcccgnnnnnnnnnnaacctgtggggtgcgcagggtatgtagagatgcgtgtcatggatatgaaagcctggagagcctgcgccgcaggtacgcagcatgtagcacgacatgtgattgtgcagaagggccgggcccggagagctccgcccaagagacctggctcgcagggtatggcctggtgatggggaggtcctgcagcaagcatcaagagggatcggcgtgggggcagaggatgccctctgaaacacgcatcaagcatgcccaactctgcaagatctaggccccaccgcctcacctgcaccatgctcatgtcatacccctgccatgcaaaggaaaggacgggacgctgcgatgtctgctcgctgccggatgacacggctcctgttgtgcagggaccggggcactgttgatgctgaagaggagcatgctgtcctacctcagttctcatggttaaacacccagccacgtcatcccagcaaagagtaagctctccatgctggtgacatccaggtgtggcctgcgcagaacctatctaatccaggtccagacctgacatgctgcttgagcaggccctcatggtgagccgcatttcgaggctggaggcatcgttggcggcggcagcatgcaacaccctgagtagcagggcggtgtccagtgcaaaggctatcttgttgtcgcagcgcgactctatgtggaagctgccgggctcaaacaggaccgcctgagggaggtatgggagttgatacttgatggaaattcagcacagacaagcaaggcctttctggcagctttccgtggcctgacaatttcacagcttgaaaacatctctagcataaaaagccaactatgatgggcaaagaagaaaggctcaaaaacttgcagctgcagacgactgtttccccaaccacccttcacaattatctnnnnnnnnnntcagcttgaaaacatctccagcataaaaagccaacaatgatgggcaaagaagaaaggcacaagaacttgcagctgcagtcgattgtttccccaaccacccttcacaattatctcaccgcagccacacgtgccgataagagcaggccatcagtgtcttgctctgtctgacagagatatgcaccctggggatccaggaggagctgcaggctcttcccaaacttttcgaatgtgggtaggaaacccttctccaacactcgcaggcctctgtccgacaaggtggccttcagcttcatcggagcaaggcctggccgtgaagatcaggggcctctcgaaaccaagcgggtccaagagcggtctgccttcatagaagcgtaggctcgaaatgtgttcgccgtgagagcggtgtccggtagccgaccgatgcacaacagaacttcgtggaggatcacgatcgatgtgatggcggtattttcaataacgttacaactctttgtgtatttcatgttattcttattcttgcatgtggccttcttgggcacctgatcgccagttcatccggaacttcagttcgaattcgcgcccagatcgttagtgcgggtccttctcctttcgctctgacgctccatgcaaagctggaacaagtattctcagattgccatagcttgtgccattacagctgatgcatttcatctaaagagtcgtgtcagaccctggctgagcgacagcctcagcatccaccaagcctactgctgctgctgcctgctgcttgtctgcttcttgctgagcctccgcatcctgtgcgagccgcgcagcctcttcctcatcctcgaggagcggggcataataatctcggtgtgccagcatgcactccctgagtgcaatcgtctgtgcagtccataaaggtcgggatcaggaggaggaacttgttgggagcaaccaaaggcatgcttgcaccctttggggtcccagagattgagatattacacacatccaccgagcagcaagagagaatnnnnnnnnnnggcattcttgcaccctttgggggtccagagattgagatatcacacacatccaccgagcagcaagagagaattatgcacgaatgcgtgccataccaagccccaaggctcacctggtcgccacatcgagatgcaaagtctgcgccatcttctcgctccttgtccacacacttgctccaggcctatggcaccaggtgatttgagttgagtggtccgaacatgctctgcatagcatctcgcaacccctggccccctgactgactcaaccccgactcacattgaaagccttcttgcagcctccacccttcatgaagatgcaaaacccacaggtatcattttcatcatcttcatcgtcctcatcctcgccagctgaaccctgctgttcctctggatgagcagctgtcgcaggggggtccgagccagcattcgtcttggcctcagacctgccgtcggaagcaagctttggaactcccgtcccgctggtgctagcgggggcactgctgccctctgcgcatcggtcaaatatggaagaatatatgaatgcttaccagtgtccatgcatgcacccggattgggaccatgaagctcctcgtgatgcatcctcacctgccatgtcgaccacagctgctgcgtccaaggctgagtcgggatcagcaggaacaagagctggtagccagtacagggttcagtatatcaaattcagccttcacgtcgtgaggtgcgcgnnnnnnnnnncccaaggccgaatcgggaccagcaggaacaagagctggtagccggtacagggttcagtatattaaattcagccttcacgtcgtgaggtgcgcgcgccaaaggcctttgcttccattgtgcgtgccgaaatttcaacgcgtgacgatgactcatcaatgatattacatccttcacacagcggactcgagaattctctgatgggcactgggtcacgccctaaccaggctcacaattccacaggagcacctcaagactctggaggaccagtccgtacgcatctcgaccgtgcgcccgccttactccccgccgagccgccaaaggtgggcggtacatccgcgtcccgcagctcctgcagcacggcctccagcccccccgccctgccctccaccctgtcccaggcatcgtccagcatggggctgccatacacccgcgcctcgttccggaaggagaagatggtgcccgaccgccactgcgcgtcggggcggcgcgccagcgcctccagcaggtcccgccgctccttggcgctgtagggcgtccggcccgtgccccccttgctgaagcagctctccacgtcgggcaggctgatgctgccgcgccgctccgccgacaggctggcggtggggtccgccaccgtttgcttgtaccagcccgacagctggccccaggggtaggtggggcggtacagtttgctcacccccgcgcctgcccgggtcccggcgcccggggcacgggggaattgacccagatgaaggtcgtgcagctggtgcaggggtacgggcgacgacacgacgctctgtaggggcggggggggggggggggggggtgggggg

SEQ ID NO: 41005 - DNA, 224 bp, Chlorella protothecoides
tgcaacttcttgttggcacgagttgacgggtggcaggggagaggggagggtgtgagggagcggcaggccccacggcagcggtaccaaggggcgtactgggccatccccatcccgacgccgcaacgcatcgcacactctctcagttgcaggatctcatttcccaaaaggctttcccagtaaattcgggtgcccgatcgccggtgcgggctgatcagacacggccg

SEQ ID NO: 41006 - DNA, 61 bp, Chlorella protothecoides
tcgtgtccaagcgcagggaggtggagagggtgcgacatgtccccacctctgcttcacactg

SEQ ID NO: 41007 - DNA, 18087 bp, Chlorella protothecoides
  modified_base (674)..(683): a, c, t, g, unknown or other
  modified_base (1705)..(1714): a, c, t, g, unknown or other
  modified_base (1799)..(1996): a, c, t, g, unknown or other
  modified_base (2236)..(2245): a, c, t, g, unknown or other
  modified_base (2905)..(2914): a, c, t, g, unknown or other
  modified_base (3985)..(3994): a, c, t, g, unknown or other
  modified_base (5607)..(5616): a, c, t, g, unknown or other
  modified_base (6158)..(6167): a, c, t, g, unknown or other
  modified_base (7466)..(7475): a, c, t, g, unknown or other
  modified_base (7724)..(7733): a, c, t, g, unknown or other
  modified_base (8274)..(8283): a, c, t, g, unknown or other
  modified_base (9067)..(9076): a, c, t, g, unknown or other
  modified_base (9699)..(9708): a, c, t, g, unknown or other
  modified_base (10832)..(10841): a, c, t, g, unknown or other
  modified_base (11491)..(11500): a, c, t, g, unknown or other
  modified_base (12038)..(12047): a, c, t, g, unknown or other
  modified_base (12661)..(12670): a, c, t, g, unknown or other
  modified_base (13719)..(13728): a, c, t, g, unknown or other
  modified_base (14296)..(14305): a, c, t, g, unknown or other
  modified_base (15047)..(15056): a, c, t, g, unknown or other
  modified_base (16133)..(16142): a, c, t, g, unknown or other
  modified_base (16804)..(16813): a, c, t, g, unknown or other
  modified_base (16890)..(16899): a, c, t, g, unknown or other
  modified_base (17679)..(17688): a, c, t, g, unknown or other
cggcgcggctggcgtggaggcggcgccgagcgcagcgccgctttctgcgggcctcgccgccgccgccgccaagaggccacgggtggagcccggcgcggcagcgagcggcgcggtgacggaggaggaggtgcgcacgctgcttcaagcccggggacgaatgcctctcaaggagattgtggctcacttcagggccagggccacgggggacaacgccaaggccttcaccgccctcatgcggagggtaaggtggtggaacgagaggaggatcttggatttggggtcctctgtgttcaagcaggacgccacctctctctgacttgctcgcaagaagcaacgcatcggcgtgcgtgggtgctcgcattgacgcccctcgctctcacaggccctgtgttcactcctgcgcacaggtggtgagactggaccccacgccctcgccggatggccagaaatacctcatcctcgcttagtttctcatcaaagggtcccgtcctgggctgacgccgcgcgattttgttgtaaagtggaagcctgaccgtacttgcacccatgcgcttccatcacaaggtacaggggcgtgatggggtggatgcaaaggtgcttgggctagacaaggggtcgactgaacgcacaaggatgcccccaactcttttcatcgctgtcttcagtcgtcttcnnnnnnnnnngacaaggtacaggggcgtgatggggtcgatgcaaaggtgcttgggctagacagggggtcgactggacgcacaaggatgccccctcctcttttcatcgctgtcttcagtcgtcttcgtccatcacgagcctccgcgcgcctcgccgtgggctggcgacggcgccagggtccggcttgatggcaacaaggcgttgggcatcggctgcgccgccctccgcgaccgtgccgtcgccttccaccaggtccacctccatgggcgagctgggtgactcccccctggcaacccctccccattcctgtcctcgccggggcctccctcctccttcccctcccgcgccaggcaggcgggggacttccggtactccggcagcggctcctcgctgcaggcgggggtggggggggtccagggtgggaaggcaggacatggtgtcttggcggggtggcatacggcgccgacgcgaggcagcggggtgcagcgcgggatgcgcagcaggccctgtgccatgcagcctccgcgagcaacaagtgatcgagcgcgggacctcatccctcgctcgcctgaccctacgcacggaccccccccttccctgcctgaaatcccccccccttccctccccaacacacagacagaaacagccctcccccaatcccacctgagcagcgcccctagatccggcaccgccacgatgcgctggctcaggctgcccagcgacactgcctgccgcgcggcggggaagagcaggcacacctcctgcgcgtgcaggcacggcgtccccgccgccagctccagcgccacctctccgacgcgcaggcgcaccgcgccgctggcctgcagcttccccaccagcgtctgcggcaggtccgccagcgcagcagggcgggggtcgacggccacgccgccggggccgggcgcgccggagggcaccagcagggggaggacggggggcagctggagcagcaccagccgcccatcgttggcctcccggtcccgcagccagtccagctcgctggttgtggcgctgnnnnnnnnnnacagctccagcgccacctcgccgacgcgcaggcgcaccgcgccgctggccatcacctgcagcttccccaccagcgtctgcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggtcctgggtgcgtggagttgcgaggaagggaggggtggacgagacgagctggtggcagtctgcgagggcgggtgggggtgctgccactctggccgccggacgtaggcacacggggtgccgctcctcagccagctaggcaggaggtggaggtcaccgaccagaccctccccctgcgacatcctgcagccaattgtcgcagtctgacaaccacacacctcgcgcgtcatgaggtccnnnnnnnnnnggcaggcacacggggcgccgctcctcagccagcgaggcagggggtgaacgtcaccgaccaaaccctccccctgcgacatcctgcagccaagtgtcgcggtccggcaaccacacacctcgcgcgtcatgaggtcccgaggcacggccgatgcggggtcgctgccccgcagcgtggccggggcctggccctccccgtcaggcaggggcagggtggtcggatggtaccgggccagggtccacggatcctcccgctcctctcgctcctccaccgccaggtcagcctccaggaccgacagcgcggggccgccctttgcgccggggccgcccggctgcgcgcttcccggggcagaccccgggccgccggccctgctgggccccgcgccgctcccggcgtcgcgggagggggtgcccccccacaccccgtgccgcgcgctggtggccgccctggccgtggggcctgctgggggatggtggggttggttgctgtcggggtgcagggtagcgcggctgcgtacccaatcattagcagcagagcagtggcacagcagaggggcactggaaggtccagggccgtcgcggtcgtcctgtccttggccggccacacaggaacatagcacgctcagacccctaacgtgcggcgcacaccgcagcgcctgcaccnnnnnnnnnnggggggatggtggggtggggtactgtcggggtgcagggtagcgcagctgcgtacccaaacattagcagcagagcagtggcacagcagaggggcactgcaaggtccagggctgtcgcggccgtcctgttttgggccggccacacgggaacatagcacgctcggacccctcacgtgcggcgcacaccgcagcgcctgcacccccacccaccattgccgccgccggaaaaggtggtgacgctccccgctccacgcctgggggccgggccgggccctcgtccgagcatgcccctccccgctcggccccggccttcggcggcggcggcgcggatgagctcctcgaagacggagtcgggtttggcgctggggcctgcactcccccgcgacccaccatcgctgctggagcccgcctccttcttgaggcgagagaagttggtgggcaggaagcgcacctggctcggaggcggaggtggagagtgggaagagggcagggacttgcagggtgcagtcagtgtggcatgcatgatcaacagaatcagaggtgcacccgtaccttgcgtcctgaggtcgacacggtggccttctccttactcagacctgtagtatgaaggaatcacaaaccatgagcgcatgtcgttggcataatgtcgggcctcatgggtgcagggacccactggcgccttaccttccggccgacccaggccggagtgcagggagccaggacgctgtgctggtgccggactccccccatcttcttgctttactggacccgccattcactgggcacagtgcatggtcgtgcaggctgttaacttggggtcagtgagcggcgcccccgaaggcggtgtcacccaggacttctctgttgaggacaaatcttcgatcagcctcgagcttcgcttggccctcacaaagcacccaaatacatatgtgatggatgccctcgagtgccctgcgtcggcaattggcaaatgtcgggcatgccgttaaagtcgcgcgcgcgcgatgccccccagcctgaaggtctgagaggtatctttcagtacagctgaacaggttcaaaggggagtcagnnnnnnnnnntctcgatcagcctcgagcttcgcttagccctcacaaagcacccagatacatatgtgatggatgccctcgagcgccctgcgtcggcaattggcagatgtcgggcatgccgtcaaagtcgcgcgcgcgcgatgtcccccagcctgaaggtctgacaggtatctttcattacagctgaacaggttcaaaggggagtcaggtcaggggtgcaggcctgtgagggacgcacaagattcaggttgtgagggtacagagtttgaagggcctctgcgctggcctggggggggggcggggtcaacacctgccctcacccaggcagaggccccgggcgcagagccgcgccccgccggcagcgccgccgctgggcactagaaggcccgcgcctttgctgcctcgggcaggggcaccgccaggtccatgcccttgttgatctggtctatcatctgcttgatggcgttgtgcttctccagggtcaccggcggcccctccacgaacttgtacttgcccgcctcgaactcgggcatgggcgggatgcgcgtcagctccagcgcgtgctgcggctccgtgtagaagcgcttgtcgaagccccacgcgtccccgccgtccatggtcttgtagatggtgcagagggtgtagtggaaggcgtgcgcctcgcccagcccagcctggcccggcaggtgggcgatgaaggggctctgcccctcgctccgcagctccaccttgataccggtctccaccagggccagggagaaggcatacatttcacgcacccatcccaggcggtctcggacctccgtgtctgcctcaatggccgcggtcagtcgctcccagctgggcgtcacctgccgggggaggggggcagattgagatgtgaacagggatggtgggggctgggtggggggaatgtgattcggtgcagggcagggttgactctgtcctgttcgatcgtggggcatgcaagggaacatgagggcggcgagaagcagcaggcccatggctgggtaggtgccttctcgagatcaagatccactccgaacttaggctgatgaaggcattgccccagccagctgggcaggtggcctcaccttgatccagtcttgcaggctgagcacaatgggtgcgggtccagtggggggaatgctcttcacatccacacccggagagagtttctgcatctcattctgaggaagagggaggaaaatggggggggaggtagagtgcagaaaccatgctgggaaggacagctgtatggcccatggggacacgaatgttttgggatggtcttgcagggaggatcatcctgagaggccgagtgagagagacaaaacatgctaagcaggccgctgccgacttcctgcacctcaggaccattcccagagccaaagggcaagccccagagatgcctcaccgggacggcaattgggttgatgtaattgaagggaaacgcccagcctgcataaccctctggcggggtgctggggatgcccagcggcttcatgaagacatagtcggactcaatcatgtacagccactccccctgcaaagcatgggatcttggtttcggaaaaatgatcagcctttgcactttgagctggcaagggatggtggacgtgctnnnnnnnnnntggtttcggaaacatgagcagccttggcattttgagctggcaagggatggtggacgtgctatgtcatgccaagtcactggtaataggagtggtggaagatctgtcccaaccctatcccaggcccaggcagaaagtacaaaaaggcaaacagtctggcactcagacaagttttagacgtattttctctcctcattccggaagctcagagagctgggattatattgtcatcaccgtgccagggtgtatgtcagcagggtagggtgtgatacgtccaggcatagacccagagcacagagaatgtcactggcaggcacatggacatgcttcagaccatcccaccctgtgtgaatgtggtgagcggagcattcccctttctaagtgggcctccctccccttgaatctccacaagctggggtactggaagatgcccgcctatggcaaagtgccggcatcatggttttccataacaaagtctgtactcccaaccatttcccaaccatgtacccttccaggaccagataaactaatcgacccaccttgannnnnnnnnnccatcatggttttccataacaaaatctgtactcccaaccatttcccaaccgcgtacccttccgggaccagataaactaatcgacccaccttgatgcggtcgggggtggaggggagggagtcgaagaactgccgcatggcattccctctgtcagagacagggtagttgcaccagccgtcgcaggctggctgcagtggcgtggcatggaaggtgtcgatgatctccatcaggatgtcgggcttggtgcggtgcaggatgcgggtgatgcccacgtgacgctcgccgccaggcatgcccttgatgatctcgtaggtgcccagcaggatgcgtgtctggtagttctggtagggggagccgttggaggtcatgaggatgtggatggtgcccgcgggaggcttcgtgctggcgccggccacgggggcgctgccgtagtggtcggccccgcgggaggccagcatcgtgtgcaccgtgcctgggggccagggtggcgggatgcggtgaggcggaccggttcgagacttgatgctggggttctattcacaagcattgtccaggaggagctccatcggcacttacccatgaagatgaagcccgccaccgccccgatgccaatccccagcaccagccatacgagcaggtggacggcggaagttgaccgctgccctgcagcaaatcgtttccttgccatctaaatagctatgaaaagcaaggaagggtggaggggcacaggaatgaggctaggtgaggtatccgagtggtgcgcccagtcaggtcatattctcgcagatctatgctacattaatcagccagggcatctgccgttcgaacaccggtcaaggagacacggggccaatgcatcggcgaagtactatttttgcgctgctcttcttctcccccgagccggaggttccctcctttccattacctccaaaggggcaggtcttggggccccattgccttcctcatcttgtgacactttttgccctgcacggtccacaattttcatgagtcccaggtatcactttacaaagtacttggcagcgctggtcgatactgtgcgggcttaaacgatggagttggtgtcgaaagggttgtgcaagcatctgactggcgccatggtcgatacgacaccattggggcgcagactcggagctcattgtcgacctgtgggacccaaatagattcctcgtcgaatcggggctgattcacaatatatgaatctaatatgaattcccctcattagctgtcagcatggccacaatccctgtcgtttgaactcttcatgcggcgaccggcgatnnnnnnnnnnttgcattaatcagccagggcatctgccgctcaaacaccggtcagggagacacggcggcaatgcaccggcgaagtactatttttgcgctgcccttcttctcccccgagccggagatttcctcctttccattacttccaaaggggcaggtctggggccccattgccttcctcaccttgtggcacttattgccctgcacggtccacaatcttcatgagtctcaggtatcactttacaaagtacttggcagcnnnnnnnnnncacccaaatagattcctcgtcgaatcggtgctgattcacaatatatgaatctaatatcagttcccctcattagctgtcagcatggccacagtccctttggtttgaactcttcatgcggcgaccggcgatttcgacatgacgactgagcggccacgaccgtccttcctggatgaaaaacatgcacgaccctcattgtcggggtccatacgggatggagcgaagacaatgggtcgcccatcccagggcaagtcgagagaatgggcgtcatcgggaaggttggcattgtgtccacttcaattgatacaaagtgcatgctgaccccctgcaccgcaggcccaggcatggcaagcaggcgccgctcctcagtgtcgagccgcaagtcacaggcagacaagcaggctgcagacaagatcgcagaacgtgaggcgggcatggagcgacctcggcccctttggccacgacccgccgcacacattccctatggcgtccacccgctcaggcccccatcaacgagtttcaaccagcccaaaccaccaacggnnnnnnnnnncggccacgaccctccgcacacattccccatggcgtccacccgctcaggcccccatcagcgagtttcaaccagcccaaaccaccaacggtatggcgctgggggcggggtattgtccaggatgctggccaggcttaaagcagggtggtgagctcagaactgcatcacctcctgtgaaaacctttcgactgtgactatgcagctctggcaccctgctgaccagcgccacacccacgttcccagtgggcatgtgagtgaccagcgccacctcccctccaagtgcagcccgctcccgtgccgatctggccggcccagctctgcctccccggctgcctcacgctccaatgcttgcgtgaactcgtcgccagcggcagcccggcggccagtaaattatttcctctgggcccaactcgctccgaccacggcaaccaggccgaacccctggagctcctgtgtcagcagagccggggcgatgcgaaccccgcagccaccggtcccgccgccgccgacggccattccgagccctcagacgacgaggggcgctccacgctcgacgccacccccgagcccagcgcctgcttctccgaggcccagccgcggcgcggatccagcctcgcgggcgacggtgcgtccagcggcgacgaggcggggcccgcgcgccggtcctccgccctccagcgcggcaggcgccgcagcagcgggctcagcgcgcagtccctgggcgaggtggcggtaggggccgccagggacggcaaagcccgtcgccccagccacgccgcgtcggctnnnnnnnnnntggggggggccgccggggacggcaaggcccgtcgccccagccacgccgcgtcggctggggcggggcgggcgcaggccgctgggtgcgccctgcgccgggcgacggccggccgctcgagcctggtcgggccgcagggcgggagtttggggcagagttcagttcaggcgccggcgccgcccaggccccgcacgtgggaggaagtgcgcgccgcggcggagatcgcgcgccgaggcctcctctgggccaggctggcggccaccccggagctcggtgcgggcctgcgccgcctggagcggtgcctggcttcctccgccgggcgcggggaggctgaaggggcgcggagagaggacagcggtggcctcggcacggccggcctgggcccgctgtgccgctgggaggacgccatgccggggcaggccatgtgctcggcgtggcaccctgtgagagggcgaggggggggggatggccaagggctgttgagggccttggtgtgatgagtttcccccttggggtcctgggaccagcgagcatgcgtgagagctctgggagtgtcacctttctgccgtggacccaggaccgcactttgtcgaccgactgcattcctcctttcctcactccacttnnnnnnnnnnagggccttggtgtgataagtttcccccttggggtcctgggaccagcaagcatacgtgggagctctggaagtgtcacctttctgccatggacccaggaccgcactttgtcgactgactgcattcctcctttcctcactccacttcccgcccccaggaccgccccgccatcctggccgtgggcttccgggatgcgcggcggcaggacagccccgggcgggtggcggtgtactgcctgtcccgcccggggcgtgcgctgtggcaggcgggggtgccccacgggccctcagccgccgcctggctcccgggccgcggcgcgctggcggtggggtgtgccatgggcaccataaccctcttccgaccccgccagggcgggcgagacgcgggcagccccatctgcaccgtgccgtgagttttcttgtttctgttgcaggggggggggagaaagggggacccagtgtccactggtacgcatgtgcccgacccccacatgcgatctctggcgggcgctggtgggtggaagagcgcgccaggcaggccgggaggggatgctcaccccagcgtcccatcctcagagcgaccgtgccccgcccttcccgatccaccacagctacggcggcggccacggcgccccagtctgcgctctggttcccgccgcagaggccggcacttgcctgtcctcgtgcggaaaggagggcacggtgctgcactggaaaggcggcccagaggacggcctggaggtcggcgcgcggcaggagctcaaggcgccgtgggccgcctgggtcacgtgcgccgccgcccgctcccccgaccgcgcctgggccctggggagcatggagggccggctgctcgtcgccgcgacggaccagtctgcaccgagctgctccgccgctggtccccacccggccccgctcctgcaggtgcggcagggctggctcggggcgtgcccggtccacagcccctgcctccctcatgcaggctggaagcatgcctgggctgttgcgcagtggaatgggggcctgtgctttgccaagggaaggggccaggggcggtgccgcccaagggcacagacctcgaaaccccagcatctgcaccaattttgctgtgcagttggcctggcacccgcnnnnnnnnnnagcctgtgccttgccaagggcaggggccaggggcggtgccgcccaaggcacagacctcgaaacccccagcatctgcaccgattttgctgtgcagttggcctggcacccgcgccggcagcacgtgctgctgagcgccgatgcgaggggcacgctcgcgatctggagcgtcgagtccgcaaaggtgtgcctggtatggtcccgctctgggcctgttgaggcagccgcctgcgtcgcctggcacccactccaaggcacctgctttgctgcgggcggcgcggacggcaaggcttcggtgtgggacctggcgaggtccacccgcttccccctgtcgacctcgaccctgggctgccccgtcacgaccctggcgtggtctccagacgggcgggcgctcgtgtgcgggggcgaggctggcgcaatcacggcgcttgcctggtctgcccctgatctgacagagggcggcagccaggacggtgcagaggggaacgatgcggtgctgagggtgctcactgagtcacgacacgagtcatcaaggatgtgaggcctcaagtctgcgtgaaagtatcttgaaaaggacaatgccgctcctcgaatcctccctcatgcttcccctccgcctgacttccagagtccacgccagcccaccatctccnnnnnnnnnnaaaatcttccctcatgcttccccttcgcctgaattccagagtccacgccagcccaccatctccaaagaccacaccccgtggcagaacccacttgcatggctcctgctcaaagtgcgtgttcacagcaagtatccacgactgcgtgacagtcctttggcacccctccagacactcatggggcctcaggcccccacaaagttggcattccctgccatgatgatgccgatgatgaccccaaagaggcccagcgccgatgcaaagatctccaccaccaggatcttgacaaagagggtggcattggccgcgtcggacagggcagcgctgctgcccacgatgcccacgctcagcctggatggggcaggggaacaggtggcaaggtgggtgcggggcttggggagggcacgccctgcctctggccatgtcagtgggtccgcacgggtgctccgctgacgtctcagtcagtcgatctgtttcctgctcgccctgcttgggtacaggtggacggtgatgggagcagcaccccgccctgcaacccccnnnnnnnnnntttggggaaaacacgccctggctctggccatgtcagtgggtccacaggggcgctccgctgacgtcccagtcagtcgatctgtttccacctcgccctgcttgggcacaggtggacgataatgggagcagcaccccgccctgcaacccccagggatcctcaagccctcacccgcacgccaggttggcccatcccgtgacggagcccgcccccaggatggcgtagcccgcgtttgctgccgccagggagtacgacccatcatcacgcggcttcaccgcctcgaccttggtctgcaggatgatggccacaatgaccccatagatggccacggcctcacagaaaatgatgctgcatgggggtagaggggaggggtgcaagggttggggctgctatgacacggacgatggggccccctcccatggctctccccacacttgcctgatcagattcttggaggtgatgcggggcaccctttgtgccgctcccatgagactactgccagttatgaagatccccctgcgacgggcgtagggaagatgatccatcgagaccttgaactgcggcatgcaccccctccccgtgcgctcccgcgatcctacccgcgatcccggccccannnnnnnnnnctccatcgagaccttgaattgcggcatgcacccccttcccgtgcgctccccgcgatcctacccgcgatcccggccccagactcaccatgccgctcccacgaccgacagacccacacacagggcgatccccaggctcgaccagaagtagggcgagatgttctggaagaggaaaaacaggtatgtgacgtccacgaaccagatgaataccatgggagggccgtgtcaggagtgctacgcgcccctgaagaaccccgatatgtggggcctctacaccgatacgtcgcaagggttctggggtgaccgttgcaaggtgagagtgtcaaagctggaatttcgcagccccttgccaaccgagtagagtcttgaagcgcagagtgaggtgcagggttgaagggttggcagcggagcgcagcagtgcgagcatccccaattccccagaatcccagatcgtgactcgcctgcgatgcagtccgctgcgaggcccaaaccgtgctgattgcgtcgccacaaacgatattccatgtgtgttgtcgcgatggtcttgtgatcatggcccctgctgcgtagatcagaagggactttggggcactggcctccacggccccatgtacttcccctatgggttcccccaatgcctggatgcgggggaggtgccgccttctgaaggacttgtcgacactacattcaccgaccagcatctgttgctgacctacagctcccggatccaggcctggtcagcgggccgacacaggatcagggtcggcgaggtggtggtcagccccaccgacctcgaggacgagggggagcatgttgcagcagcatggtgccagagaaggcgtcgtctggctctggtggtgagctggggatggggctcggtagacgagggactgccagattcgggggtgggtgggattggggggggcctgaccagcacagcgtcttgcatgatcagggcaacagggcaaggaaagcgatccctacgcccacccttgcgataaattatacctttgtgttcgccactcccaacccataacccaccagacgagccnnnnnnnnnntagcgatccctacgcccaccctcgcgataaattatacctctttattcgctactcccaacccataacccaccagacgagccgggggtacctgcacatctatgccgtcagcagctccaaggaggttctttggcagacatccggcgaacccccggccaagctgaccaacatctacatccagaattcggtcttcctcagcagcgacgaagacccgcccgttggagtggtagtggatgtcaagtccatcctggtggtgcttgcctctggcaaactccaaaacaccgactggaatgggcgggtgaggcgcaggggttggagggcggggcggcatttgcatgcttgtaggaatgaaaatgcacggtgtgagtactgagagaatggtttagtgccaaaatttgatgcgcgagcatgagatcacagcccagaacgagcatctccagcctgaagcttcaaccgcttcctacccttcatactcccctccagactcgcggcagcgtggatctctttgaccccagcaggggcgtgtctgccaggaggagcgactccctccgggcgccgccgtcccgggccnnnnnnnnnnggtggatgtcaagtccatcctggtggttctcgcctctggcaaactccataacaccgactggaatgggcgggtgaggcgcaggggtggagggtggggcggcatttgtatgcttgtaggaatggagatggacagtgtgagtactgagagaatggtttagcgtcaaaatttgatgctcgagcaagagatcacagcccagaacgagcatctccagcccgaagcctcaaccgcttcccgcccttcctactccccaccaggctcgcggtagcgtggatctctttgaccccagcaggagcatgtctgccaggaggagtgactccctccgggcgccgccgtcccgggccagcagcagctgccagtccgtggctgcgttgctggagtcgacgccgccgcgtgcctcagacggccatgccgagctcgtggctggagcggcccagcccctggagtccggcagcgtgcacagcgtcgcccactccccaacctccggcctgctggcgctcgttcttcgggacgggcgggtggtgctggcgcgcagcgccgagtccaccctccacccggtggaaaaggtgggtgatggggtgtggcagtggagggggcccggcggtggagggcagggcggatccgtagtctatcggtgcatcaagctctcccagcatccctacatcagtctctgcccgcacgctgagcgccagcctgtgctgactttgcgtcaacctggctgcccaagcgccatccaccagtctgnnnnnnnnnnagtgtggcagtggagggggccggcggtggagggcaggcggatccgtagtctattggtgcatcaagctctcccagcaaccctacatcagtctctgcccgcacgctgggcgtcagcctgtgctggctttgcgtcaatctggctgcccaagcgccatccaccagtctgcattgcctcccccggcccatcccatgcccccaacaccccacagatctacatgctgggcccgggccacgtgcctggcaactctggccaggccgccacctgcgccgccttcgaccccgtgaacgccaccctggcggtgggctgcgccggcggccaggtggcgctgtacgcgctggccgagctgctcgaccccggcgtgggggtccccgccccagtgcgcacactgtcccaggacgagtggggcctggatcccaatgcgctgggcgccgcggcctgcctgcgctggtcgcccgacggccgggcgctggcagtgggacaggcccgggccgggctgtccgtgtggacggcctcgggctgtcgcgtgctgtgcacgctgcgccagcacgcaggcgtcgagccgggcatcctggaggtgggtctggtgtctgggtggtggggttttggggatctacggagggatcgccggaggcgagggggccttcgggctgtagatcctcggaggtgtcgcaccgtcgggcaagagggtgggccaggccatactcagtgcagcacgatcacctccctctcccttgctccccaccagggtcccgtgacagccttggcctgggcacggcacggcgcccggctgctggcggcggagggcgggtccccgcagctgctgcaggagctgcgctttgcgcgcaccctggcgggcgaccaccgcgcgatcctccgccggcgctggacgggggcgcaggcctcggggtcggagctcccgccctggctggacccgggcgaggaaggggccgggcatgctctgctggtgggtggggtaggggcggatgatgggcctgaagctgttactgggcgtgtgtatggtgcacacagagtcttttgtcgagggggtgggccctcgggcagcacagtctcaatgcnnnnnnnnnngggggggaaagatgggcctgaagctggtactgggcgtgtgtatggtgcacagagagtcttttgtcgagggcgtgggccctcgggcagcacagtctcaatgccctcggcctctggcctttcggctctcaagcttgctatgccacccagctcccgtgcgtaccccgccaggccgaggatcgggtcctgctggtggggccctgcgcggccgtcgggcgcggggcacggggctcggggccacgccccgagcttgctctggagcacctgcaggtgccggaggcctacctggaggccgcctaccctctggtgtgtgaaggtcctcctgtgtggggggggtgcattggcgtaggtaccaccgccctgcaggcgccatggggccccgggtgcgtgcgtgtgcagacctccgctcccggccacacgtccgccgagcaggcccgacccccaccgttcacctcgcgcaggtccgtgcggccgtggaccctgcgtcgggcgacgtcgccgtggcgggcggcgtgggattcgcgctgcactcccggtcgcaggcgcgctggcgcctgtttggcgacgccgcccaggagcgcagtttccaggtgggcggtcgatgggcgtggatgctcggtgcacggcgaatcctcgggaggggcttgggatgaggaatcgtgcgnnnnnnnnnngaccccgccgttcactccacgcaggtccgtgcggccgtggacccgtcgtcgggcgacgtcgccgtggcgggcggcgnnnnnnnnnncttccaggtgggcggtcgatgggcgtggacgctcggtgcacggccaccccccgggaggggcttgggatgaggaatcgtgcgtgtggtgtgagcgctgtacaccagctcgatgtgcacacccggggtccttgttcccttgtgtgagccgatcgcgggtcgggttcagggcaggtgttcgctccgggccccccccgggaggtcccaacccctgctgcgccaccaggcctggctgtttcggtggtcgcagtgtcccatgccaccttcctcgcaaacccgtgaacccacccacggccccgccaggcgctggcgctggtgtggctgggggacggcgtggtgggcgtggtggcggggcccccgccgggcagccccgattcacccccccgcctggagctgcatgccaaggcgcggctagatcgcggcgccctgctggccaccctggacctggaggaggcgccgctggccgccgacgcgctggggcgctacgtgctgctggggtcgggggcgctggacgtgcgcctggtgcgctacacgccggcggagcgcggcggcggggctgggcggctggaggtcgtgcggcacctgtccctgatgagtggcgggcgcccgctgcgggtgcgaaagggcctgggggtgtggggggtttgctcttgggagggcgtgctgactgaaggatgcatggctgaagggacggagggaggtgggatgacgggtgagaggagggctgtggcaggagggaggcaagtgggggctcaacaagcctgtgaaagcgggatccctccnnnnnnnnnncggggtttttgcttttgggagggcatgctgactgaagggtgcgtggcgtgggtcggagggaggtgggatggcgggtgagaggatggctgtggcaggagggaggctagtgggggtcaacaagcctgtgaaagcgggatccctcctgaggggagccagtgacccatgcccccccccgcataaaccctccgtcctctgctcgcatgcccgaccctggccgctccattcttccttccctgatccttccaggagctggccctggtggagccgggggagtcggcgacgacgtcagacgacgacgataacgatgatgatttcgtcgccggacaacccccaccggacgccgtcgccccggacgcagccggggacaagcccgccgccgccggcttgggcgccacgccg

SEQ ID NO: 41008 - DNA, 61 bp, Chlorella protothecoides
tgagtgggtgattgtctcagcgtggcaggggggtcgtgtgcatgcgtgcgcatgttggcat

SEQ ID NO: 41009 - DNA, 3733 bp, Chlorella protothecoides
  modified_base (467)..(476): a, c, t, g, unknown or other
  modified_base (646)..(655): a, c, t, g, unknown or other
  modified_base (1173)..(1182): a, c, t, g, unknown or other
  modified_base (1649)..(1658): a, c, t, g, unknown or other
  modified_base (2211)..(2220): a, c, t, g, unknown or other
  modified_base (2560)..(2569): a, c, t, g, unknown or other
  modified_base (3206)..(3215): a, c, t, g, unknown or other
cccccccccccccccacacacacacaaacatctgcgcaggtgcaccccatgcggcgcggcgcgactttcatgtcctcgttcctcttcaacatcgcgctcctgctgctggcctccaccgccgccgtccagttctgctccgaggcctttgcgctgtacgcggagaactcggacatcctcaacatctttggcgcgcagctgaccagcctgcagggcctgtcctggctgtacaacaactccatcttcatctatatcctgctgggcatgaccctgctcaccctcatctacctatgcgtgcgtggaccggaccgctggaagcgcgagaagccggagggcgtgtacgagatgtgaaccacagggcgccggagggtggagctgcggcgtgcaggcgtggattcagggcgggcgagcgcatggagcgccgagggcgggcgagagagctggtgtgcaggacacagcggccatggtcnnnnnnnnnncgcggcgtgcaggcctggatttcagggcgggcgagcgcgtggagcgccgagggcgggcgagagggctggtgtgcaggacacagcggccatggtcgagcaggcgcggcgcgcccgagggcgcggctgcagtgattcgtgagggaggcgacaccaaagagcccaagcctgtnnnnnnnnnnttagggcggctgcagtgattcgtgtgggaggcgacaccaaagagcccaagcctgtgcaccaccacatgcatcgtctccctctcgtaaacccctctgacaaactctgcttgccgatgcatgtatgtgcgcagcgggtcaagaactcaggctgccacctttgagcgcccgaggggcgggcggccggatcaggacgccagccgccgctccggccagcggcgtggcaggcaatccgtcgggagccactccttggccggcgccgccgccgcgctccagcttctgcgactggacgctcaggccgttcaccacgcagaagcaggaggtgcgggggtgcagcatcaccgtgcggcgggggccgttctgcaccgcattccaggcgtagtcgtagcggcagagcagctgcgactccttgaggatggctgccgcatcggtccgctgcatggagggggggaggtggaggacaggagggtaggggggggttctgggtggagatgtccttctgaacagcgcagcaggagccnnnnnnnnnnggactccttgaggatggctgccgcgtcggtccgctgcatgaatggggggagacggaggacaggagggtagggtgggtttctgggtggggatgtccttctgaacagcgcagcaggagccgccactctcaagctgtcactgccccacagcagatgggcaaagcagcaccgcctggcatctccccaccacccctccaacttgccagatacttgaatcgggtcaggatggtgtagccctgctgcagggcaaagtgcatgaggggcgccaggtgcgaggcaccggcagcgtgggtggcctggcgccggcgcatgttgcccgtcttgccgacgtacaccttcaccctggtcgtcggtgggcggcagggagggagtgattgcaggcatgagcgctcgtaccgcgggggcgtattccgaggaggggcctcatccttagaagaggggggtttcctgcacacgagcaccctcaaatnnnnnnnnnntcggcagggagggaggggttacaggcatgagcgctcgtaccgcaggggcgctttccaaggaggggcctcatccttagaagagaggggtttcctgcacacgagcaccctcaaatcatcggctaagggcccacttcctcctcacctcttctcagcaaagcgggggtggcacagggcaaactcgtagatgccgggctgtgcctggcagttgggacccacactccgcccctccgtcccactgccgtccgatgcaggggccggcgtcaggaagttgtaccatttacagccgcgccagagcctcctgtaccatgacaggaagctggtgtgagccagctcccgctctggtcggcctgccagcgccatggcggttcaggggcggttgcgggtcggcaccgtcgtcaatcgcatgcgcgcttaggaggagggggcgtagggatgggtacgatccgaacgattgcatatgatataaacttggtcttctattgagtgtgattctcgcatggtgtcccgaggtatcacccccgcgcgtggagaccgtcaccgagtgaatccgggnnnnnnnnnnggtagggatgggtacgatccgaacgattgcacatgatataaatttggtttactattgagtgtgattctcgcgtggagtcccgaggtatcaccccggtgcgtggagaccgtcaccgagtgaatccgggggtaccgtgagatctgctcaccccccgctggagactgcgccctgtcaccgagggacaggggcatacgatgtacaaaatgagagtgggtcacgctgtttgtgcattgctgcaagtaaggaaggaagacagagggacatggcaccacacgtggtccacgccagccagagacagctgcgggacgtcagccagcaggcgcagaggagcacccctctnnnnnnnnnncgccggcaacagctgcgtgacgccagccagcaggcgcagaggagcacccctctgggcctcatcgctggcaacgacagtcgccaccggtcatccatcaatccgtctcgggcctcgagaactcggccgcgtactggtcgacagcctcctccacgtccggcagctcggccagcatgccggccagcccccccttcttcttcttcgccgcctcgccaccgtcccgcgcctcgctcgccttggcggcgtcgcccagcaggtccagcacccgccccgcatccatgccctccagcgaggcgttgtcggcgttgaccaccgcccccgccacgtccagcttgaagcgttggagggacatgatttcctcctccagcgtccccgccaggatcaggcggtacacgttgaccgagcggcgctgccccaggcggtgcgcgcggtccatcgcctggtgcatgcgtgcgggtcggggagacggggatgaatctttctcgtgtctgtgtgagacagatgccggggaggggggagacgcaaggaggtcgggtgtcacagaggtgccctcctcagcaccacctccctgccacccctcggcccacctcccgttcaacacccccccctcgtctcaacccgcctgcatgtccttcatggnnnnnnnnnnggggtgggggagacgggatgagtctttctcgtgtctgtgtgagacagatgcctgggagggggcgacgcaaggaggtcgggtgtcacagaggtgcccccatcagcaccacctccctgcaccccctcgacccacctcccgttcaacaccccccccgtctcaacccgcctgcatgtccttcatggggttccagtcgtgctccaggaacaccacggtgtctgcggcggtcaggttcaggcccagcccccccacccccgtggtcagcagcatgacgcccagggtggggtcggcgttgaagcgctgcgcgcgcgcaaagcgctcggcagggtccacgccgccgtcgatgcgcgcgcaggcgatgcccgcgggcgccagcacgcacgcctccaccaggtccagcgaggcgcggagctgcgcgaagatcagcacccggtgccccgcgtcctccggcgtcgccgacgccgcgccgtcgccgtcctcggcgctgggcgcgcccaggcccgcgccgcgcagcagctccg

SEQ ID NO: 41010 - DNA, 61 bp, Chlorella protothecoides
tagtcttcgtcgctcatgacatacttctcccccttggatgtgtcctccagccagccattgc

SEQ ID NO: 41011 - DNA, 79 bp, Chlorella protothecoides
tggtacatgatctccttggcctacgggttgcgtgggtgggcaggggtgaggaggggccacatggtgtaggcatggcaag

SEQ ID NO: 41012 - DNA, 80 bp, Chlorella protothecoides
tggcgcggtgggcctcccaaggcgtgcgcagtgcaaagggggccagcacaaggaaggagaagctcatgtgcgcggtggtg

SEQ ID NO: 41013 - DNA, 67 bp, Chlorella protothecoides
tgatcttcatgaagctgtggcagggaggggggaagggtcagcaatgcgatggcagcacgggtccatg

SEQ ID NO: 41014 - DNA, 160 bp, Chlorella protothecoides
gtggggtggtggtggtccacctctttcgtgcaccatccaccgctggacagccggacagccaagcacctgagcaggtccacatgagaaaaccaaggtccgcctcgttcccacttgcacccaccgcgctgtgagagggagcctggctgccctcctccgcccc

SEQ ID NO: 41015 - DNA, 61 bp, Chlorella protothecoides
cttgattgattcgtgcaaggcttcagtggggcatgactgcgcgttggaggtacattctttg

SEQ ID NO: 41016 - DNA, 61 bp, Chlorella protothecoides
gtccttgagcacgcgctgggcctgctccgccgtcacctctgccctgctccggctggccttg

SEQ ID NO: 41017 - DNA, 119 bp, Chlorella protothecoides
ggccgtggaggccggcggcagccatgcagcgacggggcggggcgcgggcgccggcccgggcaagccaaagccagggggacgcacggcagcggcgctgagcatccaggagaggcggccgg

SEQ ID NO: 41018 - DNA, 82 bp, Chlorella protothecoides
agcgctgggcccggctcgcagggtgtgtagtgggggtattgagggggagggcgtgtggtgtggctgcaggtggcagcagcga

SEQ ID NO: 41019 - DNA, 61 bp, Chlorella protothecoides
gcatcctcatggggctgtcgtgcatgtgtaccctctacacgattctctttgggactcggct

SEQ ID NO: 41020 - DNA, 119 bp, Chlorella protothecoides
cgcccccccccccccgccctcgcagactgcctccagctcgtcttgcccacccctcccttcctcgcaactccatgcacccaggaccccgtcagcgccacaaccagcgagctggactggct

SEQ ID NO: 41021 - DNA, 117 bp, Chlorella protothecoides
accgggcagccgacgcactgggcccagaccatcctggtgctcaggtgccatgggaaggaagacatggagagaacatgagggaggggcatgtcgctgcccactccccaggctggacaa

SEQ ID NO: 41022 - DNA, 82 bp, Chlorella protothecoides
ttcggacccctcctctggagcacccctctacccctcccccccccccaaaaggcaccaacccctcgcaccttctcgaacacct

SEQ ID NO: 41023 - DNA, 76 bp, Chlorella protothecoides
ggcgccacgcgctgcccccccgacggcgctgccccctgcggtccagatgccaccgacccgtgcgcccccgacagca

SEQ ID NO: 41024 - DNA, 62 bp, Chlorella protothecoides
accaggttcttcacaatcctgggcatgataatagaggagcaaggattttggagggaggagag

SEQ ID NO: 41025 - DNA, 61 bp, Chlorella protothecoides
cacctgtatctgttcgtggacctggcgcagagcgttgaaccccccgggcatgctctccagg

SEQ ID NO: 41026 - DNA, 78 bp, Chlorella protothecoides
ttgcgggcgccagctcctttggcatgagcgggaccaacgcgcacgctctggtgagccgcgcgggcgaggaaggggact

SEQ ID NO: 41027 - DNA, 61 bp, Chlorella protothecoides
ctggctgtgcgggagctggcggcacgcgccaccctgtcactgctccccgcccacggcaggg

SEQ ID NO: 41028 - DNA, 84 bp, Chlorella protothecoides
cgctccccacagtcgagtgagtggggcagatgagagggttgcagcttactggtgagcccgccatgaccctgcgatccagacatg

SEQ ID NO: 41029 - DNA, 61 bp, Chlorella protothecoides
accactgcaatcgatggtgcctggcggagggggcgatgttgcgagcagagtccccgcttcc

SEQ ID NO: 41030 - DNA, 68 bp, Chlorella protothecoides
cagccccagcccctcccccagcccaagcccatccccgtcgtctgtggtcctgtcccagaaatctgcag

SEQ ID NO: 41031 - DNA, 86 bp, Chlorella protothecoides
acaacacccttgtgttcaagcctcacattgggtcccctcccacacacccactcccaccacccaggggactgccgacggcttcaagg

SEQ ID NO: 41032 - DNA, 61 bp, Chlorella protothecoides
ggagatcgcccagctggcgggcgaaggagggttcatcgcgggtgtagcttccgtcatgttc

SEQ ID NO: 41033 - DNA, 61 bp, Chlorella protothecoides
agcactgttaggggactcggcggggctggggtgttcctcttctccttttccaggggcgctg

SEQ ID NO: 41034 - DNA, 66 bp, Chlorella protothecoides
acccccccgcaccgtggacagtggcatccatcatgcggaaatccaggcacccgaggctgtgcccgt

SEQ ID NO: 41035 - DNA, 67 bp, Chlorella protothecoides
agaaaagacagtcagagccaccacccgacccgctcagggtgcccaggccgggcgatggccggcggca

SEQ ID NO: 41036 - DNA, 61 bp, Chlorella protothecoides
taaggacctcccacatcctcccaccccccctcaccagacgtcggcatccgcgtcaaattcc

SEQ ID NO: 41037 - DNA, 120 bp, Chlorella protothecoides
aatttctgggaggtgcgctgacgcgggagggggagctcctctcagaccggcatgtctgggctgaggagatcgcttgaggtgctgctggcttgtcgttcatcctggtgcagcaccggcgga

SEQ ID NO: 41038 - DNA, 70 bp, Chlorella protothecoides
ggcgcagactgtaaaagtcctcctgcaacaacaatcacaggtcctctcgaggtgattgacacaggcagta

SEQ ID NO: 41039 - DNA, 112 bp, Chlorella protothecoides
cattgccggcagccagcgagcgccaggtgcgtgtcatggcacgtggccctctccatggagtgccagctggtttgatggggcggcagtgcagaatgtcctggccatcctgcgg

SEQ ID NO: 41040 - DNA, 71 bp, Chlorella protothecoides
tcagggccacgcagtcgccgggctgcggggcggggggggtgtgacagggcgtgaggaatccaagtgctctg

SEQ ID NO: 41041 - DNA, 3793 bp, Chlorella protothecoides
  modified_base (134)..(239): a, c, t, g, unknown or other
  modified_base (543)..(552): a, c, t, g, unknown or other
  modified_base (704)..(713): a, c, t, g, unknown or other
  modified_base (962)..(971): a, c, t, g, unknown or other
  modified_base (1127)..(1136): a, c, t, g, unknown or other
  modified_base (1386)..(1395): a, c, t, g, unknown or other
  modified_base (1862)..(1871): a, c, t, g, unknown or other
  modified_base (2162)..(2171): a, c, t, g, unknown or other
gggggggaaggaaaggggagagggggagggaagggccagccggaggttccagtatgtcatcacaaggtttcctttcagggaaaagatgagcatctggctggcgtggcacggcggctgcacatctcgatgtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaatgttccggccctgtatcccttacttcttcattggtaacgaacccctctccatttacccaccctccttcccaaaacaattcagctccgacggggagctggtgctgcaggtggtgcaggcgcacctgctgcgcttgctgcgcagcgccaccagcctgcaggccctggacgcctgcagcttcggcctgcaggagatcctgcgtgggtgcgggcacctcgtggcggggccggatgggtccgcctcgcaggagcgcggcggcgacggggccgaggccggcggcgaggagcgcgctgcgccgcgnnnnnnnnnncgggtaaatggagaggggatccttaccaatgaagaagtaggggatccagggccggaacattgcagtggcgcgtcaagcctggcaccaatacacagtttcggtcgagtgcctgcaaagagcgcgcacatcgagatgtgcagccgccgtgccannnnnnnnnngctcccggcgcggcaggcccaggcgggcggggtccacggcgcccaccaggcccagacaggaggaaagcgcggcgcgcgcgggcgggtccagcacgccaaaggcctgctgctcgcagtgccgcagcagggcctgcatcagccgcgtgacgggggacgcctttgtgtgggcggcgcctggcggggcgcccggcgaggcgcctggcggggcgcccgccccatccccggcctcggcgcccttcgccggccggnnnnnnnnnnggccagccagatgctcatctggtccctgaaagaagaccttgtgatgacatactgaaacctccggctggcccttcccaccccctctcccctatcctccccctcccccccaaaaaatacaataggaaaaaagggaccctaccgagccatggagggcgnnnnnnnnnnttggttcggggaaagggggcacgactgcattgtcccaggctaatcgggaaaagggtgtgtgcagggcatcagcgcgagccacttgcccccctgagcgcttagacatctgatgtacagacgccctgaagcagcagggtcctcccactccccgggaaaggtatctacctagtcgccacccagccgtctctcacacccagacgcaccccctcatccagacggtcgtactgccgtaccttgactccaagtacannnnnnnnnncaaagtatctaactagtcgccacccagacgtctctcacacccagatgcaccccctcatccagacgatcgtactgccgtaccttgactccaagtacagcgtgcgcagcgcgatccggcgcccccccggccccgtcttcgccggcggggaggccagcggcgcgcgcctgacgcaccgccgctggctggcgctgtggatgacgacgctggcggagcaccatgcgcgcggcccgctgcagccgctcttcgcggccgtgctgccgccgctgcgccacgacctcaccctctccctcttcctcctgccctacctcgtgcactccgccgtaaccgacggcggcgaggccagccaggccgccgtccagcaggtggagtttcggtgtgggtttatgggtgggcaggcagcttcgcagccccccctggaaacacacccccaaacccatgcacctgcaggagctggcggcggtcatcgnnnnnnnnnnatttcggtgtgggtttgtgggtgggcaggcagcttcgccgcccccccttgaaacacacccccaaacccctgcacctgcaggagctggcggcggtcatcgcgggggggccggggtcggcggagggcgtgatgtgcctgcagaccgtgtttggcctgctggacacgctgcagcgctgggtggaggacgcgcgcgtgtctcgtgcgcgcggcgaccccgccggcgggggccaggccggcaccgacggcgagcgctgggcggcactggcgcgggtgctggaggccgtgcccctcnnnnnnnnnnatctcgtgcgcgtggcgaccccgccggcgggggccagggcggcaccgatggcgagcgctgggcggcgctggcgcgggtgctggaggccgtgcccctcgacgctttagcgcaggcgagcttgatggttttctcaaagaaaagggagaaggaggggtggcgaggggttggccggggtccagggctgcggggaagagagcgttgatcgggggcatgcgtttgaaatgaaggtgtttcgttgcatgccaactgtgtgcccagtcacacgcctccacccacccaaccccatccccaccaagcacgcaggcggcgttcagctcgggcgcgcacgctcgcgcgctgcagtacatggagctgcaccttcggtccagggtgggcggcggcctgaacccctgcgcgcgcaccagccacacctacggcgaggcgcaggtggccttcctcaaggaggtgtacgggcgattggaagagccggacggcatggagggcctgctcaagctgtgcggggccggggcggcaacctcctctgggccgctggcggccgcgctgcagacggggaactggcccgacgccgcggtactcgaagagctggaggaaagcgcgggcgatggtggtcagggagagggggttgccgacagacgcaatgccggtggtcctccccccccacgcccggcctcgctgccgccctgcacggccgacaggctggaggggctgctgcgcggcggccgcgcgcgcgccctgctcgtccaggtggagggcctggcgggggccacggccgagcccgcgctgccggctctggcggcgctgggcgcggcggctgcctggcggttgggcgaatggcagctgtcgcgcaacctggcacgcgtcgctggggagcagcaggaccccgggcgtgcgtgggaggttggcgtggcccgcctcctcaccgtcgcggcgggcgggggtggtgcgggaggaggtggccgaccgagcgcacgagcccattgcaacgccgccttcgcggccgagctggcgcgcgtcagggaggaaagcatggcggcgttcctgggcgccgcgtgcgagtcgtacgcgcgcgcctacccctgcctggccaacctggccgcgctgcaggagctggaggacctggcgggtgggtcgagggttcgaggcttcagggaaggggggcgggggaaagggcgtgcatgcccgacaggaatgtgcgcattcctccaatagccccggtggccaaagggggtgtggcgccggggttctcgatggcatctcgacggcactggtgcgcgcccccttccactattcctcctcgcaatgcacccaagcctgttcccaccgagcacacaagcaaacacaccatcccgctcacaccccggcaatgacccaccgtgcacagcctggctgccggcgtgccgcacggcgggcaccccccccctccccgtggacctccccaacaacctggccctgggctggacggcgcgcctcgcggccagccagcccacgctgacggtgcgcgagcgcctgctgtccctgcgccgcgccgccgcaggcctggccggcgacggctgcgcggccgcgcggtgctggctcgcgctgggcacgctgtgccgcaccaacggcgagcacgccgcggcggc

SEQ ID NO: 41042 - DNA, 61 bp, Chlorella protothecoides
gccctgggtcgtatggcttccttgacggggtcggaaggctttgggccgcctgcagccacca

SEQ ID NO: 41043 - DNA, 118 bp, Chlorella protothecoides
gggatgcaaggcttcaccgcggcatgcttgctcgacgggtgcccgggcggcagcagagggcacgccgtgaccctcaacactgctgcttgacgcaacaggctgacgcaggggagggtcg

SEQ ID NO: 41044 - DNA, 89 bp, Chlorella protothecoides
gcgttcttgatgtcgccctgtcaccaagtgtatggccccatccagaaacccacacttgggatggaggaggctggatgtccagcccggca

SEQ ID NO: 41045 - DNA, 61 bp, Chlorella protothecoides
ggttccaagctgcccacgctgtgcctggccaacggcgaggaccctgcctcgggcgaggccg

SEQ ID NO: 41046 - DNA, 65 bp, Chlorella protothecoides
ctcctccacccaccaagccctctccccctccgccaaccaagccctctcctccacctccatcgaag

SEQ ID NO: 41047 - DNA, 61 bp, Chlorella protothecoides
gtagatggccagcgcctcgcccgcctcgccatgctgcgcggccacgcggatgagcgtggtg

SEQ ID NO: 41048 - DNA, 90 bp, Chlorella protothecoides
ggggcgggcgtgctttgtgggatgggtgctcgggctcttgtgcgtcgccggcattgggccaggagcaggcagggggcagcggacatgcca

SEQ ID NO: 41049 - DNA, 5334 bp, Chlorella protothecoides
  modified_base (571)..(580): a, c, t, g, unknown or other
  modified_base (1022)..(1031): a, c, t, g, unknown or other
  modified_base (2262)..(2271): a, c, t, g, unknown or other
  modified_base (2505)..(2514): a, c, t, g, unknown or other
  modified_base (4359)..(4368): a, c, t, g, unknown or other
  modified_base (5010)..(5019): a, c, t, g, unknown or other
  modified_base (5244)..(5253): a, c, t, g, unknown or other
cgccgccgccgccgccgcgcgccagcgccgcgcgcatcagccccagcgtcgcaccgcgcacgctgtcgtaggcagccaggaagccctggtgcacccagggccggtcctcggccccggcctcctcggccaccgcctcggcctccgacacggcctgccagaggcggtccagcaggacccgggcctcgccggcgctgcccttgaccgcctccagcgcggcggtcaccacgctggatgccccggggtccgcggccttggcacctccgtcgccctcgtcaccgccccgcgcttcgtcacctgcccccgagtcggtgatggcgtccagctcggcacgcacgcgctgcagcctgctcatcacgccgtcgtagatggtggcctgcttcgtggagtcggccagccctgggagggggggcagggccaggaggtgcggggggtgtgtgtgtgtggagactcgtgatgccgcagggaggggtcctggaaccgccgcgcatgtatgcctcgaccgcacaccacccttccacagcggcctgagcggccagccaccaaagtaccaccccacgccctaccgcgatgnnnnnnnnnngagaggtcctggaaccgccgcgcatgtacgccttgaccgcaaaccatccttccacagcggcctgagcgctcagccaacaaagtaccaccccacgccctaccgcgatgcagcggcagcgtcggcacggccgcggggtccagcagggccggggcgagggagatgtcggtgaggtagtcccgccagttgtcctgctcggtgcccctgaaggcgatgcacagctggcgcttgcccaggttccagtacagccaggcctgcagcggcggcaggagtggacgctggacgggcctggccggtgtgcttgttttgaggcaggcggcaccggacacccacaccccgccgttccctcgagccgccacgactgcagtcgtgatccaaatccccccaccccagccaccacacacagcgcccccgacctgggtgtctgtgcgggggtgggtgatgnnnnnnnnnnagcggcaggagtggatgctggacaggcttggccggtgtacttgttttgatgcaggcgacgccggacacccacaccctgccgttccctcaagccgccacgactgcattgatccaaatccccccaccccagcccccacacacagcgcccccaacctgggtgtctgtgcgggggtgggtgatgaagcagagcggggtgaaggtctctcccagctggatggcagcggcctcctgcagctcgcgccaggggttgctctcaaactcctccccgggggcccccagcagactgctgcgcggctgggcgaggtcctgctccagcgcgtctgcaggagtcgatgcgcaccgtgatgcctcatgccacacagtacgcatcgcaggctctgccctgggggtcacctggtattcacccaggtttttgaatggcacctgcaggcacgacagcttccccacaaccccagccgcaccttccatggccacatactgaaggctgagggtgaccacacggggctgctctgcctccgccttcccttcctcggcctcagagctggggagcgcagccgccgatgactcatccccagcagcctccttcgcgtcgggcttcagggtgatcgccacctcgcgccagcccccccgtcctcccaggccctgctggaggtccagctccccgctccccagcgcctccaggggccgccccagccggctcctccacagcttcacgcgcagccggcgcgccttggcgcggtcctggatgaagagcagcttgggggcgggagggggcgatggcttctcctccttgggaccgggcagcaaggccttcacccccttcccgccgtttgctggcttctccaaggcgcgcgtctccaccttgctgcccccgagctcgacggtgcagtagacccggttgctcacgtcccacaactggcggagcagggcatgtgaggatgttttctcggcactgggcgccaagcaatgggtgaaacctgggtctaagcatcaccatcgatatcgcaggctgtcgccgggaatgcatcctcatctccacacctcttcgctgggcagcccagtcgccctcaggagctccacatgtagcaggccatccatgcattgcctcaggaacgtcctacaatagtccagtcgcagggtgcgcacgatgtgaatccggtgagtgtcgcgttgccatgtgggagtgccagtgcacacctcagcaaaagtgcagtcacgcatggaccctcagnnnnnnnnnnctgcctcaggaacgtcctacaatagtcgagtcgcagggtgcgcgcgatgtgaatccggtgagtgtcgcgtcgccatgtgggagtgccagtgcatacctcggcaaaagtgcagtcacgcatggaccctcagtggcatggcactgccaaccgcctggcccacaaacgcactcgtcgacgtaggtgatgcacgcgtcgttggtattgatgtgcacggcgttggtcttgtgcgccagnnnnnnnnnnaacacgcactcgtcgacgtgggtgatgcacgcgtcgctggtatcgatgtgcacggcgttggtcttgtgcgccagctcaaagtaagcctcaaaggacgctcctgccaatacgacggactgtcgccagtcaaagtcattcccggcggctgcaggggcgctctggaagtcccttttcccaaagtctcgagacaggtcctgacatgcacgctgaccagcgtgcaaagcacgcagcggtcggagcatctcagtctggcggacgcgcatgccggcctctgccctgaacctgcatgaaagtccgccccaaggaggagagagacggcgctgagcaattgctataccgcgacgatcaatgtgcatgcaatcttgcagcccggctctagtcctctcaccctcgctgcatgcagcggaggcatcgcaaggtgccccctccctcccagcctcgcggtaggagtttccagtaactcagtgcatgtgtcgccaaactcctcatgtgcgcatgcgggctggtgacgaggttattaacatacttcatcaagtaaagtgcatatgatgagctcagatgaccccgcgtatcgattacagtgtcttattctggtggttgcatcgatgggctgtcctggaggggccggcgccggtgacctgtcatttgttcaaccaaaaggagacccaaggggaccacattgggcaacccattgatggacaacagttcaagaaacctttctttagagaggatttttagaatcaataaaagctacaatttaaaaagctgggggctctccagagctataccaagaccaccaagtgcaccgcctcagggctccacattgttgaagcttgacctcacaaggacccaatgatggagtagctgatgacccagctcaactgcggggttggcatttgaaggcttgataattgttgggagatattgcggtcccatgtatattgaaacccaaccgttaccctcacaggacacactagcaaaatacctttcactcaccacgaagagagtgaggctctgcgcaaaaccttcaaaccacacgggaccatttgcgctgtcagagccatctggggctgcaaagtcctcgctctcaatcctgagacacagagggggcggatggacactgtagatgcacgtgcgttgcagaaacatgcacacacttcccaatgacagacccagctcacaccacccaaacatctgcacaaataccaatgagcacttcctgcgccagctcacccttgatactgcatccaaaggcgcatagatgtgtaattgaagcccacgaatctgacggagaagggtaaggaagtttgtgtcatggaaaactttgcctaagcatgcaagcgcaaccgtccctattctgctccgttctttctcaccctaagaaaatgtagaggccttcaaggcctaggcaccccactgtgatccccgctataagggctgagaggcatcgcaggtagagcatcacgtccagcacgtcatcctgtacaagagggaaacagcggggcgacgtagagggcagcgtcatcctgggacacacaggctcgagagacttggtatactatgtgagaggcgtaataggctctcgctgtggactatctcaggctaccttcttccagtcgtggccggtggtcgcggcctgacgcaagagggcgagtacccggaccattgcggcagcagcggcccaacaacaaatcgatgaggttatttgagatatgtgcaatggcaacacacagatagattttgttcaggaatttttgatcgagatgtctgtgccccctgtgattatactctgatttgtccgaagtcacggttgtgccgtgcgacttgcatgtggcatgctttggnnnnnnnnnntacacacagatagattttgttcagaaattttttatcgagatgtctgtgccctgtgattagactctgatttgtccgaagtcacggctgcgccgtgcgacttgcatgtggcatgctttggtttgaaaggtggcaagacagacattgcacttccacataaatcagcggtccttcgacacaaatcatatcgacaacggcgcgacacacacgatgccacaaccccagcgtctttgagcgaggagtggtatggcgtgatcagagcccaccctcccgcactctgccctgctccagcgaggagatcctcgccctgcacgccaatggtgcgccgtgtgggcctcggactgaatcttacggggcccttccattcccgtatcgtggcattcataccctctgcgttccgtgcagggcatctcgggcctgctgccgcagctgcggagcatcaccaagcgggtgcacatccgcgagcatgccggggccagggccgcggttgacgcctacagcctgctgcacaaaggtagctatggctgtgccgaagagatggtggaggacaagcccacgaatcggtgagaatgggggggcagcttcacaagaggttggccggcgtgtgtcacctggcgctcgcattctgctgtctgcacgatgtcnnnnnnnnnnaggggggcagttcgacaagaggttggctggcgtgtgtcacctcgcgctcgcattctgctgtctgcacgatgtcaacacctcatccgggggcccttccttgcatgccaagcgatcccgcacgcaagaccctggccttgcgtgccgtgagcccaccgccgcccccaggccatgcatccccaaataccctcctcccctccgcccccctcccattcccccccccccccnnnnnnnnnnaagggcccttccttgtgtgccaagcgatcccgtacgcaaggccctggccttgcgtgccgagagcccaccgccgctcccagg

SEQ ID NO: 41050 - DNA, 100 bp, Chlorella protothecoides
aaccaggtgggtcggtggttgggggtctggggggagggtctgggggagggggccttggtggacctggcgacgcacagtgcagggaggagcgtgggggagg

SEQ ID NO: 41051 - DNA, 61 bp, Chlorella protothecoides
cgctgtctggggtgacggccgagtctctttaccgagggagtgccttcgtgtcatgcagtct

SEQ ID NO: 41052 - DNA, 143 bp, Chlorella protothecoides
ctggacgctttggctggtgaaggacggaccgtgcccgtcctgcgcaccgcgcccgtgcgaagtttgaccggcgcctatgacgccgggcgcggctctggaaatcttggcggcggcacggcctccgcctctctccgcgacgcgcc

SEQ ID NO: 41053 - DNA, 80 bp, Chlorella protothecoides
tccacatcggtggcgttggacgtctgggctgcgttcaccagggcgcggcgcagcagcttcctggtggcagcggtggggat

SEQ ID NO: 41054 - DNA, 61 bp, Chlorella protothecoides
gcgccatactcactcatctactccttcctgaacgaagtcggccttcacgttggccacgaca

SEQ ID NO: 41055 - DNA, 61 bp, Chlorella protothecoides
ccatgtctgagacacgcccctcggtggtctcgcgcgcaggtagacgccgcagtgccccatc

SEQ ID NO: 41056 - DNA, 90 bp, Chlorella protothecoides
cccttacactgtgaagatggctgggtctcttatacccctgtgagtccacaggagatggatttgcccgaggtgccagaaggtgtctccacc

SEQ ID NO: 41057 - DNA, 34660 bp, Chlorella protothecoides
  modified_base (475)..(484): a, c, t, g, unknown or other
  modified_base (1432)..(1487): a, c, t, g, unknown or other
  modified_base (1702)..(1711): a, c, t, g, unknown or other
  modified_base (1830)..(1839): a, c, t, g, unknown or other
  modified_base (1957)..(1966): a, c, t, g, unknown or other
  modified_base (2085)..(2094): a, c, t, g, unknown or other
  modified_base (2159)..(2168): a, c, t, g, unknown or other
  modified_base (2969)..(2978): a, c, t, g, unknown or other
  modified_base (3656)..(3665): a, c, t, g, unknown or other
  modified_base (4352)..(4361): a, c, t, g, unknown or other
  modified_base (4694)..(4703): a, c, t, g, unknown or other
  modified_base (5520)..(5529): a, c, t, g, unknown or other
  modified_base (5732)..(5741): a, c, t, g, unknown or other
  modified_base (6131)..(6140): a, c, t, g, unknown or other
  modified_base (6620)..(6629): a, c, t, g, unknown or other
  modified_base (6737)..(6746): a, c, t, g, unknown or other
  modified_base (6849)..(6858): a, c, t, g, unknown or other
  modified_base (7091)..(7100): a, c, t, g, unknown or other
  modified_base (7384)..(7393): a, c, t, g, unknown or other
  modified_base (7467)..(7558): a, c, t, g, unknown or other
  modified_base (8121)..(8130): a, c, t, g, unknown or other
  modified_base (9394)..(9403): a, c, t, g, unknown or other
  modified_base (9766)..(9775): a, c, t, g, unknown or other
  modified_base (10294)..(10303): a, c, t, g, unknown or other
  modified_base (10826)..(10835): a, c, t, g, unknown or other
  modified_base (11625)..(11634): a, c, t, g, unknown or other
  modified_base (11844)..(11853): a, c, t, g, unknown or other
  modified_base (12269)..(12278): a, c, t, g, unknown or other
  modified_base (13060)..(13069): a, c, t, g, unknown or other
  modified_base (13281)..(13290): a, c, t, g, unknown or other
  modified_base (13693)..(13702): a, c, t, g, unknown or other
  modified_base (14238)..(14247): a, c, t, g, unknown or other
  modified_base (15028)..(15037): a, c, t, g, unknown or other
  modified_base (15752)..(15761): a, c, t, g, unknown or other
  modified_base (15958)..(15967): a, c, t, g, unknown or other
  modified_base (16304)..(16313): a, c, t, g, unknown or other
  modified_base (17265)..(17274): a, c, t, g, unknown or other
  modified_base (17623)..(17632): a, c, t, g, unknown or other
  modified_base (18661)..(18670): a, c, t, g, unknown or other
  modified_base (19580)..(19589): a, c, t, g, unknown or other
  modified_base (21386)..(21395): a, c, t, g, unknown or other
  modified_base (21794)..(21803): a, c, t, g, unknown or other
  modified_base (22586)..(22595): a, c, t, g, unknown or other
  modified_base (25310)..(25319): a, c, t, g, unknown or other
  modified_base (25637)..(25646): a, c, t, g, unknown or other
  modified_base (25846)..(25855): a, c, t, g, unknown or other
  modified_base (26030)..(26039): a, c, t, g, unknown or other
  modified_base (27102)..(27111): a, c, t, g, unknown or other
  modified_base (27592)..(27601): a, c, t, g, unknown or other
  modified_base (28181)..(28284): a, c, t, g, unknown or other
  modified_base (28352)..(28361): a, c, t, g, unknown or other
  modified_base (29219)..(29228): a, c, t, g, unknown or other
  modified_base (30033)..(30251): a, c, t, g, unknown or other
  modified_base (30509)..(30518): a, c, t, g, unknown or other
  modified_base (31992)..(32001): a, c, t, g, unknown or other
  modified_base (32447)..(32456): a, c, t, g, unknown or other
  modified_base (34102)..(34111): a, c, t, g, unknown or other
  modified_base (34453)..(34462): a, c, t, g, unknown or other
gcggcgcccgccgcggcggcgcccgggctccagcccagccgggtcgaggcgcggaggagcgcggcgccgaggctcagggcggcccccgccacgctgcgcacgctgcgcgccaggcccagcagccaggcgaggggggccaggagcagggtctggagcgcctggcaaccgtgtcgcggggacgaggtggagggtggggggggttgaagtgtggacgatggggagggggcgcatgggacatggggagggaggggggcttcctgatggcgacggcgtacagcctgttgggatgcagctgccaggctgcacacatgcctgcaaaacaggcagctgtctcgcgacaccccccttcctgacgagagggcacaagaagctgtggactgcacagactcgagaatccctcagagagattcaagtccctgggcaccagtaacaccccttgcgagacacccaccagcgtgaggggcatgacagcgannnnnnnnnngaacaggcagctgtctcgtgacaccccccttcctgacgagggggcacaggaagctgtggattgcacagactcgaggatccctcagagaggttcaagtccctgggcaccagtaccgccccttgcgagccacccaccagcgtgaggggcatgacagcgaggtccagcaactgccgagcggccgacagggcgggtgtgaacgcacctgccagggcgcacgccccaccccacaggccggccatgtgggggcccagcagggtggaaagcgccctgcccgccgtgcgcagcagccgcacgcccaccaccagccactcgctctttccaagcaagaaggtgagcagcagggacagccgcacctgatgggcaggcaggggagtggggaggggggctgggtgcatgtttcagcagcgctgagaaggccaaaggtcccacaccaccaagcccctgcgccagctccctacctgtgcatgtgcttccagccaccggaagaggactgagggcccccagaaacgtgccacgaccatgttgaacagtgcctggagggggatgccgggaaggggtccgggttcagagggtttatattgttgtgcatgtcgaggaagagagcctggaccaccccccccttccaaaggcaccatcctcacctgaacacccggcaggttgcggtagaggtcgtagaagccggctgccagcgagataatggagaagatgtagaacaggatccaggtgacgcgtctgacccagggccggtagtagatgcccaggcgggggaggagcaccgcccagcccggcaggcccgactcatacaggcgcagcaggcggtcctcggacatgatcaccgaggaaagcacgcctggaagcgtctcctcctcaaaggagatggagatggtgcgataggcatactcctggggcaggaccgggggacagagtggcggcgtttgcggctgccannnnnnnnnnnnnnnnnnnnnnnnnnnnnnnnnnnnnnnnnnnnnnnnnnnnnnnnctgctccagcgcggtccaggaggctgcgggtggccaccggtgctccgggctcggcggcgcagagttcagcgaggactcctgggtggccactcccgggaggtcatcgtccccggcgttgcagggaaacatgtcgctctgtggcccagtgcggacgacggctaggggtgtaagcccgccgttgcaaaccagcggagtgcccggacaggcctgcgccnnnnnnnnnnttccaggttgcggtgatgcaaacaccaacatcagggggctggacagacaaattgatccctaagccccgtcacttctgccgccatgcactcagacacttgccgacccacccgtccacacnnnnnnnnnnctccaggttgcagtgatccaaaaaccaacatctgggggctggacagacaattgatccataagccccatcacttctgccgccatgcaatcagacacttgccgacccacccgtccacacnnnnnnnnnnaaggtcatcgtccccggcgttgcaggggaacaggtcgctctgtggcccagtgcggatgacggctaggggtgtaagcccgccattgcagaccagcggagtgcccggacaggcctgcgccnnnnnnnnnnagcaagcacaccgcaagctcatactccttggtgtgcagcacgcccctgaggcagcctagatgccnnnnnnnnnnggggctgtggactgctctggcaccctgaggcctccagacgacggcactgcgtctgatgcggtgaaaccatagaactggcgagccgatgccatctgccatgtggatgtcaggagtggatttatatgagttgaactcccggctggacacactcggagtctgtggcaaggcaacctgtgcgtttggcaagcataccgcaagctcatattccttgatgcgcagcacgcccctgaggcagcctagatgcccctccgacagtactcgcaccgatttgaaggtcctccgccgggtgccacgggcctccagcaccagtcgccccggactgcagagggggtttgagtactgcatgcctaccagcccctgccagccaacctcgaaggcctggacccgctgtcccggacagggcgaggcgggtcgctgcgctattccagacagaatgctccgacggtggggcgcgctgccgacgaggaagacgaactgctggtccatggggaggacgaagaggagcagggtggactgggaggaggctctccacatgcccacccacaggccgctcaagcccttttcctgtcgcacattcatttcaaaagaatttatgccgcgttacatgacccatcggtggtacgagggactacatggcggaatggggtttcagggggaatttgggtcggcaaagcctccgcaaggggcatgggcctctctcatcccagtaggagcttcgaaaacgagttgctttaatttagttttctggatttttaaaaggcgagggcgcgaggtgctgcggaaatcacactctgccaaccnnnnnnnnnncagtattctggattttcaacagacgagggcgcaaggtgctgcggaaatcacactctgccaaccaggctcccggacgtactttttgcatggcacctgtccctctcgaaatccaagcctgactttctttattctacaaatagaattccatccctgctccctgaacgaatgggaacaagactcgccaggggacagctccttcaacagtctctccagctttgcagagaactccccagtggcaaaggcgcctcatggaagccgcagaggtcacgctgttcatttagctgcacccaaggcttcttggatgtccttctcctccataaccttgatctgcactcaaagaacagggaatgggtccctgaggcaaccataaaagacaccacagcatggtgatggttgataatgatacaaggtgcctccatacactgcctggacacctcacttcttttaatatacccacagtgcccccaccttgtagtcttcggggacctcccatgggcgccactctgcaatcgagagaaatgggcgtgacctcagtaaacagtgcacgtctgaggatgacgtacacatccacaaaccacaggcagtactaatcccacaaggcacaattgctccatccacccagccgcccagtctgcagcaactcatccacaagtccagcctcacctgccatcttcgggnnnnnnnnnntttatcccactaagcacaactgctccatccacccagctgcccagtctggtgcaactcatctacaagtccagcctcacctgccatcttcgggatgagcttgagctcgtccttcatgatcttgatttcctcctccaattgcctgccaaactgctgctccagctcctcatcctcagcacctgtctgaagagctgccaggcggtgcttcacggtcttctccaccgactggcggtagacagcagactctgggatgactgtgatggcctccagcacttttgcgtagtgctcccccagggtcgtgcgggcatcttcgtccacgggcaaccccacgatgcccgtggtggtcttgcaccgagtggccagagactggagggcgagcctactggataccaccctatgggcccttgcaagcgtcagcatgaccgccgacacccgcgctcggttgggagactgtagggtggggttgcctcccctaagaaatgaaagtgtggggattcggagggagctctcctccctttgggacgcacgcacccttccttctcaatataacctgtaccggtagcgatctggaatgggttgagcggctcgcaagtcgtgatgtcactctgtcggtggtgccgggctgggtcaagctcgaggaaagtgcgccagctacacacacgagtacgatttctcctcggccagatgcannnnnnnnnncagctcgaggaaagtgcgcccgctccacatacgagtacgatttctcctcggccagatgcagtttagctggctgcaattcagctgcacagacgatatggtatattttggatatccaaagatccgaataaacgagtacgaccatccgtgtcgccgtgtgcagggcccaacgcttgacttgggggagggagctcgtgcagggggtactcgcggccatgagccagaccagcacttccatggtacgttccatgctgcatacctagaaaatgataccgtctgacactgagaccgttaccaggatgcttctctctgtgtctcgcaggacctgggcccatnnnnnnnnnnttgcatacccagaaaatgataccgtttgacactgagaccgttaccaggatgctcctctctgtgtctcgcaggacctgggcccatgcccacctgagaatctggatgccgcccatgacttgaagctggtgcggaagggtgcaaaacatgacttgcatcgtccccaaacacagaatgacctaccactctgacctttgactcaacccagccaaccacgacctccaccaggagttggctgcctggcattcacaatttggcgcgcgattgaaggctacccaagcagagtgtatagccgtccaagagcttgttgcctccactgttacggtgggttggcggagtactgccgaggtcctgatctgtatggtgcagatattcaggccaagtaatctggctgagactgcatgatgaacatcaagaggaggagcccagcctatggtaacctctctctcatgctgcagcggcttgaagacagcgtgatcaagatgcatagcactgtttcgagcatgctggggaaggaggaaggccaagcgtaaagaaaagacgactctggtgtctgatgctctagatctcgttgatatccaattttgaaggggtgcctgtagcctttgggaaaacatgggaggcctatccaccttcttgtacgccatcgacaatctgttacgggaaagtgtaacccttgttgaaacgcacagcacagaattcatcaggtggcaagaggagactatctggtggagcttcccaccatttcccgatcaactgtttcgaacaagtcctgttacctcgcggatattccacctgctctgtgctgttggacctcacnnnnnnnnnnagtggcaagaggagaccctctggtggagcttcccttcattttccgatcaactgattcgaacaaagtcctgttacctcgcggatcttccacctgctctgtgctgttggacctcactcaacctctcttttcagttacacattcttgtctggtccctttgaagtaacaaattaagggaggttataaagcaggagatggtcgctcgnnnnnnnnnntacctcccttttcatttacacattcttgtctgttccctttgaaataagaaattaaaggaggttataaagcaggagatggtcgctcgggccttagcgctcagcagcacagccctggttctgtcgcgagactcgcacctcgcatccccatgtcgtcggctcacctctagatggagacgtgagtgtatctacgacctagtgcatggtgtgcttgcgacttgatcgggatgcactgcagtttcccctgcctgcaactcatctcccagtttgtctgtgccttcctatccctggcagccttcgtccctgctgctccctcgaggcgtgctcccgttgacctgagagcctggagggagagggatgaaccgctggaggaccgtgtgatctttgacggannnnnnnnnnttgacctgagagcctggagggacagggatgatccgctggaggaccgtgtgatctttgacggagaggaggattgggaggagggggtgagtgcgaggtcaagggaacggtgtggatctgagtctggcaacagggtgtcaatttcacgatctggatgtggtcttgacccatttctgcccatctgatggtgatttatgtgttgttgcctccagccgcaggctgggtggcctgtgccccatccagccagtctctggaccccaacccaaccaccccagggcaccaacgtgacatctggtttgggtgctctgccaggggccgcgctgcgcctgctgggcacccttgccgaccgcatcaccgccacggcggtacagcttgcgccccaggacgtctcgccgggcgtcgtgaagacggctgtgaatgccggcctgatcatcgtgctcctcggctttgccaggagcatcctctccgtgagacggggctggnnnnnnnnnngggtcttgacccatctccgcccatctgctggtgatttatgcgttgttgcctccagccgcaggctgcgtggcctgtgtcccatccagccagtctctggaccccaacccnnnnnnnnnngcacaggaggggtgcttgcactcttatcaagttgcaacgatgaagcggactctgcacaggctgttttgtagtagggagcgtctctgtcagacgctggggcggnnnnnnnnnnacacaggaggggtgcttgcactcttatggaattgcaatgatgaagcggactctgcacagcctgttttgtagcagggagcgtctctgtcagacgctggggcggcaatcttgtcgcaggcatgcatcggccgggaaggctcatctcaccttcaccttccacaaggcattacatccatggaggtgccatgcattcttctccacgctgcgcagttcttggtgacaatcggaaccctnnnnnnnnnnggagatgccatgcatttttctccacggtgcgcagttcttggtgacaatcggaaccctggtgctcggagcctacctggcgatcaaggtcttccgcatcaacatccccacgctcaaccaggacaggggagacggcaggcatcgtggtggtgagtgtggcgagggagggcgccgcaggcaggctgcggggctggactgaagctgctgggcgttgaaacagctgtgtcttcatgagcagctgcagatcccaacgagagggcggggccatctctgcccggctcgtgccnnnnnnnnnnaaaacagctgtgtccccatgggcagctgcagatcccaatgaacgggcggggccatctctgcccggctcgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctctccagcccccgacccgccaccctttccagcccccgacccgccacccacaggtccccaaggcggctcgaggaggacccagtcgggcgcggcgcggtacaggtcggagttccaggggctgctgggggcacgcgacgcggtaaagaacgacgacctgatggacgtggtgtttgcgcccaagcagaagaagggcaaggacgggaggcggcccggcaggccggtccgcaggtgacgggcaggctgaggctgagaaaccttcgccttttcacatgcctcctgggtaaaccagtcactgacatcatcactgagtgagaggcgccagcttgatgggggggatccctcgaccctcaccattacatttgaggtggagtgtgtaatactatcgacaccctgttccctgcactttttctatgtgtcctgatgtaattactccgatacaaagtggcaagatcctgcgaggcttggagggtgggccatggaggtcaagcatggaccccgtgtgcaagcaccgtgtacacagtatccgctcaacagcctcagcgtcattgcctcttgttgannnnnnnnnnaagggtgggccatggaggtcaggcatggaacccgtgtgcaagctccgtgttcacagtatccgctgaacagcctcagcgtcattgcctcttgttgaaaaggttccgcacagccgagatgcccttggtcaacgggctcgtggctgccgtgtagttgtagagcgacgtctcaatgtccgctgcagcatggtggtagaatggttgagacacaatcgagcagtgctttgcggtctggccacccgcctccatgtcagcaggcatgccagggcccaacaccatggcctgcactgggccagatccaccacacccacacgatcccacaaatcaaaccatccaagggccaggcaaactcacaggaggttgggcgctgcgccatgctggctatgggctcccatttccccttagcgagcaggaggatcctccacggggcacccgctctgcccgcactgcgcatgacgatgccgtccttccgggtgaccaaggcctgtggtgcgaggggtgggcgagggtgattgaaggcgccatggacaacagtcacatgcgctcatgcccaggtggagactagaaagtaggccaatcaaggaaaggctcacgtctctatcaggggaggcgctgtcgcaccttgatgttgagcggcatgaagacgtagacagcgtcaaacctgaggtcctgcctcgtctccgggctcgatggaccccctccctccatctcccactccgcgttgagcatgagcacagggccccctccccaggcgtgcagcagcctcgccacctggccggcctgggcagcggagggcgccacgatgagcaccgggcccttgccgggccgcttcagggccccctccagggtcaagccacgggagaggctagccgtggagctgctgcaccccacgggcgtggggcggggcagcccccgccgcgtcagccccgagatcagggccgacaccagggcaccctgggccgaggggctggtatccgccagggggatctccagggacaggcggatgcggttcagcccgtcaaagcccgtgctggagctgccagaaagccgggctgccagggcatcgcaggcctgctcgatctggggcgagtagcggtggggaggagggtggatgagggtttgtgtggcttggttgtgcaggcaaaggtggcaggcgctggccagcagaaaggagcatgtcacaggttgcagtggctttaactctagatccattgcattactatacccatcgctgcgtcaaagtcactcacggcctcgtcttgggatnnnnnnnnnntgagggtggatgagggtttgtatggcttggttgtgcatgcaaaggtggcaggcgctggctagcaagaaggagcatgtcacagattgcagtggctttaactctaggtccattgcattacaatacccatcgctacatcaaagtcactcacggcctcgtcttgggatgctggtaccacgggaacgtctaggttggaggcggtcttcggctgagaggaatttcctgccatgcacacatacctgagccggccatgtgcagcatgcacactaatggtgccgggaggactagcagattttgttgtaggataaaaagccatccatttttcaggaaggccctggcgaattccgaaggagtgggagagggacnnnnnnnnnnagttggaggcggtctgctgctgagaggaatttcctgccatgcacacatgcctgagccggccatgtgcagcatgcactctaatggtgccgggaggactagcaggttttgttgtaggataagaagccatccattttacaggaaggccttggcgaattccgaaggagtgggagagggacgccccatgaggacctacacatggagggctcgtgcggatgctttggccgaccggcatggggaatgtgcacgtcaaactgcaatgcacgagagcacagcgccccgtcatgaagcgatggtagtcataatggctgtctctcatagtggcgaccattttgcatgcgtcttcgtcggacgaccccggatcgcatgggtccatgtcggacttgaaatctgggcgtaagccagtcaatgaggtggggcagcatgccgcatgctctgcgccgcgagaggaccctcacaagggcaaacatcaccagatgtctcttggacagctcctctttgcatagcacactgcaggaatcnnnnnnnnnnggagcaagcatcaccagatgtctcttggagagcctcctctttgcatagcacactgcaggaatctctgtcttcagctgtctatcagtttgtgcgtgattgctaatcaccccacagcactcgaaggccagcaaccaggagcctcaggcaagtgagcgcagagcgtcgccctgcccctggaagaagaggaaggacagcgcaaagtcggcgatgaagatgagcaccagcgagatgacgacggctgaggtggtggactccccaacgcccttggctcctcccgtggtggtatatccccacgagcagctgacctgtagatgacgcaaaagagaggaagcgggatgcatatcattggcaattgcatcatcatctgattgctgaggtttgcaagggaccggcagggtttcctatgacgttccgtcggtaattcagtccctcaccacgccggtcccatgtgtgagcctggctgccagcctccctccacagccccaagtcccatactccaatccgctctgcagtctactcaccnnnnnnnnnntatcatctgattgctgagtttgcaagggaccagcagagatttctatgatgttctgtcggtaattcagtcccttaccacgttgggcccacatgtgagcctggctgccagcctcactccacagccccaaatcccgtactccaatccgctctgcagtctactcaccgaggagatgatggtcccaaaaacccagcatttgaggatggaagacaggatgtcccagctagagatgctgcgcatcgcagagtccaagatcacattggccgagacgctgtaggccgcctctgccagcagcatgctggccgccatacctgtatgattgggtggtcgcagggcaccaaactgtgaaagggtgggcagaagagctttgcaggcacagagcagctctggacatgcatgcgatagatgtgctcggggcgcccctggagtacaagcttctgtcctcaaatcctcttcatcaagaacagcagcacaccctccctctccaaccctttcccaccccccaccatcttccgcgacatacccatgcagaagcacatgatgttgagtaggggggtggctatcatgcaggccaggatgcgtggggtaatgaggtagtcaatggggtcgctccccaacaccctgcacgttgtggtggagggggaaggttgacggccggcgatgctgagtggggagtctcttgtttgatcagcaaggcacagggatcattccgacaaacgcagcgcattcgttccccccctcctacttagaacttggtggcctcctccaagaagcatgcttcctttgcccaccnnnnnnnnnntgcaaggcatagggatcattccgacaaacgcagtgcgtgcgttccccctcctctacttagaacttggtggccccctccaagaagcatgcttcctttgcccaccagagtagttgcaagctcctcttcccgaaaagaggcagtgccttcctagcccccaacagcatcaggcatgcagcccagggtacccacctcagagagtcagtctgctcnnnnnnnnnnccaaagaggcagtgccttcctaagcccccaacagtatcaggcatgcagccccgggtacccacctcagagagtcagtctgctccgagacctgcatggtcccgagctcggcggcaaaggcgctgccaacccgccccgccacgatgatggaggtgacgaccggggtcaattcccgcgcgagtgcgagcgccagcacaccacccaccgtcctcgtcaggcccagcttcgtgaattccctgcagagaagcgaggggggggtgaggggcttgagcatcgaggctgcgtccgtaggaaacacttttggccgccgcccccagcctgcagaacccgctataaagattagacccaacagtaccatctctttgtttacctgatgaactggatggtaaacaccatgcccaggaagaaggaggtgaggnnnnnnnnnnctccctgcagagaggcaagtggggggttgaggggctcgagcatcgaggctgcgcctgtaggaaacacttttggccgccgcccccagcctgcggaacccgctatagtgattagacccaacagtaccatctctttatttacctgatgaactggatggtgaacaccatgcccaggaagaaggaggtgaggaggcacacccccagagaccggggcccaaccaggttcaattgctccagggtgttccgccagtgtattttgcctggtgtaggtttgtcggggcacatgtgtgactggcggaaagatcccattccggcccctgcaccttgtcacatggatagcgccaccacactccaccgacagaccttgaaagatgcggaagatgctctggccagcgatgaccagggctgcaaaagatctccacaggtactttggcggcctaaacctgttgttgagttgctcgatgcgctccgacacccgctgcttcatctcctcagggctgggcaggcgtcgggcgtcgggaggggtaccggccgaggctgatgccctcgtcaccagctgtacacccctcgtcagggtctggaaggggcgggcatggattacaaatccatgtgcgcgatggctgcttgcaaaggcgcctccttgtaatctaggcccgagagcgcagggcccgaccaggcaggcctgcatgggtaccgggggcttctaggaagggcctcctggcgacatggcctcgctggatggctggtttcaagcgattgacacccgccgatcacccgtgcagacnnnnnnnnnnggtcagacaaagacacctgatcttgccccaggactgcccgagatcgaacgcttgattgcgcgcgcgcgctgaatctcgttgcttggggccctctcaaaaagtgacagaagtgtgcatggacgggggggttgaaacctgggcgagacattcgccgtgatgtcccgggaaatccagcccctgaccatgctatggcccttcccagtcccggtgcnnnnnnnnnntttttaacctgggcgatacattcgccgtgatgtcccggaaaatccagcccctggccatgctatggcccttcccagtcccggtgctgcagcccgatctggagggggggcgccgcgccctgcccccccaccgccatgggcgccagcttcctggcgagcgactggggcacgtgcgccttgatcctggtacccgtggcggtgaactccgcgctctgcaccatccccgagcggtggatcaggtccacgaactcgccctgcggtgcagccagggcggcaatcggtcgcaccagggggttgatgcagagcgctgccggcccggaacaggtgtcaaacaagactgccatggcatcgcagggcatgggccttgccgctctcgggacgcagctcgcgtccctgcccaggcagnnnnnnnnnncgccggcgcggaacaggtgtcaagcaagactcccacggcatcgcagggcatgggccttgccgctctggggacgcagctcgcgtccctgcccaggcagggacgtctgcattcctggggcgccgggcgcgggcctccccggagggcaccctggcccccttgcccggcccctgagggcagcatgcctcccacaacacccacaccctcctccctgctccagcgcttaccctgctgtagggcaccaggacctccacatccaccatgctctgctgcaacatgtaggacactgcctccagcaggtcctccacgccctcccccgacatcgccgacacgcacacgctgtgcgggcgcagagcggccacagcgcgcacggcgtgaggatccgcgcacgcgtctacctgcgaggcggaggaggggagtggctgcttttcagtgtgtttgaagcttgcaggtgaggcaggatggcattggtgcggcgcctccgtgcggtcgggtgcgtctctctctcggcaggctcgcacacacccctgaatgagcgnnnnnnnnnnttttgaagattgtaggtgaggaaggatggcattggtgcggcgccttggtgcggtcggggcgtctctctcttggcaggctcgcacacacccctgaatgagcgcctccacgcctgcaaaaacaatgtccaagcccctcccacccccctgctttgcctcatcacagcgtgcctccagcgccacgtggcggtcctcgctcccctctcttcccccgtgcaaaacatgagaccgcccccagcacatccgccccccccccctcgccatggcgcctcgccttgttccagacgtgcagcacggggatgccgcccacccccagctccttcagcacgtcgttcacggtttccacctgggcggcggcggtggggtggctcacgtccaccacgtgcagcaggaggctggcctccgcgatctcctccagcgtggcccggaaggccgccaccagctgcgtgggcagcttctggatgaaccctgacgagggaatggttggagcatggggggagtattagggttggacttgttatactcgtgtgtgggccttgcttctcttgcaatgcctgcggtcaagggcacccgtgatgattgcagaggagcaacagctgcatggcgcaaaccggtgctctccagcctctctgacccctatttgctacctgcccaagttgcaactgggagagcgggccgtgagacacttcccttcaacctcatcacccaacccctgaacaaacccatccccactcacccacggtgtctgtcagcagcacctcctgcccctggcccagctccaccnnnnnnnnnncgcggtcaagggcacacatgatgattgcaggggagcaacagctgcatggcgcacaccggtgctctccagcctctctgacccctgtttgctccctgcccaagttgcaactgggagagcgggccgtgggacacttcccctcaacctcatcacccaacccctgaacaaatccatccccactcacccacggtgtctgtcagtagcacctcctgcccctggcccagctccacccggcgtgtcgtggggtccagggtggcaaacagcttgtcctctgccagcaccctgagggtgtggggggggcggcagagagcgctgaggccatgcgatcccctgcgatgcggcgtctgctgctgcctcgtggccagcccgcccctcccagccttgacgccatctggcaaccacctccattccccactcaaccccccaaagacacgcacccggcatgggtcagggtgttgagcagcgtggacttgccggcgttggtgtaccccaccagcgcgatgacggggatgggggcctctgcacggcgcacccggtaggccgcgcggtgggtgcgcacctgatgcgtgggaggggggatggttggtgttaggggggggtgttcgccctgcaacaggatggggacgagccgagcagggacgaacctgggtgatgttcacaccgtcgacgccgccgcgcagaggaggtataagcacagcctgaagtctgcacgcagagnnnnnnnnnncgggtgatgttcacaccttcgacgccgccgcgcagaggaggaataagcacagcctgaagtctgcacgcagagggagggcggtccctcgtccagggccaaagatcgcccaacatcccccccagccacccctcttcccactggctgccatagcacctcctcgatgtcagagcgcaggcgcgccatgcggccacgcagcnnnnnnnnnnttttcccactggctgccgtcgcacctcctcgatgtcggagcgcaggcgcgccatgcggccacgcagcaggcgcttgtctacctctatctgcttctcgcccatgcccttgacctggccggagccggactggcgctccaggtgcgtccacatccgcgtcaggcgcggcagctggtactcggcctgggccagcgccacctggcgcgcaaggttggggaaaggatgaggaggatgtgtgaggggggtggtgggcaattcctaggcagatgggccctgaaagcgtggcagtcacgccgccactttcccccgatctgccgatctgcagcgcacccagggagtnnnnnnnnnngagcgccacctggcgcgcaagggttgggaaaggatgaggaagatgtgtgaggggggtggtgggcaattccctaggcagatggcccctgaaagcgtggcagacacgccgccactttcccccaatctgccgatctgcagcgcacccagggagtctccccctgatgtagacctgctcacctgcagctggccctcgcgcgtcgcggcgcgctggctgaagatgtccaggatgagggcggtgcggtcgcacagccgcaccgcgccgccaaaggcgcggtccaggttgcgcagctggcccgggctcagctcgtcgtcgaagaccagcgtgtcggcgcccgcgccctccacggccgctgccagctcggccagcttcccgctgccaacgtaggtgcggggatggggctcctccagcgcctggatacagtggcccaccacctggcaccccgcggtgacggccagccgccccagctccaggatggagtcgggggcggagaaggcgcgggaccgcggcgaggacttgcgggccaccgccaccaggtaacaacgttcccgatcgtccgggccggccactgggactggagcgggcgtctggattgaagggatggtgatactctggtgtggatgtggtggagtgatgctgctgcttcgagagcctccaacccttcaggagtgtgtctggctcccaggctgatggctaacaaccacatgttgcaggcccatgcgcgccacaggtcagctacactccacattcatcccacgtgccgtgtccagggagagggactcggagagggggggcagctcattctccggcagggccggggggctggccacgggctccacctggggaacaacgtgcaccacatccggcccagcgcccgacaccctgtcctcatgccgtatggcggtggtgcatgtcctcctggggcccctgcatcgccatcgcggggcgggctggnnnnnnnnnngggcaccctgtcctcatgccggatggcggtggtgcatgtcctcctgggccccctgcatcgccatcgcggggcgggctggggcacgaagcagtacctcgccgggagggtaagtgatcctcctgcgaactgcgtggcacccagcatgccgggaggctgcggggcgggggcctcgtggtatggaggtccacaaatacaaggattcaatggccacgggcctgtgccttgacctggcagcgcgtcgcgggagcctgcatgaccataactccgccttccgtgaatctcgtcccgacctcaaggcgcccccatgacacctccctaggagaccccttccccctccccaagcaggtcnnnnnnnnnntactccgccttccgtgcatctcgtcccgacctccgggcgcgcccatgccacctccctgggagaccccttccccctccccaagcaggtctctgcatggatcaccacgcctcacagcgcaggtcatgggtcattggaagtcgaacacgcacacgctgtggtcgtcggaggcagaggccacccgtgccccgtccccccggaaggccaccgaccagacctggtcggcgtgcgcgtcggccaccgtctgcgccagcgtgcgcgtgctcaggtcccagagcctgaccttggcgtcgctggagccggtgatggcggcggagccgtcggggtgcaccgccacgctgagcacccaggactcgtgcgcggcaaaggactccaccagcgcggcctggccgacatcgtacaggttggcgtgcaggtcgtcgcaggcagtgagcaggtggcgcgagtccggggtgaaggccagcccgcgcaccgccttggcgtgccccgccagcgaggacagcaggcggccggtggccgtgtcaaacagcgccacgccgccgtccatggcccccgccgcgaccagccgcccgtccgggctggccgccacgctgagcacaaagggctgggcgggggcggcgccggccgcgccggccgccggcggggggggcatgtgcagggtgacggggcggggggcctcgccgccagccagctgcgccgacacgtccagcagcgacacggtgttggagctgccgccggcgacagccagcgtcaggcggccgtcggatgacggcggcagccaggccacggaccaggcctcggcgggggggagcttgaagcgcgcggccgaggagtagtcggcctgcgaccatacgttgatcgtgctgtccatgctggaggcggcgccgtactgccccgtgccgtcgatggccacgctcacaacccccagctccaggcccagctgaggcatggggggagagggggtggggttcagtcgattgaacagggggtctcggctgccaaggaggaggattccgtgggggaggaggatgnnnnnnnnnnaatggggggagagggggtggggttgagtcgattgaacaggggtcacggctgccgaggaggaggattccgtgggggaggaggatgcagtgcagggatccaaggaagaggtgcaaggagctctttggtgatgaaatgaggatctctggcactgcatcccagactgcgcatggagaaaggctcctgcgcgccaacacgcaggaaatcgcagcaaggtgcatgcatccacacacacacacacacatcctgaaagacgctgaggcgtcggcaaccccagatgcaccatcaagacccctcccccgctcaccagatggtgcttctgctccagcccctccccggagtcctgccacagcttcacggactcatccacggaccccgtggccagtaggttctctgtgggagaccagtgggccgcccacacgctgtcatcgtgggccgcctcgagcttctgatggagggtcagcctcatatgcctcgggtgtgctccggcacctccgtcagcaaggggggggcgcaccggtgctgcacgccttcacagagggcgtaaaaagtggcatgcactcctcttccacaaaggtaatgcacttttcactctgtgggtgctcttttccagcatcaatcgacgatggggagcaggctcgtcgcggtttcccgagagcccggcagtgtaaagtgatcggactgtttattgctgggaaggagaagcagcccttcgcccttcaagcgcaccaataacatgacacaccaggcaaacggggatccaaactgccattcacaacgttgagtcaggacgatcagaaccccactcctgacagaccccccagctgccttgtcgatcgtatatctatttctatggcccaaggccgatcataggctgcttgctagcatgacattcgatgtgaagattaaacannnnnnnnnngtgccttgtcaatcgtagatctatttatatggcccaaggccgatcataggctgcttgatagcatgacattcgatgtgaagattaaacattggcacgctgtggcgagctggacgtgggatgcaggtgcaggacagcatggggtgcactgtgggtgccctcagtgtgatgctctggggtggcatgcggtgaccctggagcctcccatccccgtacactcccattccacaggggacgatgtgtgtggaatatgccgcatgcccttcgacgggtgccccccggaagcccgctttccaggggacgactcgccggttgtctggggcacctgtgcacatgccttccaccttcagtgcataaatcggtgagtatcaagtgactcggcatgtgggagtatccattcagcgtagaggtggattgctcctgcattggacttgagcctgtgcatagcttccctgcaagactgtacagtacatgccacaggtggctgtcctctcagtctgagcagcgatgcccaatctgtcgaaggcactgggagttcaagcaagcagcggtttcagatggagagcaagaggaaagcataggtgtcgatatggaggatgccccctcttgagtcaagagtgccagcttctgtgacatgggggacccatggctaagcaatgcaacagttgtggccattgaaagcacttatgggtctgactgcaacgcaacatacaatctagtaccttttctaagacagaggcaggctaccgagatcttgtcacggctgactagcgctcgatggggaggggggcaaacccttcaccagctccggatcctcgagaccgctgcctctcagctgccggagagagaccactccatgtccaccacctgtatacatggtaccaggctcgcgcggatctgcgcaaagttctctaaataccatgtcagatttgaggtcaactcccgtgccgctgcatggcgagcctgtgacacgtcccaatggtgtggctcccccggagtcccagcccggtccgtccagcatgagccagcctcgcagacgcacccaacagtcgtcagccaaggcttccacggggcccgatccactgcagaggggagatgaaccctggcagaagactgcgagaaaggcccagtccttctttcgcttcctggtcccgtttttcgtgaccatcggccgcctggcatacaagttcgtcatcctgctcctgccgctggccctctggggggcctccaagtacctgacctggtgagatcatcttatgcttgagatgtgggttgctctgggggctgtcaagcttgctcatgattcaagaaaaagctcaatccctctttccatggcacctcccaggactgtgggaagcttcttgggcaagatcgaacggaccctcagctgggtcagctggctgataggctacttgccaaagagtgagggagcatccattacttgaggttctgaacatcttctacctttttcctgccctaccagggttgggccctcaaccatgcagttggagagacctgtgctcaaatcctgccgcccgataatctcctgccatgcaatgtcgtaaacagcatggaagccacaatgtgaatgacccccaaagtacaatttgtatactcaagccatcctcgtatgtgcgaggaagatctccattggtaagattaggcatgcatctagccctgcaagccagagcagtgctgtctcagtacctgtgaaccttacacctagcttggctgggactcgctctcatggggaatgattctctgtcataaattgctgcatcatgcagtctgttcgtccannnnnnnnnnacatctagccctgcaagccagatcagtgccatttcagtacctgtgaaccttacacctcgcttggctgggactcgctgtcatggagaatgattctttgtcatgaattgctgcatcatgcagtctgttcgtccatgtaaaccatctcacgagtccattgacgaaatcgaaacaagttgtgcctttacggaagtaatactggcttcccaagggcctaggcctcggaaaatcttgtaatctgatgcactgtcgtgtgccattttcacaccaagagatacggtgtctcgcaccattttcggaaggacggcctagtgcataggtttctgaaatcaattgcattgtgggaggcattgacttggacaagccaggatcggcggggcctagtctgcagccaccagcctnnnnnnnnnnagcattgactcggacgagccaggagcggcggggcctagtctgcagccaccagcctcaacaatttgccaccccagctgaaggtggcagccgtctcctccagacacgcattcttctcctcgtctgaccacgtctgtgccacactttccagcttgcccctcacgtcatccagcatgtcctataatcagtgggagggcagcaccgactcactcccagtctctggatttgtgcacggcacaattgaccgcacaaaagcctttgaactggagctccaatcgtggacaacacctcactaagcccacttgccttgacatttccgtcccacttgtaaaagttgcccgtccatccgtccaagatcctctgcagcggggaatatgattggaaggggcggctggtcaagaccatgatctagtctccaggccccaacatgcaaagagcgagagaataagcggcaagtacatgtcgattgtgcaccaagctgatccctcctttcatcccaccgttcaccgcactgttcctgctcacctgggaaacctgcttccctatcattcggccacccgccgtgtgcgcaaagtagtggttgtaaaagtgacacaggaagggtcccggcttgtttgctgcgagctcgcgcaactcactgtgggcatgatgcggaggggtgtaccctggagttcagtaatgagacggtggggcaaggggtggccagttcctatttgagtcggccgcacaaccactacccctgcaggtccccgcccacctggcgtaggtgtggcctgggccgtctgnnnnnnnnnngccctggaattcagcgatgagacggtggggcaacgggtggccacttcctgtttgagtcggccgcacacccaccacccctccaggtccccgcttacctggcgtaggtgtggcctgggccgtctggttttgcctccggaatgggcacgccatacttctcggagaggtaggcaaggtcgtggtcgatagctgcaccgcgctgaagccccgtcgccgcaaactccttgtctgtcaaggcagggatggcagggacattgtgactctttgacacacgcccttgctgttgtctgccaagggtcgcagccgtagatcctgcaaacaaaggacacacccgcatagcgtccacatcccagcataacacaaaggtccctgacagagcggagaaggccaccaaaatgtctgccctgcccacccacgctcacagtaaggctgtgcgcctgccgccaacagctcctcaaaagtgtcgtacacgaccttggactctgccatgaactgcatgtagccagccagcttaggctcccactgcaatgtgcagggatgcccaagggttcggattccccctgccatgggaagcatgccctgtgcaagcaggccacacgggcaccccatgatccccgatgcacaccggcttgtcaggcttgggagcggcggccttgccctcccgaggtgcctgctcccgggtgtgcaggcgcatggcatactgcctcagctcccccaggaaggctgcatggttagcaggattgcgcatgggagtcagaaccatcgccattgagggactcggcatccatgaaatgacgcagggggctccacctctccatgatcactcacatccgtctgccacaggcttcgcatgcacggagctgccgctccctccatggtgcccatgcgccgtgataggatgtaattttctgcagggcttcacgcgagactgtacgggagtgcggcgcgcatgccgcgctccgccctgagaccctatggacaaggccatggcatgcaccattctatttgtaggtgatcgacactgcctgccagatgaaggtcgttttacctttgagaccttgagaattgagtacctcccacggtgttgggggtgttttgaagggacctcggccgagagaactaattgacgtgcgcgtggcgagatctgacgtcctgtgctgtcctcgtctcctcttatcttggactccatgtccaacctcattagccctgatgagcatgcaatctcagctctgacgtaagatttccttgagtgattcttctctgatctactgtgcaagtcaggaggattctccttcgtgcaggaccagtacgatggcaacaaaccaggccagtttcagggatgcaagggtcacagcaaggcaagggactgtcttggtgatcaatcttcagattgatcggacagagcaccaatggtgattcccacatcgtttcggccccgggcaacgaaggtaagccgggccagctcggccgcctcctgcgaccccgccgcagaacagccacacaggatgctccacttatcctccagcccctgcgcctggaacccgtacatgatgggcagcgcccccaggaatacggggtacatctttgccatgtaggcctcgaagctctccaggctctcgccggcagggatgatcttgagggagacgtcagaggccaggcgaagggtctgcgagtgcaaggcggaaagtgaggaacattgtcaaggggagatggttgcgcagggcaccctttaccgaactgaggagtgtgagacgatgagcaatccagccaatgttattcaaaaacgagcaaggaggcatgcactcccatcatggtcctcgatgcaggcagcgccgcctgaccacaatggcatcgacgtcttcacaccataacacccaggtagcaccacagtggacctggaacctcacccagaagatacactacctttaaatcggggccctgttgacccagcctctggatcatctggtcacaggcttcctcacaggccctatggctggcctccagtgcagcgggatctccccagatgtggggaggcactgcgagggagcggggggaccaacatcgtgggcatctgggggatcaggaatccatacttgtttggtgcaagcatgtccactgcaagcacccactcaccaaagtccccctcctcatagggccaactgaacaggtccacaagaggcgagcctgggtcatcaggagtacggcggtgtgatcaagagagtttccacggcattccctgtgcccctggcacccttgattctcatttagcagcagcaagggatgtgagtgagcaacagcctgccagagccgcagcctgcccacgacgcaaccccttgtgcccatgcaggtgtggagttcgctgccagattcatccctctcaccctctgcctgttcgacgcccagcaggatggttgtggcctccacgctgacgtcctcgcacacatgggtcagctgccccagctgcagcgccaggtcaccttccacatgcagcctgaaggtccgcaggctggtcgccatgttggagagatgggtgtgaagaggtgggaaggggaaaacgccaggtggaaaacggggttgggatgaatgtgcatgtgcaagaggccgccaggcgctcgcaccctcaatgcagccctgacaaaggaagggcgtggcccgcataggccattgcgcccacggacacgtactttggctgcttgtacatggagaacgagtgggggnnnnnnnnnnactcaatgcagccctgacaaaggaggggcgtggcccgcattggccattgcgcccacggacacgtacccaggctgcttgtacatggagaacgagtgggggaacgagccaacctctgcatatgtgccagactcaagccgccaggacgcaggcgcgggcatgggataatagtgcggcatgcggacttccagatgctgtagcgtggggcagcagtcgaccaggtgcagcccgtggatattgtgcaggcgcagactagtaaggcggggcaagcgcagcaggtgcgacacccggtgctgcaccactgaagtttctggaaggatnnnnnnnnnnggtgaggcggggcaggcgcagtaggtgcgacaccctgtgctgcaccactgaagtttctggaaggatcagctccaagtcctgggttcagtaagggaggaaagggagaggaggctgttgtgcacagctggggcagctggcaccggacaaagtccaggcaccgcatctcctgggagagtcatgctaccctgccagagcatggnnnnnnnnnnaaggaggctgttttgcacggctggggcagctggcaccggtcaaagtccaggcaccgcatctcctcggagagtcatgctaccctgccagagcatgggcggaggaagcttgccaaacaaatggcaaacgcgagcaaggcatgggtgcaccccgattcccataggcagtcgctggctnnnnnnnnnntgaatgtgagcaaggcatgggtccaccccgattcccataggcagtcgctggcttcccctgttggctgcatgcctgcaggtgttgcagggcaggctgctgaatgaggtgttcattcaatacccagacgtcgtgggttgagcatgcgtccatgaggatgtggttgccaggcatgggtcttgagtcgatgtgcagtcccaccagctccaatcgatgcagccactggtgcaggagggtgccggcatcggcgctgtctaccacggccagcctcagctctagccgggtcctggagagggcctgaagcagagcaaggggggctttgactcacagttgtggatgtaagggagttccactgctggccaggtctgcgcgagagctccccttgcacccctccctcccattgcccacctccttccaccgtcggcacaccaggagcaaggtgccccacaggcgaagggcatctgccgcatgcagctcccgtcctcggctatcaaaagttcgggcaaagacgatctcgaggacgtcgatgggcagatttgcagcgcatggctgggtcatggacctggccacccgcacttcccggtccagtgacgagcgcaaggaataatctcggcggggtggtctacatgcgcggcgatgtcatcggaagtatctagctacttccaacagtctaccgtaattgaaatgtatgagcgccgtctcggccatggctaaatcgttcggacgaggttgcgggtggagcagcatttcattccggcagcagcagggtgtttccaaagccgagatttaatactccatctttgagcggccgtactcaatcgagaactggacctaaatcaccgaatctgcaagtacaagcatgaaggacgtacttgggaagttctgcatcctggctgtgcagccgtacagcatggggatggagtcttagactaccccttggatcaccacaagtagcgcatcacaaatgccttgctagggattacagtttggaacaacgtccattacttcatactcctgcttttatctatttatgatccgccagctcctgcactttatgacttgcgannnnnnnnnntagttttgaacaaagtccattacttcatactcctgctttaatctatttatgagccgccagctcctgcactttatgacttgcgaactggcgctcggctacacagggcaacaggacgcttcgagtcaagcagagcactcgctcacaaagtcgttttgcccagtctctcgattcgcatggtcccagatccttgagcagattcctgtctgtatcgtggctttctcaggctccggcttcggcgtcagctgcgggcacccatcatgcccaccgcactgaatgcggacgcgtggccggaagactgaggaatcattgcacctggctaggcgcgcatacatacacccttggtttcggtgtagcatatgtccctcgccattccgaataggctgtttattgactggtccgctcaaggccttatactgggtttataaagtaagaccatataagggcaggaagtctcgtacgccaccttgggcgtcctcgcgcnnnnnnnnnnacatacatacacccttggttccggtgtagcacatgaccctcgccattccgaataggctgtttattgactggcccgctcggggccttatactgggttttaaagtaagaccataaaggggcaggaaatctcgtacgccaccttgggcgtcctcgcgccctaattcaatctggcgccttgctgcagagcgtccgcttccgaaacacatcaggctccaccctggcgacgagaaggtgcgtgctcccagtccagagctcctccaatctagcatggtgaacacgttgtaccagctttggtcccagcatgctgtcctccacctccaataacgtgctgttttgacgacaacccctcttctggcagcagcattccctcgcctcgggcgaccatgcttcgctccctcggatgcaatccactacggggccacaagatcgttccattctaccccaacgctgggttccggcactggcgatcgagttgtgaagccctgcagaccgcaagtcggcagagctttgcctcctggacaggtgtggcctttgggctgtgaagaagttggtggagttagggaagcattccctcagactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgccagatcatccaacccctcattgttctctctcggccctgattgcaacaggcaatgcatcccagnnnnnnnnnnatcctggtcaggtgtggcctttaggctgtaaagaagttagtggagttagggaagcattccctcagactgtctgcgatgcttgggtggtggtcttgcttgccacttgtctccatgaagaggtgtgcatggggcttgccggatcatccaacccctcatagtcctctctcagccctgattgcaacaggcaatgcatcccaggatgagctcatgatcaaggatgaatgcatcctggtggacgagtctgatgctgtgacagggcatgccagcaagtatgactcccacaggtctgtgctgcgacatggtggtcatggggtagggtcctgcttgtgcacatgtgacgggatggtcaggccatgctcctgtttgcttcagacctctcgatgtgccattggatgttatgaatcacccctccctcctcttgacatgagatctagataccataccaaccgttcatgaagctcgtactcctgaacatttatccccagattcgtggatgggcagccccatggcctgctgcaccgcgccttctccgtcttcctctttgacgaccaggaccggctgctcctgcagcagcgtgccgcctccaagatcaccttcccggaggtctggaccaatacgtgctgcagccacccgctccatggctacagccccacgggtgagctgggcggggtggtgaggcctgcgagctgaatcttgaaagggccactgtggctggaacccccttgacctgcaagatgaatgccacggtgcagctgttgcgtggcacgtctcagcttcctccctcgcatgcaccacgccgcggcacaatccccagtcccatcccccgtgcggacagaggtggacacgcccaaggatgtnnnnnnnnnnctggggtctgcgagctgaatcttggaagggccactgtggctgggaaccccttgacctgtaagatgaatgtcacggtgcagctgctgcgtggcacgtctcagcttcttccctggcatgcacccacgccgcggcacaacccccagtcccatcccccgcgcggacagaggtggacacgcccaaggatgtagcttctgggcaggttccaggcaccaagcgtgccgccaggcggaagctagagcacgagctgggcatccccccgcatcagataccgctggaaaggctgcagtacctcacccgcctgcactactgcgcaggggacacaggtctgcgaggcatgggccccgacccacgcccccaccgcatgcactgttggccagcgcacctgcttgcctgagcagggaatgctgagggagtccgggatggagccctctacccccatttcggggcctctcaccaacccatgccccactgtcacttgtggtgcagatgagtcgggcaagcccaccggctggggcgagcaggagatggactacatcctcttcattcgcgcgcaggttgacctcaagcccaaccccgaagaggtcatggtgagctgccatggttgcgctgatattgatcaagcgggggatgggatggcgtgcgcaccagctcaagaggctgagggggagtgtctcgcctggtccaacagagtcttgcaattctactcgggccagaatgcagtgtcgatgactcgggtgctggaagatccttgcctcgcgccatcccgaccacgatcgcacaaccctccctgcaggacacgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttacagccagtgccccgccatgctctgtcgagtggcggtgtcacacagactccctgtagacatggccggagaaccagcgccagcagagattaagaggtggaggtatccggtgggagcacaggccccattcccccctgcttgatgatgttggcgccgagcccgcaggcgacataccttgctccagcagcccctttgaaatgatcgcacccattgtgcgttgccctcccaccaaacccacaaagccgctgtatgtgnnnnnnnnnncgtccaacagagtcttgcaattctgctcgggccagaatgcagggtcaatgactcgggtgctggaaggtccttgcctcgcgccatcccgaccgcgaccgcacaaccctccctgcaggacacgaggtatgtcacgcaggccgagctggcagagatgatggaccccgcctccggcctgcgatggtccccctggttcaggatcatcgccacccacttcctgccggggtggtggcatgggctggaggctgcctgctcgggcagtggcggccaccaggatctggcttccatacaccgcctgggctgagaagctggggaggaccgatggcggtgcagagcaggaacttacagccagtgccccgtcatgctctgtcgagtgccggtgtcacacaggctccctgtagacatggccggagaattagcgccagcagagattaagaggtggatgcatccggtgggagcacaggccccatcccccccgcttgatgatgttggttccgagcccgcaggcgacatgccttgctccagcagccccttgaagtgatcgcacccaccgtgggttgcccccccaccaaacccacaaagccgctgtatgtgcctttattacatgcgtgaaagcatatgcacacagggggtgacaagggcgaagggcctgtggccatgggagcctccctcccacccgatggagtgtcgtggaagaaatggggggtggagggaaggtaaaggtaataaagggtgtgaatgaagaagacacaagtgttcagactcacaagacgtgtacagctggggaaagagggtgcagtcccaggggtccaatggaggggcatcagcttctcgccgatgcagctactctcctgatccagggctgcacaaaaacgtggggtcgccaacccttctctcctgtctccagccacagtacagggtcgcgctggtggggagccagggaaggcaagcgcggtgccggcgcacatgggcaccacgttccaggcatggtcgccgccagaggcccgcaggacgcccagcagggaagggtacggcgatggggaacgaaccgccgcaagaagggggtgtccagccaggggacagagggcatcagggggcgtggcgatctaaaaatggaaagaatgcgcgcacagatgcaacgattgcgcgcgcgcctcctccggacgatgaatctacagggggggcagccccacacaggcggggacttgggccgaaaatttcaagaatgtggacagtgctcggcatggggcccggtctcttggggagcatggcgtgacaggcttgaggagggggtggaggaaggacccctacatgctgctggagcggataagctcgcagaactcatagtagtccaggccatcgattttgggggacctgcacggcgcagaggacaaggggaaatctgagacgcgatgccccatggggcatactccccgactaccaacttcactcccatcccttcagcgaacaagacccnnnnnnnnnnctgagacgcgatgccccatgggacatactcccagactaccaacctcactcccatcccttcagcgaacaagaccctccgcctgtacaaagtcttgggagcatctgaggaggccccattgtcccacccccgcctttagcaaccacgccagcccacctgcgccgtcctccaggggttcgtggcgaggatggcgtgcctggaacgctggtctccatggactcccggggggtggacagggaggcaccccctggagagggagggatgcctgcctccgactttcccaggccataggcagccgtgctgcgtgggatcctcagaggggaggccctcgagaggagcagcgggaagttggtcacagcgcctgcagcggatgaagaggagcggtgtgtgtgagtgtgtgcgtcataattatggcgatcgggtcccagcaaatgcctgccatgcacgannnnnnnnnnagtgtgtgcgtcataattctggcgaccgggtcccagcaaatgcctgccatgcacgacatgtccaccctgggatgtctgggagcaggatctccagtacccatgccctcccccgacaccccgctggcacaaccctagccacggccccacctcccggattctgtccagcagaggaggcgaatgtgctcctcgcatccaccgcaggccggtgcagggggcgctccacgctgtgctcgatcgggtgatccactgcgtcggtgccgaggtgacggagaatgcctcgtcagcgtgatttctcccatccatcggggcgtgcgcatctcgctccgcgtccctgagactgtgtcaagcatgatgatctactcactgtcttggccgacatgaagggagaagtcgttgaaggaggggctgctcgccattccgccggccgcggcgggagtaccggccaagtccgcctccctggacgttcgtctgtccaagctcacggaaagtcgtctgagaagagtcgccatggttcctcactccggcaaggtctgggttccgcccgcgacgcgccccagtgtttcaccgggacggtggcgtgagcgtcgggtccggggtcaactcgatctacagagtggtcgattgcggggtcaactccgacacggagaacgcgtcgagggctcacgcaaccatgctccaactctagcatttcccacaacaccttcacgtcatctcctcgtgcccctcgccctccgcaagcccttgggacccgtaacaggctcgcgccccctggtgtccccgaggaatgcgagctgatgtcagcttctcggcgggtcccatgggacacctgtccaatcccccagatcctgatggagcagtgtaacagaggaaaaggaaacaatcgatcctgcatcatgttggagggacaaatgcgtgctgtcgcgtcgatgacactgtgacagtgtctggggtgttggagtgggaggggcatccattgggctcagcccgtctgaaagcccccatccgattctgtgccgcggccccagctcgcttcaccgcggctggaggaaggggaattccgcgctgctcctcagcacctgcggcagcccatcgctctcccggcacgcctggtctatgaggtccagcagggctggcccagagggcaccggcgcatctgcgcggggaagaaggggggctggctcctgggccgggacacggattgctgattgggagagagggacaaggctcagcgaatgtgcccaggcacatgcgccccacccttccaggccgggtggagatcaggaggcacatggcatgccccagacccatggcgctcctctcccgttccacctcgccctcacccaggacggagtcggggcgctgcgccgcctgcacgaagcagcgcgccgcctccgtgagggcgcggcgcggcagctggaaggcctccattggctccacctgtcgcggaggggcacaggggcgggggtccaggatgacgaggaagggggtgggaccagggagcggtcgcttacgctagtggccgggaacacaagaccacccagggcatgcgcccgcgtcttgcacgatggggtcgaccatgcagcagctattaatccgactacaggcatagacggtgggctctgccggccatttcccaggcccatcannnnnnnnnnagcatgcgcccgcgtcttgcacgctggggttgaccatgcagcagctatcaatccgactacaggcatagacggtaggctctgccggccatttcccaggcccatcaccagaaaaacacaggagaaactgaccagcaggttttcctcctcatcctccctgtcccactcggcgccggcatcgtcgtctgcagaaaggacggagggagggtgggaccacttgttacgtgactctcgtcagcgacgagaggagagtattgggatctgccacagcaacacacatggcttcctcggtgactgcttgggggcctcgggcacctgccagcgcccagccagcctttgcccaannnnnnnnnnaatcgccgtctgcagaaaggatggagggtgggaccacttgttacgtgactctcgtcagcgacgacaggaaagtattgggatctgccattgcacacacatggcttcctcgatgactgcttggggcctcgggcgcctgcaagcgcccagccagcctttgcctaagtcatacccctgaacctcacgccacatccccacacc

SEQ ID NO: 41058 - DNA, 20797 bp, Chlorella protothecoides
  modified_base (217)..(226): a, c, t, g, unknown or other
  modified_base (554)..(563): a, c, t, g, unknown or other
  modified_base (1715)..(1724): a, c, t, g, unknown or other
  modified_base (2837)..(2846): a, c, t, g, unknown or other
  modified_base (3628)..(3637): a, c, t, g, unknown or other
  modified_base (3747)..(3756): a, c, t, g, unknown or other
  modified_base (4395)..(4404): a, c, t, g, unknown or other
  modified_base (5243)..(5252): a, c, t, g, unknown or other
  modified_base (5486)..(5495): a, c, t, g, unknown or other
  modified_base (5911)..(5920): a, c, t, g, unknown or other
  modified_base (6926)..(6935): a, c, t, g, unknown or other
  modified_base (7148)..(7157): a, c, t, g, unknown or other
  modified_base (7741)..(7750): a, c, t, g, unknown or other
  modified_base (7994)..(8003): a, c, t, g, unknown or other
  modified_base (8318)..(8327): a, c, t, g, unknown or other
  modified_base (8385)..(8394): a, c, t, g, unknown or other
  modified_base (8794)..(8803): a, c, t, g, unknown or other
  modified_base (9470)..(9479): a, c, t, g, unknown or other
  modified_base (9710)..(9719): a, c, t, g, unknown or other
  modified_base (10113)..(10122): a, c, t, g, unknown or other
  modified_base (10248)..(10257): a, c, t, g, unknown or other
  modified_base (10476)..(10487): a, c, t, g, unknown or other
  modified_base (10575)..(10597): a, c, t, g, unknown or other
  modified_base (10779)..(10788): a, c, t, g, unknown or other
  modified_base (10899)..(10950): a, c, t, g, unknown or other
  modified_base (11464)..(11473): a, c, t, g, unknown or other
  modified_base (12129)..(12138): a, c, t, g, unknown or other
  modified_base (12211)..(12242): a, c, t, g, unknown or other
  modified_base (13035)..(13044): a, c, t, g, unknown or other
  modified_base (13626)..(13635): a, c, t, g, unknown or other
  modified_base (13725)..(13734): a, c, t, g, unknown or other
  modified_base (14811)..(14820): a, c, t, g, unknown or other
  modified_base (15033)..(15042): a, c, t, g, unknown or other
  modified_base (15245)..(15254): a, c, t, g, unknown or other
  modified_base (17896)..(17905): a, c, t, g, unknown or other
  modified_base (18699)..(18708): a, c, t, g, unknown or other
  modified_base (19569)..(19578): a, c, t, g, unknown or other
  modified_base (19713)..(19722): a, c, t, g, unknown or other
  modified_base (19857)..(19866): a, c, t, g, unknown or other
  modified_base (20031)..(20131): a, c, t, g, unknown or other
  modified_base (20447)..(20456): a, c, t, g, unknown or other
gcgctccgccgccgagtcgtcggcggccagcaggtagcagcgccgcagcgcagccggcagcccggcggcgcccggcgcggcggccccgcacccgggcaaggctgcgcccagcgcggcgtacacggcaccctccacatccggcgagatgaacggagcagcggcggaggcggttgccccggctgccgtcgatgccatgagcgcggtgcggttcagggcnnnnnnnnnngtccggcgagatgaagggagcagcggcagaggctgtcgccccggctgccggcgatgccatgagcgcggtgcggttcagggcggggcacagcgcggcgccggtggcagcggggtcgatgtcaagggcaatcagcgcagctgcgagttgcgtggcgctcagcgcgcccaacgtggcgtcgtgcgacaggggcgggcctgtatcagacaccctgctcgccacccctgccagcgcagatatggcgcctggttcaatgaccgtcgccgcatacgccgccatcgcgccagggcagtcggcattcgtgccggcagagagggccaccagcgtctcnnnnnnnnnnccaacgaccgtcgccgcatatgccgccatcgcgccagggcagtcggcatccgtgccggcagagagggccaccagcgtctccaggccggggacgagtaacaggtaccgccccgtgcccgtgcgctgggcagcgggcatgcgcagcatcgcgtccacgaaatcgagcagggattcgacggggagcagccccgcgagcgtcagcgccgccgagtcgtgcagcgcggaggacagcgtaagcgcccggccctcgtccagggcgcagtcggcgcccgggcacgcgccctgagtgtttgtggggggtggggggtggtggaagaatcctggagggcaggcttccatgtgggcttcaggctgggcacggatcatcagcgccggggactggggtcaaggaccctccaggcggatccagcacatcctgggagctgctggggcccctgggccacacatcatcctgtccctcccaccttttttgaatgctaccggtagcccctaccgccacacatcccccttgttcccacccttccaaacaccgcgactcaccacctgcgtggcccaggccgccagggcctccagctgcgcggcgctgtgcagcgtccggaagaggccggtggcgttcacgctccccgcccaggcagactggtccgcgacgccgcccgtgccggccggcagcgtccacgctgcccccgccgcgggcaggcacagcgcctgccgcgcggcttcctcggcgcccaggccggcggcgggaagctgggccgtggagcagaaggggcccgccctgtcgggcagctggcccaccgcggccacggcactggcattgcgcagcgggagcaggggctgggtggcccacgccgtgcctgtctccggcaggccgccggccagggggtcggtcgagatgatggtcccctgcgccgccgctgccgcgaccaggatgtcgccaaagttggcggatcccagcgccctctcatgcagcagggcctgttggatgggtggtggggatcaaggagtctggctggtgcagaatggcagtgtaagaggacggcacgggatgcttgccaggctgccaggtctccgcctcgtcacgttcccatacacaacaaactcattgagaaccccccattgcgccacctccccccccccctccccccttcagacnnnnnnnnnncgccgcgaccaggatgtcgccaaagtcggcggatcccagcgccctctcacgcagcagggcctgttggatgggtgatggggaccaaggagtctggctggttgcagaatggcagtgtgaggggacggcacgggatgcctgccaggctgccaggtctccgcctcgtcacgtccccatacacagcaaactcattaagaatcccccattgcgccaccttccccccccaccccccccatcagacctggaggccgatctgcagtgtttcgccgcccagcgccacctccagcatgcgcaaaaatgtagctgccttggagtatacctccacgccgcccgtgccgatggccgcgtccgaggcggcgaccatggccggcctgaagggcgaggcgtcggtgcaaagcgcgcgcagcgtgggcccttcatgcacgccgggcagtcgggcctggggcaggggggcgcggtaccgcaacacctcccccggcgcgcccaccgccgtcaggcagtggtactccaggaaggaggccagcccctcgttgaaggccagctgcgtccagttggtccccgtcaccaggttgccaaaccactggtgtgccacctcatgacagacgacgtccgcagcgcgccacgccccaaagctgcctcccatggcctgagaggagatagaaggttggagggagagggggaggtgtgggggaatacgagtgtgaggctgtcaggccgcagaccaggcaatagttggggcaggagtcctcgcgaccaccatcaccccccgtccccccaacctggctgtggaggaagcgatgctcgtcaaagagcaggaggccccagttctccatggcgccctgcttgcctggaatggccacaaagtccacctgtggggtggacaggggagggatgctgtcgacaggggttggtggattggcatgtaaaagtctggggtgtactggaacaagcggcgggagagaaaggggcaatcaacgtaaaaatctggttcagaccgttgctgcctgctccaaattttcagcagcagacaatgctgagcacataagctcggcaaatgcggtagcagtggcatgtagcccaaagttgtgatcgatttgcctcagagacctttgccgnnnnnnnnnngtccaaatttcctggagcagacaatgctgagcacacaagctcggcaaatgcggtagcaatggcatgtagccaaagtggtgatcgatttgcctcagagacctttgccgccccagtcgacaccctatctcgtctccacaccttggtcagaggctgctcgatccccgtccaggcggtgtagaaagccagcgacttcaccgcgatgtcggcggagaaggctgccaggccctccctcccggggaccacccaggcctggacctggagagcctctactgcttttggcaggggcagtccgggcttcaccgccaccaggttcccggcagccaccgccagcaggtaggtcggcatgggcggagttgggtggaagctgtgtcgcaggctgcctggcgtcgtgcccatgcccactcggagaatggggctgttgctgagtaccgtcaggccgacctcgccagggacctgtgcaagtgtgaagtcaggtgtttcatggtggccacctggggtcgaatggaggctgaggggggtttggctgcgcgatagcatgttgaggttctgggcctcgctacatgaaggcacacgctgctgacactgcgcgtcagtctgcccgtcactgccatgaagagctgtgaaatgacaagcgcctgtccaaaggtgcagcaacctctcgctctgggccacaaccagggtttgggcctctcaggcaacccagtccacacggccaccctccgatgagacactcgtccgccacacaagagtgctccgccgccccacctccacagcgacgttgnnnnnnnnnngaagtgtgaagtcgggtgtttcatgatagccaactggggtcgaatggaggctgagggggattcggcttggcgatagcaagttgaggttctgggcctcgctacatgaaggnnnnnnnnnntcaccctccaataagacactcgtccgccacacaagagtactccgccgccccacctccacagcgacgttgtagacggcccgaaagcgtggcacatccacgcaggggaagacggagcgggcgtgcgtggcagccaactgcgtggcaaccagcgcgcgcgcgcagggcgcgcggtcgctcgtccccggcgcgacgcactccgcggcaaaggcttgagaccggtgcaggcccgcgccggcgcccatgacccccgtgtactcgaaggtcagcgcaggcgcggccccctccccggggtcgagcacgtcggcgcccaggtccaccgccaccaggtccgtgcgccaggtgtcgtccgagcgcgggcgcagctcgcgcagcgtggcgcggcaggccaccgcgtcggcgcagagcacgcgccgggcgccgccgccgcgccgcagcgccacgctgcgcacgctgaggccccgcgcctgcaccaccaggcagcgcgtccgcctccgcacgcgccaggcgatgcttgcgctggcgttgaagcgggggtggttgggggcgtcgacgccgccgtcgaagtgccctgcttccaatttgagcgtcaggttgtaggcggtgggcgttgcccagtcccagggctcgcctgccgccgcnnnnnnnnnntgttgggggcgtcgacgccgccgtcaaagtgccctgcttccaacttgagtgtcaggttgtaggcggtgggcgctgcccagtcccagggctcgcctgccgccgcatcttcgcaggagaaggaaggggcgacgggaggtggaggagcggaaatggtcttgccgctctgagcttccgctgggccctgccgggagcccagcgtcaggaagaggagtacgatggccgtgaggaggatcgccccgccgcccaataccagcatgccccagcgctgcttgaagggcctgagcgcattctgctggattcccctgtggggtgcacaagtatttgtaccttgtagaaggaagtggcaaagggtgggcgaggcatcacgcaacacacggatcctctgctctcaagacttgcggcaccatgcagggctccacattgccccagcacagacaaatttctatgaattcactgctcacccaaatacagactgtggcttgggaacctggaaggcgtcctggcgatttatgggagccatctccgaccatgggccctccacctccatgggctggatgggggccatgtctgccacagggggttggacctcgacaccctcctgagattgcgctctatattacacacatcacatgttggtgccaaatccttcacaggcgagctacctatggctcgcagggtggaggtgccgacggcacacgcctcgcacatggtgtctgttgtaccatcttgggaaaatcgggcgcgctggggcggggctcaaactttgagtcaggcagcgaccactctcgtgggaattgtcctccctatcctggttcaagctcagactgttcgaccgcagnnnnnnnnnncctcgtgggaattgtcctcgttatactggttcaagctcagactgttcgaccgcagtcactcatcaaaggatcgaataccagttacatcgccgcctcgcaccctgcctcagcatgtcggaggtggaggcccccgccgtggctacacctcctcccacagaagaagaagccactgcacctgtggacaccgtaccggagccagctgttgctgagggcgcacccacgcctatggaagannnnnnnnnntcctcctcccacagaagaagaagccattgcacctgtggacaccgtgccggagccagctgctgctgagggcgcacccacgcctatggaagaggatacggaggcccctcctcccgcgccagtcgaagatgcgcaggcacctccgtcctcctccgagcaaggcggggccgctcctcccccctcggcacctgcccagcccacggatgatcccaaggctgaggcacctgcgaccacttccccagaagcatccgctccggaggccccgaagaagacggagttgcctgtccgacagtacctcgagagcacgggtgcgtggtgcgactggctgcttcttccagtgtggcgaatgggtacgatcacccttccatgtgtagctcaagggggcgttgaagccccaatgattgcatcggaagccctcnnnnnnnnnntgactggctgcttattccagtgtggcaaatgggtacgatcacccttccatgtatagctcaagagggcgttgaagccccaatgattgcatcgggagctctcacctgccgatatacctcgtggctggctcatttgcacttgcatgcaatgtgagtgaccagccgcacacgcccccctttcaaatctgtagtggtgcccctgctgacatcaggcatgcagcagctggtcaaggaacgccctgcagaccccattgccttcctgatcgactacctccaagccaaccgccccaagccatctggcactgagtgacctcattgctgtacacaccctgccagccgggccactgggattttcaccatgggtggctgcagcccggccctgcaagcgtgatggttgcggcatacgcagctcccacatctgcaatggcagtgccatgcagcgccagctgctgccagccgctcagcagtgccgggccgtttggaatcatcatcagcaaggcttgcaagacctggggagtggtgggcgtctgcccctcctatgcaagtggatgtgagagagcaggggcccactcactttgagacgcggggctgggatggcaaggcggaccagtccatgaggcgggtccgcacacctaccccgtcacagccccaccctgagggagtcagcaatccatgcccgcggcagggcccgtgtcacatccagcccggccagccatgatcgcatgagagcttaccagcttgtgcacgaggctggggaaggaggactgcagggccagcgtcgtcgccaccatcagcacgccgacggtggccgccagggcataccagggaccgggggcgcccgccccacacaccccggcccacgcccaccagacggccagggccaggcggggcagggcagtgaggcgcagggcggccctcaggcaggtcgccagctcgggggtgggtgcccgcggccccggcccaggcgccgccggcgaagcatactctgcccagcgatgggcagtggcannnnnnnnnnggggggcccgcggccccggcccaggcatcgctggcgacgcatactctgcccagcgatgggcagtggcagtgccactgggctcctggggctcggcacgcgggcctggggttgcagctgagggttcgggaatcgcgccaggggcccccatggggcgggaggatgccggtggggccctctggtcgggtgcctgctccagcaccggctcggctgccnnnnnnnnnngtgcagctgagggttcaggaaacgcgccaggggcccccatggggcgggagggtgccggtggggccctctggtctggtgcctgctccagcaccggctcggctgtcgacgcatcctgcacctcaggccgtcgcatccccgtgagcgccgcgagccgctcttctgaccgggccaggatcttctgccggcgcagctctgaaggatccagcaccctcgccgctccagtgtcggacgccatcccaagtgaaggtggcgcgccgagacgccggtgtggacgagtgggaggacgctgatagattgatgagcgtatccaaagtattctgtggaagtttcacgttcctgtaaggtacagaactgcctcagcttgacgttaatgctgggtttctcctctccaccttgctcgggtgtccttctggaggccaatcaaggagagaatattacgctgaagggcgagcgtctctgattgtcgcgatatacgcactggtctcgaagctgtcgaacgattttcatgcatgggtgtgggagcggtcgtcagtttgcccctgttacagtaagcaggtggctgctgcagccgggcggaaggtgannnnnnnnnngatcagggagataattttacgctgaagggcgagcgcctctgattgtcgcgatatacgcactggtttcgaagctgtcgaacgattttcatgcatgggtgtggtagcggtgtcagtctgccactgtcactgtaagaaggtggctgctgcagccgggcggaaggtgatcgaccattcagaactactcatcagaatactgttagcaggtagaccagatcgttggcatcagattgaagccaggtgaatnnnnnnnnnnatcatcagaacactgtttgcaggtagaccaggtcgttggcatcagattgaagccaggtgaatggcaacgtacaggctcgtctatcgatgggagcagggaacatcacatgcaaggcgaaaacataccaatgtttttattgctacttctcatctccgccggtcgatgtagtataacggtcagtatacgtgcctgtcaaatggtgctgagtgccagtcctttctggacgcacgtgatccgggttcgattcccggcatcggcgaataacccttttgcggttttatcctatggcttcaggttggaaggtctacaatgttnnnnnnnnnngatccaccaccattggggcttgtgaacttggatgacatacgatgcttgcaggtcgagnnnnnnnnnncaacccttttgcggttttaatcccatggcttcaggttggaaggtctacaatgttgatgctggaggcgtttacgtcagcccttagcattgtagcatagcccgtcttggtgtatccaccaccattagggcttgtgaagttggatgacatacgatgcttgcaggtcgagcagaacagcgtcagtacaatgagcgagcagggcagcagcgggggacagggaagaggctgcggcctcagaccgacttcccgtgctcttctaggtccgcgggcgtcacaaactgcagcctgaccagggcgtagaacttgtctctgatcttcacgccatgctgggcccactggggtggggggagagcggagagattgagaagcacggggtcagggtggggctgagtcgagtgtgtgnnnnnnnnnntagagcggagacatcgagaagcacagggtcagggtggggctgagtcgagtgtgtgggggcgaaccagtggattggtgatctctcggcaatgcctcgcaggcgcggcccagcccttgggcacatctgccatgcgcatgcacagtccactcacacgcaaccaagccactgccaagcccgacgtctacccgaagggagggagcccgcttgccagcagcttgtgctgtgtcccttcccaaccaccgcttctcttgtccatggcccacgacgaccggtcccatccccgtcgccctgccagccaacatcacaccagtcccacctggagctcctcccaggacaggtccgggcagagcacggtgacctcgctgcctggcagcggcacgcccagctgccgcatgcgcgaccggggcagcgcctcggcgcagcgcgcgaagcggtattgctcgtcggtcgcgccctcctccccggccacccggctcagctcgtatcggtgcctgtgtggtgggagggatgttgcgggctcgaatgtgagcctcaaaatctgtccggcaaggcatcatgggggggacgaggttttgtctttgtgccggctggtgcccgcatgccaggataacagcatccacttgctcccccgcgtcccctccctctacgtccagcaccacacctcccnnnnnnnnnngtctgtccggcaaggcatcatgggggggggagaggttttgtctgtgcccgctggtgcccgcatgccaggataacaacatccacttgctccccctcgtcacctccctctacgtccagcaccacacctccctttcagggacccccccctctccctcccttctttcaccacccaaaccctcccctcccgtcccccccccccacaggaaaaccacgaccctcacgtgtggctctnnnnnnnnnnccccctcccctccccttgcccccccgaaaggaaaaccacgaccctcacgtgtggctctccaggtacagggtggcggttctcatgcgcgctgaggtccactcgtggggccgcaggccgcggtctgccaccgcggcggcgctgtacttgagccacggctcattggccaggttgaagaccacggtgacctcctgcgcggtgcgcaggcgggctccgctccccgccgaggagcgggtgaggatgcgctcgtggtgggagggggtgaaggtgggcgcgcccagcggcagcccgtccaagttggacgccaggtccacgctctgcccactgcgcagcaccacccaggcgcgttccaccgcaaaggagcagccctggggagaggggggggggggggggggcnnnnnnnnnngttgatgtgtgtgcacatgtgtgtgtcactcgacaggctgacaaagggggacccatgcttgagagcccttcccgcgatccttcacaacacacatcacccaccgtgactggggcggcccaggcccgnnnnnnnnnntgtggtgtgtgggcacatgtgtgtgtccctcaacaggcagacaaggggggacccttgcttgagagccctccccgagatccttcacaacagacacaacccaccgtgactggggcggcccaggcccgggagcggatgttgttgcgtgccactgatgggtacgagggtcttggggggtgggttcggagcaacacccgcacctctgccaccacggcgggaggnnnnnnnnnnnnaatgttattgcgtgccactgatgggtatgagggtcttggggggtgggtgcggagcagcacccgcacctctgccaccacggcgggaggnnnnnnnnnnnnnnnnnnnnnnnacggggtctgggcacaactgagatgcggtgagcaggtcagaaggatcccgtcccctaggaacgcattgtcaggcctcgcatgacgaggaggcaagcagggcagggcgattcccccactcagtccccctccgagcccctgccagacccagcagggccccccccccccccccacgaaagagggnnnnnnnnnntgcatgacgaggaggcaagcagggcagggcaattcccccactcagtcccctccgagctcctgccagacccagcaaggcccccccccccccccccccccacaaaaggggggnnnnnnnnnnnnnnnnnnnnnnnnnnnnnnnnnnnnnnnnnnnnnnnnnnnntagccacagtgcatgagcactgccaccacatcagaatcgtcggtgtacaagtcgcagccccagagctggcgggacctcacgtgccggttgttgctggtgaggcagtgggccggcacgcggatctgcggcggtggtcggcgtggggtggggagggtggcttggatcactgtgtggcatccctgccacgaatgcccacgcaagggagcagcagcgctgcagggcatgagcctcagcctcctcacctcgaggagttcggcgccgccctcacgttcgtggctgaggctgagatctctcaggggctcggtctccttgtacatgatcagggggccccgagtgcctgcacatgggttgggcatggacgcagggaatgaattgcatggttgaaggcttcggctggtcagaggaaggaggggtgggggattagtggaagtaagtactggtgtcgtcgatgccgccccccccctgcggtttcccgggctgtccgatgccatgaaccccgacattcccacatccnnnnnnnnnntaggaaggaggggtggggggttaatggaagtaattactggtgtcctcgatgccggccacccccctgcggtttcccgggctgtcagatgccatgaaccccgacattcccacatcccagtcgccaacgcagcgacgcagtgccagcgaaacgcaccgcttctcctgtaccctccacgactcccttcatccaatctcgaggacttgctgttgctccgatccccgctggagtcagcgggctggcgcttggacatgaccggagggttgtgggggtagccccagccagacgcaccctgtgacggggaggaatttgggttctcgctgcgcccatggtgatgggatccagtcgtgatgcacacgggcgccgtgagctggtacgcaccgcgcgagcggaactgcagagtgacacccacctgtgcttggcaggcgaggatgtcagcgcacccagcgacgccctcacacggtacaccgacaagaaatgtgcaaggatggcagcaaattcgaatcttggtgtcctgtcaatgatgacatcggaagacgactggattcgatgacagttcttcttctcgtgggtacaacggggggtgccgaggtttcagatcccggcaccccgcagcatgcaaaccagcaggcaactactttcaaggaatcactcccccnnnnnnnnnnatcttgtcaatgaaggcatcggaagacgactggattcgatggcagttcttcttctcgtgggtacaacgggggnnnnnnnnnnnnnnnnnnnnnnnnnnnnnnnncaggcgggcggaaaactgtcaacgcacttgccatacttgaattcgtacattctcagctctgcaaaaaaagcaacctcaagcagattagaacccaaggggcacatctgtagggggggtagaggcaaggacccagggcagtggtcatcatgccgccacctccgcggccttcccatccgcgctctctccgctctgtgccgcctgtttcgcctgcttctcggccaaacgttgcgccgtcttcttcttctcacgctccaggaactcctgtggattgggggtggtatggcgagccggctcagcgacagaggctccgagggggttgggaggtgaccatcccaccagtcggcccccactccagtcgcgccacaccatctccagtccgctgcccacaccttcatgatctccttggcggcctgcagcttggacagcacgttcttgtaggtcaggaggtcggcgttcacgcgctccaacggcacgcccagggcggacgtcaggccggagagggccttggggcccttggcccccgccagctccagcaggcggaagaggcccacggcgaagaagcgggtgtacaggaagttgccggacttgatggcctcggccgtctgtgccagtgtcttctggatctcgctgccctctgcaagggaatgacagggtctctgaggtcagtaatcatggtctccatggcaaagctatggcaaagagccacacgagagatgccaagcatcctacccccccgcatgcactcgggcatcaccataaggcttcagcgttctgattgaggaggcacttgatnnnnnnnnnnggcatgcactcgggcatccccaggagggttcagcgttctgattgaggaggcacttgatgctgcttacgcgagcgggcccaacccaccagctggctgcgtgagctgtagccccctacacaacacaaacagagtccaggccccccgcctctcacccctaaaaacccaaccattacctgcatcaggcttcaggttctctgggccacccaggctcccggcggcctcttcgaggcgccgtgcatcaccacggtattgcgccgggtcctcctgcagcgccttgatgaacgcctcaaagatggggtcctgctccggcagcccctccagcagctggtcaaagatgctgaccacgccgagggcggtgatggcgttgtaggagtaggtcacgttccagcggaacaggtgttgctgcaccagtagctcctggatgacggtggagtagatgcccggcagagggcgcttgaagccctctaggaaggcagccttggtgtccgccaccgtgggagggatggggtggtgctcatgtgtggctgcatcggggaggaggagggggggtcagggcttggctgacatgatagcacagcccannnnnnnnnnaatggcccagtggcaaatcccaccagcagcatgttccagagggaccctgcatggaatttcccatcacaaggcaccagggcattacatgcnnnnnnnnnncggagggatggggtggtgctcgtgtgtggctgcatccgggaggaggagggggggttagggcttggctgacatgatagcacagcccatgacggtgctcgccatgggaacggcacgatgccagcctgcaccagccgagttccaagcgacagtgaaggtgcctgtgacagtgctggcccagtggcagatcccaccagcagcatgctccagagggaccctgcatggaattccccatcacaaggcaccagggcattacatgctttcatggagacggccgaccggaggctgcgcctcgggcatgctctaaaagcctgaaagacgagcttcgacctcaccggccgcagactgcagagaggggcgggatcccatgagtacgcagctcgcatgggcaggcaatgatcgatacagcccaaattacaccgcgcggtgtgtggcctcaccatgtggtgggggccggggccaccgccaggcagggaagggctcccagcatcgcttccggagacctgcttcgtacgccttggaatgtggttatgactcggaaaatatgcgcgggtgggtaatgtgcggtgtctgagtgtctttatgaggtgcaactgctcccgggagtgccctggtctggaggatcacccccggtgtcgtttgcttggtcggcagcgcgcaactcgacaatgggaggctctcgtcagcatccattcagctaccaaatctagccttgccggtgtacacccctttcgtactatttcttcgctgtaatgattgacaaatatcactggcaagccgatgggtatcaaagggttgcatgcgcacccagcttgcgtttcaaatgctgggtggtctggcaatgcgcaggctgcttgtactgatgctcacaagggggggaaggatgactgcctggcgtcagcacacgacgcacgactttcttcgggtggctcggatcgaagccgagcgcgaggcaggtggctgcgcactcgtggcgctggctaccggtggggtactcgctgggcccggaaccggggcggtggcgccgtctgccggccgactcgtgtcaagagccggccggtgtgggtcgctgaccgcatnnnnnnnnnnggcgcggcaggtgcctgcgcacctgtggcgctggctaccggtggggtactcgcggggccggaaaccggggcggcggcgccgtctgccggccgactcgtgtcacgagccggccggtgtgggtcgctgaccgcatgctgtgccgggtgcgcacgctcaacttcctctgcgctgttcccccgcgtctctccaagcacgcccacatccggcgcctcnnnnnnnnnnagctcgctcaacttcctctgcgctgtttccccgcgcctctccaagcacgcccacatccggcgcctcaccagtctcctccgcccctggcgccgtcccttctgcgacaggggccaagcccctcgccacgctcgaaccggggacacccccctcggcccctcgcgtcccaggcgcagcgccacgtgggaccgtggccgcggtccctnnnnnnnnnnggcccctggcgccgtcccttccacgacaggggtcaagccccctgccacgctcgaaccggggacaaccctctcggcccctcgcgtcccaggcgcggcgccacgtgggaccgtggccgcggtccctgccctgaccgcggcgccggggtccacgtggccgcgccctcaggcgtggccgttggccccggaccgcgtccgggagggcgccgggccggcgggcgtgtgcagtaccagggactcgttgccggtgcccagcaggattgacgagcccctgcaggttggtcacgggagagggtgcgttggaaaccatgcgggtctgtccgcgcaacggacggatcatcggtgcagcaacgcggcgggaagggcaggggggacggttggcgggcagggtcctgctgtgtgacagcctccgtgctgttctcagggtgtatcgcttgccccaccacaggcgcggcttcccagcaccaaatgtgcggcttcccagcaccacaccggctcactggcagcgaacgggcaggagctcgtgccggcccaccccgcctcacaccctctaccctgtcccactcccccttccacaccagcccgcccacctgctgagctcgggacggtactggggccccggcgcgggcgcggcgccgatggccacaccctcacccgactcgcgctgctccccctcctccccctcctcctcgtccggcacgttctggccctggccgcgcaggatggtgagcaggctcttgggccggatgtgcttgatgccggacccgaattcgttcaccgacacgatcttgatcatgtactcgcccacccccgtgcgcgacacagtgacgacgtggtcctccggcgccagcatgccctggcgcaccgccagcaccaccgcctcctccagcagcgactcgcccgcgctgggcgtgggcgcggccagcacgggcatgagccccgaggtgagcagcgcctggcgcgccgaggaccggccctccagccgccagcgcagcccctcgcgcttcaggtagggcaccaccagcgtcatgatgggcatggcggggcggtacttggccaccagccccgccgcgcgcccggtctgggtcaccacgatgatcatggcggcgcggaccttgtccgcggcgcgcaccgccgacgaggcgatggcctccagcttggacaggcgcgccgcgccgcccgacccgccgctcagcaccgactggctgcgagggacggagggcgcgccgccgccaccgccgccgccgcccgcaccccagcccgccgcctcggaggccaggctggcgcccgacaggttgcgcatcatgtccacgcgcgaggcgtgggcctcgccctcggcggccagccgcccaccttcgtccaccaggtggtcaaagtgcgcggcgtggtcgaaggcggcctccgcctcgcgcgcgatggcgcacacggtgcgcaccgtctccagcgcgtacttgccgcggtacgtctcggcgcccagcaggaagccgtcggcgccgtccagcaccgcgttggcgatgtcggtggcctccgcgcgggtggggcgcggggtgtcgatcatggtgtccaccacgcgcgtgatcaggaccggcttgttcagcaccacgcaggtggagatcatggacttctggatcatggccatcttctcaggcgggacgtccaggcccaggttgccgcgggagatgatgatgccgtcggcggcgcggaccagctgcttgaaggcaaacaggctctgccgcgtctcgcacttggccagcaccttggtgtgccccgacccgacggaggacaggaaggcgcgggcggactccacatcctccgcgtcgcggcagtaggacagcgacaggaagtcgacgtcgaagtcggcggccagggaggccaccgcctcgcggtcgtaggcggtgagcaggggcaggtcgttctgcttgttggccaggccctcgctggagcgctcggtgtggaagacggtgagcaggcccgacaggaccgcgccggagagggcggtgcaggtgatgctggtctcgtccgccgcctcgacgcgcatgtagagcgaggaggcgtcggcgccggagaccaggtaccgccccacaaacagattgtccccgggctccaccatggcgggcaggccggggtaggagatgggaaacaggctggcgctgaaggcctggctggtgtcggtggtcagcaccaccgtggaccccgccacgattgtcgtggcgtcgggctcgcggtgcgtgccgtcgttgtcctgggccacgtcgcggttgaccatgatctcccgccccaggcagtccagcatcaccgcgcacagtcttttgagggttttgagaagggatgttttgtggggggtgccgggaatgtgcaccttttggtgacttggaggtccaaacaaccacccttcgccaggactccatgattccccacggcctgcactcaagcacgcacctccttgtcttcttcatggcttcctggaggttagccagggactgacggtggtaggccagcgagttccactgtgggcgagggcgagggaggcggtgtgaggcagccgaccgttggcagacatagcagcgcaaatgcggtgacagcattgcactgtgagagcaggcgcattggctgggtgtgatcttcctaatcaacggcctccaaannnnnnnnnngcgagcacgcacctcctcgtcttcttcatggcttcctggaggttggccagggactgacggtggtaggccagcgagttccactgcgggcgagggcaagggaggcggcgtgaggcagccgaccgtcggcagacatggcagcgccaatgcggtgatagcattgcactgtgagagcaggcgcaccggctgcgtgtgatcttcctaatcaacggcctccaaaatagaccagcgcaagccgggaaagatcaataccaggtgccctgcttctttcatcgaccatgaatcccaaacccaaacagctcacagcccctcaccgtcaggtcgatccgtccgcatgttccgccagcctccagcagcttgcacagtgtttcaacagatcgactgccggatccaatggtgaatgccactggggagaggagggacggccgaagtctcagcaaattgacctccatcgctgaacggcgcagccaccaagcccccaaaaccccaactcatcgaggctggcacacaacctttcccgacccgtcctcaccctttgtttttgtaaaggagccatcaccatgtgtggcgtccgcatgcagcacctgccgcaagtcgttattctcaaaaaaatgtgtcttggccttggtcgtgtgagccgtggccattttgcagcaagggttttccgcgctaacaggtctcgcgagctagaggggatctcactatgtgcaaggatcccaatcaaagcctgtatgtcaagctggctgtggtccagcagggtgggtcccggactggcccatcaggtgcggcctgatgcnnnnnnnnnntgaggggatctcactatgtgcaaagatcccaatcaaagcctgtatttcaagctggctgtggtctagcagggtgggtcgcggactggcccatcaggtgcggcctgatgccgaagggttgatgccccagaaatccacaatctggcgggaaactcgaggcgtgtcggaagtccccccctccttccggggtcctcccaagaatatgccgccgaaacgcgttggcaggtacgctggatttcgtcgagatggcctctatataggggatcctctggagctccggcataaccctgtctcatactaatatctgggtactttggcttgttcggtcgtggtcggtcagtccagagtactgctccccctcccaagcccaccggggcgtgcctggccccagccaaccgcctgtgaccatgcacgccacttcaatgctcgggaccgtggcgcagcccaaaaccctttgccggcaagcaatgtccgctgtggttccccaggccgcaagcgttgttcgaccttgccagtcgtcccacgggagatcgtcggagagtgcaacccccctggccccggcccccgagaggttacagcgtcgacagtcgcatatcgagcgtcgtgagaaggtccatagcatgctgctggagtgggaccgatactgctgagcgcctagcgcctggcggacggagataccggagctcgtacacggcctcgactccacggacgaggggcgggggcaacctcttgcgcccatctctcgccccccaccttagaccgacctgtacattcgttttgagcgtgattcagcaaaaaaaatatctctcatcagcttgacgtactggccgcagcggccagagagaagattgcaactcccagatnnnnnnnnnnacgcctgtccgattgcagattgcacggcccgcaccaaatagcgagtatacttgtcattgtaacaacgactggtacagcacagcaaacagggtgccggcttctgatggatgcggggcagaggggaccggcctcagnnnnnnnnnngcgcctgtccgactgcagattgcacggcccgcaccacatagcgagtacacttgtcattgtaacaccgactggcacagcacagcaaacagggtgccggcttctggtggatgcggggcagaggggaccggcctcagnnnnnnnnnncttttgaccgacctgtacattctttttgagcgcaactcagcaaaaagtatcattttctcatcagcttgacgtactggccgcaccggccagagagaagattgcaactcccagatgtttttcaccccagaatcacttcctccctggcactgcctcctgggaaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagctccatggcctccggcgcggggcccacctccacatactgagcgacgtcgaagcggcgctccgccaccaccgctgcgcggtataggatgggtgggggtgtgtcaggggaggttgggctgcatgacatgcagctgggcaggcggacgtcgtcaaagtggcaacccatatgataccaacacattttccagccgaagaactccagccaggctggcccttgctggcccgtagcccttcccgctacagtcctctccaaagcccgattcagcatccgcctcccccatccccgcgctccccatataatgggcctcccgnnnnnnnnnnaatgaattccagtcaggccggcccttgctggcccgaagcccttcccgctccagccctctccaaagcccgattcaccatcccccgaccccctcccccgcgctccccatataatgggcctcccggccccagcctgccgtgccgcaccccctttcccccttcccaactcacgagcattcccggacttgatgaccatggggtgcgcccgctcgtacgtcttgccctgcaggtactggtgattgcgcaggtactctacgctgccgcgcttgatgacgcagatgtccacgtttgaccccgaccccaggtcgttgtacaccccggccctggagggggggagggggggg

SEQ ID NO: 41059 - DNA, 123 bp, Chlorella protothecoides
cctgcaccgccccaccacaatgctcagcctccatgcgtcgagttgcactctccattggaataggttggctgatcaagtgcccaacatggaaaaccccctgcttctgcgcccccggacctctca

SEQ ID NO: 41060 - DNA, 76 bp, Chlorella protothecoides
ccctgttcactcacccgtctccccacccccattcagagtgcacggtatcaagagcgggcgcatgctcaaggagttc

SEQ ID NO: 41061 - DNA, 2580 bp, Chlorella protothecoides
  modified_base (508)..(517): a, c, t, g, unknown or other
  modified_base (951)..(960): a, c, t, g, unknown or other
tgccctggctgccggaggtgatgcggcagcgcgcgggggaggaggcggccgaccagctgccgccgggcaggcgcagcgactcggcgccggcggtgtgctgcgaggctcgcggggtggtggccgccgaggacgcacgctccccgcccgcccctctgccccggtcggaggccaccagcgcctccacctggctgcgcagcgcggtcagcgccgcctccagctccgacacctgagcggcatgctttgcgcgctgggccgacagctgcgcggcgtgctcctccttcagctgcgccagctcggaggcacgcaggccggggccgggcagcgccgcggccgactgcgcgcggggcgagggggggaagatgtcgggcggtgcgcaacacctcgcattcccactgctcgcatgcttgcacacggacctcgcctcggatggagcacgaacccctcccattttcgctcttctttcccccactccctttcttcctcctcatcccagctcacatctcgctgnnnnnnnnnnccccctcccattctcgctcttctttcccccactcccttcctttcctcctcatcccagctcacatctcgctgctgctgcaggccctgcgcctcctccagctccgcgaggtacccgagctccacctcctgcagcctctgctcctgctccagcctcagagccgccagctgtggagagggcgttgggttgtgggagtggtggtgcggtcgtggctccgttggcagggaaggggacgctgcactgccacgaggcgtgcaggcagcttcgaatgacacggggatctcgaagacctgggcaccccccccccaaatcatctcgcaggtgcttattgtaggatgcaaaacctcgctcagcgtgccacgtcattcggtactgtccagacccctcattcccaggccacacgccccacctcctcctcgtgtctggcctgcagctcnnnnnnnnnnatcattcggtactgtcctgacccctcattcccagaccacacgccgcacctcctcctcgtgtctggcctgcagctcctccagggccttggccgtggccgccttttcggactgcagcgcttgttcgtaggaggccagggcctcctgcatgccgccgctgccactgttcgacgacatgtcctgggggagggtgagggggccttgatgtggatccgtgtgtcagcactctggtcagctgtcgtgccctgtccaggcctggatgggccccaagacacatcaatggttccagttctcaaagcacagattactgtgggggctgcacagagaccacaggcttgggcagacatctcccttccccacccctcctgcctttccccttcaatacgtgcctggtcggcgccagggcgctggtgtgcgggggaggcaacctcccgccgcacctcgccgctcgcgcgcaggtggctgagccgggctccgggtggggaggaggtggcgctgccccccgactcgccgcccgcccttgccatgagcagcgcctgggtggccaccagctcccgtgtctccctctccagccgggcctgcaattcctgagtctcctgggcgtgggctgcccccctctcgcgggcaccctccctggtttgcaaggaaggggacggaagggccatcagtgtgtgtgccaggtggagagactggcctcgcacacccaaggccctgacctcccgcccccaccagaaactgccacgcaaggtcgcgcactcctgtgtatctcatgacgcaaagatcctgctcaagcagcctttcctcccaagaaaaccgacctgcttgcatcgagttcgtgcctgcacgcctccagctcgtgctggcaggcctccagcctctccaccgccgctctttcccgggcctgcgccacgccaacttctccagcaagagcctgcagccgcgcgacctcccccatcgcggcctccagctgggcctcagccgcgcgcgtcctttcctcagcgtcccttacgcgcgcctccgcgtcgtacattgtgccgccctcctcctctccatcgccgccttcggcacgcgaggcgacgctgccctccgccgaggacgccagggacgccccgccggcgcggccgcgcagcaggtgcgcctggcgcttcgacatgcgcaccgcggatcccgccgcggccccgcgcgccctggcggccgccagctcggcgtcgcgctcggccagcgagcgctgcagcccggacaccaggtccagaagctgcgacaggtggcgtgggtcggcggcgggctcgggcgcgactctggcatccttcctgtcctcctccacccccacgccctcctttcccgccagcagcaggagctcggcgcgcaggtgctcggcctcggcctgtgcggcctgccgcgcctcgctctccagccccaacccgtgcctggcctcctccagctcgcgcgcgcccgcctgcgcggcggtcgtcacacggtccagcacgttgcggagggcgcgcacctcggtgtcccggtcggtggccagttccgcgtcgcgcgcgcggcgcgccagcgcctcgctctcctcctccgcggcacgcacgcgacgctccgcctccgcgccggccccccgcgccgcct

SEQ ID NO: 41062 - DNA, 67 bp, Chlorella protothecoides
caggccccacaggtggttggccgccgcgggcaccccctgcaccacctcgcacaggcaggagaccagc

SEQ ID NO: 41063 - DNA, 80 bp, Chlorella protothecoides
ctgggcgcagagccgggctgagagccaggccccgccccatgttggccgaagcggccgcgctgttgggcacttgtgaggat

SEQ ID NO: 41064 - DNA, 97 bp, Chlorella protothecoides
agttccttgcaaggtttattgtggcgaagacaagataatatttattctccgctctctgggtctcttacatcgtcgtctgagttcagcagtgacccgg

SEQ ID NO: 41065 - DNA, 61 bp, Chlorella protothecoides
cgacgccgcaccagaggagctggtccggcgcggcgaccgcgaggctctggccgacggcgag

SEQ ID NO: 41066 - DNA, 61 bp, Chlorella protothecoides
tgttgtatggctggcgcgatgggacgggggggacgtgggagggatcactttacaaatgact

SEQ ID NO: 41067 - DNA, 122 bp, Chlorella protothecoides
ccactgcgaccacctgatcgaggggaccaccgccccccagagcgagcgcgagaacaagtacggcggcgtggcggacctcaagtacgccaacgtcaccaacaaggaggtgtacgacttcctgg

SEQ ID NO: 41068 - DNA, 68 bp, Chlorella protothecoides
ggccgcctgtggcaaggagtaagaagggaacttaggtgctgggagagggttgcactgcaggggttgac

SEQ ID NO: 41069 - DNA, 85 bp, Chlorella protothecoides
ggccgacgcgagcagcgcctccagccgctcgcaacgctcctctgccgctgtcaggcgctcgcgcgcgaagacggcctccctggag

SEQ ID NO: 41070 - DNA, 61 bp, Chlorella protothecoides
agcgcctacatcaccaaggtgcacccttccgaacacacacagtctcccagagctctccgcc

SEQ ID NO: 41071 - DNA, 75 bp, Chlorella protothecoides
agcaagaggaaggcccgccagccaattcccatccccaaaccatggccacttgccgtagatgcgcccggacttgag

SEQ ID NO: 41072 - DNA, 3287 bp, Chlorella protothecoides
  modified_base (1240)..(1249): a, c, t, g, unknown or other
  modified_base (1315)..(1324): a, c, t, g, unknown or other
  modified_base (1647)..(1656): a, c, t, g, unknown or other
  modified_base (1734)..(1867): a, c, t, g, unknown or other
  modified_base (2265)..(2274): a, c, t, g, unknown or other
  modified_base (3008)..(3017): a, c, t, g, unknown or other
ctccaccgaccccccccttcctccccaccgccccagtccctgctggcagagatccggcagcgcgaccccaattacaatgccaataaggcacagtacctggactttatactggcctccggagtcacgcccctgatcgcggccacgcaacgtggaaatctgcagtgcgcggaagtggtgcgttcttgggggcgggctagtgtggcgatagttcttatgtgccttgacataaagagcctgtgttcaccgataatatatgagcgggggtcgtgtgttgcgatcaaaggacaagcccccccccccctgacctccttcatcacgcagttgatcgccgcaggcgccgatgtgcacatcgtgtgccccagcctggatgggaacagcgcactgcacgaggccgtgtcccgcaagcaagacagcttggtggaggtgctgctgcaggcaggggccaacccctgcgtcgagaatgccaagggtgggtgtcatggttttgggtggtggtcccgaggtattgggaagggtggcagaggagcaggtggcgtcatggtcgtggccaatcgttcacgcaggccgcacgctgtcgccccattcgttcaattgccagcacaacgaacctgtgctgggacctgacccccccccccttgctgctctttcttccgacccatctatctccctccgtcatgccccttccacacaagatggcttcgcatgcctccctcccacccacccctcccggccactccccctgccacccgtcgccccctcacacacatacacaaaccaaaactggtcatacccacaggctacaccgcgatggacgtggcctgctcgcgccgcaatgtcagcgtgctgcgcctgctggagcagcgctcgcccttcaagggctggctgtacgtcaagactgccacctttgccgggctgagccgcgagtggaaacggcgctggtgcatcgtgtgccaccgccacccctacccgcgtgcgcccgagggccggcgcctgatccacgtggtcctgctggcctaccgcgacaccgaggccgtagcccccgtctgccgcgtctggctggacggcgcggtggccacgcccatggccagcgccagcgcgcaggcacgcgtgcgagggcacgggccggcacaggccgcgctgaagctgcaccacaagcacgaggtgccggcgggggcctacaccacgggctacgccggccaaggcctcaccatgtacctcaggtggtggtggtgtgcgtgtnnnnnnnnnnccgcgcaggcacgcgtgcgaggacatgggccggcgcaggccgcgctgaagctgcaccacaagcacnnnnnnnnnnttgggggggggggaaggggggaggaggctttgtgtggggtttgtgcatgggagagggtcaccaaggaagggacgagcaagccgcatcgcctgcctgtggctgggatgccatgagggggcgagtgtcgttggcatgccttcgctcagattcaacgtccatgcgatgaaggggcctgcgccgttgcactgcactcgcacgcctttggggccattgtcgggttaccggctgagttgtcaccaaggagatccgtagtctccttctccctcctggcccactcccatcatcccttcttcccagcacaacacccccacactcacccccannnnnnnnnnctttgttgtgggactggtgcatgggagagggtcaccgaggaagggaagagcaagccgcatcgcctgcctgtggctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccggctgagttgtcgccaaggtgatccgtagtctccttctgcctcctggcccactcccatcatcccttctccccagcacaacacccccacactcacccccacccccgcgtgccccctcacaggcccgactacggcgaccaggcggtactggatgccttctccgccttcatcgccctggtcaacaaccgcggcttcatcccggcaggggccaacccctcctcgcagccggtgcccaacaacctgcccgccacgccccacggccgcctagcagaccgcccaggaggtgggtgagggctggtgtggggtttctgctgggagcagggtgtcgtgcctggggggtagaggagggtcggggccctgggtctggcatcagaggggccgtgaatgggccgggcnnnnnnnnnngcaacctgcccgccacgccccacggccgcctggcagaccgcccaggaggtgggtgagggtcggtgtgggctttctgctgggagcagggtgtcgtgcatggggtttacaggagggtcggggccctgggtcaggcatcagaggggccgtgaatgggccgggcagccgtcatgtgctggagaagtcccagatgtacgttgttctcaaaacaagaacagcatgtcccaggattcctcgctcactgacacacgcactgcacctgcagactggggcgtggctgctgggggagcgggggcctctggcggcctcggcggcgcccccagcgacgaggagctggccaggcggctgcaggaggaggaggactctggtgcgtgggcgatgaacgtgatcgcagtcttgcctgtcggcgatcgcaaccgccccgcaggggcaggctctgcttgcgggcccctgtggtgggcatgcgagtgcgtggcgtcgcatgcccatgcacccagccacccggcctgggagccacccaaacccttgcgtgacagacaggagccccagggaaccctatcccatgaaccccgttacccccctcccttcccgcacagcctttgcggcccggctggccagcaatccggaggaccaccccgcggcctcctccaacgcctccttcgccagctccgccggctggcagggctcgggccaggccggcggccgcccaggccctccctcgcccagccgcacccccnnnnnnnnnntggctggcagggcccgggccaggccggcggtcgcccaggccctccctcgcccagccacacacccgccccgggtggcgcgctgtaccctcgcatcgactacgagcagcgctacgccgaccaggcggcgcccccttcccctccgcgcctcccctccagcctgcagtccacgccctcacgcatctcggcgccgggcacgggcgcgggacccctgggcctgtctgccctgggagccgccgcgcaggcgcccagcagcgccggcgccgcggcggg

SEQ ID NO: 41073 - DNA, 64 bp, Chlorella protothecoides
cctccacccagccccttccttccacccagcaccccccctccacccagccttcctcctccaccca

SEQ ID NO: 41074 - DNA, 72 bp, Chlorella protothecoides
gggctgggtggaggaggaaggctgggtagatgggaggggcttggtggaggaggaaggctgggtggtggggag

SEQ ID NO: 41075 - DNA, 127 bp, Chlorella protothecoides
gcagcgacctggcgcgggcggctgcgccccgcacgctttcctgggcttccagacgccctacggagcggcggcggcgtacggtgcgggccctctcccgcagcacgcttacccgcagcaggcatacccc

SEQ ID NO: 41076 - DNA, 382 bp, Chlorella protothecoides
  modified_base (131)..(319): a, c, t, g, unknown or other
ggctcccactcaagtacacgcggatgttgcaccagggctggatgctccctgggggtgaaattagtcattcagagcagcactgcaggcgcacacctgaggtcgtcaagccggcgggatgggagcagctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcactacagatccaggcctgacccttgccttcacccagcaaagccgcaggggagcgacac

SEQ ID NO: 41077 - DNA, 61 bp, Chlorella protothecoides
tcgcctgttctcctctgacccagcatcttcacccgtcgtacgacaggcaacacgcacaagc

SEQ ID NO: 41078 - DNA, 9383 bp, Chlorella protothecoides
  modified_base (600)..(609): a, c, t, g, unknown or other
  modified_base (853)..(862): a, c, t, g, unknown or other
  modified_base (1319)..(1328): a, c, t, g, unknown or other
  modified_base (2340)..(2357): a, c, t, g, unknown or other
  modified_base (2539)..(2548): a, c, t, g, unknown or other
  modified_base (3007)..(3016): a, c, t, g, unknown or other
  modified_base (3458)..(3467): a, c, t, g, unknown or other
  modified_base (3682)..(3691): a, c, t, g, unknown or other
  modified_base (4090)..(4099): a, c, t, g, unknown or other
  modified_base (4233)..(4242): a, c, t, g, unknown or other
  modified_base (4694)..(4703): a, c, t, g, unknown or other
  modified_base (5303)..(5312): a, c, t, g, unknown or other
  modified_base (8458)..(8467): a, c, t, g, unknown or other
cggtgggcggcgccgggggcggcagcgggcacgcaccgacgcccgcggtcgcgccctccgcggccgccgcctggcgctcgcccaagtacgaccggcccagcgtggacatcgagcgctgcgactccagcggctactggatcgtgagcatcgcgtgccgcgaccgtcccaagctcctgttcgacacggtgtgcacgctggccgacatggactatgacatctggcacgccaccatcgacgcgctgcccggcggcggcgcggtgcaggagtaccacgtgcgcccgcgtggcggcgaggtcgcctgggatccggaggccgcggcctgcctggccgccatgctggagtcctccatccagcgccgcttccccgccggggtcaagctgcacgtacgctccgtggacaggtttggcggcctggccgacctcacccgtgtgctgtcggaggcgggcctcagcatcactcgcgccaaggtacgcacctacgtcaacagcaactccagcgggcacaccttttacgtcatgagcaagtcagggcagcctccagacaggcaagtgttttattagttgaaggggttgtttggaggggagaggagggggatgctgnnnnnnnnnnggggcagcccccagacaggcaagtgttttttcaatgggggggattgtttggaggggagaggagggggatgctgtggaggagaagggtcgggcgattgtttgtttggtgatgcgctgaagacaaaagagcccagcatgaaaacgtatcgcgtggagatgggtgagtagggactcgtcgcttgaggcggcgttgccagggctcaggccgagatcatcctcccctgggactctgtgcctcaatgcannnnnnnnnntcgggcgattgtttctttggtgatgcgctgaagacaaaaaagcccagcgtgaaaacgtatcgcatggagatgggtgaggagggactcgtcgcttgaggcgccgttgccagggctcgggccgagatcgtcctcccctgggactctgtgcctcaatgcatgcactcagggccccccctcccctttccacacctctcctgtaggacgaggatccaggaggtgtgcacgcgcctgggaggcaacctggtggaggctgggcaggagagccagtcctccagcctgggctcccaccgcttcaccttctccttcctcaaccgcagcgccggtgagtttgggtgctcctgggaggaggaacggtcggagggccttgatctgcaagtgcttgcaagcacctgttcaagagcttcactccccctaacaccctgtcccttttaaacctctcccatgcaggctctcccannnnnnnnnntttgacctgcaagtgcttgccagcacctgtcccagagcttcactccccctaacaccctgtcctttttaaacctctcccatgcaggctctcccatgtcctcctcatgtggatcagtgtagaagtagagaagaaactggtgatgggatggcggggcgaggattatgtgagaccctcctcccccctcctccccgaccaacgcccttcttttcccctctttctgccctcaagatgattgcacttcctacccacccaacccccctcccactcaaccctgtactcatctccccagcttacctcgaccactgcccctgtctctcccccaacccgcacgggcacgctccacacttccttttcctgggactgccggctccgccacggggttggcacaccatgctcccacccaataacatgcacactatccccgcaccctcgagcatttgtttctttcttgccacgcgcctgtggcaaacacgtgcatacatcgatgttgccgtcccttccaaaccgcaagcatttggcttgacgtcttccccacaccgcgctgaccctggagcctggcgtgggaggggagggggaggggccggcgcccgcgccggccaaggcctccgagcgcccgaaaaccttgccttcacccttccccactcccctccgcggccctcggccatcttgctgctgctgcgctattgcgtaccttgtctagcaatgtagcgtgtcatgctggagtcgcgctcccataccgtcgccggagctcaccttttttgctcaggagctcccgtgtggaaggtgcctggtgtgcgataggcgaggcaaacgaccttccctgccgacccaggcatcatccttactactctgtggccttggacgagggtgggccccgcattgccccccccctctcaccctagcgttgctcattgcttgtccgatatgatgagagaagtgtaagcgctgtcgtacatgacggacggggatgatggtggcaagggacgtgaggggggcatggcctgtggcaggnnnnnnnnnnnnnnnnnngcgcctagcagcggtgcgccggtggcgccctccgtggggctggggagcgatgcttgcggcctgtgggaggcaggtgggtgggggaagggagaggatcatgtgtcgggtactgggaggagaagtcgactgagctgaccaacacaccgactccaaacccagagcgcccccactggcaactcgcnnnnnnnnnngggggaggatcatgtgtcgggtactgatggagaagccgactgagctgactaacacaccgactccaaaacccagagcgcccccactggcaactcgcgcgagcccgcactttttggtggtgaggcaggacaggatgcctcggcccacattggcccggcccagcgggtctgcgcccccgcccagaaaggcgttgaagaaagcgcggaggatgaatgggctcgcggtcctccccgcaaaccaggacttgcgcgtggcaatcgggtctgccgtcacaactacggagccaagtgaaggggggtccgggggattggaaagatcactcttgccggtgcaccgaatcagtcaaagaaggtcccaacacacaatgtcacctggcatgccccgtgtggtggcatgcaggccagggctcaccaacaccattgattcaagcgcatgcactctgctgggatcccagctcccannnnnnnnnnttcaaagaaggtcccaaaacacaatgtcacctggcatgcccccatgtcgtggcgtgcaggccagggctcaccaacactattgattcaagtgcatgcactctgctgggatcccagctcccaagcctggccccctcaacaaggcacccccacctcccaccttccaccaccaggccacggttctggggtcggggggtgaagatgaagatggtgccggcggggacgtagggcgccagctgcttggatggcgcgggcacatacttctccaccagctggttcacggcgtccggcaccttttgccgcagcctggacaccaggctgccttcctcggtgggcgtcttggctgtggggagggtgaggaggccgagggggtggatggccggggtggctcagggggcaggatgtggtagccggatgaggggcggcaggggatgtagcagctgcnnnnnnnnnncccggggggggctcaggggccaggatgtggtagccgaatgaggggcggcaggggatgtagcagctgctgcgcggcttacagcccttgcaaacatacctgtgcactccactgtgtcgcagggacgcctggctaaaccatgcagcaggtcaccaccccctccgacccacccgtcagcgcggtcacgaaacgctccagctccagctccgcgcccggcnnnnnnnnnncacctgtgcactccactgtgtcgcatggacgcctggctgacccatgcagcaggtcaccacccactccgacccacccgtcagcgcggtcacaaaacgctccagctccagctccgcgcccggcggcgccccctgcgtccggctcagctcggcaaagctggaccccagcccccccgtcagcgcgtcccgcagggcgggcatggccatgggccggtgcgtcacggccatcagcgtcagctccaccgcgtcggcgctctggatcacgtcgttccagaaggcgccctgcgcgtccccactgggccgccgtcgcgcccagcgtgggcacagctcccggcgcaggctctccgggttggcatctgggtgtgtttgtgcggtgggggttgggtgggtggggggctgggnnnnnnnnnnggccagtcctgatcggcgcgaggaccttggtgcacgccgtccctggtcccgagacacatgctgcctcaaactcccgcctggcgggcggctgtggcggtgctccctgggatccccatcgtcccctgcaggccccnnnnnnnnnntgccagtcctaatcggcgcgaggaccttggtgcacgccgtcactggtcccgagacacatgctgcctcagactcccgcctggcaggcggctgtggcggtgctcgctgggatccccatcgtcccctgcaggccccgcctccccttcccccatggcaccacaccgcccacacacatatgccccacgagatgtcccgctggcgcggcaggagggcgggcagcctccgcgtccactcggcacggggggtccacactgcgcccagccccagttgctcctgcagcaccgggggtacaggggttccagggtccgtcaatcgaccagaagcagatgcctcaaggccactctgcggccttcctggatagtacgcacggacaaagccctgcatgaaacaattcaaggggactctaggcgcgggtgcccgcgcgacccaccagggggagcttggcttcatcccnnnnnnnnnntccttcctggatagcacgcacggacaatgccctgcatgaaacatttcaaggggactctaggcgcgggtgcccgcaggacccaccagggggagcttggcttcatcccgcggccgcaacacctccttcttggaatcggggcggcgctccgtcccaatctggtgccgctgggcgacccagcgcggcacagtcctgcaagagggtgcaggaaggaccagggtttgagtggagcagtgaggaatggggctgcagaggcgggcgtccagcgcagcgcaagccgtgcctaggcacctccctccgtcaccgtgaccatgcatcatgcagccagcgcactcacccaccctcctagggcaccctgcgcacctggaggtctcctcgtatatgccctcgtcaaagtcatcctcccgctccaccagctcctccccacacgcctccaggctctccgccaggcccctgcggaggcccgcaaccttacgcggctggcgatgctccacttcttctagcagggcggagcgcagctctttccgcgcgtcttcgggcagacgtgccaaggcatcgcagagctggggtattgaggggaggtgtgtcggacggagctgtgcnnnnnnnnnngcgtgccaaggcatcgtggagctggggtaatgaggggaggtgtgtcggacggagctgtgcaggaatgggaggagtgtgcatgcccagtcaccctcctctggcatgccggagcagggagaccctgcttcccatgtggtcgtgcatgctcaccttttcgagcttctctactgcttcgacttcacgtggatccctttgctcacccattctcgccttcactcgtgcgagagagctgcgctggccaccctgcagcagcagaccgacccgctacacctcggcgcagaaggcagcagcctgccaaagtcactcgctctagcctttatgtatcagaacattatgtgtgctcagaaatgaatatagtgtgtcgaatatttggcatccagggatgcatgcatgagccccattggggcctctcgtgcgatgctcggttttcatagcgatcaggtaggaacggtaccgcagagtgtaccgctggggccgtcgcccactgggaccccggtgtcctcccctcccgactccgcataaggggacggcgcgggtcacactcttcccttttggctctatttacaatgcgtgccaaggtaggatgtgtggggtagattctcgtgtggatgtcggcgacggaaggacgtcggatgcttggcgggccgtgatgggccggcctcgttgtttctgatatgtggaacccttggcactcctaaacccctcactctcttaacgatcgcagtggaggaagaagcgcatgaggaggctgaagcgtaagcgcaggaggcaaagggcaaagtgattgtcggccgcagacccgcagcctttccgctgccctgtctttgctcccataacagccatgccttgagccgcgcagcgatgtaaagcgcgaggtgggcaatatacgatgtacagagggggagtcagaccatcggtgggctgcggacgggagtcgggcaggaagtctgaacaaggaggctggccttggcagccagtgggcctgccatcacttcgaaccctctgggtgggcaacctgatatcgcagcctcggatcatatcagtcacatcgatatcgtccaggaactccgaagtttgagctcaagttgcaggggctggaaggggtcgcatcagggttgggacaggaaagcgcctagggagggtttagacatgcacataaagcagcagcctctgtcacatacagcccaaaacaacagcaaacagagtccatgggacatggcttccctgaaatgatgttgccgtgtgctctacacatggagttcctaggactgaacggtacaacagggctgttatcgcaagtcataaagccatcagtttgtgggctactgccactcctgcagggttgtccaaccttgccaatgccatggactaacacaatcaaagcagtaaggccaatgaaaaccactagtttttggcagcactgcgtgtcatgatgcaaagcaccgagcttccatggcccatatcccaacggactactccctcgtgctgtcgttgcgggagcccttgcggtgctgaacttgccagtctcgaaaacattgccgacagaggccttgtccaaatgggacggatctaagactctggtgcgcatgtgttctcccactgtcccctccacaacaaaatccatcatgggctgatatattgcctcacgaacgcagcgcgtggccgacagctgtgatcattgttgcagcagacttgggattgtatcgacatggtgatgtccaccataagccaagggggggacggccctgcatcgggactctcgcattcggttgaccctggcattcgagtgaaaccggcatcaatgccatactagagtgcaacagacgcgttcacgggtattcaatccccggcatcaacggcttgtggattgcctgcccgcagggtagcaatcatcatgggccagttccgtgtgctgaatctcttcaagccgttccagaaggtcatcccagaggtgcagtcgccggagggcaggcggataccgttcaggtgcgtgtcggatcggatcagtggttgatgtcctcgcggaactatcctctgtgtgccactcttccacgtgaatggcgtcaggctcagccccggaccccgagctgtcacccgcagggaccggctaggctacaccctggtctgtctggccatcttcctggtctgctcgcagctcccactctatggcgtcaagtcctccgccggtgctgatccgttctactgggcgcgcgtcatcatggcctcctcccgggggacggtgatggagctgggcatcggccccaccatcaccgcggggctggtcacgcagctgctctccgggtccaagatcattgatgtggactacagcgtgaagagcgatcgtgatctgatgtgcgtcccggagggtttctgttcagggagcctgagtggttttgtggggcgtgggggtcggttgggcactcagaggaatggcttccaggcccaccgagtgcgtgcctcactgcgcctcctggcctgcctggtctgcttctccgcctcaaaattacttggcggcgtgtgccgagcgccaagtgtgtctgcagtacccactgcacacccggtgtgcgtcacccgtgccctctgtgccggatcccaagttgcacagccctgcgcccctccattacccaaccccctcccaaactgatcctccctctcacacagcaagacggccgaggcggtgctgggcctgatcatcaccgtgggccaggccatcgtgtacgtgtacaccggtatgtacggcgcccccgccgagatcggggtgaccaactgcgtgctgattgtgctgcagctgctggtggcgggcgtgctggtcctgctcctggacaacatgctgaacaacgggtggggcctgggctccgccatctccctgttcatcgccaccaacatctgcgagagcatcgtgtggaaggccttcagcccctacaccctgaacgccgggcgcggccccgagtttgaaggcgccctcattgccctcttccactttgtgctcacccgccacgacaagaccaaggcgctcaaggtctgttgcttccctggggagagggtgtgtgggggtggggtgcaagagtgtgtggcagggaggttgggtcggagaggggggatccaaggcaaggcatgcagcctggagggtgctcacagccatgagnnnnnnnnnngggagtttgggtcggagagcggggatccaaggcaaggcgtgcagcctggagggtgctcacagccatgagacatgcacgtgtatgccggccggccgtgccgctccacctcgatccaaagcacgtggccgatgcgtgcatgtccctctttctttacacactgctgaaagggcgtgccattgcaccctgaaaaagacaccctctcccccctgttcaacaaacctaccgcccccaccggcccccaggacgcattctaccgccccggcctgcccaacatcatccagctgctggccaccatcgccatcttctgcatggtggtctacttccagggcttccacgtggacctccccgtccgctccaagcgcgcgcgcggcgcggcctcctcctaccccatcaagctcttttacacctccaacatgcccatcatcctgcagtcggcgctggtgtccaacctctacttcatctcccagctgctctacaagcgctacggcggcaacttcctggtgcgcctgctgggccgctgggccgcggagggcgcgggcggccagctcgcgcccgtgggcggcctggtctactacatctcgccccccggctcgctggccgcggcggccgccgcgccgctgcacacgctgctctacgtcgccttcatgctgggcgcctgcgccctcttctccatcacctggatcgaggtcagcgggcagagcgcgggcgacgtcgccaagcagctgcgcgagcagcagtacttcctgcagggtcaccgcgacaccacctccagcctcaagcgcgagctcaaccgctacatcccaaccgccgccgcctttggcggcatgtgcatcggcgcgctgaccatcgtggccgatttcctgggcgccatcggctctggtgggacgagaagggagggggaggggacggagaaggg

SEQ ID NO: 41079 - DNA, 63 bp, Chlorella protothecoides
cccgtgccgccaccccgcgcaggtcagggcgcagtgtgtgtgtgtgtgtgtgtgtgagggggg

SEQ ID NO: 41080 - DNA, 61 bp, Chlorella protothecoides
ctgtgagtggtgggtatatagagcggcaggggttggagaatgcacattcgactcgtgaagc

SEQ ID NO: 41081 - DNA, 61 bp, Chlorella protothecoides
tcgcttggatccgattctcccgactgggggggctggttacccccacccaggtgcacccgcg

SEQ ID NO: 41082 - DNA, 375 bp, Chlorella protothecoides
  modified_base (122)..(265): a, c, t, g, unknown or other
ctggcccaccccccgcaggcgctccaggccttgtgggagccgtccaggcacacctttgccgtgaatggggcggggaagagcgtgcccgggcccctcaccagcgggctgcatgccgtcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggaggaggagggaggggaggaggaggagcagaccgctgggccgggcaacacagggaggcccagcgccctcggccccgggagccccgtcgcgccgggcctcgcgtcgt

SEQ ID NO: 41083 - DNA, 68 bp, Chlorella protothecoides
catgggttcgaagctgcagaggagacgatgtagtccacggggccttgctcaccctcacacaaaacttc

SEQ ID NO: 41084 - DNA, 61 bp, Chlorella protothecoides
cgccctgaccctgccggagacccccatccccctcaaggtggcccgcctcttcctcctgtcc

SEQ ID NO: 41085 - DNA, 80 bp, Chlorella protothecoides
catgtgccaggccaggccccgtcgcaggttagggaggatccatgcgacctgcgacagaagcacctctgtgctggctgtct

SEQ ID NO: 41086 - DNA, 61 bp, Chlorella protothecoides
gacagctctccatgccttccacgcatgcgatgtgggacatgcattccctcttccaccctca

SEQ ID NO: 41087 - DNA, 61 bp, Chlorella protothecoides
tgtttttctaagcacagcaacagcgtatagcgggtagtttgactggggcggtcgttttcta

SEQ ID NO: 41088 - DNA, 12118 bp, Chlorella protothecoides
  modified_base (132)..(283): a, c, t, g, unknown or other
  modified_base (369)..(378): a, c, t, g, unknown or other
  modified_base (464)..(473): a, c, t, g, unknown or other
  modified_base (685)..(694): a, c, t, g, unknown or other
  modified_base (1136)..(1145): a, c, t, g, unknown or other
  modified_base (1839)..(1848): a, c, t, g, unknown or other
  modified_base (2439)..(2448): a, c, t, g, unknown or other
  modified_base (2953)..(2962): a, c, t, g, unknown or other
  modified_base (3460)..(3469): a, c, t, g, unknown or other
  modified_base (4085)..(4094): a, c, t, g, unknown or other
  modified_base (4585)..(4594): a, c, t, g, unknown or other
  modified_base (5781)..(5790): a, c, t, g, unknown or other
  modified_base (6275)..(6284): a, c, t, g, unknown or other
  modified_base (6588)..(6605): a, c, t, g, unknown or other
  modified_base (7086)..(7095): a, c, t, g, unknown or other
  modified_base (9054)..(9063): a, c, t, g, unknown or other
  modified_base (9402)..(9411): a, c, t, g, unknown or other
  modified_base (9689)..(9698): a, c, t, g, unknown or other
  modified_base (10117)..(10126): a, c, t, g, unknown or other
  modified_base (10389)..(10398): a, c, t, g, unknown or other
  modified_base (10772)..(10781): a, c, t, g, unknown or other
  modified_base (10848)..(10857): a, c, t, g, unknown or other
  modified_base (11115)..(11124): a, c, t, g, unknown or other
  modified_base (11755)..(11815): a, c, t, g, unknown or other
ccagctcggcggcgcgggcctgtgaggccgacagccgcgcctccagctccgcggcgcgtgcgtcgcgctctgccagcgcacgctccagcgcctgcgcgccgcgctgagaggcggccagctcggcgcgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagggggacgtagtggaaggggaggattggtaagaggaggcaggggtacaggtgggtaggtgtgaagcaggggctgacaggnnnnnnnnnngaaaaggggggacgtagtcgaaggggaggattgataaggggaggcaggggtacaagtgggtaggtgtgaagcaggggctgacaggnnnnnnnnnncagggggcacatggattagaagaagccgctgcactgcagacatatggcttcgtgtcccatgacatgcctcagccagccacgaggaattcaaacctcctccatatcctgccctttgaagtgttcatcagatgacccgtgcttgcccttcataggcgaacaaaaaccctcacagcaatatggcacccaactacgtcacaccgaacgacaggaannnnnnnnnncaggcgaaaaaaaccctcacagcaatatgatacccaactacgtcacaccgaacgacaggaaaacaaaccttctcaaaggcatcagcgcgctgctgctgcgcctgcttctcctccagggccttggagtgggtggcaaccaggctggagtaccggcgctcgatagcctgcgagcaggggaggcattgaggatgaggccacccccccatggtcgatacttaattatccagtcaacattctgcaattctaacgccagatcatgtgccctgagctcctgtggcctcgagagcccccccccccccgcaacgagtaacctcacgcctcacccgggcagcctgatcggcgctgatggatgctgcctcggagtgggcacgacatagttcaagctcccgctccagctctgcgatgcgagcatggcttgccgggggatcctccattggggggnnnnnnnnnntgagagccctcccccccccccccccccccaagacacccaccccttcacccctgctacagcacgcctccgtcccgctgctgaaggagatgctgctggtcgtcgacctcgcgcgcgtggcgggcacgcgccatgatcgcctcgtggccgatcgactccagcgcaggctcctgcacgacgaccagaaggacagcgggctcctgccggtgcggtaaatgtggggggccagtgcctcagctcccactgtgctgcctgatgtcccagggcaatccaggcttgagcctttgcattgcgactgccatctctacgttgagaggaccactcaattcatggaactcagtctccaggatggcactgagcgcacaaataatgcccacttccacttctccacgctgggtcgtgcaggttctctcccggctcatccgcggctacaactaccgcttccagcccaggagccatgcactggagctagtggaaagcatgcacatcgtgctcggcatcgtggaccgcctggtggcagcgggtagggtctgtgtcttgaagcgcgagagagcgggtggatgacagcagagcagctgcgcatcggcctcgatgcaccgctgcaaatcggctgctgatctcaatggctcacatgagcgtctgcctggtgggcgcatacgaccatgatctgggacaggctggaagcctgaagctcctnnnnnnnnnntgatgcaccgctgcaaatcggctgctgatcttaatggctcacatgagcgtgtgcctggtgggcgcatgcgaccatattctgggacaggctggaagcctgaagctcctcgcgcggtgcatggcaagcttgaggacaaccttacaaaagctttgatccactgacaccacgcagagtcgggagacttccgggtgtgcaccaagaaaaccgtggcgctccagagcaagggaggagaaggcgcgaatattgcagccccagaggagaaggcggcgcaggacgccaccggagaggacacaggtggccagagtccaccggcgtctgcgacgtcagatccgagtccaccgatggtagagggccagggggatgctggcgaggtggagagcgctgctcctgctgggcagtctccggattgcgtatcccggcgagcagccagtgagacagggtccggggacagaggaagccgtggcggcgggtcccctgctcagttccatgccgctggcggcacaggggtggtgggaagggacgcatcgccccaggagtctcccaaaccggaagcaaggggccggacgagcgtgaggagggaggtcgcctttnnnnnnnnnncccatgccgctggcggcacagaagtggtgggaagggaagcatcgcccgaggagtctcccaaaccggaagcaaggggacggacgagcgtgaggagggaggtcgcctttgatgcggagcgccgcatccggcaggagtgcgcccaccccggtgagtctgatgggggtctgggggatgtgggagccttgaatgccactgcagtgaaaatggtacccatgcagattctttcattgtaggtttgtttgtggcaccacacctaccactctctcccctccacctcccatggcagcgatgatccactttgtgacctggctcctcagcgggtacagggagaacagctcctttgcaaaccatgcgctggtgtcctttctggagagggtttcgtccccaaagagcatgaacttggagcctatgttgtaccaggtgacttggcggtggccaatggatgcttcgggatgggtcctctgttgctgcattgctttgacatatattgatgcacggcacatgnnnnnnnnnnagtggacgttgtcttgactcagtggcaggggcatcaacactggattgaggggacaggccagtgctctggcagcaatggtagacaatggatgcttcgggatgggtcctctgctgctgcatcgctttgacatatattgatgcacggcacatgtgtgaactcacgtgcagctgctgtgcatgctctggctcctgaattctgtagtctcaactcactgcttccctgtgttacccccagatgagcgttctccggctctttcatgccatcctagcggaccctgcagctcgtaccgtcccctccctcaagccggccttggccctggcgaccagggtcacacggaacctcatggccaggtgggctcggcttgccgtgcgtgggcgggagtggggcctccacagggcaagaggaacacaggttgcatgaaggcggccccatctaaaaaaatgtctggtcgtcatccccgggcacgacttccacggtatcataggctggcgcccccannnnnnnnnnggggcgggagtggggcttccacagggcaagaggaacatgggttgcatgaaggcggccccatccagaaaaatgcttggtcgtcatccccgggcacgccttccacggtatcataggctggcgcccccagagacgcctgacgagctggatttggacgctgcaagaccagagacagacccagacaaggccgcagccgagcagcaggtgcaggcgggcaggggggggagcggagggagaaattgcggggacctcccatttgcatggcaggttcttgcacacagacagtgcaattgtcgagcagggtggtgccaggtcatgccacatcagaggccttgccgccgctccctgctttccagatcaaggcttcctgtaccagcatgctcttcgtggagctactcttctggaagtccgctacagtggccgaggacgtacgggagcagtacaactggagggtgagacttgggagacgcaacacctggcatccagctcgtggctggagtgctcgactgccggggaagatacgggctctgcatgtgctgtcagggtgtgcacgtcgattgaagtgaaacctcaagggaccaccccctttctcacccctcaaccatgcagaagctgctgnnnnnnnnnntttgaaagacgcgatacccagcatccagctcgtggctggagtgcttgactgccggggaagatgtgagctctgcatgtgctgtccaggtgtgcatgtcgcttgaagtgaagcctcaagggaaccccccctctctcacccctcaaccatgcagaagctgctgaatccagcgccagcccatgctgtggcaaagagacggctcaactgcggggctgacagcgagagcgaggtggaggggcctgggaccgagccaggcttggcaggcctcccacggagatccagagccggcaccttcaccgaggtgcaggtgtgcggcctccccttgctgcgatgccccagggagtttgcggacttgactcttccctgccagggtgcgggcgaggctacagccccgccccctctctttctgaaccaacttccatgccacccctccccctccccggggtgctctcaggccaacgaactgcgcagggcgttcgaagcctgcaacggcnnnnnnnnnngcccccctctgtttctgaaccaacttcaatgccacccctcccccgccccggggtgctctcaggccaaggagctgcgcagggcgttcgaagcctgcaacggcgctaaggactgcctgtcacgtgtggtccaggccctgggaggccgcttcaagaaggtccacgtcagccgccagctggctgccatgggcctggccaaggggaagttcacgcccgaccaggtgtgtgcggggggttggcaaaaggttgttctggccacttgacctccagaacataatgacaccagaacccacaccctttgaccctggtgctgaagcttgctgcccccaagtgaccgcaggacacactcctggccgcgtactgtgaggagtacggcggcagcacgcccgacggccgggcgctcatcgcagagcgcttgaacgccggtttctcggccacccaggtgaagcggcgcttgcaggccctggggctcgtcgcgggcccacccactgccgccggcaagcaggctcgcgattggcaggccctgctaggatcctccagtgacgaggatggcagcgaaggcgaggcggggcctggcgaccgcggcagctcacctgtcggggacccagcggtggaggtccggcctcctggcagcgttgcctctgctctggacgctgaggagagcgggatcgagggagagggcggggccgagagcggcagtcaggcgagcgccccgccgggacacctgagcgcggctgagccccctgaggccgccgcggcctcgcccgagtccaaacgtgcacgcctggaaggtggggaggacgtcgagcaagcggcggctcggcgcaaggccgccctgcaagccctgcgccagtgccggctgcagcagcaggtggcggcaggggagccagagtcccgtgcatcggaccctgagccgctactctcagccagggaggcgatccaggctccggacaagtcgagcggccgtcgtcgcctgaagaaggcgggagccgcccccgcctcgctgctgctggacgccggcctcatggatgaggatgcgtagaaagcgattgcatgcgtgcgctcttgccccaatggcgtactcccatcgcaacaagccctcgcatcatctgcatgcacctgcactcgctgcatcaactaggcaccagtcgatcagcatgccgtcaatgttacaggggccgatcgggccnnnnnnnnnnccaggcaccagtcgatcagcccgccgtcaatgttacaggggccgatcgggccacgagcgggtcgggatcagagtcaagaacttctcacaagctcaatccaggggccggtccaggctggcggccagggcgcggcgcaggtccgccccctcctccgcctcctcatcggagctgggggggctggagggggccacgccgtcggaccccgggccgggcgtcctcccggccaacaccttctcgactgtgccaggcgccacctcccgcgcccgggcttcctctgcctgcatggcggtggcgatgcgcgacatgcgcgaaatgctctcctccaggcgtgcgcgcagggaggggatctgggccgccgcggcctccagctggtcctgcagcgcctggaggccaggctctagggccggaaaaacaggctcgcgcgacgccgagcccgcgtcagcgtccgcctccgcggggcttgcctcagacgaaggacgggtggnnnnnnnnnngaaaacgggctcacgcgacgccgagcccgcgtcagcgtccggctccacggggcttgcctcagacgaaggacgggtggaggccaggcgcagcgccagctcctcctgcagggcagtctgcatcgaggtgcgcagggtcgccacctgctgtgcagcgaccgtcacctctgcctccagggcgcggacctcctcatccatcggaggtggggggaggagtgggagtgctggggagccaaggcccctcgcagggtccagagctcccagctggcccctggattgggtgcaggtggggacttgttttggagcnnnnnnnnnnnnnnnnnntctctggccaacctgatgggaatccaggcgtccaggagggtggctacttgatcctgatcggggccatgggaaggaagagacaaaggaccttggttgggaacatgcctgtggctatcccactccagccacacatcaggagtagatgctgcaggagtccaggcacctaccactttgttatacagctcagtttcaacatccgtcccactcgtctcgggggaggcctggaagggtgagacgagcatggcgaaggtcacaatatcgcacatcggtacatttacaaatacttcatacagcggcatcgccacactcacctgcaaatggtccgcaagactctgttgcagcaggtcgtgcagggtctgccgatcccctggtccctgcaattgcacgagtgtcgccatgttctcgtcgacagaatcggcgaagtacagaattaagtccttggtgtagatcaatctgtagcgtgccttcggaaccaggtctnnnnnnnnnntgaagtacagaatcaagtccttggtgtcgatcaaatctgtagcgtgccttcggaaccaggtctccggccacacgctgcgcgcagatctctcgggagcttgtggtggacaggtggcagttcaaatgacatggcagcatgcccagcacccttgcccctccgcctctccttgatggttgggcagcatgctcctgaccccatggcttgctgctggtccttcagaaggaaattcatgaaattacaggaggctggttgaggtgcatggtgggcttcgaggagctctgctgctccctgtgatgcaggagacgagcgggagtgggggcctcccagcccagaccggcagcacccacaagcatggctcgctgggctcctacctggcctgcctgcgggacaacccctccttcacatggctttggatagcagaggcagtcaacaccatggggagctggttcaagtgagatgtgggcgcgtcgaaggtgcccggtcgaggccctggtccggatgctagcgtatggcagccccccggaccccagggggcacacccgacccttcttcagcccccgccccggccccttcctgcagctatgtggccgtcttgatcctcgtcaattcctactctcaaggctcgggcctcgcactcgctggcgtggtgctgctgcacttcctcccgtccctggtcctggcacccatcacgggcatggtggccgacaggcgagtgggtgcctccgcaggcacgagcctgccgggggatgggctgcaccctgtctgcctggccacttgtccccggccgagcacccctcgaccaacctccccacccaccctccacaggttcaaccgggtcggcatcctgatcgccacctccctgctctcctgcgccgtggtctccgccctggtgaccgtcacctcgcgggagcacacgccgcggctctacgccctgctctccctccagttcacctgcgtggccttctacaccccggcccgcactgcgctgatgcccgtgctggtggcgccccgggacctgcctgccgccagcaccatagacacctttgcctggtcgctgacgggggcggtggcctccagcctgggcggcgtggtcacctccaagctcggcgtccgcgccgctttcctcctggtgcgatgcgcgcggcctgcacatggcgatccggggcatgcagcgctgggcggtcggtgccgtcggagtcggctggcaggagcgccggggtgcaggtgcacggctacccccactcgctccccagagcaccacagggcacctcaaccatccaccctccgtcttctccttcccgaaacgcacaggatgcagtcacgtacctcgtcagcgcggtctgcgccgcgcaggtcccccgagcgctgggcgtgccgggggcgcccgccgccagcaccagggcccgggagggcgaggcacagcccctcagcctggagctggcggcgatggaggcggtgggctgcgacgggggcgcccgcaccgcgtgcggcgagggctcggcctcggactccgagccggagcccttggccagcgccggacgcagcagggcgctgcctggtatggccagcgtcggacgcagcgggatcttgagcagcaccggcagcatcaagcagggcgggatgctgcacagcgcggacagcgcagtgctccggtatgactttgggtcgcagctggccgctggctggcgcacagtgacggaggggtgcaggtatctggcagcccccgagaaccgcgacgtcgcggccatggtcacgctcaaaggcgcaggctccctatcctggggctgcatggacatcatgaatgtgaggcagcgtcagccagggggtggatgttgaatgaggtagaggggtggaggaatgtacctcaaggcaggctgcatcgtgtgatgagtggcagggatgcgcagggtgcctggcgccgatcgcaggcccgcaggtgcaggatccatggcacatgtnnnnnnnnnnatacctccaggcaggccgcatcgtgtgatgggtggcagggatgcgcagggtgcttggcgccgatcgcacgcccgcaggtgcaggatccatggcacatgttcccctgtgaacctcgctgcctttttatttgtcgagcgctggagtgcctctcctctcgtgttcctgcaggcaccctgcctgcccgccgctgctattccaccagaccagttcccttgccaacccactccttcctcttcaccccttcttcctccatcctcctgccttcccccagctgtctatgcctccgcacacaccctccctaccccaaccccttccaggcccggctcagcgacctacccnnnnnnnnnncacccactccttcctgttcaccctttctttctccatcctcctgtcttcccccagctgtctatgactccgcacacacactccctaccccaatcccttccaggcccggctcagcgacctacccgagatgcagcacctgggtgacgcgccgcagacaatgggctacatctttgccatggtgggcgtgggttgcctggtcggccccctcgtcctgaacccctgggtcccgccgcgcgtgcccctgctcctcgccgcctgcgccgggtccctcacgctgctcnnnnnnnnnnctgcctggtgggccccctcgtcctcaacccctgggtcccgccgcgtgtgcccctgctcctggccgcctgcgccgggtccctcacgctgctcagcatcagctacgccgtcatgctggcggcccccgggatcgggctggtcctcctctccaccttcatccgcgccctgggtgagggtatttatgtatcggaggggggtgtccctggaggcattctgttgcgagggttctgttgcgagggtaccgcgacgcccatcaaacactgggcctggttggcgcaggcagggccctgcagctcggccagaccgccgtcgccctcaccggaaccgatccgcccaggtcggatatcgactcgcacccacccacccgtcctgcacgctgcccctcgtacatgccgcaggctccgcgaccgtgtggatcttnnnnnnnnnntactgggcccggttggcgcaggcagggccctgcagctgggcctgaccgccgccgccctcaccggaaccgatccgcccaggtcggatattgactcgtacccacccacccgtcctgcacaccgcccctcgtacgtgccgcaggctccgcgaccgtgtggatcttcagtagcctggccctgcaactgcgcgtccccggcgccctcatgggccgcgtgtccgcctgggagatggcgctctacaccctggccgagtcctccagtggcnnnnnnnnnngctgcgcgttcccggcgccctcatgggccgagtgtccgcctgggagatggcactctacaccctggccgagtcctccagtggcctggccacaggcctggccctggatctgggccacgcctccctccgcgccgtgctctgtggcactctgctcctgtccgccatccccacgctgccctggctggcctgggccgctcgcctctggcgccggcggcggcgcggcgacggcgccggcacggagggcggtgccgccgcaagccggagcggagggagcaccacgcacgaggagcgcggcgtttatgcgcgggtcggtgtggagggcgatgccttgcctctgggcaccaataagtccctggatctggggatgaggccccgannnnnnnnnngattctgctccgccggggctggttttggcgatgcgggactggtgagcctgcacgccgggcggactgnnnnnnnnnngtatgcgccggtcggtgtggagggcgatgctttgcctctgggcaccaacaagtccctggatctggggatgaggccccgataccacgtcgaggtccaggccacggtggcgggggaggtggcgtagccatggtggcccgagccactcgacctacgtgagaccgccggcggcaaggaccacgcccagggggctgcgtccggccgccgctccccgccgccgcgcacacccggcccgcggattgggcagctgctttgccgacnnnnnnnnnngcccgagctaggtcagaccgccggcggcgaggaccgcgcccagggggctgcgtccggccgccgctctgcgccgccgcgcacgcccagcccgcggattgggcagctgctttgccgaccgcggattgggcagctgctttgccgaccccgaattgggcagctgctttgccgaccccggattttgcttcgccggggccggttttggcgatgcgtgactggtgagcctgcacgccgggcggactgtgccccacccggtgccctccccgtgactctcccgtgaccgactgaggttgtatacacaagcatgccagcgccgccccgggggggcgggcagggtctcaacgaggggcagaaagggggacatgggtggggctgcttcgcgctctgggcattccatgccacgacgctccggcgtgaatcagaacggcaagggatggtgtccaaggggggggcatgcagctcagagcgacagtgctgaagggtactaccgatgaacggtgtgtgtgaggaatggggcaaaaaggagcagggaccatggatgggcggagtgtggggggttgttctttgcgcagtgttggagagaagtggtaaaatgcagcaaggtgacgtgccgacgccgtcccccccccccccnnnnnnnnnnnnnnnnnnnnnnnnnnnnnnnnnnnnnnnnnnnnnnnnnnnnnnnnnnnnncgcggtgccggcggcagcgaaatggcagggggggaggagcaaactggggccactcccatacttttttttcatgcacccaaaaatctcgcagacatgggaagtggaagaaaatcgggtatcggttcgtcacatgcacgggggcggggaccaagagggccgcggcaggggagctaggggcccccgcgacggggccggagaggaaaacgagctaaaagtatgggcgagatgaggggtgcagggcgtgaggtggggtgtggagtgggcggtgtgcgggacgggggttgtggggggggggcagggatg

SEQ ID NO: 41089 - DNA, 61 bp, Chlorella protothecoides
cccccgtgcccccgcccaccgatgacgagcgggccagggccaggttccgcgaacgtgagtg

SEQ ID NO: 41090 - DNA, 61 bp, Chlorella protothecoides
gagagggggaggacgcggggctggccgctgtggatggggaggtcgcagggctggctgccgg

SEQ ID NO: 41091 - DNA, 80 bp, Chlorella protothecoides
tcaagagggcgacaggcttccagaggacacttgctgtcgatgtggcatgtgtcggaagggagcctggaggagggagcagg

SEQ ID NO: 41092 - DNA, 64 bp, Chlorella protothecoides
cctcccacaaaccctgggtatctcctccctgccccccccacggccagacctgcatgccgagcgc

SEQ ID NO: 41093 - DNA, 61 bp, Chlorella protothecoides
tgggctgggggtcgtcctcgcccagggtcaacgtggtcaggcccataagcgtggcgacgtc

SEQ ID NO: 41094 - DNA, 64 bp, Chlorella protothecoides
tggtgctgccactgggtgatggtgatggtgtgcatggggctgtgccctttccctggcctcctcc

SEQ ID NO: 41095 - DNA, 395 bp, Chlorella protothecoides
  modified_base (126)..(323): a, c, t, g, unknown or other
gtgcgaatggagctgcaacaagttccccgcgacaaaggcgagcacaccctggattaggggtgggacacgggcataaggctgcagcagtaagtatttcatgcatgcaaccagcgatggatgcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccgtctgccaacctttggaggagcgctaggggcacaagggtagctgggacgaccaggtagtagctgcg

SEQ ID NO: 41096 - DNA, 91 bp, Chlorella protothecoides
gtcgaggccgtagcctggagagctggcaccatgttgcatcgccgaggatcgattcccggcgcccgcctcccaaaccccgcctcccaaaccc

SEQ ID NO: 41097 - DNA, 61 bp, Chlorella protothecoides
gggggagcgggagcggtacaccgcgtgccccgccaggctgcaggtcttcagcagcgggatg

SEQ ID NO: 41098 - DNA, 61 bp, Chlorella protothecoides
gagctagacgtctggccgaccgaggtcggcaccccgctcggggaagccagcccctcctcta

SEQ ID NO: 41099 - DNA, 12579 bp, Chlorella protothecoides
  modified_base (167)..(226): a, c, t, g, unknown or other
  modified_base (1177)..(1186): a, c, t, g, unknown or other
  modified_base (1389)..(1489): a, c, t, g, unknown or other
  modified_base (1614)..(1623): a, c, t, g, unknown or other
  modified_base (1751)..(1766): a, c, t, g, unknown or other
  modified_base (1866)..(1875): a, c, t, g, unknown or other
  modified_base (2323)..(2332): a, c, t, g, unknown or other
  modified_base (2439)..(2448): a, c, t, g, unknown or other
  modified_base (2714)..(2723): a, c, t, g, unknown or other
  modified_base (2989)..(2998): a, c, t, g, unknown or other
  modified_base (3381)..(3554): a, c, t, g, unknown or other
  modified_base (4954)..(4963): a, c, t, g, unknown or other
  modified_base (5173)..(5182): a, c, t, g, unknown or other
  modified_base (5802)..(5811): a, c, t, g, unknown or other
  modified_base (6014)..(6023): a, c, t, g, unknown or other
  modified_base (6236)..(6245): a, c, t, g, unknown or other
  modified_base (6383)..(6392): a, c, t, g, unknown or other
  modified_base (6842)..(6851): a, c, t, g, unknown or other
  modified_base (7472)..(7481): a, c, t, g, unknown or other
  modified_base (8060)..(8069): a, c, t, g, unknown or other
  modified_base (9198)..(9207): a, c, t, g, unknown or other
  modified_base (9677)..(9686): a, c, t, g, unknown or other
  modified_base (10063)..(10072): a, c, t, g, unknown or other
  modified_base (10431)..(10440): a, c, t, g, unknown or other
  modified_base (10864)..(10873): a, c, t, g, unknown or other
  modified_base (12128)..(12137): a, c, t, g, unknown or other
  modified_base (12488)..(12497): a, c, t, g, unknown or other
cggggccggcggcgtaggccacgcgtgcgcgcgccaggcccaggctcacctcagcgtgctgcacgccagggacggcgcgcagcgcgccctccagcgcggccgagcatgccgcgcacgacatgccctccacgcgcatcgtcagcagctggacgtcggaggcgggggcnnnnnnnnnnnnnnnnnnnnnnnnnnnnnnnnnnnnnnnnnnnnnnnnnnnnnnnnnnnngcggggtgtcgctgagcagctgggcggcgaaccccgcgtccacgaccgcgcccacgatggcgctggggcgcatatgggtggggtcgtagaccacctcgccccgttcgctcagcagggccacactggcggaggccacgcccggcagtgcgctgtgtgcgagggtgtggaggtgggcgtgtgagggagcgggggcaaattagaggagagggaggcagggtgtgcggtcggcagtggactgccctggtggagacgtagcgcggcacctttaatttgcctggctaggcagcgcactccgatgcacgctccccgccccatgcacacgccctcctcccctctccccccgcacctgagggccttctccacggccgaggagcacgaggagcagtgcatgccctggattgatacctgtgcggggagtgggtgggtgaagggtgagtgggtcgacaccctacacctgggacctggactcacagggtggtgctttcggggctctccgcggtcccagcctcggcctgcagcaatggcaaccacattacacaatcaagcgcccatgaagtccagcgcaccactgcctgggagagtgcaggaccggccttgcggggcgagcaagaagagtcccgcccgacacccgctccgggccggccggcgaggggaaccagctcagccgcctcagccgcatccgaggtgtgtttcttgttcacagagcccctcagccaacccaggcgggtgagggggtctgtcaggtcccagtaggccatcgcccactctgacgtcaccttctcccagtgtttcgtgtgcagggtggaaatgccagactcacgctgccttccctgcagcaaacaagcaaggcattgtaacccaatacaggttaacgcactgacgtttcgccccgtgcgcatagaaccagccgggcatcggccacctaaggatacgcaagggcgtacgcagttnnnnnnnnnnataaacgcactgacgtttcgccccgtgcgcataaaaccaacagggcatcggcgacctaaggatacgcaagggcgtacgcagttcgaagtccccggcttgtccgtgttgcgatcccgctttctttccgtgacaggatcggtcgcgagctggccgatgagcttcgtgagtgatgaaaataccggcgaaaggactcaaggcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgcacctgacccaacagagcaccgagcatccacttccacccattgcagctctatcgggactgtttgcgtatggcagattggattgcaaccaaggtggggtccaagggatatactttcaagtnnnnnnnnnntgtcaacgctgagactttcaccgtcgccaaggtgcgcttggcctggcgcaggtgtatcacgcccatgcacctgacctaacagagcaccgagcatacgcttccacccattgcagctctatcgggactgnnnnnnnnnnnnnnnncaagagcctaaccgatcctgtggaggtgtgggggggctttgttgcaatggaggcccatgtttgtcttgattttgatgaatgcaaacctgcctcggatccnnnnnnnnnntaagaacctgaccgatcctgtggaggtgaggggggctttgttgcaatggatgcccatgtttgtcttgatttttgatgaatgcaaacctgcctcggatccatttcatcaccaacgctcgcaatttctctcattgcccacagattgaggctgccaaggctgagtgagtttgggtggggcacactgtcctgaagtgcccagtacgacagtttggaaccttgcgttcttctccttgtctcataccctgaccctcaattctttcacccgcagtgctcgtcgtggactgtccaacctgctgttcatggaagctcagcgcatggccaaggttgggctgtgcagggctggttgtgatgtggagcctccacccctgtaaagcctttgttgctgaagtctgacccaattgtcctttggaggtatcaatttcccattcgccaactctaactcaaggaannnnnnnnnngggtgcccaggacgacattttggaaccttgcgttcttttccttgtctcataccctaaccctcaattcttccacccacagtgctcgtcgtggactgtccaacctgctnnnnnnnnnnaccccaccccccgccccactcccaaccacccgcaggaccagcaagacaagcacgacggttagacacctccgtccccagccccagctctgctccagcagcatggcagcaactagagcgtggaccagcccgcacaggccggtgctgcagcagcacattgtccacaatcacctttccagcggcatgcccctccccccccgctgtcccctgtcgcgttctggggcggcgaaggcccgcatagctccatcgagatccagagccctggcgcnnnnnnnnnnggtaactagagcgtgcagcagcccgcacaggcccgtgctgcagcagcatgttgtccataaacacctttccagcggcatgcccctcccccctcgctgtcccctgtcgcgttctggggcggcaaaggcccgcgtagctccatcgagatccagagccctggcgcccgacaattcggaaggcgaggctcagagtcccctccccgccgacgtagcgcggctcagccgcctggcccaggcgctgtcctcgcacgcattcgactccttgctgnnnnnnnnnnggagtccctcccccgccgacgcagagcggctcagccgcctggcccaggcactgtcctcgcacgcattcgactccttgctgctggatgaggaggaaggggagacggaggagagtcaggcgggggatgacgccggctcctgggacgacggcgcgatgctggtcgagcacggcgcagagcccggcgacctgtccgtcctcgatcccgacgcccccgcgccgtccaccgcgccggtgtacaaatcgcggcgcgcggcgcgccggcgcgccagcgaggcgcgcgaggcggcgctgggcgcgggctcgcgctcaggcgccgccctgccgcgcgtggccatcgtgggccggcccaacgtgggcaagtccgcgctgttcaatcgcctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgatggctgacgccgccgcgctgctagcccccgagcacctggccgcggccgcgcgctccatcagcgcccccggcctgcccgcggccatcgagcgccaggccgccgcggcggtggccgaggccgccgccgtcgtgctgtgcgtggacgggcaggagggccccaccgccggggacgaggagatcgtggcctggctgaggcgcaccttcaaccgcctccccgtcctgctggcggtgaacaagtgcgaggcgcccgggtccggcgacctccaggccgctcagttctggggcctgggcctagagcccatccccgtgtcggccatatcggggaccgggacgggcgacctgctggacgccctcgtgcgccgcttgcgggaaggggaggacgaggatgaggacgaggaggcgggcgaagcggccgctgccgtgggcggcgccgcagcgtctgccgccccgggcacgcccgccgcgcccgtggccgtggccatcatcggccggcccaacgtggggaagagtagcatcttgaacgccctcatcggtcaggtgggtgttttgttgtgtgggggggggggccgcagaagacagtggcggcagcgggtgcagagcgaggactggtgcctggacatcccagcatgcgtctaactcaaaactccatgcatgtctgtgctcaggccactcagcacaccgcaacccacccaggaccgctcaatcgtgagcgacatggcggggaccacgcgcgacgccgtggacacggagttcaccgcccccgacggcactcggtacacgctgatcgacaccgccggggtgcggcgccgcacggccgtcgccgccagccccgacggcgcggaggtgcgtggttctgttgggtgcttcccgtttttgggggtgcacatgctttgcatcgcacttggagatgcgagggccatggaggatggctgcagactgaggtttggagcgatctgatcagagcacgacccatcctaagtaccctcaaaacacctcaaccccccacccaccccgctcctgcccaatctctctcagacgctgtcggtgaaccgtgcgctgcgcgcagtgcggcgcgctgacgtggcggtgctggtcctggacgccacggagggcatcgcgcagcaggacttccgcctggcggagtacgtggcggccgaggggcgggcgtgcgtgatcgtggtgaacaagtgggacgccgtggctggcaagggcgccgccagcctggctgagttcgagaccaacgtccgggcggaggtgattggtgatgtgtctgtgaagtaggggggcggaggtgattggtgatgtgtctgtgaagtaggggggcggagctgaggggatcactggatgcctagaatgctctgccttgtgcttctgtcgtggcgctcgggagtcccnnnnnnnnnngcggagctggggggatcactggatgcccagaatgctctgccctgtgcttctgtcgtggcgctcgggagtccctcttctcagacccaacgcaccctccacagcccaccatcatgcatgcatgccccctccatcgttccacttgttcttcccaggcaactcacccccctcccctgaacccacacacactcgaacagctgcggcccgtggagnnnnnnnnnngagaccctacgcaccctccacaacccaccatcatgcatgcacgccccctccatcgttctacttgttcctcccaggcaactcaccccccttccctgaacccgcacacactcgaacagctgcggcccgtggagtgggccaacatggtgttctgctccgccaccacgggtctacgcatcccccgcatcctggacgcggtgcgcgcggcctgcgccgagcaccgccgccgcgtccccactgccacgctcaacatggtggtgcgtgatgcggtggcctggcgcgcgccgcccgcgctgtccaagaacaagcaggcgcgcgtgtactacgccacgcagacggcggtggcgccgcccaccttcgtgctcttcaccaacgtgaacgagaagttccccgaggactacaagcgctacattcagcgccagctgcgtgagcacatcggcttccccggcagccccctgcgcgtctactggcgcggcaagacgccgcgcggggaggagggccccaggaaggggaggaagtgagttccgggcgtgggttggagggagaaggggcagcggcggtggcggggcgcggcgcggctgacctgagagcacggacggagggagcacggcgcctttggcccnnnnnnnnnngcccaggaaggggaggaagtgagttccgagcctgggttggagggagaaggggcagcagcggtggcggggcgcggctgatccgagagcgcggacggagggagcacggcgcctttggcccaaccaggcgggagccgcggcgagagcctcgcccgtgcacccgcatgctcagcgactctgcccccccccccccccccccccccccnnnnnnnnnntcgagagccttgcccgtgcacccgcatgctctgcgactctgccacccccaccccgtgcctgcctcgtgtccggtcaattacatgtttgctgtgagcaccaccgtcgggggaacagggagcgcattgggtggtgtgggtcaagggcaggcatgtggtacagggggcggctgtttccgggtgccgctctgagagcgggaactccggagagtctgnnnnnnnnnnagggcggctgttaccgagtgctgctctgagagcgggaactccggagagtctgggcagggccctccttgtgtgaacagtgcccttccacggagacatgtcgagcaggtcacccgaccagactccccacaccccgccagnnnnnnnnnncgcgtgaacggtgcccttccacggagacatgtcgagcagggcacccgaccagactccccacaccccgccagctgtgcaaaccttctctgcttcgcctggcacttcttcacaccctggacagcaggacccgggcgccgtcctcggacaggctgaaccctgcgccgctgaaggtgctgctggcgaagaagggccccagctccaggatgtccaggtccttgcaccgctcctccaattgccttttgttttgaagggggggagcgggggggatgaaggtgagtggcctgcaacagctcaggggctgagcggggtgccagttcatagctccccccccctcgcaacagaaaccacacctgacgggcacggcaaagtgcgcggggtcggccagggtgcccgtcacggcctcggcgcgacgcgcctcccgcaggcactcctgcagcttgtacaggatgnnnnnnnnnnatgacggcctcggcgcgacgcgcttcgcgcaggcactcctgcagcttgtacaggatgagcgcgtcgaagtcggcgcggtccacgatgtagcgcctgaacttgcggcgcaggctcttctgcaccgacagcttctgggtggagacaaaggactccagcatgacgcggatggcggcgtctatgtcgtcccccgtcacgtggtcgcgcaggtgcatggcggcgcgcgcctccgacatgcgcaccatggactccaggtgccgcaccgcgatgggcatgccctgcgtcagcgcgctctcgcgccgcaggtcggcgtacacctgcgcgatcttgtcgtggtcggccagcgccaggcgggggcggcacgtctgcttcgcgtacgtcacgtacttgcgcagcatctcctgggacagcacctcgccgtcccccgccgcggcctcggggccggcctccggcggcgcgtcggggtgggagcgcgcgtgggaggccaccacgaagctggccagccgctcgtcgttcaccgcgtccaccgtgtcccggatcacgcacaggatgtcaaacctgcgaagggcggggaaaggggtgcagggtgagtggaacggcgaggaggacgagggaggaggtggnnnnnnnnnnaaacggcggggaaagaggtgcagggtgagtagaacggcgaggaggacgagggaggaggtgggttgtgtgtgtcgctggccgctgcctggactccatcgccacgagcttgagggccgtgcagcggcggccagccagctgcaggcccaatcatgctaggcccagaagatggcacctcacagcatcaccaccatttttcccctttctcccccccccccaccccccaatcacctggacaggatggggtcggtgagctcgacgttctcggaaaaggtcttgctggcgtcgtagcggccgccgacggggttggcggcggccagcaccgagcaccgcgcctggagctgggtcacgatccccgccttgctgatggagatggactgctgctccatggcctcgtggatggacacgcggtcagcgtcgttcatcttgtcgaactcgtcgatcaggcacacgccctggcgtgtgtgttggagtggggggtcggcattccagggcatggtccaggcaaagctgggtcggggggaggatgtgggtggagcctgagctccacctccccagcggcctgcctctcgcccatccctnnnnnnnnnnagggtcggcattccagggcctggtccaggcaaagctgggtcggagggaggatgtgggtggagcctgagctccacatccccagcggcctgcctctcgcccatcccttcccaggtggccagcccccccttccccctccttctgcaccaccaccaccaccaccccaaagcctgacaccctgaaccccgacccacccgatccgccaggaccagggctccgccctccagcgtccactcccccgtgatggcgtccttgtgcaccgaggcggtgaggcccaccgccgaggcgcccttgcccgttgtgtagaccgcgcgatgcgcggccttctccacgtacttgaggaactgggacttggcggtgcccgggtcgcccaggagcagcatgttgatgtcgccgcgcagtcggtgtgtggcgctggggtgcttctcctggccgccaaacagggccagcgccacgccgtgcttcacaccctcgtgcccgtagatggagggcgcgatggatttcacgatgcgcgccgcaatgcgcgggtcgcgcgccagcgcgcgcacctccgcgcggtcctcgtcggtcaggcgggcggcggagtagagctcgccgcgtcgcgccaggtgcaccgcctcgatggaggtggagtagacagggaagccgtgccgcgcgttctgccccgcctcgaagctgtgctggtagatgccggtgaccaccacctcctccccagggcgcacgccgtccaccaggtcggtcagcaggatgacctccttggagcggggcaggcgtcctgcgggcaccgagccgggcgactcctgcagcgtgatcttctggtagttgcggtacaccgtctcgcgcacgttgatctgtgggtggtggtggtggcgcaggggagggaggggtgacgggaagagggtgggaaggaatggtacacgtgggctgtctgaggcatgggcgcgtgtgagccaggaccagagacagggactggctctggcatgggtcgctgggcacgagtacgcaggggcggttgacgggtcggtgggcagcgcgcggtcaggagtgcggggcccctcgccaccttctgacgccccacttgcgcaggaaccaaccgctcggcaaccccaccgctgcagcccaccgagaaggnnnnnnnnnncctgacgcccctcttgcgcaggaaccaaccgcttgacaaccccaccgctgcagcccaccgagaagggccccttgctctcgcaggaggggcaggagccgagtcggatctcgcggtccccggtctggatgtagggccccagcaccgcgccgcagcgcgagcagtcgtacataacgcgctggagctgggggtagaccccggtgcgccgcgtgaccacgccgtcgacgcgcaccagcgagttgaggtggaagtgcctgaggggcaaggggggttgtaagagaggggaggatgggagggtagtggagaaggcgaaaggcgaagggggcgggctgggacgcaggcgtggggcctggcagggggcctggtttgcaaagaggtgggtttgggctgacaacccacgctcgggccatccagtctccacccagatccacgcaacaggcacacgcgcatcagcatcctcccaccaacctgannnnnnnnnncgggctgacggcccacgctcgggccatccagtccccacccagatccacgcaacgcgcatcagcatcctcccaccaacctgaggtcgcggatggattcctccaggggaatgttggccaggcggacgtatacactggagtgcgtgtcgccaaagtcctcgaactcgtccaggaccacctgggtgaggcaggcgcggaggagggaaatgggtgagggaggtaatcaggaggtgatggcgagggaggagcgtggaggatgggctgccactcacgtgcaagcccaccccttagcgcaccgaacgatatgacactcccagccgccggcaaataacctcagccccgatgccacccacccacctccttggcggtctcatccaggnnnnnnnnnngacactcccagccgccggcaaacaacctcagcccccatgccaaccacccacctccttggcggtctcatccaggatggggaggatgtcgcgcggcatgtctgccacccacaccgccaccaccgggagcccgttggcgaggtccacatagtccagctccaggctctggcagttggctgtgatgttgagaggggggagtttgggttggggttagggggacactgaccccgtgctttgaaaagagtacaagtgaccagcaaggatgcctcggtcaggggcgggcgaccaggacagggcggaacccgagcgtgcagccgacctggcgcctcaggctgcggcatgcagccccattgctgtctgcnnnnnnnnnntgggaccctagcgtgcagccgacctggcgcctcaagctgcggcatgcagccccattgctgtctgcaagctgaacccagcacgccccctccctgtcccagaaaacccgctccgcctcacgtacttctgaccatggcgcggaggaggggcgggtagatgggctcgccgccctcctgcgcatacgtgcggagaaagcgggcaaagcgccgctttatctccctgcgcacgttgtccttagcgatccactccttgatggggccgcgcgtctcctccagattgatctcgtactcaccctgaagcaggttaagttgggggggaggggggggaggattcagtggcccgatatgcagggcccgagggccctggcagaggaaccagtccaagggaagtcgtggtgtgggcaaggatcagcctggagttttcagnnnnnnnnnngatatgcaggcccgagggccctggcagaggaaccagcccaagggaagtcgtgatgtgggcaaggatcagcctggagttttcagagtgctcccaaacctacaaccccctccctcctctctgcccgccgccgccccacctcgtcgtcgtcccctgcctgcgcctcctcgagccggcgccgtcggcgcggccgatccccgtcgtccacgtccgattcgtccccggccagggcggcgatgaggccgcggcggtggcccgtcagccgcccctcctggcggtcgcgccgggcgagggcggcctccgcggcggcgcgcgcatccatgcgggcctccatggttgcgtcgtcgatgaacgccgtgtccaggccctccgtctcgtaccggtccaggtgctccatcggccgatagtcgctgtgagaagggggaagagtgtgacgggggtcagtaatgtgtcacggatgacaccgccaggcagcccaggggcctgctgcatccagcatgcgcatgtgtgcctgccacacttcccctgcgcctgctctagcaccgtcggcactcacgcctcaaagttgtccatgaggtcctccccctcctcctcggagtccccggcgaccacagaggcagagtccccctcgacctccgaggcgccctcctcaaactcccgctcatcgcgatcggcctgcggggaatcgagagggaaatctgagacctcggacatgtagagccagatccgcgacctgcatgcgaagcctgcggaacccaccatctctgcgcgagcacactggctgcaagcttgtgcgtactggaagccgaccacaggctcgaaggggtcccttcaacgcagatactgtggataatttataggagtattggcaggcgttcctcagcacactactccaggcgatccaccaaaagggaactggatgcgtggtttggaatttgaattccgggcgcaaggtgcagttgacgtggcattcgcctcacgccatctcttcgtgacgccatatgccgtatacggaggtgacttgctaccaagctgacgtatagccggccccggatggtgagtatctcagaggaagggataaagtcatttctagcagggttcttgggatccacagcctggaactggtagcattttctgctctgggcaaagtcctgggacagcgatctacaacttgcgcctgtttaagaggctaccatcgaccaggacgtagatgcatgttctgtaaatcagatgaatcatagaagcgtatgttggagannnnnnnnnngcatgggacagtgatctgcaacttgcatatgttttagaggttaccatcgaccaggacgtagatgcaagctctgtaacccagatgaatcatagaagcgtatgttggagacaatatgcatagcttcaagcagccaaaaagtcgtcctccccttcactaaatagctccataatctgaacttgtcaaaattcttactttcaggagtctgtcaaatatcacatacaaccgatcaatacaagttgggaggattcatttccgtcatgaagtggtgtttattaacaccagatggtgggttgataattcgaggcctaggcgccttacttcattcaagcgcgctcgccacggatgcggcgnnnnnnnnnnggagtcttcctccccttcactgaatagctccataatctgaacttgtcaaaactcttactttcaggagtctgtcaaatatcac

SEQ ID NO: 41100 - DNA, 448 bp, Chlorella protothecoides
  modified_base (174)..(303): a, c, t, g, unknown or other
ggccagcgcacagcgcgcgcagcagcgtgccggcgtgccgttcgtcgccgggcgcgtccaccagacggaccagggcgtgggctgccacgcccagctccggcgccgtggccggcgacacccccgcccggttcagcacgcggcctgctggatggtgcgtgtgtgtgtgtggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccaccttgcgcatcgtagccaaggagcacatgggcggcgctggaggtgcggccggaggcgagctcgtggcggtggcgcaggaccgaggcgcgcgccgcgccgcggccatcgtccagtcccgccgcggggcagcccagcaccg

SEQ ID NO: 41101 - DNA, 61 bp, Chlorella protothecoides
gcatcccaccgcacgatcgtaatactgcacacccaccaccgcattaccgcgacgaagtcgg

SEQ ID NO: 41102 - DNA, 61 bp, Chlorella protothecoides
cctgccgtacggggccacgattcctcccaaaagcaacgccgcggccaaccctgccatggcg

SEQ ID NO: 41103 - DNA, 61 bp, Chlorella protothecoides
ggccagcacgccgccatccaggcagaaatcagccccgcgctctccgagccccgcacccagg

SEQ ID NO: 41104 - DNA, 98 bp, Chlorella protothecoides
ggggccactgaacggggaagggagcgacgggcccagcagggcggcggcaggggtgtggcatgcatggtgcagggaacggcgaggagcctggtgcctac

SEQ ID NO: 41105 - DNA, 61 bp, Chlorella protothecoides
gccgccctgggacggaacaccccccccccccccgggccccaccttggtgtggatccaggcg

SEQ ID NO: 41106 - DNA, 61 bp, Chlorella protothecoides
ctctcctgccccgcagacctggaggctcgcgcgtccgaatcctcctggcgtggcgcctacg

SEQ ID NO: 41107 - DNA, 79 bp, Chlorella protothecoides
gcccgggcgctgacgctggaggtgaggaaaacgtgaatgggtccggggaattttggtcacccgtgtcagttctccagtg

SEQ ID NO: 41108 - DNA, 110 bp, Chlorella protothecoides
gcgtcctgggtcaaggccacagacctacccttggccggcgatggggaaagcacgggcccggcgcatgcaggtcgaccaagcgcagcagcgggactggagagcgtgaccag

SEQ ID NO: 41109 - DNA, 87 bp, Chlorella protothecoides
ggcccggaattactgagtaaaatacagtgagaaagcaaaatccatcagcattgcctctggatgccctgaagtagaatgaaacaatca

SEQ ID NO: 41110 - DNA, 68 bp, Chlorella protothecoides
tggctttgggatgtgccacagcgaccccccccattccgttcctgatcacaaccagatgtcccctttct

SEQ ID NO: 41111 - DNA, 942 bp, Chlorella protothecoides
  modified_base (289)..(298): a, c, t, g, unknown or other
  modified_base (455)..(464): a, c, t, g, unknown or other
ccgaggcggggggcagcgggagagcactgcccgccgccgctgccgccagctcggcgtcgcggcgcagcaggatgcccaccgtcggctggtagaggagcgtgaggtcggagaggagcttgagcgcgaagcactgccgcgccaccgcaaactgctcgggcgacagcacctgtgcagtggtggtcgtcgttgttgaaggattggatgtggagttggatggagggaaggagttgtgtgcgcgagtgggggcggtcccggactgcatgcagtcgccgcactgttgcatcgacgnnnnnnnnnntgagtgggaggcggtcctggtaggcatgcagtcgccgcactgttgcatcgacgttcgaaggtcacagggccaggatggccggacgcagcacagcccttccgcttcagcaaccctcgtcctctgcccgcctcactcaccttgatgggttcctgattgnnnnnnnnnnccaaaggtcacagggtcaggatggccaaacgcaccacagcccctccgcttccgcaaccctcgtcctctgccagcctcactcaccttgatgggttcctgattgccggtctgtgtgcccgcctcgtcgatcgacagatcgacggccagggagccgtccggcatcagccgcatctgcacgcccggcgccgccgcggcgacctctgtcgtctcgccctcaccgggggcctccatccgcgcgggtgcctggtactccagcagcactcctatcaacgcctcggtcaccgccaggaagtccggcgaggcgcggggcgcgcgcttggcgggtggcgcgaccgccgcgccgccgggcgtctccggctcggtcgatgtttggactgcccgtggcgcaggggtggcgggtgcctgctgcgacccgtcctgtgtcagcgtgcccgtcgctggggctgctggcggccccgacgccgacggcgtcgcctctg

SEQ ID NO: 41112 - DNA, 17290 bp, Chlorella protothecoides
  modified_base (456)..(465): a, c, t, g, unknown or other
  modified_base (832)..(841): a, c, t, g, unknown or other
  modified_base (1525)..(1534): a, c, t, g, unknown or other
  modified_base (1866)..(1875): a, c, t, g, unknown or other
  modified_base (3117)..(3126): a, c, t, g, unknown or other
  modified_base (3953)..(3962): a, c, t, g, unknown or other
  modified_base (4749)..(4758): a, c, t, g, unknown or other
  modified_base (5068)..(5077): a, c, t, g, unknown or other
  modified_base (5228)..(5237): a, c, t, g, unknown or other
  modified_base (5737)..(5746): a, c, t, g, unknown or other
  modified_base (6695)..(6704): a, c, t, g, unknown or other
  modified_base (6940)..(7005): a, c, t, g, unknown or other
  modified_base (7371)..(7380): a, c, t, g, unknown or other
  modified_base (8450)..(8459): a, c, t, g, unknown or other
  modified_base (9359)..(9368): a, c, t, g, unknown or other
  modified_base (10650)..(10659): a, c, t, g, unknown or other
  modified_base (11020)..(11029): a, c, t, g, unknown or other
  modified_base (11348)..(11357): a, c, t, g, unknown or other
  modified_base (11492)..(11501): a, c, t, g, unknown or other
  modified_base (11577)..(11586): a, c, t, g, unknown or other
  modified_base (13531)..(13540): a, c, t, g, unknown or other
  modified_base (13838)..(13847): a, c, t, g, unknown or other
  modified_base (14180)..(14189): a, c, t, g, unknown or other
  modified_base (14669)..(14678): a, c, t, g, unknown or other
  modified_base (15066)..(15075): a, c, t, g, unknown or other
  modified_base (15799)..(15808): a, c, t, g, unknown or other
  modified_base (16300)..(16309): a, c, t, g, unknown or other
  modified_base (16543)..(16552): a, c, t, g, unknown or other
  modified_base (16912)..(16921): a, c, t, g, unknown or other
gccatcgggtccggcggccagccccgccgccagctcccgcgcggtggcggcggcgaggaccgggtcgtgcgcgcgcgcgcccagcgccgccctcaccgcctcgggctgcaggccctcgtccagcagcagctgctccagtcgcctgatcgagagtttgtggggttttggtgggaggtggaggggtcgaagaacgtgtggaatgaaaccacctcatgaccctagggacggctggcccaactggtcctgattctccaggggccgtgagctgtacccccaccctcaggtgggcagcccatgcatcaaaccgtccgccccggatcctctcaatcgccccgctcaccggcaccgctcgagtccccaccccttcccctccctgcgccgctccccacctggtgatgaagtccagcacgccggccctgacctcgggcgtgacgggcacgggaagctgcgcggaannnnnnnnnntgcccatcggcaccgctcgagtccccacccattccccctccctgcgccgcttcccacctggtgatgaagtcgagcacgccggccctgacctcaggcgtgacgggcacgggaagctgcgcggaagccagcgccaccagggcaggcaggtccatgtgcaccccctgctgcagcaggatgccgagcaggcccaccgccgcccgccgcagcgcataggggtcggagttgcccgtgggggcgcaccccgcggcaaacagccccacgattgcgtccagtctgcgcaacaggcgatggagggggaggagttggacgggtggagggcacaacaaggctcatcgatgcggcgctgaagaacaattgagccaatccnnnnnnnnnncgcgtccagtctgcgcaacaggcgacggagcgggaggagttggacgggtggggggcacaacaaggctcatcggtgcggcgctgaagaacaattgagccaatcctttgtggacccagggtcgatcctgcacctcccacctccctctccacaccaggcccctaaaacctcggctgcgcacttgtcggcaagggacaccaggaccccggcgggcgtggagggcagggcgtcgccagagaagcgcggcaggatgccctcatacatggcggtggccactgcagagctccgcccctccacctcggcgtagtgccggcccatcacccctgcatatgcggcgcgggaggcatgagctcaggcgggcagggcaagggcaatgtgtgtgaaggcatggcagcgagaatgccgagggctcccacagacacatgcggcgaaggatccttttgtcagccgcacccacctgccagggcggtcatctcggtgaccatggacgtgcccaggtcggcattgtagagggaggcagcctcacccgccacagcctccgtgtctgtagcagcatcgcatgttgtagagtcagggggacacctgtctttccacatcaagatgtgcagatatatgccgaacatggttctgcaagctttgaaatcgagactgccacttccagcctcgtgagcaatgtccaacagcccnnnnnnnnnncgtaaagttagggggacacctgtccttccacatcaagatgtgcagatatatgcagaaccatgttctgcaagctttgagatcgaaactgccaactccagcctcgtgagcaatgtccaacagcccctgtacctttgtcaaagccacaggccagggtcagcggctcaaccaagctgaagacacgcttgcagcggtccagcagggagccgaggtcctgctggaaggtcatgctttctagcttttccctgcgatgcaaatcgcatggaggggagtcggtcgatatgcctcgctccagcaaaaagagaacgcagtcggttgctgtgcgctccattgcnnnnnnnnnntttttccctgcgatgcaaatcgcatggaagggagtcggttgatatgcctcgctccagcaaaaagaaaacgcagtcggttgctgtgcgctccattgcaagactggacgtcgacatgggtcccggtgacgatcatcaggatgcctgccagcatacgcttatggtccaccagcccgtggcatccccatgaaccaaccctactcaccggtgctgttccagcgacttcttggtgtccgcctcatagaaaaagcgagcatcctcaaacctggcccgcagcactgcctcgttgccggccctcacgaggttcacattcaccgcgccattggcgacggtgatgaagtgcggcagcagcccgtttgtctgggggtcgacaacggggaagtaacgctggtgcttgcgcatcaccatcaccaacacctccctggcgggaggcaaggagattactaggagtgagggctgtttccatgcctgcgattgctcagcacttgctgacgacgctttatcatgcccccgcctacacatggggccttttggcatttccccccagcaacatgacgaaatcgcccactcactgcggcagccccaggaactcggggtcaaaagatcccaggatgacagtggggctctccaccagatcggcaacctcctccagcaggtcatgtgtcgtggcctcagggatcgaacctgcccagagtgagtggtgaggggtcaagagacacaggaagaaagctggtaggtagctgtcacagctaaactcaagcagtatactgcaatatcatctggcaggacgcgctcctgacgcatcctctctccagacattggcaattcatgtggatcttcccctgcccccatccgctccccaaacatcgcaccgttaatgctcgctgccgcactctggcaagcctcccagatgctggcccttcgctccgctacatccaccaggatgccggcatccaggaggacagcgccatgctcggaagcagatgccaactgtggcataagagggagggttgggcaggagggccatggacgcagctcctcggcatcatgcaacgctgcaagtctttgggatccagcccagactacatcctcttgacgcctcgcaatgacactggccatgcacattctgccaaatagcagtgtaccttgactggagaggcctcaatgcgcagaaggcgagtctggtcaccgctgtccacgccggcaaaggaaaacgggaccaccgtcccggcatgcatggacagnnnnnnnnnngcattttgccaaacagctgtgtaccttgactggagaggcctcactgcgcagaaggcgagtctggtcaccgctttccacgccggcaaaggaaagcgggaccaccgtcccggcatgcatggacagcagccaccgcacgggtctggagaaggaaggcacgcccgggagccagcgcatgctcttctggaaggagagaccactgagaaggtcaggcagccgctgcgccagcgcctgtgtaaaggagtcgagggggagcaggcagtggtttgtttggctggtacgaggatgctcaggaagatgcaagggctggaggacatcaatgaattgtagcgttgcctttatcagcatcacctgcactagccatccgaacaaaaatccgtcaacagcacctgccatgcagcagcttgggaatgctcgagcgcacaccacacatagtcagccccattggcatcagcctccagcacggtgtccttcactgcatggaggtgtttggatcgaaagcatttgagaacagagtgccgcagagtctgggcaaggatcgagcaaagaagctcgagacaaaagtgccttttcaacattgaataagtttcctaccagcataattccgcactatctcaccttctatcctgttctttcgacagaatccaagcagggcgggggtggggcttccatccggtgcaaaggcgacctgtacagggcacattgcgacgaacgaactactttatgccaggagccatgcaggtatgccctggtctcatctcatctttggttgcctgtataggcacaaactcttgccacaaaagtgagctcccacctttgctgggggcccnnnnnnnnnncacagggcacattgcgacgagggaactactttatgccaggcgccatgcagatatgcccaggtctcatcttatctttgcttgcctatataggcacaaacccttgccaccaaagtgagctcccacctttgctgggggccctcggatccgctcagaagctgcactctgctggggagccaggtccgcgatgttcaccaccaggcgcctgggagtgcccgcgacagtgacagcaccgtggctcaggcggcaggccttcagcagctgtgggatgccttgcctgtgggtttgggaggcggagtatatgtggactatgtttggcacatgctgccatatgagccacacgactcgagaatccccacaccgtccacccctatcccccccttccttgaagctgcacctgagctgagtcagcgcatgctgcaggtcggcggggggcaactcctcgcacccaatctccagcaggaagggggctgggcccgtgggcgggctgtgtgcggggggttgacccaggtcgacgaccgtactggccttgcagtcgaggagcgcattgccaagggggtgtccctgctcctccctccgctccgaccaaagctctgcgatacaagcataatgagcaggggtaaggcgtacagaatgggccttgcagtggcaggagcgatgcccagataggatagccttgcccagcattggttcgccgccacgcgaaagtaatcgggaacagattagcggacagcgggcaccagcactctgcccttccatactaccaacttgagcacctgttgtctgccgnnnnnnnnnngatgagcaagggtaaggcgtacaggatgggccttgcagtggcgggagcgatggccagataggatagccttgcccagcgttgcttcgccgccacgcgaaagtaatcgggaacagatttagcagacagcgggcaccagcactctgccctcccacactaccaacttgagcacctgttgtctgccgcgccaggctcctcagcgcggcaaagctgttggctctctcggtgacacccaccttttgacatgggcaaggtgcttgcatcaacgagtgaatttcccacgcttggccaggccgcaatcttgacatgcacnnnnnnnnnncaggcaatcataggcagggatggggaggcgcagggccagcatcctcttagcttcctgcgcggagcagggtttgcagagagtgccaatgcagaatgcacagagtgtgtttgccccccttccgacttcagtgtctccctctctggagaggttnnnnnnnnnnattgccagcccatcaatcaaacctcaagcacgacagtcgttgtggctcaccgctccacgggcgtccaggacgttgaaggtatgtgagagcttcagaaggcaatcataggcagggatagggaggcgaagggccagcatcctcttagcttcctgcacggagcagggtttgcagagtgcgccgatgcagaatgcacagggtgtgtctgccccttttgacttcagtgtctccctctctggagaggttcgtttggtaatctttgccagtaagagtccaccaccccatctgagggtccctcacctcctcgtacagtctgaatcgggtctggtggtcgctgatgctggcctcctccagattgtacttgctcatctcccactcattctgcaggaggccgttggcatgagatggggtcgctcagcatggcttcccttggccagcctccattgtacggtatggttttgtctctctgcaccccccccccccttcctgcagcttgcctgcannnnnnnnnncggcatgagatggggtcgctcagcatggcattccttggtcagcctccatagtacggtgtgtttttgtctctctgcacccacccccccttcctgcagcttgcctgcaggaacatctcgccgtaggtgagatgctgggagtactggatgtctttaaagtgcttcacaccctgtgagtaggtgtggcggaaggcggaggagattaccatgcagagcctcgcagctcaaagaagagcaatggtcatgcaaaattccagcaggtccatagcagcatgcctacagacccgactgctgggaactcttggttcggtctgcaatgctcccctcctcaaagggtcccacactgtacctggatggccatgatgatgcgttccaggccataagtgatctccacagacggcacctccaggaccttccctccggcctggcgggtggaagaatcctcaccagtcagctatacacaagcaaacaagcgcgcgccatggtatccaatgcgccaccctgcgaatggccatgagaacaccgtacacgcccagtctcgcacctgttgaaagtatgtaaactgggtgacctccatcccattgagccagacctgcgcattggagggagggagtggctctctggaagcatctccctgtctgcattcatgcatctccaaatctccgccaggcaattggaggcacagaagtggaacatgccccctccccctccggatgactgacctcccagccgaggccccaagctcccaaaaccggcgactcccagttgtcttccacgaagcgaacctgcagggggaaggggtcacagggtgtgagggtcccaagaaggcacccatgatcctccctcagagcactgcgtggaaacaagaccggaggacgaccactacagccatgcacatgactctgcgccaacatcaaagacctccaactcccatgccgtcgaaccgccggcnnnnnnnnnnatggaaacaaggccagaggacgaccacttcagccatgcacatgactctgcgccaagatcaaagatctccaactcccatgccgtcgaaccgccggcctcacgtcgtgctgctgtgtgtcgactcccagcgctcggaggctggccaggtacaggtcctgagcattgccagggtctggcttcaggatcacctgtatcggggagcagatggtcgaggtgggggagcagatgggcgaggtnnnnnnnnnnnnnnnnnnnnnnnnnnnnnnnnnnnnnnnnnnnnnnnnnnnnnnnnnnnnnnnnnntcttccccactctgcacacccctcagtcccatcaggcaatgcgccgtgtccatttgccactccagcatccctgggcccctgacctggaactgcgtgtgccgctgcactcggtttggattcaggccatatctagagtcgtctgggcggatggagggctccacgtaagccacgctccagggctccggacccagtactctgaggaaggtggagggattcatggtccctgcccccacctgcgcctcgggggatgaagggctcgcattgtcgcggtcggctgtggtaccaccagtgagtggggagaaagtccccccggcaggacaccagagcacacccatcccatatcgcacctctgtgttgtgggggagnnnnnnnnnntggcaggacatcagagcacaccaaccccatatcgcacctctgtgttgtgggggagccacatggcgcacccctcatcggcccagaaggactgcagccgcgtcacggcgtcctggaaggtgatggaggcggcctcgctgtcctctgtggggggtgctgccgccccctcggccaccgtgcccgaaggcctcggcgccagctccagggatctggagctggaccagcatcgcagcgatgcattgctgctgcaacgtcgcgcgccattgctgtacaggctcgccgagttccctagggatgtcccgcgagggtgcagggttccgataacagggccatgcagtcgcaggatcccccggcacaccctctgcatcgccgatgtgataaatcaacaataattgaaatcaatgtagagagctctgcacgagctcatggctgtacacctgtgtcgaggcatgggaccttgtgcgtcgatgtttggatcatgcattgcccatcgcgcccgcgtttccatgcgggagatctggagtctgatggatgaatctgcaagtcttgtgtcggtccgtcattttctatacaccaaacttgcatcatgtggcagctgagccactgagtgtccaacaagatcagttttagggaccaccatgggcattgatgacagagcagcctctcacaacgttgcaccctaggtgtcccctcgtctttcagccaggagtggcttgcctctgggattgctctggcacttgctgcatgacaccatctcaggatctccacccgttatttgcttgggtaagcacataggtagccagctcacggatgtcctcttccggcaatcgggctccaaatgtgcattgcctctgccagagagaggatggaacgaagactcaggtggcctgaacctcttgaggagtgatccatactggtatgagtcatacgcttcacgaggcaataataaaatgctctcacctggggtgtgcattcctttccaaatcctgcggcgccgagtatggtgagggtcagtcgccaagcatgaggcaagctccacccatggcccttccacgacaacatctctcagcaannnnnnnnnncgtgcattcctttccaaaccctgcggcgccgagtatggtgaggttcagtaaccgagcatgaggcaagctccacccgtggcccttccacgacaacatctctcagcaagtagcgctaccacccacctggcatggcgcccttgccgcggctgatgaggttgtacataccgtagtctgacagcatgccattgcgctgcaggtcgggcaagctgagggtagctccccctctgttgattatgttgccacctcctgggtgacacccagcgcatgacatcccaaagacttgaccgacgttttcgagagccggagccgccgcaggaagagccattatcgccacagctgtgaggacgaggtagtttgagggtgagagattgcaaaaggggttcatggtttgcctccatcagaaggttgagcctgggtgtcgcacataggagagcgacggctggacaggtgatgctcatcggtaggaggtcgggggtttcaatccttttgttgagggcggcatctcggtctgtgaagttggaggcggcacaaactcccgactgccgagtagcacgtcgccatcttggctgctcttcatgccgactttgtattgtgggtgcgccaatgatagcactgcatcgttgcaaactcaacattctgagtgcagctggcgaccatcaatcacgaaagtaatgattgcatgaatgcaacatgcgttgtgtcgagtgagtagcgtaaggggccgaaacgatcaccacgccacgaattcgccataaatcattcaggcaaacgacggaatcgacgaggaatcggctgtgtgggccagcaaacagcctgtagatcaaagccatggaaggggtctcgaacatgccatcagatcattcaacgtgaatttaaccggccagaaggcgatcatgttannnnnnnnnncaaaagggcctcgaacatgccatcaggttattcaacataaatttaaccggccagaaggcgatcatgttacgcttgacgtcggtggcagggcgtttccgatccctcgttcccgccgcctcaagctttcgcccagactggctggatgcgagcctggggctggaggcccgatccctgaccaccagccaagccgccgagcaagaatccaaagcagacaaagagcgagagtaaggcacaggcgttgtatcgtgtccctggggtgctgcatcccgtatggttgaaaggcatgcaccacctgctgatggggcagagtgtgccctggcctccccacgccccttcttcccataacaccctcccaccaagccgcctaatcacattcacaggagcttcagctcgagggctccttggctgcgggctgcggtcctgggtgccagcgatggcctggtcaccacttcctccctgctcgccggggtgggcgccgcggccgtggaccaccggacgctcatgctgaccggggtcgccggggtcgtggcgggggccgcctccatggccgtgggggagtacgtgtcggtcagctcccagcgcgatgcggagagggcagacctggtggccctggagcggcagctgcaggcgggggcggcaagcaaggtcggaccccaggctgacgggattgcagcgggtgttgaactgaccctcgtccgaaggattcgtgggaagagggatgggggaaatctaagctttgcctccaatctccagcatggatgtcagccataccggcccctgctcacagagcgttgaggatggtgcgactccaaacgcctctggcagccccagccttgcaccgcatgtctcccatcaaccacatgagcgccacgcaggcggaggcagagagggacctggcgcaggtgcacattgaccgcggcctgcctcccaagctggccgggcaggtggccagcaccctcaccaatcaggtagaagacccggccgccgcccacgccagggaccgcgacggcgtggatgccgacaacctgaccagcccctcgcaggcggccgcggtctccctgctggccttcagcctgggcggcgcggcacccctggccaccgccgccctcctcacccacgacgcggggcttaggagcgccagcatcgcggtcgtatccctgctcgccctggtgagcaggcttgcgttgtagcatcaccgaattacggaggaggggccaggagagagggaaaaggtggctggcccatgctgcaactgcaggctcaccaacacacaaacctccannnnnnnnnncaggagcgccagcgtcgcggtcgtatccctgctcaccctggtgagcaggcttgcgtcgtggcatcaccaaaccacggaggaggggccaggagagagggaagaggtggctgggccatgctgcgactgcaggctcaccaacacacaaacctccactccatcgctccaggcagggatgggagccctgagcgcccacctcggcggagcgcccatcggaaaggcgactgcacgcgtggtcctgggcggctgcctggccataggtgggcgtcagatccattgggatctgaaacatgcagtgggtggtcgctggcctgtggcgtggtgatcatggcgtggggcatgcgatgccggccacggtacctgnnnnnnnnnngattgggatctaaaacatgcagtgggtggtcgctggtctgtggtgtggtgatcatggcatggggcatgcgatgccggccacggtacctgtgccatgcacagcacccagtcgtggcttcttggggctgggccgcctctgtctgctcagtgatcccgaccaaaaccgacaacactgcaagggtgcccctcgtgcccctctcccaggcctgactcatcttgtgggcacctactttggcgtggacaccacctaagtggagcgtctgtatggggtctctgcgtgccggcctgactctcgggccgaggaagcacagcactgcgcnnnnnnnnnngctcgtgtccctctcccaggcctgactcatctcgtgggaacctactttggcgtggacaccacctgagtggagcgtctgcctggggcccctgcgtgccggcctggctctcgggccgaggaagcacagcactgcgcnnnnnnnnnngtatcctcatgtacaccatgtatcattgccatcaacaccaccctgtacagtctcgtcatgctctcccgtcattgtnnnnnnnnnncgcgtttcagtgtcagacatgagcggcgcggggcacgctttgattcacactcctcgaccctttacccttatgtacaccatatatcattgccatcaacaccaccctatacagtctcgtcatgctctcccgtcattgtcattcaatacaccaggggccttgctcctggatccagcccaaggacactggccagccgcgccatgcacccaaagttctgtacaggcttgccgccgctacgccgacgtcagcgggtctggcaccgagacgcaaaccgcgcaggagtagggaagcatgggcagcacccccgcgcgccgccacggctcccccgctgcgcgcaccgcgtgcacctggtccgcgctcagcgcgctgtctgcggtcagcacgtcgaagggcggggcccgccccgagtccagcgccacctcccacacccgccccgcccgcgccggcagcgccgcggtcaccgcgccgtgccccgcgttgaaggccacgtagagccccccgccatcagattccggcagcgaaaaggccacgaagcggccgtcctcgccccaccccggctcctcccccgcgacggggccgtgccagaccaggtccccccccccccgccaccccttctcgcgcagcgcggggtgggcggcacgcagcgccagcagcgcgcgcacgaagcgcgccagcccgccctcgtcggccgacgcggcgcgccagtccagccagttgagcggcgagtcgtggcagtaggtgttgttgttcccgcccttgctgtgcccgtactcgtcgccctgaaccagcatgggcacgccctgcgccagcagcagcgcggcggcgtggttgcgcgcctggcgcgcgcgcaggccggccacacccgggtcgcgcgtcggcccctcctccccgcagttccagctcaggttgtgggtctcgccgtcgcgcccgccctcgccgttggcctcgttgtgcttctcgttgtaggccaccaggtccgccagggagaagccgtcgtgcgcggtgaccaggttgaccgaggccgcggggccgcggccgccgcgccaggccgcgccgagtcctcgcccccaccagtcgccctcgggcgcggcgtgcaggaatacgtcgggtgaggcgcagagcgcggccgcaaaggcgcccgcgtgcgcgccgggggagcccttgaggaaggcgcgggccgcgtcgcggaagcgcccgttccactcgctccagcgcccggcgtggtgggggaaggcgcccacctggaccagcccgccgcagtcccaggcctctgcgatcagcttggtgcgagccagcaccgggtcggtcgagatggcctcgatcaggccggggtcagacaggggcgtgccagtggccgaacccgccccggcgtccatgtgccgggggccctgggggggtggaggtgacgtggcgccggacatccgggccccggcggcctcacccctggccgcatcctcgtgcttgccaccaccaccacatcccttgggccgagtccacatggagggggcgcgggtgaggatggagcccaggtcgaagcggaacccgtccacgtggaagtctagcacccaggtgcgcaggcagtccaggatgaaggcggagaccactgggtggttgcagttgagcgtgttgccgcagccagagtagttgtagcactgcccaccaggggccagcatgtagtaggtggtgttgtccaggcccctgtatttgattgtttgtgggaaggggcgatctgggaatagagggagctatttgactctaccaaagacttgcagaagcagcatgcgagggttgccaggcaaatgcagggaacgaagccgagcagctgaccagacagatgtgcacgcaagccctgcgccgttgatcgatggccacccatgtagggcatgcatatttcaagggtcatgggcgtcattctgaaagtcccggacatgggtgtagctgctcatcnnnnnnnnnncgatctgggaatagagggagctagttgactttaccaaagagttgtagaggcagcatgcgagggttgccaggcaaatgcagggaacgaagccgggcagctggccagacagatgtacacgcaagccctgcgccgttgatcaatggccgcccatgtagggcatgcatatgtcaacggtcatgggcgtcattctggaagtcccggacatgggtgtagctgctcatcactatggggaagcagcttcaaataaagccaaacaatcctgcctccctctctctcctccctcccacccaccggaagnnnnnnnnnngaaattaagccaaacaaccctgccccactctctctcctccctcccacccaccggaaggagagggtcggcccagcctcgctgccctctgcagtgtggttgaacaccacatccaggatgacttcgatgccgcgctggtggcaggccttgacgagctgcctgcacgaattggagtgtgcagcagcaacggatgcatgagcgcataggcatgacatcttgtcggcaagggatgacgcatggaatctgatggggacacaacatggctgctacccagaagagtcgcccccctcctcgccccggctctacaagaacaaaaggtaatcagtcctcccggcnnnnnnnnnnaggatgcatgtgcgcacaggcgtgacatctcggcggcaagggatgacgcatggaatctgttggggacacaacatggctgctacccagcagagtcgccccctcctcgccccgactctccaagaacaaaaggtaatcagtcctcccggcctcacttaaactcggtggcggcgtcagatgcggcgtatcgagccatgggggcttggaaggccagggtggagtacccccagaagttgtatcgtgccggagaccccccgtcctatgattcgagaagttgaggcatgcgagcttgaatcgaatccagatgcttcgcatacaaagcatcaggaacccctcggcgtgtcagcagatgacgctttcacaatcactctgacctcaggtctgcttcgcctctatccaaacttataagaatggtattttaaatctcagcacccctctcagtcaaatcgccaccccaactccactccaaccctcccagccccnnnnnnnnnntgcctctatccaaacttataagaatggcatcttaatctcagcacccctgccagtcaaatcgcctccccaactccactccaaccctcccagcccctcctcacatagtactccagctcgttgaactcgtggatgggcagcagctccaccgcactgatccccagatcctgcaggtagtctagcttctcaatcacccccgagtacgtacccggcgccccgaccccgctgctggtgtgtgcggtgaagccacggacgtgcatctcgtagatcaccaggtcctccatgggccggcccaggggtcggtcgccctcccagtcaaagggcttggcgggggcggcatggggcaaggccgccagggtgaggggccaggtgggacccgtgccatagaccnnnnnnnnnnccggtcgccctcccagtcaaagggctcggcgggggcggcatggggcaaggtcgccagggtaaggggccaggtgggacccgtgccatagaccccggggcttccatactcgatgtcctgctgcgggattaggggggggaggggaggggggtgctgggtgcatatccgagtctctcatccaggagaccagcatcaagtcggagcggtgagcagactgtcacatgctaagtgacacatcaccgcgccgatgctgaatgcccacaacaggaagtgcatcccctgctcatgcaggcagccagactcacaggcccaagctggccaaagcgggtgcgtccgttgaccacggtccgggcgtgggggtccagcagcacatgagactgttggcatgaggtggcgagcaagactgagggggggctgagcagggcgacggcttgcatgccacgcagggggaggttaatgtgaggccctgcatgtgcgacagggcgggcaggaggcatcatggcactgaagtcctcaccctgggtttggcgcctgctgtgccaccatccagctcggagaagctgccgcagggctccaccttgaaacctgcacagatggccggatggggccggcatgggctgcgcgggtcagcccagcgcaattcaatgctggctctcgagaatgctgggtgacagtgaatagcggtggttgcgcatcaaagagcatgcaccacttgctactgccgagnnnnnnnnnnttgcgggtcagcccagcgcaattcagtgctggctctcgagaatgctgggtgccagtgaataacagtgcttgcgtagtaaagagcatgcaccacttgctactgccgagctcatcacctcctccatgccagccagtgcctgcacgacatcgagcttggtattacacacgctcaccataaagtaggttggaatcaagacctacgacggcaaggtgccaggtgtctccagtccggttgacaatggggtcgaatgcgatctcccgtgtcaacctacccagtgcgtgatccgcaggggtggacaggcacaggaacatcgaggtagcagaggaggagtacaccgcaaagttgacagcaccctggatggatggtgtggaaatcgcagagcaggtgggtgttgcaaattggggccatgggggaaactagaactatgcagcgctgggacggcctagccactgaaattctgtcaaaccttctatgagcaaaactcaccgttgnnnnnnnnnngaattagaactatgcagcgctgggacggcctggccactgaaactttgtccaaaccttctatgagcaaaactcaccgttgcctcattccagcttgcaccaaggggcagcgggaatccagcctcggtgtgcatgtcgggtgattggcggttggtcatagtcttacgggtagcctgtgcctccgtcacacactgctgtcgctgccgtcccttgggcacagaccattgccagccagtnnnnnnnnnngggtcatagtcttgcgggtagcctgtgccttcgtcacacactgctggcgctgccatcccttgggcacagaccattgccagccagtccttagctcgctggaaggtcttctatgtctacatctgcaagcaagcaaatggtattcggagtcttgtgttcaatatcattcgggacactagcggattttatcacgccggttaagacctgcgtctccttaccctgagtggctgaccaaaccacgatcatgcgcgagcgttagctcaggaaggggtgccgatggtctacaagcatttaacatcctgaattttacttgatccttggactgggcacctcaaggggccagggttggcgtggtttgtcagnnnnnnnnnntgttagctcaggaaggggtgccgatgttctacaagcatttaacatcctgaagtttacttgatccttggactgggcaccccaaggggccagggttggcgtggtttgtcagtttcggcaagacatgttggagggggcgagggggcgtgacctgttagcaaaagaatgcacgggaatacccttgttcctctaccggacttgtgccggatgctagcagcttgttcccgcgaatgggatgtcgtttgcgcagttggttgcctcaatcggcgaaccacggggtttggggggggggggaagggaggggaagcaggcccccccagaaagctgttgaacgaggtgcattcgcaaagaagcacctggtcagcatgagca

SEQ ID NO: 41113 - DNA, 98 bp, Chlorella protothecoides
actcccgcgtcgcacagatggccttttgttcattgggaagaggggtcgaaaggggagtgcgggtggtcgggttggggttgcagggggcgtgtgggtga

SEQ ID NO: 41114 - DNA, 71 bp, Chlorella protothecoides
caatgatcgggcacatggagttgcccccccccaccattgtgagcatgcagggggtcccacctcagagtcag

SEQ ID NO: 41115 - DNA, 77 bp, Chlorella protothecoides
ccagtcgggcttccgcgcgcgctcctgtgtatggtgtacgtgtgtaaactcgagggatgggagaaccttttgcctcg

SEQ ID NO: 41116 - DNA, 9858 bp, Chlorella protothecoides
  modified_base (600)..(609): a, c, t, g, unknown or other
  modified_base (1686)..(1695): a, c, t, g, unknown or other
  modified_base (3421)..(3430): a, c, t, g, unknown or other
  modified_base (3800)..(3809): a, c, t, g, unknown or other
  modified_base (6180)..(6189): a, c, t, g, unknown or other
  modified_base (6425)..(6434): a, c, t, g, unknown or other
  modified_base (8182)..(8191): a, c, t, g, unknown or other
  modified_base (8941)..(8950): a, c, t, g, unknown or other
  modified_base (9432)..(9441): a, c, t, g, unknown or other
  modified_base (9519)..(9662): a, c, t, g, unknown or other
gggggcggcggggctgggcacggtgaccaccgccgcgccgccctgggagtccagggtcaggggggctgaccagaaggtcgtccccggcggggccgtcagtgggctggcgcgcagctgcaggcgcaggcgctgcttccctccctgcagcaacccgccctgcagcgccggccagctggcggtattttgtgtttttttgggggggggtaggagatgtgtgatgaatgggatggaaaagagtctggatgcgtgccggatggggcagaggtgtttgatggtccgggtacacgagaggatcacgaatcaagtaagaagccccagatgccaagctggcccactaggacggccccttctcccaaacacacccaccagacggtgcgatcctgggacgaacggccgtcgaccccctccacgatgccccagccgcggggcgggggcgggcgcttgtggcccagcaggcgcggaccgggctccggctcgccggcctcgcgcggcagcgcggcgcccagccccgctgcatggaggaaggaagggagggacttggggatcgaggggtgtgtgcgtcgggaatagcgcagggacgcaggcctggagcaggacccnnnnnnnnnnaagggacttggggatcgagggatgtgtgcgtcgggaagcgcgcagggacgcaggcctggagcaggacccggcacggctcctctgccctctccacagccaggcagagcgcacatcaccagcgtcaagcccaccgctcagaccacggacccccgcgcacctcccgcgaccccgacgtccaccgaggaggcggcgcggctgaggggcgcgagggaggaggtcgccgagttcaggcgcatgctcgacgcggcttcccccctggcgggcgagaggagcatgggggagcgcgcgggcgcccccgcagccgaggcggtcacgctcggcgggccccgcggccggaggagctccggcggaagggccaggggcgcgagccaggcctgcggcatctgcacatcggaggtgcgacagtcattgctgggttcactcagagagagggcagcgcgagagaccctgaactgacctcatgacgtcacaagcatctggcccagtgcgcacacatagagctcatgctgcatggctttccctggcttgcgctgggccgcctccctgaacttccccccctcctctcctgccaaggcatgctcctcccccatctctccgcatgcctgtccctaactcctgtgtcaaccccacagccacggccaccaccctggttcctcaccctgtcctccgcggcggccgcccgctcggcctcggtgaagtggccggcgtcttcgtgcgcctgccgcagcgccagcggctgccccgtgcagttgaagatccagagcgtgcaggtcaggcgcagcacgcgcgccccgctccccgggtcgaggccgtggcgcaggaccacgcccacgctgtgcccgctctgccccacctccaccagctggaggggggtgtccctcacccaccgcaccgcctgctgggcccccaggccggtggggccggaggaagaagggtggggaggcagctcctggggcggggtggtgatgggttcgtagggacatgtcctatttataagagcgcagggcaggatgcagtgcttgctgaacctccaaggggggcggtcgtcagccagacgcccagacaccgactctcccnnnnnnnnnntggtggtgatgggtttgtagggacataccttgtttataagagcgcagggcaggatgcagtggttgctgaacttccaaggggggcggtcatcagccagacgcccagacaccgactctccccggtgtaccctcctcccactacccctccagctcaccaccacctcgatctcctcctggcgctcagcggcctcggcgcccagcgcgcccagcatggcgggcgagagcagggccgcctccacgggcgcgtagccggcgggccgcaggcgcagccgttgcgcccgcgcctcctccagcccgtgcagggcgcggcgctggagggggcccagggtcaactgctggccgcccacgcccacctccaccggcacgggcaggctgttgaggagcacgaggggggcgcccaccacgatggccagcgcgccgctggggtcagagggagcgggcagcggccacgtgcgctcatcgcgcgggggagtttcctcgaactccccggccaggcgctgggagccgacgctgagggccagcggggcgtccaggccgggggagcccggcgcctggcggcacgtcaactggaaggtgccggcggcggctgcgcccgccctggcccctcccaccagctgcgagacggggaccgactcactccactccaaggggccactggcaccaaagctcctggcgcggtcgagcgaccttcgcgccaggagcgccggcgcggggggtgggccgccggtcgtcgaaccggcagccaccacgggcgggtgcaagggggggtgcctcgccagggctgcaccgggccccgcctgcgagaagagcacgcccgatccggtgcggctgacggtaccgccatgcgtaccgccttgatgatgcccgtcgtggccggcaccgtgacaaccgccgacagccaggggcctgaagctcagcgcgctcagcagcgcgtgctgcacgggcagccacaggccctggcccggctgcagcgcgcccaggctggcccgggggctggcctcggccacgaagccgaggggcgtgtgcagccgcacctccagcgccacgccgccgcggttgaccaggcgcaggccagagtgcagcaccacagaggtgccggcccaggggtcggggccgcgcgccacgctggccagcacgcggggtcggggggcgccatccccccgcgaccccggaacctggccacctgcgccaggccagggcccgccatacgtgtgggtgccgggggcggccaggggcacgcaacccgccgtgccgcccgagccgcggaagtacacccgggtgtggcgtggcgggcagggtgggtcggaggggtcgggtgagcatccggtcatgtcgcctcgccatcctgccggccgcacgcccagcatggggtcggggtacccggcgcacccggccgccaggtcagccagggtgtcatcggagccgggccagacagggaggtccacgcgctcacccgggatcaccgtgaggtggggccgctcgagagctgggagcagaggggtgggaaggggggtggggtgaagagaagagtgtgcgagaagagggcgggattggcatgagttgactgctgcatggctgcaagctcacacgtgcagcacaggctttgagaacctgacagggagatcatccagcatgagaccccagactcttggcggtctgacacatcagacccgactcagcaaccgatgacgtagatccatgacgcgcaatgcacggtgacacagcannnnnnnnnnggagctgggaacagaggggtgggaaggggggtggggtaaagagaaaagtgtgcgagaagagggcgggattggtatgagttgactgctgcatggctgcaagctcacacgtgcagcacaggctttgagaacctgacagggagaccatccagcatgagaccccagactcttggcgctccgacacatcagacccgactcagcaagcgatgacgtaatcccatgacgcgcaatgcacggtgacacagcacccacgatgcaaggaggcatgcccagcgtgatcaaagtactcaattcactgcaccatgcacacatacaaccaccccaccaaattacaagccgcatcccccctgcaactcaccaatcatgtctcgcnnnnnnnnnncctcaatttactgcactatgcacacatacaaacaccccaccaaattacaagccgcaccccccctgcaactcaccagtcatgtctcgccggcccgacgtgcccgaccaacccccagggccggcctcggcggcacccccgccgacgagcccccccatccacagctccaccgaggcccccgtggcgttgaccagcgtccagccccccgccagcgccggctcccccgcagctgcctgcgcggcgcgcaccgcctcccccgcacccgccagggtcagggtggagaggaaggcgtaggactgaagggcgcgcgccgcggccgccaccccgccctcgctcgccgtcagctccagcaggtcgtcggattcgagggacagcgacagcggcggggtcggccccggccccgcgctttccagcgcgccacgcagcgccaggcgcacctgccacggctcgaccaccggctcccagccggccagctgcggcgcccagctccggacctccagccggcagcccagctgcgccgtggcagtcccagagccggcgcacgctttcaggtcgtgagccgccgcctggagtaaggggcagcgcccgcgccccacgccgtccacgcccccgaccccgacgagaacagctaggatgccggcttgggcacgtagctcccaggcggtgagagccttggcatcatcacccttgtcccgcacggcacgccgcgcggcgccgccgtgcggcatcgcctcggcggcctgcgcctgcagacggtgcgcgagcagcgtcagcgcctgcgtcagcgccagggccacacccgccgtctcctggctcagccacaccgagccacgcgccagcgcgagatccacctgcacggcgtgcgccgatgaccccggcggctcctcgggggactgcggagtcggccccggaggctccgcgctctgtgctgatgatacgatgctcgtgagtagagcagcgcccggtgcctggccttcctcctccttggcgatgggttcagcatccagcactggcagcgcctggcgatccgggccgtctgggcggggagcaacaggcccgacacagcgcagctcgaagccggcgatccccgccagccccgcgccgagtgagaggctcggcgcggcgccatgctcccgctcctctgcatcagaaactgcagagcccaggcccgcactcagcagcagcccaggaacgcgcagctgcagccaccacgccgcttcgggcgctgcatcagcgattgccccagcctccgttttcgtaaccgcagcgagtcccacgtccgctcccaccctcgcctctgcctcaaggctggcctgaagggtaagggcgaggatgggcccccgccagctctggacttcgccagagtgtctgtctgccattcgcacactgtgaaacggcgagggcggggccgaccccgggccggactcctcggcgttgcacaccagcgtcgcgcgcaggcaggcgcagcgcacgtgccagcgcagggggtaggccgtggagggccctgtgtcgcctggttcgctcgtgccgaccgggtcgcccgcgtcgcccccggcgctgttctcctctgcagtcaccaacgcacggaggtcgggcagtgcgccgcccatcagccccacgtggttcaacacgcaggcggcggcctcctcccaggccccgacgtcggccgaggcgtggaaggcgaggaccggaacgaccaggttcacctcgccgccgatcagaatatccctcgccaggcgggcatgcagcgcggctgtgcaccgcgtctcgccgtttggcacgcccccgccgccgccgccgcccaggcgccagaggagctgcggcgccgtcacggcgaggggcggggggctggcgatgcgtgggctggggcccaggggactctccgccccgccctcctccacccaggcggggccggggtcgagctgcagcgtgctcgccccctcgctgtccacactgccgcccgcgctgaagtagcgactggcggcggcgctggtcccggcgctggagcgtcgctgcgaccgcgacagggcctcgtagaatacctcgccctcgtcgctggcgtccgccgggaactggttggtggactctgcatcgattggagaaaagggtttgaggagggagaagggtgggggtggggcagataccattggcgggcgcaccagtaaaccatctgtatgcgtcagagacctcatggaacagagcacgcagcgcaatcgatcaggtgccaaaagcatcacagccaaggcgcatctttccccgtgcgctggacgcctcgccggcgcacctgacgccctgcacggacctgtcacctcgggcggagacgcccagccggcatgactctcaatgccgcggtcccatccgctgcccggccccnnnnnnnnnnggcacctgacgccccgcacggacctgtcacctcgggcggagatgcccagccggcatgactctcgatgccgcggtcccatccgctgcccggccccgactgccatgccccgcccgcctcctcctcgccctccggcgacgcgacgcccccaccagggctgcgccgcccgtcggagctgactcgcagcgccgcggccgccgcaaagggcgtggcctggtccggcagcgggcgcagcaggnnnnnnnnnngccccaccagggctgcgccgcccgtcgaacccgactcgcagcgccgcggccgccgcaaagggtgtggcctggtccggcagcgggcgcagcaggctcacgtccagggtctcgaagccgagctccagccggcggcgggcgccggggccaggcgcgccgtccagcaccacctcgatgcggcgccagcgcccctccagccccgcgcagctcacattggggcccagcagctgcagccgcacctctgcgatggtcaggcgcgcggagcaggcctccagagacagcagccagcgcggcggctggggcggctggtgggtggcgatgggtggcgtgccctctgccagcgggggaacgcatcccaggctcggggtggcgaccggcgaagcagggctgcctggctcccagcttgcggcgagcgtgagcggggtgcgggcctgtgccacccccagcaggtccgacatggaccgggggctcgagctctctgcccccaagcgtgcgccatctgcggtttgacgggagaggattgcgttggtggtgctggcgggcagaggcactgcgcatgtggcacagggcttcaggaccaagacttgaagctggggtctcttcatctgggtcgtggtatcaacctgctgccatgcaaggctgcagcagcacaagcatgtcgctacacttgcatcctgccttgacctgttgtcatccaccacgcagagcaggaggcatcctgctctccatagcatgggttcctcacccggccctcccgacacctccccaccccctcctgtggcacctgagctggaggcggggaggtccaagaggttggggcgccgcagtgccgccagctcggcagcaaacagctccgcggccgccgccgccatggtgatctggctggggtgcaggccggcaagcacatcgcccgcgcccagggtcaaacgcggcggggcccccccgcccgcgcgctccacggtcagggcgacctcgggcaggcgcaggagggggagcagggcgcggccgcccacgcccagcgtggcgcaggacagcgcggcgccgcgcagcgcaacgcgctcgcccggctcgtccagcgggaagcgcaggacgcagcgcggcgcctccagcacccccagcacgccgtgcgtgaggaggaagtccaacgcggcgggggccaggcgcgcggccgcggtacccccgggctggtatcgccactccgccacgcactcctccaggtccagcgtgaagctctcgctctgcacaggcagcgtctgagcgggcgcggccgtgctgtggcggggcgcaggggcgacccctgtccccccggcgtcgatgccccctcccgcccctcctcgcagcgcgtcctcggccacactccccaccacctcctcgggccccacacccgtgtcgggcagggtgaggaggaggatgcgcatgagggcggcgtggcccagtagcacgttgttcagcgccacgccgacgtgcaggtgcgccgcgttttccaccaccgtgatcacaccggcgttgggacggccgcggtgcaggcgggcgatgaagttcccgggttcgtcgcggtaggccgccgacgctgcgtcgtgcaggcgcaccgtcgtggccgtgcgtggcgcagcgccagcgtcgcgggagaagtccaggtcgagccgcgccagggtcacacgcggcgacacgcgccatgcgccgcggtccaccacgggagggggcagcaatccggaccccggcgccgtctggtcctgcagggtcaggtccannnnnnnnnnggggggcagcactccgggccccagcgccgtctggtcctgcagggtcaggtccaggagcgaggcacccaggttcgcctcgccgctggctcccagggccaggcctagcacgccgctgcccaggcgcaggcagagcagcggggattgggcggcgggcgcagcgggcggcgggcctcctcttgaagcgcgcgtccccgcgccgccgcgcgtggcaaacggcgccgggccggcttccgccgcgtcaaaggcgactgcgcagctcacgcgctgcagtgagaggaccagtcgcgtgcggcaggggttatcgctttcgatctcagacccggcatccctgccagcggccagcggcggcacggcgcctgcgtcgccgagcgcaccgccactcgcaccctgcatgccctggaccggaggtgccctggcctgggtgggcacctgcaacgccgcctggatctcggccagcaggcgggtgcccaagctgaagctccagccgcgggcctctatgctcagcgcaggggccttgacctggagagggaaggagcggaggcatgttcttgttgttggttcaggacgaaatgccccacaaagaggctggcacagtcccatgtttacttcttgggaagaggggtgagaaaagacttgacatggtcgcccgggcagggcacctgctccccctgagcaccggcatgtccaaacatagccgtacccatcaggaacggtccataactcgggtaacaaacctcccaagcagcaccnnnnnnnnnnacggaggcatgttcttgttgttgtttcaagacgaaatgccccacgcagaggctggcacagtcccatgtttacttcttgggaagaggagtgagaaaggacttggcatggtcgcccgggcagggcacctgcaccccctgagcaccggcatgtccaaacttagccgtacccatcaagaaccgtcccacgactcgggtaacaaacctcccaagcagcaccctcggctacccacgttgggggtgcgcggcacacagaggtccccctgcatggtcgtcggctgcagtacgggcggctgggtggggcggaacaccgccccgccctcctcccactcctgcacgatcagcgccacgcggcgcacgctccagcgccacgggacgcttgcggccgtggcatgcgagggaccgaccccacggtgctgatccaaaagacctgcgtcgtcgacaccggcgtcgcgtgcctcgcccatcaccactgcagcagtgctnnnnnnnnnncggtgcggggcaggcagaggttcccctgcatggtggtcggctgcagcacgggcggctgggtggggcggaacaccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgcgtcgtcgacacccgcatcgcttgcctcgcccatcaccactgcagcagtgctccgggcggccagctgcccggcgctgagcagcaggcaccgctgggcgccgagcgccagcctggcgtcgacccccgccagctggacggaccaggccacgggaggccccaaccccgccagcctggcgcggcccagcgcctc

SEQ ID NO: 41117 - DNA, 9228 bp, Chlorella protothecoides
  modified_base (1510)..(1567): a, c, t, g, unknown or other
  modified_base (1875)..(1916): a, c, t, g, unknown or other
  modified_base (4590)..(4599): a, c, t, g, unknown or other
  modified_base (5066)..(5075): a, c, t, g, unknown or other
  modified_base (5687)..(5696): a, c, t, g, unknown or other
  modified_base (6323)..(6332): a, c, t, g, unknown or other
  modified_base (6411)..(6420): a, c, t, g, unknown or other
  modified_base (6499)..(6508): a, c, t, g, unknown or other
  modified_base (6747)..(6759): a, c, t, g, unknown or other
gggtggggcgcgcgcgacgccggggtcgcccccgcgcagcagcccgtgggcctggagctgtcgggctaccacgcggcagcgctggcggcggcgctggcacgcggcggcaccagcgccgggtcgctgccctccctcttctccccgccctcccgctcctttgcgcaccaggcgcgctggatggagggccacggcagctggcgcctgggcgacggcgaggcggcggccgcgctggacgcgccgctgccctcctcctactccggcctgctgccgttgctgccgggcgggtcggtgcacctgccgggtttccagccctcgtccgtcagctcctacgccgccgcgctggcccaggcccaggccgcggcctacgagagccaggccgccgcggcctacgaggtgcaggcccagctggccgccgcgcagcaggcttacctggccgccgccggcggatacccgggctcctaccctggcggcgcctcgtacccgggcgccggcgcgggcgcattcccccaggcacaggcggcgcagcagcacctgctgctccagcagtacagcgcgcagcaggcgctcgtggcggcgcagcagcagcagcagcagcagcagctggcggccgcgcagcatgcgcaggcggcggcgcaggcgcaggcgcagggggtgccgcaggctggctggcagtctgccgcgatgccgaccgccgtgctgcatggcgcgccgagcggaagcctcggcccgggcatgcccagcccaggcttcgaggacgggcccgagccgggcgactggaacccgctgtggaggtgaggggcaggggcttgaaggggcggcgggcggaggaagagcaagggggaaaggagtgctcgggggaacgaggcaggctgaggggcacgtgcgctcctgccgctggcttgtgtgggcctgcattgcgtggtgcagggatgggccagagggcctctgcgcctctgatcacagcggctgagggacctgtgtgacactgtggacccttttgaccaaggacttccttcccggcaccgccccgctctccccaaacacacctggccctccccctcccccctccccttcaacagcgacgacgtgctgcgagaggaggacgcggcgccgcgtcccctgctctccccgccctcctccagctcagccctgggcggcagcctgagccagcgcctgtcccacccgccggcctcgccctcagcgccgtctgcgggcccgcccgaggctgccgccggcggctggtggcggcagagggcgcacggcacctccctgcccccgccaggcccgcactccctgggcgcctcccgacgcagccgggaggcgggtggggggagtgcccaccccggcccccgccaccaggccgaggcgcaggcctacacgccggcgcacgcgcccgactgggcggcggcctgcgcccagatccaggccgccgcggccgccgcgcaggggcacggccacggcgccgacccgcgcgagtggccggcggcgccggcggggctggccccgcccnnnnnnnnnnnnnnnnnnnnnnnnnnnnnnnnnnnnnnnnnnnnnnnnnnnnnnnnnngcccgcctcgtccttgcccaccacgctgggggggctgaacctggcggggcgcagcatggacggccaggggtacgaggcggggacgagcgtgcccgggtttggattccagccggccgcagacgggtgagaaaggggggaaaatgcggagctcgtgctgccggggcaaacagggcgggcggcgacctcatgcatgtgcgtgcccgctgggaatggagggaggaggagaggtcctcggcgcgtgggcgcgtcgcaggcaaagcgaccacgggccatgccgtggacctcctgctccccccccccccccccannnnnnnnnnnnnnnnnnnnnnnnnnnnnnnnnnnnnnnnnnattggatgctcctcggctccccccttgcgctcgctgcatgcccatcctcccagcccactcgtcgtcgggagcctcaaccccatgaccccacccctcgctgcagctctcgctccagctggcagggggcgcagcagggcgtgggcagcgtgcccggggtccaggcgtggatcgaggccaggacgcagcagcagctgcagcccagccccttcctgtaccaggccgggtatggcggcgggtgagcaggccgcgacgacgcccacacatttttcgatgcggtctgagcgggaggaaacgccgcagcacaggaagggcaccgcagcttggcgaaatgcatcggtgggatgtcccgtgcctgcccaccacgtatggtgtaatgagggcagcccagatctacggggggaccaagggcgcgaagcaccttccgtggaacgagacggtgtataaacaccgcggggatgtgaagtgctcacccacacctacttgggaaaaacaaagactggattcaagaaaacaattgttgacgtgaggcctccatagtctgcgaaattccccacttttggacaatcgcgtacccggctcctcctccacctctcggcagtcccttccagatccacgcacaccgccatgtgttgcgggaggcagaggggcccagcggccatatcactacgagtgatggcctgcatgaacttcgtgacgggcctgggcttcataatatacggactcgtcctctgcgccccacccaacaccgcgctcccgctgtgagcttccagcgaccatgagggcagatccatgtcactcaccagtgtgtgagaccatggggagtgttcccctgccttgaactgattggcccctcccccccctctcccctacgtcgcgcaggggcctggtcattgtgggatcattcgcttgcttcacctccctgttcggcctcatcgggtcctactgctggctctgctgcctcaccatgtacctggtgatgggatgcctgctcaccatggcccagctgggcatcatcctctcgctcttcttcaacctgaatggggtggtggccaacatcgcgctgtacaagctcagcacgaaccccttttgggatgggtgagtgaggcgtgctgcatccgctgggtgtgtatagaaacggtgcctgtgactttcgaggttgggcttgtggtcgactgccccctcacggggggcttgcttgctggctgggtggggctgcggcagatgagggatcctggcccggatcatcaaacgtgtatgataccgaaggccaactccgagtgcagtgaggatgctgtgcccatgccaagttgtgctgctgcccaccccctgcaccgatcccctggatgcaaaggttttgcaccaacaagatgtgcccataggccatgcacacctggccccatcccacagtgagctaccactcagctccgtccccgctccacctccccctcatgtcgactaggtacgacggtgtgcgcaacgcctgcctcatcggccgctatttcttcctggtggccctcatcctgcaggcaatcggcatgataatcgccgtctacctgcgcgtgcgacgccctcccacctacgacgagtacaaggagtttgagaacgacgccgagcggcagctgcagcgcagcgtccagaacgccgtgcagatggaggagctctcggcggcgaccacggggcggcaggcggccgcccccggcggcccaccccagctgtcgcgcctcaccgccgcctcactgtacgccaagacgtcctctagcaggtggggtcggaggtgaacagggcatcggagggttggcgcagcttgtgcatgtaatgggggttgggacaccatgacgagggctggctttccgtggagggggatgcacaattggccatgatcaggttgtgacagggaaaatctcttcctgtgagcacttgatagggagccagctgtcccaaggatgtgtgcctggttccatcagtgaatatctctatcctcccgccattccccttcctatgaccacagtgtgctcaagaagatgtcggctaagtacggcagcttctcacacgacgcctcgatccagcgatcgtggctgtccaggacgttcggcaagggcccttaaggtcccttggcagaggcacgagcagcttcaggggtgcaccaggccagtgcacgtgcagggatgggtgatctggcccgtgcacacacccacatgcagtgcagtcctttctggaaggcagccctctgtccaagccctgagccttgtacccccaaagagcagtacgttgcccttgcctccgtgcaaagagttgaccctgactggcaatggcccttgtggcatggactggaggtcggcaagtatttaacagcagcgataccatgtcatcatcccgagatcggcaggtggccctctttcagggcgcctcaggctctcgagcccatcacaccctcaagatcctttgcgatcgatgccagccaggcctgcttggccgccttgtcttggatccacaggtggttgccatcgatgggggtgcaggcaaagctgccgctggtgaagcgctgccagccctgcagcggagggaggggtggaggtcggggatggcggatgtttgaagctgcgctgccacggcagagagacgaggcgtcccatgccatgcagagctgcagcgtggcaggcatcgagactcacannnnnnnnnnagatggcggatgtttgaagctgcgctgccaaggcagagagacgaggtgtcccatgccatgcagggctgcagcgtggcaggcatcgagactcacaagctggcctccacccctggctgtgcgccccgtttctttcttaatcccctccaaagaaccatctggggtcttgtcgctcattccctcaccacgatcactccctcacctcccccatccactgcttgatcctgaggtcgccggtgccccagtaggcgtggatggggaagtcaaagggcgcctcccccgctctggtaaactcgtactcgtcaaacagtcggaagtctgctcgcatgatgggctggtatgtcggccagagcgcaggcgtgaacaggatctcgctcacactccagccgcggcactcctcctgcacacaggacggtacacagagggcaaggaccatgcttggcagtgggcatttgcagagagcgggtcannnnnnnnnngcgacggtacacagaggggaaggaccatacctggcagtgggcatttgcagagagcgggtcaaacaaccagtgtctccatgccaaacacgcagcccactcccgcgcgccttgaagtcctcctcgccaagggtccgctgctggcgccagggccgctggtcgaaagggatgtcgggggcgcacagcgcggagagggaggcgtgcaggggcaggggcaggcccgcgtccctggcggccgacagcagttcgaaggccagccaggtgccgagactgtgccccacgatgacgtagggggtgctggccaggcgagacgcgaccacaggtagcaattctttcgccagactcgccgcgctgtctgcaaaggcgtgcttgctgcgcaggttgcgccccggcggctgcacggccaaacactcggcgttgttggcccggcaccagtcctgcacaggggtgagttgttggttgagggagataaggtagccgtccatggctttcctatgcaagccaggcatacactcatctaggtaattgggctctttttagtgtaaagcaagcacccctcccagtcttgtggtgcaccctcccccatccaggtgcccaccaggaggggggatgggnnnnnnnnnntcactcaagtcttgtggtcccccccccccaaatccaggtgcccaccaggaggggggatggggcccggcggaccccggtgccctcgctcgtgtaggtgtcctccgaggtgcctgcgctggggaagcagaggaccagcagcgccggcttctcggaggccgtgcggctcaaggggaggcccgggaaccaggtgcggaacacctcggcctcgggcggcgggaaggtgggcgccgccgcgtcgacccctgtctcaaagtaccgccggatccggctctcggtcctgtggaaaggagggggtggtgctgtggctgggaggtgctgggtcaatctgctgtgggctggcatgcattcttagggacctcctcaacacccgtaccagtcctgtgcagtggggggtggctcctctatctgacgaccttcggcctccgcatcttccatcaacacctgcacggcgtatatgcaagaactttcgtgctgcctttcaacgatgcaggcgccagctcgttcatgccgatgagtcaaactataaccaccatgccgccatgccaacaagtcctggctgtagctcgaagccgcttcgggccgcagaatcgcagatgcgtacctctatgaggtttatgtttcgtattnnnnnnnnnntggaggcacagcagttagatactaaggaattgtagagtcatccaggaaggcttgcagatcaggcttggaggttgaaacnnnnnnnnnngggaggcacagcagtttgatattaagaagttgtagagtcgtccaggatggcttgcagatcaggcttggaggttgaaacnnnnnnnnnnatcatgccgatgagtcaaactacaaccaccatgccgccatgccatcaagtcctggcagtagctcgaagccgcttcgggccgcaggatcccagatacgtacctctatgaggtttatgtttcgtatttgcgtctctgtcaacgtcatgtatgcgaagtatcgtgctgtgtatctcgtgtcttgtgggtttcgcactccgaaacgtgctcggtcgatgataaatgtcgcaacagcaggagannnnnnnnnnnnnagtgtgaacgtccccgtcaaggcaaataactcaatgcgcgcgcggggatgctgttttggggggagccgtcgtccgtgtacatgcaagggtttgactgttagccgcagccaccgagacattcaagactcgagcactgcgccaccacatctgaaagtctgtttccttactcacagacagtgcgtggatggtgagagctcagacgctgttgccaagttgcacttacattgcatcttcatctagcaagccataggtcacaagtaatgatagattgacaaaccttcatcctgtgcttcagtaatgatatgctgaaagacaccagtgacgagctggtgcgtgaatgtgtcggactgctgtacaccttgagcgctttgttaaacattgcagctcagtaataaactacacagaagtatcacaagtcagacacttggagatatgaactctgcatcttctctcagattttacttgttactttccgagaatagccttgaaggtgaaattgattgtcagatgaccctctccgagagccccattctctcatctcagctgtttccccatcgcgggatcgccgaaatacaaaatcgcgatcggacaggcaagcccgccccgcgccctcttgggcgcccacgaaactcagatcggtgcccaaactgtattcttcacgtcgaaatgctgtgaagggaaagacgcgagcctttgagacaagctcagcaatggagggtgtggtacgggtgctgtcccgtctctcccacctcggacaagagctgcaggccacgggactcagcgaggatggcgtaacaacagctctcagctcctacatgagcgataatttgctcgaaacttcaccatattgggtggcaagcgcgggcgaggcgctgtgggcgaggttgcaggaggctggtgccgggctgccccacatctcccgagccctggctgccatcatcacacacagcagccacgaccatgcagtcggtgccgtggagctatgtttcggccttctggccgtcgacaagtgcccggtaggggtggtggtgccatctaggcccggtggtgaggaagttgcactgagcatggcatacacttgccgcacctctttcccaccctgcattccccacctcacgacagacgcggggcatctttgatcgcgtgctgtgctcttcctaccttggatggctgcggggcgtccagagctccggcccgacagccaagaagcgtgccgggcggaaggggaagaaggcggcggcgatggacaccgacgaggatgaggcgatggacgtcgaccaggagcacccatcacccctggcctccagcctggcgggcttcgccggcaccctgcgcaccctcggcctggctgaccagccagacgtcgtccaggacgccgcctcgacctgcgtcgacgtgcgctggcgctctggtggtggggagtgatgcgactcgccatgtcttggatatccacactgcagtaggcctgaccaactgagccagccgccttgcattcatgagagtctgcgccttggattctgctcgccaccgcctctcccttcctcagcccccccattccacatccccactgccagttgatctgcaagggcggggcctcaaccccccaggaggtgtcggcggcctacggcgtcctgctctccttgctccagcccatccacggcaaccccagggacctgtgcgccatggtgttccggcacctggcgtcgggcctggcggccatggggggaggcggcgggaaggtggcccgcgccgaggtctgccaccagctcatcgcctttgccagcagcgctctggggtgcgggcctgggtgacggaaggcgggcagatgggggccgtggctgtcgacagccaccccctctctgtgggtcactaaggggtgtcttccccccccccctgccctgcacacgccctccttccaagggctatcttcccccaccgctcccccccttccacctgcagacagagccccagcgcagcgacggagtcggtggcggccctggcccgcgcagtggtgctgcgcgccgcagaccgcgccgacgcgcgcaccgctgccgtggagctggccatgggcctgctgggcctgctgggccccgccgagggcgaggcctttgtcgtcttcaccgcgcgcctgtcgcgcacgcccaaggcatgtttgttcatttgtgttttgttttatcgacttgggtgggggaagggggccccttgtccatgtttccaaggggtggggagatccccggctgcagtgtgcacgccggtgggtcgctcctcacacgaaagccctgccccggtctgcgccgcccactccaacagacccactcccactttccccaaatgcaggtgagccagcgcatgatggccgtggacctggcccccgccctgctcgccgcggcaggggagcccttccagacctcggccgccgcgctggaggccgcggccgcgacgcccggcgcgggcgcgggcccgctcgtg

SEQ ID NO: 41118 - DNA, 67 bp, Chlorella protothecoides
cacaacccaggtccgtgacgggggtggcagctaaagtgggatgaggatggcgatgagggactcagat

SEQ ID NO: 41119 - DNA, 61 bp, Chlorella protothecoides
gagaagccccccacccccacccaaggagagtttccctcctccaccaaagagtaacccccca

SEQ ID NO: 41120 - DNA, 74 bp, Chlorella protothecoides
gatacaccatctcctggggtgagctggggagaagggctgcgttgtgctgggatggaaggaggagcagggcggcg

SEQ ID NO: 41121 - DNA, 121 bp, Chlorella protothecoides
ggtgggcctggtggccgagctgggcgcgcccgaggccggcggcgcggcgccgggcgacggggccggccgactggacgccacccccagctcgacggcgctggagtacctggaggcggtggcg

SEQ ID NO: 41122 - DNA, 80 bp, Chlorella protothecoides
ccatggcgtgtggcctcacacggcatcggaacaggtttgcgcccccccccgtcaccccccaccgtctgtcacctccacca

SEQ ID NO: 41123 - DNA, 61 bp, Chlorella protothecoides
cgcctgctgggtggactcaccccccttgcaaccatcgaaactccaactctccttccgtcac

SEQ ID NO: 41124 - DNA, 80 bp, Chlorella protothecoides
cacctcttccttatggacccgggtgctgtgaagtttggggactcggtgcgtggactgtgcctctgacactcgccacactc

SEQ ID NO: 41125 - DNA, 61 bp, Chlorella protothecoides
ggcgcgccccatcctggagtgggagagcacgctggtgctggtgacgggcgtgaccgagtca

SEQ ID NO: 41126 - DNA, 79 bp, Chlorella protothecoides
gatgtggacatgccgacctcccaccccccccaaccctgcagcctgcgctttcctgaagcactgggacaggctgctgcac

SEQ ID NO: 41127 - DNA, 77 bp, Chlorella protothecoides
gcgacagtgggaggccggggcggatggagaggcgcgaggagcaggaccgtgggccttccaggcggcacacgcgcagc

SEQ ID NO: 41128 - DNA, 109 bp, Chlorella protothecoides
cggcgacaggcccccccgcggcgaccgctttggcggggaccgcccccgtttcggcggcgacaggcccgaccgcttcggtggcggcgaccgcggcggctaccgctccgac

SEQ ID NO: 41129 - DNA, 61 bp, Chlorella protothecoides
caaaaatcgcccagtccctcagattccttccgctgcctggacccccaacacacacacagcg

SEQ ID NO: 41130 - DNA, 6603 bp, Chlorella protothecoides
  modified_base (355)..(364): a, c, t, g, unknown or other
  modified_base (1210)..(1219): a, c, t, g, unknown or other
  modified_base (1416)..(1425): a, c, t, g, unknown or other
  modified_base (1684)..(1693): a, c, t, g, unknown or other
  modified_base (2078)..(2087): a, c, t, g, unknown or other
  modified_base (2373)..(2382): a, c, t, g, unknown or other
  modified_base (2705)..(2783): a, c, t, g, unknown or other
  modified_base (3090)..(3099): a, c, t, g, unknown or other
  modified_base (3225)..(3234): a, c, t, g, unknown or other
  modified_base (3329)..(3338): a, c, t, g, unknown or other
  modified_base (4035)..(4044): a, c, t, g, unknown or other
  modified_base (4108)..(4117): a, c, t, g, unknown or other
  modified_base (4264)..(4314): a, c, t, g, unknown or other
  modified_base (4816)..(4825): a, c, t, g, unknown or other
  modified_base (5675)..(5684): a, c, t, g, unknown or other
  modified_base (6118)..(6127): a, c, t, g, unknown or other
  modified_base (6391)..(6400): a, c, t, g, unknown or other
cggcggcggcgcgcgcgggcgcggaccgcgtcccgggggtcgcggccctgacgcccccgcctgcccgcgccgacccgctgcgtctgaccctgggcgtggaggccctgggcctggatggacctgcagccgccgcctggctggaggccgaggccggcgtcgtgctggagatgagcacgccccgcaccgtggtggccgcctttggcatcggcagcgccgcgggcgacggcaacgcgctcgtggaggggctgtgggcgctgtcgcgcgcgcgctgggacccaggaagagcggcgaggtgtgctgccggcacgggtccctccgagcccagcctgaccccgccgccgctgccagaggtggnnnnnnnnnnactgggacccaggaagaccggcgaggtgtgcttccggcacgggtccctccgagcccggcctgaccccgccgccgctgccagaggtggtgctggcgccgcgtgaggcgctggcgcgccgcaccaccgccgtgcccctcgtcgcgtccctgggcagggtggcggccgaggcggtgtgcccctacccccccggcatcccggtgctggtgccgggggagagggtggacagggccacgctgcgcgcgctgcgcgacgccgcggccgcagggcgccgggtcaccgggtgcgccgacgcctcgctccgcaccctcagggtcgtggaggaggggtgaggtgggagtgcattgtgtggcgacgtggctgccccagcctgggagcgactgcagtgggcgctccattggcatcgtatgtttgtaccgagccactcaccactcctccctgccgtcgaccatgtgtcacgctcagacagctgcagcggggccaggctcgggcttgatccggctcgctgtttactcacatgcctctcccatcggctcagctcctgctgtcacaccctgggtcccaccccagaccctggctcgcagacctacacgctcatgtacaacatgggtgaagcaatgcaatggggccccggcaccgcacgtcacagccgcttcaggctccgcttcttctccggcgccgcctttcgtacccctggggccgccgagaggctgcgcggggcgggctttcctgcatcatccccacagccctctgcgttcacggtgtttgccccgcctgtcgccgtcagcggcgtttgcctgggcatgtcgggggggggagggatggtgggcgcttgcctcgaggctactnnnnnnnnnncgtttgccccgcctgtcgccgtcagtggcgtttgcctgggcatgtcgggaggggaggggatggtgggcgcttgcctcgaggctactttgcggcctgagcgccgttgctctgcgcgtcgagctgtgggtgagcgaagcctcgagtcggactccacatcgatgcaccacctgtggtctgctggaccgactcacaccagnnnnnnnnnnttgagcgccgttgctcggcgcgttgagctgtgggtgagcgaagccccgagtcggactcctcatcaatgcacctcctgtggtctgctggaccgactcacaccagaaatccgtccgatcatccacatgtgcactgctgcagagcatccggtgcgcacatcggcgcgaattatctgatcataagatcgccctctgcggctcgcacgcacccgtcgcggcgcccagcccctgctccacctgcctcctggcacctccccgcgcnnnnnnnnnntgcgcccgtagcggcgcccagcccctcctccacctgcctcctggcacctccccgcgcccgcccacctcgtggcgtgtacgctggtgatgagcgcggccttccgcgcaaactcggggaagccctccagcaggaggcgcccggcctcctcgttcagcgccgactcggggttgggctccaccagcaggcagcggatgacggtcaggatgtgcctcaggcccaggtccggtgtccagtcccgcttcagggtgttgacgcagatgtcgccggaggtggagacgttggggtggaagatgcgggtcaggaagtagcctgtgtgtgtcgaggaggaaggagaggtgaagggtgcctgagtcagtgacagactgcccgcagagctggagggcgnnnnnnnnnntgagggggaaggagaggtgatgggtgcttgagtcggtgacagactgcccgcagagctggagggcgcgagccagtgggcgctgtgcatgttgggctccagaccgatttttcaggcatgagcttggaaactaatgtacggtgctgggtgtggtcacaaaaaaggcatcggcatcgctgccatgccgttgaggggcggtcttggtgggcagcagagctccacccagcttcccaacgaccaacagtcctcaaagttccagggccctcacctttcggggctgcagttggannnnnnnnnncgcatgttgggctccagaccgatttttgagggcatgcgctcggaaactaatgtacggtgccgggtgtggtcacaagaaaggcatcggcatcgccgccatgccgttgaggggcggtctcggtgggcagcaaagctccacccagcttcccgacgaccaacagtccccaaagttccggggccctcacctttcggggctgcagttggaaaatcctgggggaacaccagcttcatgcggaaggttccgccctcaaacggtgttcccgctgcgaaagaagtgtgtagggctggtttcatgcagcggctggaggcgttcggcatgtcaannnnnnnnnnnnnnnnnnnnnnnnnnnnnnnnnnnnnnnnnnnnnnnnnnnnnnnnnnnnnnnnnnnnnnnnnnnnnnncatggccagatacgaaccaaaatctccccacccccttctccttgaccaagccacacctgggcctacatactctgcctgtatgtcggacacgtcgtcctcgttcagaaacacctgtgctcgatggaagtcgcgtatgcaccttaaggaagcatgcccagctaatgtatgttcatgcccgtcccgggacccgcttgtccgtgcccctcataccttgacaccatcgatggggttggcctgcaggtctcgatactccttgagcagctttgtgacagcagcgggggccaggctcatcgtctggtttgaatgnnnnnnnnnntaaacacctgtgctcgatggaagtcgcgcatgcatctttaggaagcatgcccagctaatgtgtgttcatgcccgtcccggggccggctcgttccatgcccctcataccttgacaccatcgatgggnnnnnnnnnngcgcgccccttccacccttcctcgcaccagctggttgcaattccgtctccgacaacagcagcacggagggtctgtctcgatcctacctacttgtnnnnnnnnnnacgcgccccttccacccttccccgaaccagctggttgcaattccgtctccgacgacagcagcaaggagggtctgtctcgatcctacctacttgtgattgtaggctttattattgtataaatgttttgcaaggattgacgtgcatgcacagtaaggagtttgaaacttttgcaactatgcagaggctgtttgaaagtgcaggggcctttcatgacctggatagaaaccaaggccgctccgcgatgatggggtcccatgcactgaacgaccacagcaccaccttcgcacactgaccctgatcatccgaggattatgcacacttgacctctgttgagcttccctctcatcgctgccgtctgcccacctctgagcagcctcgggacctcgcatggccaacgcttcggcgtgcaccgcacggacccccgtggtcccctgccgggcggcatggcagcccagcagtcgccgttcgcgctgcgactttggtagccggcctgcctcgcgtcccaggcagcgcgcatcccggtcctcgtccctgctggtctccgccagtcagcccctcatgaccccccggtgcgtgcaacccccttggggtggtctggaatgctatcatgctgcaccccaccgctttaaaatagccttatgggatcccagattggtagctctggtgatatacgtggctccggccaacatgcctggcnnnnnnnnnntctatccccccacctccctgcgctgcgtgcagaacacaggacatggcgggggaccccttcggcnnnnnnnnnntcaccgctttaaagtagccatatgggattccagattggtagctctggtcatatacgtggctccggccaacatgcctggccacagggatcctcctgatagggggtggtcccgcaccccctctccctcccggtccccatcgcggagatnnnnnnnnnnnnnnnnnnnnnnnnnnnnnnnnnnnnnnnnnnnnnnnnnnnctgctcctgcgccagcgcatcatcttcctgggcggcgaggtcaccgatttcgccgcggatgccattgtgagccagctgctgctgctggacgcgcaggacgcgacgcgcgacatcaagctcttcatcaactcccccggcggctccgtgacggcgggcatgggcatctacgacgccatgcagctttgccgtgccgacatccagacctactgcttcggcctggcagcctccatgggcgccttcctgctctgcacgggcgccaagggcaagcgctactccatgcccaacgcccgcatcatgatccatcagcccctgggcggcgccagtggccaggcggtggacatcgagatccaggtgcgctgccgtggtattgcggttttcttttgtgcttgtgtgtgtgcaaggagggggaaagctcggctctgggttagagctgggtggtctagacctcaagtgctgcagggtacgcggtgcgagatgggcaatgcttgtgtctctccatgcnnnnnnnnnngcttcaagtgctgcagggtgcgtggtgagagatgggcaatgcttgtgtctctccatgcccttgccatgcctacaccatgtggcccctccccacccccgcccacccttacaacccgtaggccaaggagatcatgtaccacaaggccaacctgaaccgcatcatgtcggatgccacggggcagcccatcgagacgatcgaggaggacaccgaccgagatcggtacatgtctcccctggaggccaagaactacggcctcatcgaccacatcgtgggaggggaggaggtgggtccgagattgtgggggtgaggagggatgccttgctgtgcatatacaaagggatagactggagcaccataggcggaacggtggcctgctggctgaactacccgctcccttccactgccgcaggcggtgttcaagatcgtgggcaacaccaagaacttccccaagacgcggcgggagtacatcgcgtggggcgacgaggacaacgatggctcacggtctgagcgcttcctgcgccccgccgaaccctacacccagcccgtaaaaaccaaggagtgatggccaggggagcagttttagagcaccgcaagggctgggcctgtgtggcaagtccctcggcccctcgctcccctgtgtgtgagggttgtccctttgccttggagccccttcctgtgcctctgtacatgcctgaagcatagcctcggcagggcttgccttactgaagtcatcgaatcaagctggaagcatcatcttgttgacaagatctgtgtgggaagggtataatcaggcgacgcgcccctcgcaacccctccagaggttgaggcctgagattgggcgggaaagcannnnnnnnnnctcaagctgggagcatcatcttgttgacaagctctgtatgggaagggtataatcaggcgacacgcccctggcaaccccgccaggggttgaggcctgagattgggcgggaaagcagggagtgacctgtcggctccggcccccacccgagcgccgaatgcttatggtcggtgcaggaacacatgcatgcaaacaagcgaacgaccacagcgtcgtcccactatattctaaggaccaggcgctgttcatcagtgactgcccggctgggaagtgctgcacacccgtacacagcgcaatggctttcggcgatagaggcgggcgtggaggcaggggtgggcgcagccctggaggccgcggaggaggtgcgagaggtgattgcatatggtactcgtccggcccggccttgccatggatcgctgactcttccccgtttgccnnnnnnnnnnctcattgcatatggcactcgtccggcccggccttaccatggatcgctgactcttccccgtttgcccgcgcgccggcgtgctttgcaactggggatgctcggcccaccgccatccctgctgtattgtggtttcctcacaacattactgtcccttcgtggatgtcaacaacaacccaccgggttgctgcgctgtgcgcgacacggattttctgcatcgcaagcccctcccaccgccctcctctcacccctgccctctgtcccaggnnnnnnnnnnttgcgctgtgcgcgacacggaatttctgcatcgcaagcccctcccaccaacctcctctcacccctgccctctgtcccaggtcgcttcggcccccccggaggccggggcggcggtcgcggcgccccacgcggcggacgcggtggtgtgtctaagttcggaggcggcggtcgtggcgccggcgggcgcggcgggcgcggcggccg

SEQ ID NO: 41131 - DNA, 114 bp, Chlorella protothecoides
ggggcgcatcccgggacgagctgtgcgaggtgggggagcggggaccgacgtcggcccgccggagctccgctgcatctggccccgtggcctggccagcagctccacctggcggag

SEQ ID NO: 41132 - DNA, 68 bp, Chlorella protothecoides
cagccccagcccctcccccagccccagcccctccccgccgtctgtggtcctgtcccagaaatctgcag

SEQ ID NO: 41133 - DNA, 93 bp, Chlorella protothecoides
ctcccagcattgaagataggatccatgcaccctaaacctcagatacagccgcaaggatcatgtgccgccgcccagctgctcacctgatctgtc

SEQ ID NO: 41134 - DNA, 65 bp, Chlorella protothecoides
tttttgggggggggggggattttttttttttttttttggcggggggggggggggggggggggggg

SEQ ID NO: 41135 - DNA, 94 bp, Chlorella protothecoides
caagcccggtagcggcatatcttcgactcgcgcgaagcatacgccgcaggatcggacttctgtcatgatggggacacacagggttccggttgaa

SEQ ID NO: 41136 - DNA, 83 bp, Chlorella protothecoides
ggcctccccacaaccaggtccctttcagaaatggaaccttccccgcgcgccttccccagcgtcagccggcccacctggagcga

SEQ ID NO: 41137 - DNA, 61 bp, Chlorella protothecoides
aaaagctttttacaaacaacgtggctgggggacagaaggctgcaaaaggacgatagacctc

SEQ ID NO: 41138 - DNA, 61 bp, Chlorella protothecoides
ccattgtgcagccggcgcgcgtggcgggggtcaccaccgatccccaccacctcaagtacgt

SEQ ID NO: 41139 - DNA, 61 bp, Chlorella protothecoides
ccggcagaagaggtcggcggcgggggggccagcgggcagcgtcgcgatcaggtcctggaag

SEQ ID NO: 41140 - DNA, 70 bp, Chlorella protothecoides
ggcggcgccagccgcggcggggcgccgtcgagggaggccaccagctggggcggcgccagccgcggcgggg

SEQ ID NO: 41141 - DNA, 61 bp, Chlorella protothecoides
gctgcagtggtggtaccagagctactacgcggcctcggggggagggcggttcatgccgccc

SEQ ID NO: 41142 - DNA, 152 bp, Chlorella protothecoides
gaggccggcctgcggtgctcaagggggaaagggaagggtcgctcacactgccgcgcatgggaccccctcctgtgactcattcccacggccgtcgagcgcctcggccccccctgcaacaggatgagcagcgtcggcgggagcatgcccagcgc

SEQ ID NO: 41143 - DNA, 61 bp, Chlorella protothecoides
aagcaggtggtgatgagcacatgtggcgggggcaccctcttaaagtgatctgcgagaacac

SEQ ID NO: 41144 - DNA, 1881 bp, Chlorella protothecoides
  modified_base (110)..(119): a, c, t, g, unknown or other
  modified_base (532)..(541): a, c, t, g, unknown or other
  modified_base (1345)..(1409): a, c, t, g, unknown or other
  modified_base (1661)..(1735): a, c, t, g, unknown or other
ccgccttcacagccagcttgggttctgcacgacgcgcctgcgcgggccagtctcagccgcacatcgggagccagggggcggcggctggcccgcacctgcctgttggcacnnnnnnnnnncgccgccgactcgctgcaccgcgactgggcaaagttctgaaggggcatcgtggccctcgtgatctcaccccgtctctgccgccctgcacggctgtgcccgccttcacagccagcttgggttctgcacagcgcgcctgcatgggtcggtctcagccgcacatcgggagccaggggctggcggctggcccgcacctgcctgttggcaccttgcgtgctcaccgcttcctttccttccatgacagtctaagctacgtatggcaccccgggcatgggtgacgagagcaggcacactgagcgatcaagtgacaccatcagcagaccagcccaggcggacacgtgcccctggctcgccgggccaaaccgcctggggcacatggcgatcgcctggggcatgggctctgcaggagcgcacnnnnnnnnnntgtcgacccgcctggggcacatggcgatggcctggggcatgggctctgcaggagcgcacgcgtgcgggaaggcaggggccgggcgtgtcgggcctgggtggggcgggacacagcgcaggccggaggggggagatgcatgcaaatacaagctgggtgcaatcggtgcgggctcggcaccggccctggttcatttcggagagggaatgcgcagacgggccagggttcgagcggcggttgttctcggactggagcgcagacgggccagggttcgagcggcggttgttctcggactggagcgcagacggccctcagccccggtccgtcggcgcgcggggcgagagcgtctggacggagccgggcgtggcgtcggactccgcccgctcccctgtgaacgcaggggccaccagagggatggtgtgtgcgcgcgcgagagggggaggagggagagggaggcgtagacccagggccacccctcaaggacctccaccccctcataccatcccccaatcgagcacttgcccgcccccccagcccccacccccctcaaagtgcggacctgtgtcgccgtcgctgcccgccctgagggaggaggagaggcaggtgccgggcgcctgggaggacccggagccctggcgcggcgtccccacccacccctgcccgcgcgcccgcaagtcgtcgtagccgtgggcgtaggtgcaggcgccgccgcggtggcagtgccccgtctgcatgaatttggtgcagaggcgcgtcttgtagaaggggcgggaggcggggttccaggtcccagactcgctcccactnnnnnnnnnnnnnnnnnnnnnnnnnnnnnnnnnnnnnnnnnnnnnnnnnnnnnnnnnnnnnnnnntggtccgcggagctggcggtgtcgtgggacggcggcacgccccgcgcccgcgagcccagcgcggcgccgccggcggcgtgggagtccaggtagggcagcgcctcgggcgccacggcgcgcagctcgtgctcgccgtgcgcgtaggtgcagcggtcgccgtaggggcaggagccggcgcgccacttgttgcacacccgggtcttgaagaagacgttgcccaggcgggggccacggcgggggtcggcgggcggnnnnnnnnnnnnnnnnnnnnnnnnnnnnnnnnnnnnnnnnnnnnnnnnnnnnnnnnnnnnnnnnnnnnnnnnnnngcccaggtggggctggggcccaatggccatggggtagcccccgggaccaaggaccaggtgggtgccgggcatgggcatgccggggaccatcatggcgtgcaggtaggggatggcgccaggtgggtagtactggggggtgggggggg

SEQ ID NO: 41145 - DNA, 83 bp, Chlorella protothecoides
cgtggatgcgctgatccaggctgagttcgttggttgttgtgacaccttgtgcgatgtgtggagtgagagcatccaggccacct

SEQ ID NO: 41146 - DNA, 61 bp, Chlorella protothecoides
cctgaggaggatgcaaggggcggccgcgtggcgatggagggcggcgaagggtccccagggc

SEQ ID NO: 41147 - DNA, 76 bp, Chlorella protothecoides
acgaggccgacgtctggctgggctgcctggtcagcgcagggcccggcgatgcaggggcccgcgcaagagccgcctt

SEQ ID NO: 41148 - DNA, 6088 bp, Chlorella protothecoides
  modified_base (444)..(453): a, c, t, g, unknown or other
  modified_base (662)..(671): a, c, t, g, unknown or other
  modified_base (1274)..(1283): a, c, t, g, unknown or other
  modified_base (1947)..(1956): a, c, t, g, unknown or other
  modified_base (2304)..(2313): a, c, t, g, unknown or other
  modified_base (3415)..(3438): a, c, t, g, unknown or other
  modified_base (3560)..(3569): a, c, t, g, unknown or other
  modified_base (4020)..(4029): a, c, t, g, unknown or other
  modified_base (4699)..(4708): a, c, t, g, unknown or other
  modified_base (4780)..(4789): a, c, t, g, unknown or other
  modified_base (4893)..(4902): a, c, t, g, unknown or other
  modified_base (5710)..(5719): a, c, t, g, unknown or other
cgctgggcgcgctggcgcgagcgcgtggcacgcgtggacaaggacgtgcggcgcacagaccgcggcgcggcgcccttcgcgcgcgagggcggcgcgggcgcgcgcatgctgcgccgcctgctcctgacctacgcaatgtacaactacgacctggggtactgccagggcatgtccgacctggccgcgcccatcctggcagtggcgatggcgggaagggggggcggccgcctcgcgcgggaccagcaggcggaggtggagagcgaggccttctgggggtttgccaacctgatggagggcgtgggggccaacttctccaccgactgcacgtgagtggatgttaggtttgagttctgaatttggggatgcaatcactgcacgatgagaaagcagaggtgtttggcgcgtcacccctgagcgtgcatcatcctgactgcgcaaagggcnnnnnnnnnngtttggggatgcaatcactgcacgatgggaaagcaggggtgtttggcgcgtcacccctaagcgtgcatcatcctgactgcgcaaagggcggggcgtctgggggcggcgggagctcctcgtgtggattgcatggatggggcaccgacaccattcgtccccggcgcgcagggggatgcacgcccagctggaggccctgcggcagctgctgnnnnnnnnnnaggagctcctcgtgtggattgcatggatgggacaccaccaccatgcgtccccggcacgcaggggcatgcatgcccagctggaggccctgcggcagctgctggagctgctggacccgcccctgcacgcccacctccatcgccgcgactgcctgagcctgtacttctgctaccgctggctcctcatcctgttcaagcgcgagtttggcttcgaccaggtgctccgcctgtgggaagccctgtggacggcggtgcccacgccgcatctccacctctacctggccgtggcggcgctggcctcgcgtcgccgcgacatcctgaccgccgacgccgacttcgacggcatgctgcgcctgtgcctggagctggcggggaagctggacctggaggcgctgctgagggacgccgaggcgctgtgcgcctttgccggggacgcaggccgggcggtggtccagggcctgccggggccgcccaagcaggcgcctatgtgagggggggttgggggggcgtggggcggcagacattgccccgggccggcgcacgccgggcggcattgtcctcctttcatgaacattcaagaagctgtctgtatgtatagtagttagnnnnnnnnnngggggggcgtggggcggcagacgttgccccgggccggcgcgcgccgggcggcattgtcctcctttcacgaacatccaagaagctgtctgtatgtatagtagttagtcatgtgcatgtatccatctagttgcccgtcctgcactgtaatgtcacatgtacccaggcccagaggtgtgccagaatctgtggggtgtcccacccaggagggggaggttttcttttcctccacacggccgcagccgcggcgcaaatttcgaaagtgatgaggtcgggctcaagggcagccgcgcacctaacactatccaagaacggtcgactttgtcgccctttgatccaagtacctgccacaaatacattagagcacaagccgctgggccttttattggccaggacctgggtttatcctgcacgatgggtatttgctggtgcttcccacgtacgcggaatggatgggaaggcgagggtactgagagctgcaacaatccagaaattgactgacgagttcatctgcacttcctcgggcaggtgcatcggcccctgcgcagctctcggaggctctgctcaagcagccggaggcacctgccaccgacgcccccatccctgctcggatcgccgaggattcccctgccaaatcagccacagatgcattggagagcaccggcannnnnnnnnntgccgagggttccccggccaaaccagccacagatgcattggagagcaccggcacgcctggcagaagctcggcccaggtgattggtgactcgatcatgagcaggaacctggtccgcaggagcgagagtcgtggagcacctgtcccaacgttgctcaccatgttgcatgtgtactgtactcatgtcaatgactcttcatttactgcaggaggtggatgcgagaccatcgaattctatcacaaaggaagctgcagagccggtaattgagacacctactattgcttctgagccccaggagccagctgcgcggtcagacccattggagcctgtggttccagcagccaccgagnnnnnnnnnngcttttgcttccgagccccaggagcctgctgcgcggtcagagcccttggagcctgtggttccagcagccaccgagcagacctcacggtctgaggaggtgttgccgtccacccccgctcctcctgccccgactgccgaagaggcaccagcctcaggctctctgctccctcaggggtctcccagctctgcctccattgcccccgagcccgaggctccccaggaaagggccacagctcagcagcaaggcaacaagaagaaccagcgcaagaggaagggcaagaagggcaagaagtagatgcggcaacagaagctgcttttaactgcattatgtaaaacatttggatcgagcaacgcgacacaaagagctggaatcataattgcaagagggcggtgcaaagtctccaggtaaatgggaagttggatactgggagccatgtgaacaatggcacaaatctaggtatcagtaaaggtggtatcaagatgaaatcaggccacgcaaccagattgctagctcagtgtggccctgcagaagggaggtgagaccatcgagctgggcatgtgagatggggcatgatggtagccgagagaggaggtggtcatggatcatgcgatgtcatttgtcacccaagagctgcatgcatcaaacactcgctgaagatcactcccggcacacattctcctgacgccaagcagaaaccttgcaaaggtaattcaccacacaactctgcaacctggttgcctcacctgagcctctgccttgtccgcagccgtgtgtccatctgcatctcggagcaggcaggaggcgcctgcctcatgaagcatcctgcagatgcttgcatgacccatgtaggctgcccggtgcaggggggtagcgcgtccagctgttgtggtggcgttcacttccacacctgagattgcgatgtgatggaagtaatatgtgacaaggataggcaagcactgctgttccagagaagccacactcggataatcaccttgtttgagaagccaggccacaatgtggtcgtgtccagcccgagcagcaaagtgcaaaggtgtgtatccagatgaacctgcacattccatcttgggtaacacttgtaagnnnnnnnnnnnnnnnnnnnnnnnnatgacacccgcaggcgtcgtcgtgatgagcacgactctccatagtcttggtgcaggttctttcttcctctacaggggtccatgcaccatagttatgggtgttgtcgactccatacgcacacnnnnnnnnnngggatcgggcgcggtcatacagcctttgtagtcccttgagatctccgctttgtgctgccgagcatgcagaggcagcgaatgccatctcatcgaggctctggctggctggagcggggtctgcgtgacacccgcaagcgtcgtcatgatgagcacgatgctccatagtcttggtgcaggttctttcttccgctgcagggggacatgcaccatatttatgggtgttgtcgactccatacgcacacggcggctgcccgagacacccaggcctttgaaatgccagctcccgacagtccatcgacactttgccaccaagagtcagcgcacctccaccagcgccaggcatgtataggaaaagaattacaacagaaaaaacaagtcaggagagggtacaacgccacagggcggagggccccctgcagcctagtcaagggacgtggggcaggagcaggcnnnnnnnnnngaaagaattacaacagaaaaaccaagtcagaagagggtacgacgccacagggcggaggaccccctgcagtctagtcaagggacgtggggcaggagcaggcggggggagcgcgccagccgcgccaggacctcccccgcccgcgcctccaccttgaggtctgcgaggtcgtccgcccggttgggccccacggacagcagggccaggggcgcccccgccgccttggcggcgcgcgccagcctgaaggcggaccacacctggaggctggaacccaccaccagcatggccgggcaggcggcggcggcggcctgcgcccgcgccgcgacgtccttgggcacactgtccccaaagaacaccacgtccggcttgaggatgccgccgcaggcggggcagggcgggactcggaaccccgaccccgcatcctccagctccacgtcgccatccggccgccgcaccggcacccggacgctgccgtcctcccgcccccggaacgcttcgtcctacatggggtgcgagtggtgaagggggttggagggggatggtcgggtactcatctgggaaccagggtcttggtacgagcgtcgcacggggcctcgatgagtacgcacgtgcaagctgacgtccgatgtgcactggtcattaggcgggtggcagtgccgtcaagctaccaccnnnnnnnnnncacgcacatgcaagctgacgtccgatgcgcactggtcatagggcgggtggcagtgccgtcaagctaccaccnnnnnnnnnnctcgatgctcctgtcgccatccaccccatgccgcggcgggtcctcatccccctcccccgcccccgccagcgcccgcgccagcgcgtccacctcgggattgagcnnnnnnnnnngtcgtcgatgctcctgtcgccatccaccccgtgccgcggcgggtcctcatcgccctcccccgcccccgccagcgctcgcgccagcgcgtccacctcgggattgagctccgcgaggcgagactgcgtctgcacgcgcggcgtcaccgccccgcaccccatgcaccgtacggcgtgggtggtgccgtgtagctccagcacgtccccgctccccgcagcgtggtgcaggcgatccacgttctgggtgaggatgccgcccagccagccgcggcgctgcagcgcggccagtccttcgtgcgcggcattcggccgcacgcccgcatagcggtaccagccggcgaaagagcgggcccagtagcgcgcgcgcgccgcggcgctgcccatgaactgctggtgcgtcatgggcttgaacccggtgctgtaggcgccggcgggcgagcggtagtcagggatgcgggattcggtgctgacccccgcccccgtgaccaccagcacgccggggtgggccgcgacgaagtcctccaaggcctgcagcgcggcgggggccacggggggggcggcggggacgaaggagggcacacgcccaagggcggggccgaggggagaggcgacgggcggggagggggcggggacgaaggccccgtccgccagcacgcggtcctgcgggaggtggatggggcagcatgtggcgcgcatgaacggggaggtagccatgggactgggcgccagcacctgtgaggagcccggcctcaggtgcctgggaggaagcttagggggggtaagggggcctgccctcgccacccacctgctnnnnnnnnnntcggcctcaggtgcctgggaggaagcttagaggggggggggggaagggggcctgccctcgccacccacctgctgccacatcgaggtcgaggaggcgacatgccgtgtctgagacgttggcgagctacagcagcctggaccatgatggggccgcgtggggaacccccagtcccgcccagccacacgtacagccggacctgtggaggagggcaggcagccgcgccacgccgaggcccgggccatgaaggcccattccccgggcatgtaaaccggtgaaagtataacagcaataaaccatgtcgcaccccatgcccagtgccttccttcgtggaacaagtggcagagttacgctccaggagtcccagatcgc

SEQ ID NO: 41149 - DNA, 61 bp, Chlorella protothecoides
agccggccaagtcatccgccaagcgccggaccactgtggatccatctcaagttgacggccc

SEQ ID NO: 41150 - DNA, 148 bp, Chlorella protothecoides
gtcagggccttggtggaggcctgtgggagtgcgacagtgagagtgtccacacgatctcctaaggcctcattaaaaatcgtgaactaccgtgcggcacccccctgctttcccacaagatctcctcctatcgcatacctgccacacccct

SEQ ID NO: 41151 - DNA, 61 bp, Chlorella protothecoides
tcgcttggatccgattctcccgactgggggtgctggttacccccacccaggtgcacccgcg

SEQ ID NO: 41152 - DNA, 79 bp, Chlorella protothecoides
gcccggctcacgaattcacctgccgtacggcgccacgattcctcccaagagcaacgccgcggccaaccctgccatggcg

SEQ ID NO: 41153 - DNA, 61 bp, Chlorella protothecoides
gcgtgtccttaccttaccccatgccactatcatgcagacgtttggcgacgtcctgggcgtc

SEQ ID NO: 41154 - DNA, 61 bp, Chlorella protothecoides
cggcaccatgacggatgccctcgtggaggggggggtgatgccgctgaccatgcccctcgag

SEQ ID NO: 41155 - DNA, 607 bp, Chlorella protothecoides
  modified_base (108)..(117): a, c, t, g, unknown or other
gggaggagtcgtggagtgcaggatctggtcggtgtggagggccgcgcggactccagcgtgccagaatggggtacatgagcagggttgcgagtgcatggatggtgcgcnnnnnnnnnnagtgtcgagggccgcgcggacccaagcgtgccagaatggggtacataagcagggttgcgagtgcatggatggtgcgcccaggcgccatactctctgacaaggcacctggtaccgcattggcatgtggccgcgacggcgcaggtcccctcgccggagtctttcccaccttgaatttcccttgcacgtacagctccatgttcccagggcctagcccccacgctttcccccccatctctgttgctccccaggtggcagacgtgctgggcatgccccccgccgagaccagctcgctgtcggccagcgtgcaacagttcctgaccgacgtggtggcctccgtcgacccctttgggacacatgcacgtggcgtgcagcagagcctggacgccgtgtttgccgcccccgcgggccccggcagcggcggcgcacgcagccctaccgctgcggggtccacgccggccagccccgcgggcgcctggggcgcgggcggcgc

SEQ ID NO: 41156 - DNA, 97 bp, Chlorella protothecoides
ggggggaagatgggagtgtggaggcggctaagaggggggccagggtcaggggtatgaggaggccaaaaatccctagaccaggacacgatgttttgcc

SEQ ID NO: 41157 - DNA, 31350 bp, Chlorella protothecoides
  modified_base (598)..(607): a, c, t, g, unknown or other
  modified_base (1154)..(1163): a, c, t, g, unknown or other
  modified_base (3450)..(3459): a, c, t, g, unknown or other
  modified_base (3523)..(3532): a, c, t, g, unknown or other
  modified_base (3594)..(3603): a, c, t, g, unknown or other
  modified_base (3906)..(3915): a, c, t, g, unknown or other
  modified_base (3991)..(4000): a, c, t, g, unknown or other
  modified_base (5287)..(5296): a, c, t, g, unknown or other
  modified_base (6345)..(6354): a, c, t, g, unknown or other
  modified_base (6954)..(6963): a, c, t, g, unknown or other
  modified_base (8328)..(8337): a, c, t, g, unknown or other
  modified_base (9188)..(9197): a, c, t, g, unknown or other
  modified_base (9426)..(9435): a, c, t, g, unknown or other
  modified_base (9625)..(9634): a, c, t, g, unknown or other
  modified_base (10154)..(10163): a, c, t, g, unknown or other
  modified_base (10988)..(10997): a, c, t, g, unknown or other
  modified_base (12619)..(12628): a, c, t, g, unknown or other
  modified_base (15414)..(15423): a, c, t, g, unknown or other
  modified_base (17108)..(17117): a, c, t, g, unknown or other
  modified_base (17764)..(17912): a, c, t, g, unknown or other
  modified_base (18105)..(18114): a, c, t, g, unknown or other
  modified_base (18417)..(18426): a, c, t, g, unknown or other
  modified_base (19284)..(19293): a, c, t, g, unknown or other
  modified_base (19357)..(19366): a, c, t, g, unknown or other
  modified_base (20187)..(20196): a, c, t, g, unknown or other
  modified_base (23643)..(23652): a, c, t, g, unknown or other
  modified_base (24617)..(24690): a, c, t, g, unknown or other
  modified_base (24850)..(24859): a, c, t, g, unknown or other
  modified_base (24953)..(24962): a, c, t, g, unknown or other
  modified_base (25051)..(25143): a, c, t, g, unknown or other
  modified_base (25623)..(25683): a, c, t, g, unknown or other
  modified_base (26649)..(26773): a, c, t, g, unknown or other
  modified_base (26889)..(26898): a, c, t, g, unknown or other
  modified_base (27028)..(27037): a, c, t, g, unknown or other
  modified_base (27167)..(27176): a, c, t, g, unknown or other
  modified_base (27684)..(27693): a, c, t, g, unknown or other
  modified_base (28066)..(28075): a, c, t, g, unknown or other
  modified_base (30114)..(30123): a, c, t, g, unknown or other
  modified_base (30418)..(30427): a, c, t, g, unknown or other
  modified_base (30836)..(30845): a, c, t, g, unknown or other
  modified_base (31266)..(31275): a, c, t, g, unknown or other
gcgccggcggcgcgcggggcgcctccgccgtcgccgacctgtcctacgcggggctgggcgggggcttgttccacggcgcgggcctgtcgccctacgccctgcccctgctgggcggcgggctgggcgacgccggcgcgcacgcgctccaccagcagcagcagcagcagctccagcagcagcaccagcagcagcagggcggcacgccgggcccctacgaccaccatgccgccgcgccacccggcgcgctggccgacctcgacttctcgggcctggcacacgtgggtgcggagtacgcgcaggccgcggggctggtgggcctggactccgtgaccctgggcggcgggggcgccgggttcctgtcgcccatgacgccctcgctgtcggcctcctcctccgcctcgcagctcagccgccagcgcctcttcgtcgttctgcacaaggtatgtcccttgtctgggtgactgctggtctccactcggtgggagtggggttcaggcaggggtggaggcgttcatggttggcatgcacactgtgtgtcccagggtcaccaggcagaagtgtgggccgcacggacacggcgatggtcccatgcagcacnnnnnnnnnngggggggttcaggcaggggtggaggggttcatggccggcatgcacactgtgtgtgccagggtcaccaggcagaagtgtgggccacacggacacggcgatggtcccatgcagcacgctcgcgccttcctatggggaaacacctcgaattcacccctcttcgggaactccccccccccacaccttcctccacccaccccaaccccagtctgtgggcgacgagacgctggcgtgcctcttccgctccttccctggcatggagtactgcgacctgaagaaggaccgcgccacggggcggtccaagggctacgcctacgtcaagtatgcgacgcatgactcggcggcggctgcgcaggcgcggctcaacggcgccgagttcccccccggctccggctgccgcatgaaggtcatgtttgccgagccggcgctgcaccgcgcgcgctccggctccgccgactcctgcgccgacgcgggcacgcccttcaacctggcgggcctggccggcgggggggcggggccgggcgtggaggagctgcgctacctgtccacnnnnnnnnnnaggcctggccggcggggggggggcggtgggcgtggaggagctgcgctacctgtccacgccgggcggcggccagctgggcgcgcgcggcgagcgcgacggcgagcgctacatgggccgcagccagggcgtgggtgagaggtatgcgacgcaggcgcctggcgaccgcttcgccgcgcaggcgcccggagatcgtttctcagcccaggcgcccggagatcgtttctcagcccagacgcccggagatcgtttctcagcccagacgcccggcgtcgaccactatggcgcgcagacccccggcgtcgaccactttgcgacgcagacccccggcgtcgaccggtacgcggcgcagacccagggcgcagcgctgggctcgccgctgtcctgcgagtccggggtgctgccgcggcgccgcgcctcccccctgcactcccccctgctctcctcctcaaccccagacctgctgtcggccgccgaccacctggccggcctgtgcctggacggcggggggctggaggggctcaagggctacacgaccccaggcggcgcgctgggcgcgctgagcccgggcacgacgctgagcgggtcactgacgtcctcctggcacgacctgtcgcccgagggcggcgccggctccgccaccagcgcgctcggcgctggggccgcgggcgccggccatgcggccgcggccggcctgcggccgcgtggcgacgccgccgaccccgaccccaccgtggtctactcgcgcctggcccgcccgctgccggactatgcgctgagccacgtcttctcgcgctgcggccccgtggatgcggtgcgggtgctgcccgacgtgcgcctggccatggtcaagttccgcgacgcggagtcggccgcgcgcgcggtcgccacgctgcacggcaccgaggtcctgggcgaggtgctcgccgtctgcgccagccccccctcgcagtgaggcgggcagggtccgggcgggacgcgcaggcacccagtgccggcggcgggcgcggccgccctcatgccccgccgacgggccatccaaaggcggcggcgagcggctgcgcgggcccacatgccccggcgccactcgtcgacctgacgcgcgcgtgggagcttgcaggggatatccaggcccgcgggcctgatcagaggaaacccgtgctcgggtgcccgtgcacgcatgcccccaccccgtccccataagagagccctgccatacacagtctcacacccccgatcgttctcgctgcctccctcgtgcttgcatttgaaactctgggtattcagccgggggtaggagaggtcgggtggggacgcagcactcgctcgtcctgccggcggataaggtccccatgacacgcatgccgcgcgcagggggtccctcccctcacatgacctgcctctcacggcgacacccccgcagtgtgccccatccattcctcacatcacaccataccctgcacccgcatcaggatgagcatgtccatggccacgagccttggctccagggtgcagctggccggggtgttcggaacccggcgaccccagcccgtgctgcagcgggggccggggctgcaggtgcaggccgcgcagcgcctcatgggcaaggtggtgtccatcgcatccaacaagacggcggtggtggcggtggagagctggagcatacaccccgtgtacaagaagcgcatccgcaccaccaagcgctacccggcccatgacgaggcggaccaggcccgggtgggggacgtggtggagctggcgccctccaggccgctcagtgcgaggaagaggttcatcgttgacaagatcctgaaccgcgaggactgaagccccctccaggtgtgcacaggctggcgggggccaggcagggggactttgggaggtactgatcatccaactggtatggcctagcggcaagggccccatggtcggcgcggtgcggtagtgcttggggcctcgacaggcgcctccgagcaatgcttgagactcagtcggcatgactgggaagctgtgcacatcatgacacgtgtagctgccactgcatgactgagatcccctggcctcacccaccccctcgcagcagcattcttggcaccccctaattttccttgactctggtggcgctctgctgtattgtaacacctggatcggccagacaacggggtcgagggcttctggctcaaggaatgggaagcacgcaagggggtgaaaggttgcgaggaccaaaggcaggagggggcaccgtgcagccgaaacggcagtgcgcaggcctagcccgctcaggaggagnnnnnnnnnntggcaggagggggcaccatgcagccgaaccgggagtgcgcaggcctagcccgctcaggaggagnnnnnnnnnncgggtcggccaggcaacggggtcgagggctactggctcaaggaatgggaagcacgcaagggnnnnnnnnnntcggaaccccatggccgcgcggcgtcttttcgcagctgaggctggtccacgaacctgcgcccattcttgaacaggaagatgacgacgcctaccgccaggatgagaagcaggaccaccctctggacgaaggcgcccaggagaaccagggcgccgctggaagcctgatcctgaggagcggattggagaggcgggggtggggttgagcttgggttggtgggctgccaatattcgacaggcagagtgtgcgggagagatgggcatgggccgtcgcgacagaccagcccctccgcctgtggcaggagnnnnnnnnnntgacaaggtggtgaggatgtgcctggcccaccgtctcgctggttccccccctcacacacacacacacacacacacnnnnnnnnnnaattcgacaggcggagtgggcgggagagatgggcatgggccgtcgaaacagaccagcccctccgcctgtggcaggagcagactgcccgccagtgtacccccagagcaaggcacccacctgtccggccaggatcctcccagcgttctgaaaagccaccacgatcgccaccaggacggccaagagagggagggccggggaaggctggctcctgaactgcacctccctccctgcgagacggcagcgtttgtccaggatcgtcgatgaggcggtgaggatgtgcctggcccaccgtctcgccggttttccccctcacacacacacacacactcacacacccaaccttgaccactcaacccacccacccgtcttgacgacaaacgcccccgtgacgaggtcaatggcgtcctgcttagcgccatcctggaagttgttcaggtagtagcgcgtcagcgacttggcgccgtcgtccagcagcccccagacgtcgcgcttgcccgtgcgtgtgaaggcggacttcatggcacccgtccccgcgtactggcgcgacacctcgtcgccgtggtcggcccaggccacgcggaagcggcgctccgcctccgggtacgcggcggccagcgccgcgccgggcgccagcacgcccagcgcgcgcagcgtggcctccagcgccttgcgccccagcaggccctgcaccacgttggtgcggtccagggtgtccacgcagttggtgcggaacacgccgcgctgccgccccgccacggcccccgacgcgctgtcgcgtgtgaaggcgccgtagcgctcaaagtcgggggccagctcgtcccagagcaccgacaggcgcgcgtagttggtcgcgccgcacatggcatggaagtcaaaggggaccaggcggaagccggagcgcgaggcggcgtaggcgtcggccgccgccacgtacgcggcgctcagcaccccctcccgcccgccctggtttgccaggttgatggccgtcacagcgccgtgcacctccaccatccggtccgcatgcccggcaaagacgggggccgaggccgagggcggcgccaggcgcagcgggatcttgtacttcaggcagggcgtctgggaccagagcaggggcagagagccccgcgcctggacgaaggaggacagcagcgcgccctccccgtcggacacgatctgctccgtctccacgtagttggccacgtgggactggcaaagcaggaacaaattcgttgtgagagaggtttttggggggggcgggggggggatttgtaaggaggatgcatggcnnnnnnnnnntgtgagagagggtatttttttttgggcggggggggatttgtaaggaggatgcatggcacgagctggcacccgcacagggcagcgccagggtgcctgccataccagtcacaagggatcgtcgccgaatggccgccggtgctgtcaaaacgtcctgaacttccctccatgggccagtcaaacgtaccgagccgccgtccgcgagccaccccgcgcagcatcccgtccccgtgcccacgcctttcccccgcccagcctgaccctcgacgtaccctgcaccccagacactctcccgccctcacctgctggtccgccccacgcctccactgccgggtgcccgggcggtgcctggacctgcgtgcaatcagggtcacgcccaggctgacctggcgcccgccgcccaggaagtccaggccgttcagctgctccacgaatcccatgaagacgggagggacataggcatccagccccgcatctggaatggcggtggacaaggaggatggggctacatgtacggcaacctccagcaaacagggtggtggctgcaaacacaccactgggcaatgtggaggggttgacaaaggttcagagcctctgcatctccactgccacggtccaactccgcaagcacctgagcttgctggctcccgctctgcacgccctcattggcagcccccaaacagcctcctaacaagaacctcgccatcgcacacccacccagcaggggcctggccagggccgcgttccaggtcacgtccaggtcggcgcgctgccaggcgcgcgcggccgccgtctgcgggtctgccgcgacgcgctctgcacgctgcgcggtcagcgtgatgtcccccgcgtggctgaagtacaggctgccgccgtactgcttggggtccacgcccgccgccagcagcttgagcagcctgggaagggtgagaggcagagggaggagatgctgagcgtggctgggtccgggtgtgaatgccacctgcaacctgggttcggcaaatctctttggacccatgttctcttctgcctacttcttgtcactcttgctnnnnnnnnnnttgcggcaagtatgactggacccatgccctcttctgcctacttcttgtcactcttgctccacttgtggctcgtgtcgtacagcaccttggtcgaggtgaccttgagcaccaggtgctcgcgcacgatgccagcctgagaatggaaaacgggggggagtacacggagtcagggacagcttcatgagacatgcgtgtggtttgtggtcagattgccagaccctgatgcctgatgcccatgcagagcagtccataccgctcaggacccaacacaccgcagacacgccggtgatgacgacgagggcggggccgccttccaggcgcagcatacccagcacgccaaagcagggcacaaagtcggaggtcacatgggggtgctcgctggctgccaggctgccagtctccaggtccaccgtcagggcgggcaggggttctccagactcccataccggctgaacaacggccacagaccccaggcgctgcaggcgcagggccgggtaaaagtcaagcgtgccggtcatgggctggcctttgaggagctggccggagggtgggcgcggtgctggcagaccgcagtccccagtggctaccggtggtgttgannnnnnnnnntgtgccggtcatgggctgggctttgaggagctggccggagggtaggagcggtgctggcagacggcagtccccagtggctaccggtggtgttgagactctctgcctccaagcgctcctccagagagggcagtggaacagcgggtgtcttgtagagggatttgtacaccacaacgcccagaccaccaccgatcgcgagctggagggcgagctgcaacggcgacgagcgtgcgtgggccatgaacagactgaacaattattaaggacctcggccgtggaccagcctgggtttgttggtacccagggcgctaggcttgcctcgcttctatgacgagggaaagaaagcggagtccgggcgcgctttgaagatctgtgggtcacgtggctcaaggtatcgtctcgtcggacagcacaagcgctcgagctggagcatggctcaggcacacagggtggtcatcgtacagaccatgccggcaagataaggtaataacccagtctcgacggcgtcagagcccgggtcggcatgtatgggatggcgctggccgtactgagcttcgccctcctcgtcgtgacgtcctccggtgcagcctcgcagaggccctggatcgagcaaatttcctggaggccgcgtgcttacttgtaccacaacttcttgagcgaggccgaggcggatcatgtggtcacgctggccaagccgcacatcacgcgctccagtgtcctgaacgacgacgacagtgtctcggatgcgcacgaggtccgcaccagctatggcaccttcctcaggtacctgaagacgtggagaatgggccatatgccaggaacgaaggtgcaccatggcagtgtagtccgagtctgctcgtccggctgagacccaaaccccccaatcccccctcccatgcaccctcccttcgaacacccctacgcccaggtctgcccaggatgaggtcatctccgggattgaggagcgggtgagccgctgggtgcacctgcccgtctcccacatggaggacatgcaggtgctcaagtacgtcgacggccagaagtacgacgcgcactgggacgagcgtgcagcggaggacgggatacccgtcggcggtggctcccgccgcatctgcaccgtgctcatgtacctgtccgacgtggagtacggcggcgagaccgccttccccggcggcttctggctggacgccgccgtgcagaaccgcaccgagttcagcgcctgcgcggcaaaagggccggcggccctggcgagaaagggtgacgccattatgttctgggacatgaagcccgacggtacgtgctggattgcaggggagaggatggggaggggggaaaagggtgggaccggcgcagttggaacctcactgnnnnnnnnnnggggccggcggccctagcaagaaagggcgacgccattatgttttgggacatgaagcccgacggtacgtgctggatcgcaggggaaaggatgggggagggggaaaaaggtgggaccggcgcagttggaacctcactggtggtggccgggggtctgcgggcaatgaaacgcattccccctcatgggctggttggatgtgagcacgcccataccttgcaggatgatccgctgtgccctgccctgggccccatcccctgcccgtcaaaagtctcatgtgccctgcccataagcatccccccttttccctgctttcctgtcaaaggggtaaccctggaccggtacagcctgcacacggggtgcccggtgctggccggagaaaaatggagcagcaccttctggatccacgacaaccccttccggcgcagcccagggtcgctgctggccgacatcgactccgcccccgcccccgcctgcgaggaccagtccaccacctgcgcgacgctgctggcagggagggaaggcgcgccatgctcggaggaccaggcggcacgctgccgccgctcctgcggccggtgctgccaggcgggggacgtgctctgcgagcgccgcgccaagcgcatcgtcgccgactgagggcgtgagttgttgcagcagccgcgccacatccgcagcctctttcgcagctcgccgtcacgctctgggcaggcacgcagcatggccttgaaagcgtcagttctccccctccttgtatttgctttgccagccatgcaaccttcgtgacctgccggcagagtctccgcctggagccacatgcttaaccccctgcagcgcagcatcagctcgcatgacaatnnnnnnnnnnaccgtcacgctccgtgcaggcacgcagcatggcctggaaagcgtcagttcaccccctccttgtatccgctttgccagccatgcaacctccgtgacctgccgccagagtctccgccgggagccacatgcttacctctgcagcgcagcatcagctcgcatgacaatgccatccggtttcctttccccccccttcatatgactgtttccccaggaatggcccatcacaaccnnnnnnnnnncctccccccccctgcaaatggctgtttccccaggaatggcccatcacaacctttctgtgtggactgaatgcggcatctcttactcgtttcctgtacatcgtgaatgatatcaaacacaataatggcgtcagaaggtggcctagcaaggaggccccggttggtggaggcataccgccggccgagcgcccgnnnnnnnnnntagtattggcgtcagagggtggcctagcaaggagcccccggtcggtggaggcataccgccggccgagcgcccgctccgaaacaccatcacttcatcaagccctgcgcacggacgccgcccactcggccgcgttctggaagagcttgagccaggggctggggtcggttggcttgagccccgtatctgcgggccaccacgggttttgccacatctgcaggcagcgctctgggtgcggcatcagcgccaggtggcgcccgcagggcgagcacagcgcggccacggcgtcgctggagccattggggttgtaggggtactcctgcgtctccctgcccacagcatccacatacctggattgggtttgggggttttagggttgttgggggggggaacagggggctgattcgttcgtgagttggatgaatagtaggaaaagaaggccgcccacagggtccgtttacccaacaacacccttccttcccacaaccaaataagaatccccagaaaacccactcaccggatnnnnnnnnnnggcatccacatacctggattgggtttttgggttttttttgttgttgggggggaaaaaggggggctgattcgatcgtgagctggatgaaaagtaggaaaagaaggccgcccacagggtccgtccgcccaacaacatccttccttcccacaaccaaacaagaatccccagaaaacccactcaccggatgggcgccaggtggcggtccagcacgtcgcggcgcacggcctcgtccggaaacagggcctggccctcgccgtgggccacccagacgcccaggcgcgcgccgcccatgccgcgcagcatgacggcgggggtgtcggggtcgatcgccacgctgctccaccggcactcgaagcggccggaggcattgtgcgtgaagcggggctgtgccgcgtcggggagcaggggccccgccgcgccggtccccgcgccggtgcccggcacccagcccagcagggccatgagctggcagccgttgcagacgcccagggagaaggtgtcggggcgggcatagaaggcctggaactggcccagcaggcgggagttgaagcggatggtggccgcccagcccttggcagagtccagcacgtcggcgtagctgaagccgccggggaagatgatgcctggagtttggttcgtgggggggtgaggtggtggtcacaataccatggtggtgacatgaggtgggtgggggtggcggccgagggtcgaccaggggagcccagggcacagcccaggaaggacgtcacggggtgcatgcaaccacgggagtccgcccgacgaccttcacccacgcatgcccagagcacggctagtgatccgtannnnnnnnnntgtgggggggtgaggtggtggtcacaatactatggtggtgacacatggtgggtgggggtggcggccgagggtcaaccaggggagcccagggcacagcccaggaaggaaggaagtcacggggtgtacgcaagcacgggagtccgcccaacgaccttcacccatgcatgcccagagcacggctagtgatccgtagggaacctcacacactggaccccggtccccaagccccctccaccacccctccgacagacccaccttggaaggagtccagggtggctgcgccggagagcaggtcggacatggtgacgtcccacggctccatgcccgccatctgcactgcagccgccatctcgcgatcgccgttggtcccctcctcgcggatcaccgccacacgcaccttgtctgtcgattgtttgggtggggaggggtgggagaagggggttgcaaggcgtgtgtattgcggagcaaggccgggcaccgaggtcgatacgtctccataacggcacgtcgcagcgcatccacacgcacaggcagggatgcaggagccccgtcggcacccccatcctggatacagaatccccacctcgccgcagcgcagcactcggtcaacgacagccgcccccgggcccttgctcgaaagaacgacacctccccccacacgcgctcacctccagcctccagcttgtccgcgggggtccaggcggggacgtaaggcacgacccaggtgggggcctccgcactgcgcagcgcggcgcgctcagactcgacgcactcgagagcggtctgccgcttctccagctcgaaggaggtggcctcccagacgtcgcgcaggtcgcgcgcgcccccggccagcaccatctccccgcccaccaccagccgcacctcgtcgtccgccaggctggcgcccacgcgcgcgcagggcacgccggcggccgcgtaggcggccagcacctcgccctcccgccccgcggcgacctcgaggagcaggcccagctcctcggcgaagagcggggccagtgcgccgtgcgccgcgtcgcgggcgtgcgccgcgccttccagccccagctccaaaccgcagttgccggcaaaggccatctccagcgcggcgacgaccaggccgccgtcgctgacgtcgtgcccggccaggacgggggagtcgggggtggccagcagggcctgggtggcgcggaaggcggcgcccaggagcgcggggtcgacgtcgggcgcctcgtcgcccagctgggagtacacctgggccagggcggtgccgcccaggcggcgccgccccgcgcccaggtcgacgtggagcagggagctggcgcccggggccttgaggtcgggggtggtgatgcgcgtgatgtcggtgcagcccacataggcggagaccaccaggttgccgggggccatcaccgtctcgccgcctggcgggatgtaggttggggggggggatgttaggggagctgggaaggaatgcgattgtctgggccaggttgactcgtcagtagttgcatgtcacccacatggaggggaggagatggcctggtgcatgcgtctggattcggtgcatgcttggaagatggatgcgcatgcgtgcgtgggtggaggagtctcacctgcccggnnnnnnnnnngtaggcggagaccaccaggttgccaggggccatcaccgtttcgccgcctggcaggatgtagagttaagggggggggatgttaggggagctcggaaggaatgcgattgtctgggccaggttgactcgtcagtagttgcatgtcacccagatggagggaggagatggcctggtgcatgcggctggattcggtgcatgcttggaacatggatgcgcatgcctgcgtgggtggaggagtctcacctgcccggcgcaggacccacgcattctccccacaaacacacacccaccccccctcccccccgcccccccgattaccaccaccaccaggtaaacagccggttcgctcacccgcggcggcggccatggacagcgagtcctttcccccgtccacgccgatgcgcagcacggccatggcctcgcgcatggccagcgcggcgtccaccatggccgcgccctctccgcccatcttggccgcgtacatccagttgaccgaggccttgacgtgctccagcgcggtgacgggcgcccagaccaggttggtcagcgcctcgcccaccgccaggcgcgccatggcggcggggtccagcagccccttgagcggcgcctcgccgatggaggtggccgcgccggtgcggccgtacaggctctgcgccacgaccgccacgtcggccagcggcgtgtgcagaggccccaccgcctgctgctgggccaccaggcccgtcacgcagcggtccaccttgttggtcaggaagcgcttggaggcgacggcggggaggcgcagcacgcggtccagcgcgtcagccggcgtggcgcccgcgaggtccagcggcgcggcgggggcgggggaccggctgaaggcgtaggccttgtccggcatgtccccgagcaccagctccaggtccaggtccacgggggtgggcgcgcccgcgggcgcctgccggtcgacgacgcgcacgcggcccgagccgtcgatggtgccgatgacctggacgccgcagcgctcgcgcgcggccagcgcctccagcagcggccggtctttcggtgcgatgagcaggcagtcgttctcctggtactccgcgccccagatctccagcaccgacatggtggcgtcgcccaggtgcaccgcgcgcacgtcgatctccgcgcccagcgggtagatgatctccttgaccacgttgcagttcccgcccgcgccctggtcgtggatggacaggatggggttggccgggcccagctccacgcaggcgcgcaccacgcgccacagcttctggctgacctcggcgtcgccgcgctgcaccgcgtcgtagtccagctccgcggagttggagccggagggcagcgagctggccgcgccgccacccatgccgatgcggtaagcggggcccccgatcttgaccaccagcatgcccaggccggggggggtcttctccaggtgcccgtggtcgatctggcccagcccgccggagaacatgatgggcttgagccactcgcggcgcgagccgtccgccagccgctggccgaaggagcgcgtgtacccggccaccagcggctccccgaacttgttgccatagtccgacgcgccgttggaggcgtcggtcaggatctggcgcgggtgcgccagggagggcggatacgccgcgtcggcctgctcccagggcaggtcgtagccctccagcagcaggttacccacgcagtacccggccgtggcggcgcccatcagcgacccgatgcccgtggcgtgggtgtcacggatgcggccgcccgcccccgtctccgcgccggggtagggcgccaccgcgcaggggaaattgtgcgtctccgcggtcagcagcaggtccaggtcgcgatgcgcgggcgccagcgcggagggcgcgccgggcgtgtcgggcagcagcgtgcgcacgggcccgccgcggatggcggacgagttgtccttgaaggccagcaccgagttgggggcggagcccgccagcgtgctcttcaccacgcccatcagcgactcgggcacgggcgcgccgtccacggtcagcgcggcgcggaagaaccagtggcgcgagtgctccgagttggactgcgcgatgtcgaacagctcgacgttggtggggtcgcggcccatgccgtcgcggaacatgtcggtgtagtagtccaggtcgcggtcgtcaaaggccaggcccatggaggcgttgacgcgctccagcgccgcccgcccctccgacaccacgggcaccgtgaagacgggggcggggaccacgctggaggcgaaggaggtcaggggcgtggggtacacctcctccgtcatgcggtcgtgcacgctggcggcaaaggccgccagctgggccgtggaggcgccgccgcgcaggcggaagcggcggctgacctccacgcgctccaccttgcccaggccgcaggaggcgcagatgctcaccgcgttggcggaccaggccgtgctgaaattcatgcgcggtccgacctggcagaatttttggggggaggggggggattataatcgggagggggttgggatggggagtgaagaggctggggagtgacctggaggtgcctccagatagtaacatacagcggtcccgcacccacccagcacagctgaaagccacccacctcgaccacggcatcctggggctccagctggaagctggagtcgggggtgagccgctccggctcaaaggtctcacgcagcaacctgtagcagggaaggaggaagaggtcgacgtccgttgcgacagtggcgcatgtagcatgcgcgagagtcgggtgcagtcgctgcnnnnnnnnnncgcctccagataggaacacacggcggtcccgcacccacgcagcacagctggaagccacccacctcgaccacggcatcctgcggctccagctggaagctggagtcgggggtgagccgctccggctcaaaggtctcacgcagcaacctacagcaggaaaggaggaagcggtcgacgtccgttgcgacagcggcgcatgtggcatgcgcgagagtcgggtgcagtcgctgcggctgaatggcgacgacgacacaatgagttgagccgcagccagaccctcttttggatgtgttgcctaggagggcctcctcccaaacttctcccattctcacacaaatcctatcttaaccccctccccacgaaggacaagctccaggcccaaggcgaccccgcttcacccccaacccctcacaagcgcagacaccccagcattcctcaccaggccagggtctcggcctcggccgcggtcagaggctgggacagggagatgttgtagcacaactcggtgtccatccccgtgacctcgggcagggtcttggcctgggcctgcttcagcagcgtggccgccttggaggccgacaggccggggctgcggtacagctgcaggacgcccggccccgcggcagtcagcttctgcagcaccgcggcggcggcaggagatgcaggcgaggcctgtgtgtgcgtgtgatggaaggggtgtgttgggttggagatccagcgggcatcgcaggtaggccggggtgttgcaggcgccaaccggtgcatgggtctcccatttgcagtaccagacttggggcctagcatttgcggtaccagacttggggcctatgcagggcggcagctgtcagccacttacaccctgccactccgcatcgcaggccggatgccgtctgcaccaggggcatgctgaaccacagggaaggtccctccacacacctgctgcagggtggatgccgccctggcaaccgatgcggagctgcgagccggctgttgccggggcagtccacgcgccagccgccctgagaagggggggaaatcaaacgtctggccgtgcacatgcaagcgggggggaccacggcgtcttcacagggcataccgcagggccccattggcgcgatgccgtttctcacctcggcatgccagcaggtccttggcagtgggcggtccactgcggaaacgggcaagtgccctcgacactctgtgcagcgagagggaggggagtggggatgggcgaatgcgctgcgggttacgggcacaatttgaactccatgccagacgcatgcacgtaccttccgcccgttgcaatgggacggtgctgtgggggacccgccgcacgtgcgaggcggcaggagtccatgtgagctggctactgggtacaggcgggtccagcaatgctaaggcatcgccttgagggcgagactgaggtacttcggtgggggttcactcggatgtaaggtcggggcccatcaacgtgccagggtgtgcgccgcgcgccagatcccatagggtcgcccaggggggcgggagagttagcgtttctaaggcactcaacctccggtctgtgtggcccttggatgaccttactctgtcaatatgcaacgtaacctacagactgtcaagaacaaggccattacaatgtcagtcgtggggtatttatacccgagggaggggcaagtgtcctgtggtcnnnnnnnnnntctcggtggagggttgctcggatgtaaggtcgggcccccatcaacgtgcagggggtgcgccgcgcgccttgaactagagcgttgctgctgcgcatgctgcaacataagttgagcaagtccggaacatgctgcacaacaacgatgggaatacagtcggcatctttggcctatgaagatggtctctgtcgcgcgatggatagagtctagattccagtcgggaacggaggaaacatgatggttcagagttgcctgtgctattcacaatccagatgttcgccaggtggtgttccttatagagcttgggatggaccggggagggactccagtttcaaggtcatagccaaggccccaatgtgacaaacatcgagatggaacacaacaaagagtcccatcattgcctctcctattggaaagctgactggcgcacagagtattgcatcgggaccagaagatcgcttttacagtgtacataatatggtccctgccagccgccagaaccatgtccagtgctatacagtggaaataactataaaaattgcaacagaagtgatgagaaggagccaatcaagaatgtccatggagtgtcaaagtcgatgttctctgcaaccacaagcattcgtagccgcgctttcttgtttttgccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgagctttccttctcgcagatagtccctgaccatggcgtcagtggcaatgagcctgtccacgatgacaccgggcatgctgaggcccgcgggacaccagaagcccttcttgcccattgtatcaggtgcgtgaaatgcaggggggtacctgcctggagcaacgagatgcgcatgagaggtcgtgagccagggnnnnnnnnnncatcaggtgcgtggaatgcaggggggtacttgcctggagcaaagagatgcgcatgagaggtcgtgagccaggggcgggtcagcaagaagcttccctgctgctcacatgcccggggcttcatcgcagggtccacgcgtcgccatagagctgccatgccgtgcaaagcgagccaggtgaggcaatgcgtcgtaacccgtcgtcgtccgggagcgggaatgggttcaggggtgccattgggatgtgccttttccatgcgcctactataggttgcgccttggacccacccctgcccacctgatcccnnnnnnnnnngccgtcgccgtccgggagcgggagtgggttcagggatgccattgggatgtgccttttccacgcgcctgctgtgggttgcaccttggacccacccctgcccacctgatccccatcattcgcagaccgtgggtcccagggaccctcagaagcgttcccttctcaaggggtgagcatcatggtggaggggtggtgggttgggatcatgaatgctggacgaaattgcatgctgtctgggcacccagctgctgcatcgactcacctgcctcgcctcatcactccacagcctgggcaccggcctcgcctccatgctggctgtggctgcggccaaggccgaggacgccaacagcgtcacctcctcgcgcatgtcctactcccgcttcctcgagtacctggacatggggcgtgtgaagaaggtcggtggggcgctgcgggtggtttgtatttctttggtcagcttcatgagggctttgtggagctggtctgtgggctgagcgatgtacgcatgcaacccttgcctggcttgccgcggcagggccagtcagtgggcatcgcagggccggtgcaggactccacgacacccacgccccctgccgcatgcaggtcgacctgtacgagggtggcaccatcgccatcgtggaggcggtgagccccgagctgggtaatcgggtgcagcgcgtccgtgtgcagcttcccggcaccccgccagagctgctgaccaagttcagggagaagaaggtggactttgcagcccacacgcagaccgaggacggcggcagccagatcctgggcctgctgggtgagcggggcgagaggtggagttgggtggctcagggcttcagggtgaagagtggttggacnnnnnnnnnncccctgagagagggcatctactgtcaacccattaccacccacccacctctacccaccctgcatnnnnnnnnnntgggtcaggaggtggagttggctgggtcaggggctggagttggatgggtcagggcttcagggtgaagagtggttggacgcgaaaggggggctgatcccaacgctgtggcatggcatgtgaggaggtctaccccctgagagagggcacctaccgccaacccatcaccacccacccacctctacccaccctgcatccgctcctcccaggcaacctcgccttccccctgctgctggtgggcggcctgttcctgctttcccgccgccagggcggcggcctgggcggccccggcggcggcaacaaccccatgaactttggcaagtccaaggcgcgcttccagatggagcccaacaccggcatcaactttgccgacgtggccggcgtggacgaggccaagcaggactttgaggaggtggtggagttcctgaagaagccggagcgcttcacggccgtgggcgcccgcatccccaagggcgtgctcctggtcgggcccccaggtgcgtccaggcatgggtttgctggttcactctgtctggctgtgctgttcagtagggaggaggagggtggcggggtggagggatgttgtacagtatcgagggggaggcaagagcggccgtcgactgctcgtccgctggctgtgagtgctgcgacagccatgtatagttttcccgggtttccctcctcctggtcctggcctcccccaggctcggcgcaggagatgcagcagcgtagtgcatggcggggccaaaagcgacattgccgattgcctgaccccccaccactcaagccatcttgcagggacgggcaagacgctgctggccaannnnnnnnnnagaggggaggcaagagcggctatcgactgcccgtcggatggctgtgagtgctgcgatagccatgtatagttcgcccgggtttctctcctcctggtcctggcctcccccgggcttggcgcagatgatgcagcagcgtagtgcatggtggggcaagaagcgacactgccaattgcctcacaccccgccactcaagccatcgtgcagggacgggcaagacgctgctggccaaggccatcgccggcgaggccggcgtccccttcttctccattgccgggtctgagtttgtggagatgtttgtgggcgtgggcgcgtcgcgcgtgcgcgacctgttcaagaaggtgagacgattcttgtcggagacggagggatgtggctgctggatggctgtggctgctggatggctggcgggccacccagcaggaaggctggggctgccatgcccccctctccccattgaagtccatcatgcacctccgtgatgcccaccactccacctcgcaccacacgacccccccgcaaaacccaacaggccaaggagaacgcgccctgcatcgtgttcatcgacgagatcgacgcggtgggtcggtcgcgcggcaccggcgtgggcggcggcaacgacgagcgcgagcagacgctgaaccagctgctgacggagatggacggctttgagggcaacgccggcgtgatcgtggtggcggccaccaaccgcgccgacatcctggactcggccctcctccgccccggccgcttcgaccgccaggtgtcggtggacgtgcccgaccagcgcgggcgcctggccatcctgggcgtgcatgcgcgcaacaagatcctgggccccgacctggacctgaaggaggtggcgctgcgcacgccgggcttctccggggccgacctggccaacctgctgaacgaggcggccatcctgacggggcggcgcaacaaggaggccatcacccaggccgagatcgacgacagcatcgaccgcatcgtggcggggatggagggcacgcccatgaccgacgggcgcagcaagatgctggtggcctaccacgaggtcggccacgccgtgacagccacgctcaccccgggccacgacccggtgcagaagctgaccctgattcccaggggccaggcccgcggtctgacctggttcatcccaggtgcgctgggttgcgggtggaggtgggggaaaggggttgctggcgagcatccgataggagggggggatggctggaggaagggccgtgcagacacgcgactggcgcgccgccccccgatgcctctccagttcgggatgtctcggaccagggcctgcatccccccaaacacatggactcccaccaaccaacctcacccctttcctcccttccctcccaggcgaggaccccaccctgatcagcaagcagcagatctttgcccgcatcgtgagcgcgctgggcgggcgcgccaccgaggaggtggtctggggctcggccgaggtgaccaccggcgcctcctccgacctgcagcaggtcagcaacatggcgcgcagcatggtgatcaactacggcttcagcgagatcgggccctactcgctgcaggaccaggccgcgcagtcgcccgacatgatcatgcgcatgatggccaagaactccatcagcgagagcctgcagcagcgcatcgacgcggcggtgaaggacatcgcggcgcgcgcgtacgaggaggcgctgcgccacatccgcgacaaccgcgcagccatggacaaggtggtggaggtgctgctggagcgcgagacgatgagcggcgacgagttccgcgccatcctggccgagtacgcggagatccccgacgagaacctggaggcggtgcggcagcagaaggcgcagcccgagcccgtgctcagctgatgagccggcagcagtaagggtggggcttggatggcaggagggcaaggcctggagtccagcaagacaccccctgcccttccggggtttgcctcttgtgaggcggtctccaagtgcgacccacccccctccctacccatcacaaagacaaagaattactccctgcttttccttggttcgagtcgacccccgcccccggtatgtcgtgtaatttacaactggaaaaggcagcgatacaagggtgaggaagggtgaggagaccttgcgctgtgcggaggtgagcaagcgtaaagaggggcaggtacgaccatcctccacccacggaagcacctcagccctggagggtaggcctcatgagcgggtgaagctgggcgatgtacacgatgccccacctgcagaggggtttgggggtccaatagagaaagacctccaggcaaagtgcagctgcaggctatgcatatcgatgcatatcacacagctagaacaatacacaacaagccaagccccgatcctggagctcacatcatccagcagcacgccaccgtcgtgcccacgagtgtgtgcttcaacctgggagagaggtcgtgggtcgcactggtcagagcaccgatcttttggtctcgccacccgccgaaaacccctggcccctggcccgagccaacgcacagtttgttcccatgtctagccccagatgcctgcacgatgccaaagcccagcagctccaggagggcgaatatgagggtgcccagccaaaaccccatggcgctccccgggcgcgaccaacgttctaggggggttttacgatctcaaagcgtgacacgcccctcgtgaaaatataggcactgctgggaccagggttgcacaactcagaagcatgtgtcctgcgagaatcttcacattacaggtttcggtgtcacaccagcactgggccttcgcaaatgtggatttccttggtctataacattgcgcccccccctcggggccgccccgctctttggccctccaggggccgtaccctgcctctttcaagcctgcactggccacggggtcaggtaccgattgtcgactgtcagtgggagcaacatggcggtcggcaagaacaagcgtgagtggacgtgcctgcgccccgccagccggcagtgcccctccacgggcgtcctcgtcccatcgctttcccaatccccccgttcgcaggcctgtcaaagggcaagaagggcggcaagaagaagatgtgagtaggctggacgcgcggtggctcgccctgctcctgcttggctcccgaagcatgctccctcacacccggtacccctcctctccactgcagtgtcgaccccttcagcaagaaggactggtacgatatccgtgcccccagcaccttccagcagcgcgctgtgggcaagaccctggtgactcgtaccgccggtaccaaggtgtgatggacggacggagcgggaaggggccggggcgcagggcgggagggattgctctggtggagatcgggcgcagtagcggcggacaggcctcgggggggggaggtctctatccagaccgctgctggggagcnnnnnnnnnngtggacggacggagcgggaaggggctggggcgcagggcggcgagggattgctctggtggcgatcgggcgcagcagcggcggacaggcctcgggggggggaaggtctctatccagaccgctgctggggagctggggatggcgagcctggagatggcccagcaccagccgctatatctttacccattggggctaggattttgcccctccagctctggctggcaagggtactcggcgagtatacaatgacaaccccccaccacccccccctccctccctccttccaacagatcgcgtctgatggtctgaagggccgcgtgatcacggtcaacctggctgacctgcagaagaatgaggcggacgcgtaccgcaacatcaagctgcgcgtggaggacgtgcagggtcgccactgcctgaccaacttccacggcatggacctgaccaccgacaagctgcggtcgctggtgcgcaagtggcagacgctgatcgaggcccacgtggacgtgaagaccaccgacggctacacgctgcgcctcttcgccatcgccttcaccaagaagcgcgcggggcaggtgaagaagaccgcgtacgcgcagagctcccagatccgcgccatccggcgcaggatggtggacatcatgacccgcgaggccacctccgtggacctcaaggatctggtggccaagttcatccccgaggccatcggcaaggagatcgagaaggcgtgccagggcatctaccccctgcagaacaccttcgtgcgcaaggtcaaggtcctgcgcagcccaaagttcgacgtgggcaagctcatggaggtgcacggcgacctgcccaccgaggtgtccaccgccgtggaccggcccgaggagggcgtggtcggcgacgccccggaggaggccaccgcctgaggcccgggcctgcctgtgcgttgttgactgtgggtaacaacggaagctaagagggacacnnnnnnnnnnnnnnnnnnnnnnnnnnnnnnnnnnnnnnnnnnnnnnnnnnnnnnnnnnnnnnnnnnnnnnnnnngacctgtggcgccctgcggactccctcccaccttccccatgggtgcgggagcgcgatgggcctagggcaaagttggtaagagggcatgacgagctgcaacagacacgctcataacaagaacgaggcaatcatggcccaggagagcgtgcgtgcgctggannnnnnnnnngagcgagggcaggcgggcagggggggaaggttgcgtggtgtggacgatggtgtaggaagagcggaggtgcaggcttcagagcgggaggcccaannnnnnnnnnaagcgagggcaggcgggcaggggggaaggggtgcgtggacgatggtgtaggaagagcagaggtgcaggcttcagagcgggaggcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagttggtaagagggcatgacgagctgcagcagacacgctcataacaaaaacgaggcaaccatggcccaggagagcgtgcgtgcgctggagggcaggcgggtgctgatcgtgaacgcccatgtcggcatgggggccgacgtcgccgagaccttcgccagggagggggccaccctggtgctcaccgcaccgcagaccctggcgctgcatgaggtcgcatcccggtgtggaggaatgggtggctttgacacactggcgccctgcgaaaccctggaactcgatctcacgagtgcggagcaggtgggcggcggttgcaggaccaggtgaaggggcgatgtgtgtgtttgtgtgtgaccacttgatcagatcactcgccacacaccatcgcaagtgtcactgcatccatcgcctgatcaggtggacgaggtcccccggcaagtcatcgagaagcatggcggactcgatgtgctggtcctctgnnnnnnnnnnnnnnnnnnnnnnnnnnnnnnnnnnnnnnnnnnnnnnnnnnnnnnnnnnnnntcctggacttgtgggaaggccgtgtaccataccttctcctatactcatttccttcagagaagtgtgaggaggatggccccctcatccaccccctggcccgccagctgatgcatgaggtgaccagcgcatgtaagggggtggacgtcatcgtgctcgccgtcggcggcacggagggcgtcgacctgcccgggccgcaggatggcagcggggatagccccgcgtacatccagatgtctaccgatgggtctcgcttcctggctgctgatcgcgagttccccagcgccggccaggcagcactttcatgcttcaaaaagcaggcggctcaggaatgattccagcccagccaaatctggaacatgggaggtttcggacacctgtatttttgcgtgattctagagcaactcggtgcctcctggtgttgcatgctgttggagggaatgccaggatctctttattgctggtctttgagtgtgcctctgagcttccagatgtttgtacaagtaaggatgaggcagggctatgaaaagttgatgttgaaaccaagtcctcttgtggcaaggagcgatatgccaacgaattgcaaggacatgcgcgagagtgcaaggacatgtaccaggttgtatgatcgttgagaatcccaatgcacagccaggtccaggcctcaggccaccaccagccctgcaaggtgcaaagggcacaagggaatgctgtgactgtctggtgatggggcccctgcttcatcagatatcgcggcgcgaggggcaggggtggcaacctcatcaaagaagtgccctcctcgccctctcaaacgcatcagctggggtggagtcagagtggtgcataacaacttcgtgtctcattatcaggggcctccccttcagaacaggtctgtggtgaattactttcatcaccccccaccagggcaagctgtgccggcagcctgggcgggtacgcacctagctacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggtggagggggtgggggcgtcagtgcaagagtaagccccgttgtgttagcgccgaaacgccctctgacgaggacggcccggcgccggccacataactgtgtctacggcgagcnnnnnnnnnnagggcaagtgtgtgggactgatgcggttgttgcagggggctgggcgcagctcttccacatgctctcgccaacagactcctcacccaaccatcgatgccgcacgcctgcacctggatttgttccagagcannnnnnnnnnggggcacgtgtgtgtgactgatgcggatgttggagggggctgggcgcagcacttccacatgctctcgccaacagactcctccctcgtccatcgatggcacacgcctgcacctggatttgttccagagcannnnnnnnnngacgccctctgacgaggacggcttggtgccggccacataactgtgtctacggcgagctgcccttcgacgatggggcccctaggggcgcctcgtctcgggggtcctgccctttcgggatggcactctctgcctcatcgcccggggactttctcccagtacatggacgcaagagcgtctgatcgtggagggcggggttctgggtccgcactcccaaaggagatgggacccaggactccacccagtcaggtcgtaccgaagtggccctttgcgctgcgcccttacctggtgtgtgcgcgctgggcagcctgggggtccgcagcagacaaattgcgccgctgtgagccttctgcacagcagagggccgccttgggtgcgacatgccgcttccatggtctaccctctcacaccctgccagggcgggaaggggtcgaggggttcagcaggacgcacgtgacctcgtcgcatgccagcacccgtcgcaccggcgccgcaagccatcagatagtgnnnnnnnnnncgacgcacgcgagctcgtcgcatgccagcgcccggcgcaccggcgccgcaagccatcagatagtggtgcatgtaaggtttcaacacgttgtggttcagaatagcaacgttgattgggatgggatcgtcatctggcagcggcacgggcgtgtgagacacaaacagcccggtgtcggtccactcacctcggggacggtggcagctgcatgtgcaaggacgccattcggtgctccaaaccctcaaggcccatgccactccccaagcagcgccgaggctgccaggctcctgccctgcgcgagatcaacagggtagaaggagaggtcgaaaaggtggggacgaaaccgacgggcctgccccagatggggttcccgctnnnnnnnnnnggagcccgatgtcggtccactcacctcggggatggtgtccgctgttgcatgtgcgaggacgccattcggtgttgcaaaccctcaaggcccatgccactccacaagcagtgccgacgctgccaggctcctgccctgcgcgaggtcaacagggtagaaggagaggttaaaaaaagggggccttaacagacgggcctgccccagatggggttcccgctcgacagggggaggtagcaggagcaaaatcatcacaaaagccctcagttcaggtctccaataaattgtttctgcacagttgttagactgctcagtagaacgaaagtttatttttagcatcaccgggcttgtgacaggagagcagcaaggaagaggagggagggaggtgcggcgttatgggtcagtgatcatttcatctcactggtagcgaggcgtgtgctacctaagaaggtgtcctaagatattgatctggaaacatcttcatccccatacgcacacaggaaaaaacgggaacagaaagcggagaaagactacagaatcgggatcggtggccaaggaatcaaggttgcaggtcagaaagaacgcagcgatgagttcgtgattcgtcaggcttgaacaagctccgagatgtgtcacggttctgtcatcagccctgccaaggtcaacaagcataggcgttccccacacaatggagctcgagctcttccctacctggcaaggtgcccgctgccatcagacctaggcaggtcctccatcccagctgaggggagcccgtgcagggacctgcaccaacgtgcgtcgacggggagtggtggtttaaagagaagtaatcctggtgcaaggaccttgccagttgaggttgcagggaagtgtcgctgtcatgcttgtcggatcggctaccgatgggctggcccgatcaaacaacagcatcgctctcctcggtttgtgttttggggcaagcaggactcatggactggagtccgctgcacggaggatacccgaggctgggagctcgacagtgacgccccatcacgcaggggcatgcggccccacaagtgccctcaggaatgcaagattgtccacaagtatgttcaggtctcaaagattatcattcaacatcttcgggcatggggtacttggtgcgcattagagcctccagcctctgtcaaaagtaccttgaagggcttgccgtcacccgctcactccgctgcgagccatattgactgccatcggactgctctccagggatggagagagtccgatgtcgaggttcaagacagaatcattgcacagaaagaatgcatgtgggactgcaaatggctgcgcagcttaatatagaggaggcgggggccaccccggccccgggtcgacccgagattggtccacgtcctcgaagcgcaacattcactcccgctgggacattcacccccgcaacatcgcgcaaggcccgagaaacccacgccctccaaccctgtgtcatcgatcctaggtacaacaccggaggaaatactcctttcattcattgccggcgttggacgggggcagacttgggactggcagtcagtttgcaccatggccgctcgccccgtcgtgaggaaagccctgggccttggcggacatggctccggtctccagcaagcagtggagcacggaaagtccaccctcttcttccgggaggtgcgagcgctgggagaccgggtctggttggggctgggttatagggcaggagcaccccatgaggtggcacccatcccctccctcataccacgcaggtgtgccgcaccctgccctggatcgtccacaactacaagctcgaggagctgaccaccgtctcccagttgcgacgaaacgtgaaccagctgttcaggcggttcgaggaggtcaagacgcccgaggcggtggacctcctcatctataagggccgcgaggagctcgaggtgagacgcaggattgggtcggctccgagggaaaagctgggcgtgagggacactgctcttaaattgcgagtcgcactgtgctggaggtttgcatgtggggactgggannnnnnnnnnagcagaaaagctgagcgtgagggacactgctcttggattgcgagtcgcaccgtgctggaggtttgcatgtggggactgggatcatgaccacgtgacccgctggcaaaggactggcctcggcagcagccaatgtggccccctgattgagaaggtctacgccatgcagactgcttgtgtccattgccccagagtgctcactgccacacgaagactgacttctgccccgtcggcctgtgctcctcccagatgatcatcatgcagcataagcagcggcaccatctgatcgacaagtacnnnnnnnnnncaagaagatctacgccatgcagactgcttgtgtccgttgccccagagtgctcactgccgcacgaagactgacttctgccccatcgacctgcgctcctcccagatgatcatcatgcagcacaagcagcggcaccatctgatcgacaagtacgtgggcctgcccgccaccacagagcccaagcccaagcccgacaacctgtcacccttcctggcccagttctacctgtccaactgatgcgtggactggtcgggggggggccgctgggtaggggatttcgcgccccagccgcacccagcgtggctcgtcatgtaaagaacctgagcatcagcgagtcaaggcggcacatctgtataccatgcagagggtgtatcattgcagaacatggggttgacagggtccaagctgctcnnnnnnnnnncgccgctgggtaagggattccgcgccccagccgcactcagcgtggctcgtcatgtacagaacctgagcatcagcgagtcaaggcagcacatctgtatgccatgcagggggtgtgtcattgcaaaacatggggttgacagggtccaagctgctccggccgagcgagggccgtgcgggcgtgcggccgagcctccagcgggccgctgtggtggcctcgccgccatggcctgcaccgcggtgctgcgtctcggcaagctggcccactccacaccccctcccaaacaacctagtactgttccggccagcgctgggccgcgccgcacagcgccagccccccgcccgtgtgcagcatgagctggcgcggcgccggccccacagtcgccgccgccgcccgcgccgccgccgcctcccaggcggccagnnnnnnnnnntgttgtggtggactcaccgccatggcctgcaccgcggtgctgcgcctcggcaagctggcccactccacaccccct

SEQ ID NO: 41158 - DNA, 61 bp, Chlorella protothecoides
cgaagctgcaaggttgatgatatggctgggggtattccatagtagaatggtgcagaggcct

SEQ ID NO: 41159 - DNA, 73 bp, Chlorella protothecoides
tccagacccttgctcagcttgagcctgggcgggggcaacccgcgctccaccagataccgcgtccgctcgcgca

SEQ ID NO: 41160 - DNA, 61 bp, Chlorella protothecoides
ggaactggacccctgcaacaagcgcccaggggtgcacccctgggcaatggtaagatggtcc

SEQ ID NO: 41161 - DNA, 67 bp, Chlorella protothecoides
tgtcgacatgctgcagtggttgcctgggacgcttgcaggtggtacgggagtgttggctgctctgttc

SEQ ID NO: 41162 - DNA, 105 bp, Chlorella protothecoides
gggggagggtgtgcggagggagtgaatattgaggcacggcgcggtgcaggacaggtgttcttgtgaggtggccggtgcatcacattcgttggaggagaggtttgc

SEQ ID NO: 41163 - DNA, 106 bp, Chlorella protothecoides
gcaaagagtgttcgcgggacactgtgaggtataggcttcgggcgtgggtgcgacaggaggaggcgcacggggacagcgctgggtcgacactgttgccaaaagtggg

SEQ ID NO: 41164 - DNA, 79 bp, Chlorella protothecoides
ctttgcctccggcgcacccgtcctgcagctcgcctctcgggccggggagtttgccctgaaaaccgcccctgccggcgag

SEQ ID NO: 41165 - DNA, 102 bp, Chlorella protothecoides
acacatcactttccccatgccgtgcgtcccaattatcctacttcacacatgaaagccctcctcctagctgaacccctctacctgttcaaccacacgcaggtc

SEQ ID NO: 41166 - DNA, 70 bp, Chlorella protothecoides
tgatatgcacaatccaccccacaggtggagataggaagtagcgcggcattccctgcatcatagagaaagg

SEQ ID NO: 41167 - DNA, 61 bp, Chlorella protothecoides
cagaccagcaatcatgacgcctccaagcccttagcacctacatcaccaagtattacccttc

SEQ ID NO: 41168 - DNA, 124 bp, Chlorella protothecoides
tgttcatgcaccgcttggtgtcccacacgtgcaccagcttctcctcaccgttgcgcacccgtacgtacaggtgggcatgcagggtggcgtgacgggcgcagcacagtttggaagtcctgtgctc

SEQ ID NO: 41169 - DNA, 113 bp, Chlorella protothecoides
atgttgagcgggaactccatgactgcgatgggttgggggagggtgaagggggggctgtggtggcgaagagaggaatggaacccaatgcctccctgattcagtcaggggaaagg

SEQ ID NO: 41170 - DNA, 61 bp, Chlorella protothecoides
gcaccgagagctggccggtgtattggcagggtgtggggcgccacagattcatgagcccgca

SEQ ID NO: 41171 - DNA, 65 bp, Chlorella protothecoides
ggtgagtgggcaggaagagggagttgtaagaaagaggggggggggggggggggggccccccgggg

SEQ ID NO: 41172 - DNA, 61 bp, Chlorella protothecoides
atccagattgaccctttgcacggtcttggccagtgggacgggccatgcgccaatgggcgtg

SEQ ID NO: 41173 - DNA, 123 bp, Chlorella protothecoides
acgcgggtgcggcatggtggactaggccaccgtgcttgaggagacgtgactgcggctcaccagcatcatgccatctcgcccttggcagcatgctgagtgcatccatcggcagcgagcgcccgc

SEQ ID NO: 41174 - DNA, 62 bp, Chlorella protothecoides
cacgcgccgggtgcatgccaccagccccccgacgcacctgcaggcacgctgtgcgcgcttcg

SEQ ID NO: 41175 - DNA, 84 bp, Chlorella protothecoides
caggagcagctccatggcaatgaatcaggccaggagtgagccacccagcatcccgacaggctgcagattctccctcaatcttct

SEQ ID NO: 41176 - DNA, 61 bp, Chlorella protothecoides
cgccatctcggcccccgcaggcacctcgccagcccccggcgccgcgccgggcgagtgccgg

SEQ ID NO: 41177 - DNA, 16766 bp, Chlorella protothecoides
  modified_base (658)..(819): a, c, t, g, unknown or other
  modified_base (883)..(892): a, c, t, g, unknown or other
  modified_base (2052)..(2061): a, c, t, g, unknown or other
  modified_base (2650)..(2659): a, c, t, g, unknown or other
  modified_base (2746)..(2755): a, c, t, g, unknown or other
  modified_base (2844)..(2853): a, c, t, g, unknown or other
  modified_base (3064)..(3105): a, c, t, g, unknown or other
  modified_base (3835)..(3844): a, c, t, g, unknown or other
  modified_base (4809)..(4853): a, c, t, g, unknown or other
  modified_base (4926)..(4935): a, c, t, g, unknown or other
  modified_base (5141)..(5150): a, c, t, g, unknown or other
  modified_base (5860)..(5869): a, c, t, g, unknown or other
  modified_base (5959)..(5968): a, c, t, g, unknown or other
  modified_base (6199)..(6208): a, c, t, g, unknown or other
  modified_base (6410)..(6419): a, c, t, g, unknown or other
  modified_base (6524)..(6533): a, c, t, g, unknown or other
  modified_base (6682)..(6691): a, c, t, g, unknown or other
  modified_base (6867)..(6876): a, c, t, g, unknown or other
  modified_base (6929)..(6938): a, c, t, g, unknown or other
  modified_base (6991)..(7000): a, c, t, g, unknown or other
  modified_base (7117)..(7126): a, c, t, g, unknown or other
  modified_base (7219)..(7228): a, c, t, g, unknown or other
  modified_base (7641)..(7650): a, c, t, g, unknown or other
  modified_base (7759)..(7768): a, c, t, g, unknown or other
  modified_base (8127)..(8136): a, c, t, g, unknown or other
  modified_base (9020)..(9029): a, c, t, g, unknown or other
  modified_base (9225)..(9303): a, c, t, g, unknown or other
  modified_base (9459)..(9468): a, c, t, g, unknown or other
  modified_base (9624)..(9633): a, c, t, g, unknown or other
  modified_base (9777)..(9912): a, c, t, g, unknown or other
  modified_base (11576)..(11585): a, c, t, g, unknown or other
  modified_base (12249)..(12258): a, c, t, g, unknown or other
  modified_base (13732)..(13741): a, c, t, g, unknown or other
  modified_base (15657)..(15666): a, c, t, g, unknown or other
ggggtagaagggttccatgaagggtacagggattgcacacgggaccagctggaatggagttacacatgctgagtagctcgagcctctccaacgctcgtcaacctccctgcttgggcggaatagtgaatctgagcatgggcaggagagcagcgagagcgtacacggtgtgcagcctctgacaagcttatgggacgaggccttgaagcatgggccttcagtgacaggggacaagctctgtgtccaatcaataccatccgcgttcatctgcctcacgagctcacctgagctgtacacgtagacaaggggcggccgctttgtgaaagcctccgcctcagctcttgcgcctccttctggctgacatccagcgcagatcgcagcatgctcacctgcggggaggcatgtacctgtgttgacggatgctgcaccccaggctgtcgcaacagaccagcaccttgtcagtaaaaggccacatactccctatctcaacccccccccattctctgactaccctcccagcagctcacatgcgcaaggatggaggcctgttgctgctccagcgcgtggacatttgccgagagccgagcattggcgagttgcaagaactgcagggacaaaatgagggagggaaagaggttgccgacagccgttaccaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggggggatgatggcgagttgcagggacgttctgtagaggccagatgggcaaggttgcctgannnnnnnnnnatgcatagccagagtcctggacaaatgctaaccccaacaaaggagatcccatcccaaagtcgtctgcaggcaccaccagcagcaaggggctcaccgtgcacttgtgctgcagctcatccaccagctcctgtcgcttcagcctcacccgtctcgctgactctcggttggcgactcgtctgtagggaggagaaggaaaaggaggggggatgatggcgggttgcagggacgttgtgtagaggccagatgggcaaggttgcctgagtgtcaagccagactcgaaacagggcatggaacaccatccacagaacacaccgcccacctcttcatccttcgccgctcctcctcgctcatgtggcctggaatggccagctgcgcgggaagacacagcaacggggtgactgcccacccaatagccattgcagtaggcaagcaggtggtccgcacaccaaacagggaaggcatctgtgctcgctttctacacctcccggaccccagctcacattcccgttcacatggcgctgcacatgtggcgtcacgtcctcagatgagtactcgtcctccccctcacacgccctatctccctcgcacatggggcctgtgatgcgataatccaaccctgttgcctcaaatctacgaaatcgggcagccccccagccaaacaggaccgttcgctccgcgaaatccccagggagccacaatgaaggaccatgaaacattcaatgcaacatccatgaacccataacatgtgatcacaagtaccctgacaatgtatggtctacctttggatggggctaaaccttgcaagagatccccccccgtcacatgaccccttggcactgagatctgagttgggagagacaagagaaggggtgagggagccagggtcagttctcaaatgttacacagtagctttcgtggttcccaccaatgcagtgccaccaaactcctctcagccagcctgcacttgcctggagtgtctgtttgctggccggcctgacaagaggtcctgtcagcgtggtcacagtcctgttgacaatctggcctgcctgaagagatgagcctccatcagcagagctgcaggagtggagggacccaatgagagaaagatcacgcagggctcggcttgcacgtccagtgcagcaggttctggtcggtctcannnnnnnnnnggtggagggacccgatgagagaaagaccacgcagggctcggcttgcaggtccagtgcagcaggttctggtcggtctcactcacatggggctggccagggcgcccgagctgaccaaggaggaggggtggagttcgcagacaaccctcaccgggaccacgccgggggttgtgccatgccagggatgcctgttaccggtgacgatcgagttgctgaccatttcgaccacggggaatcgctgcgagaggattgtttgaggcgcttaaccatcctgccccacagacccgggcatgtgcccctggacacaggtgtctcgccccagccccagcagcttagcattgttggcgagggcgcatgataagctttttcatgccccgagaccatgggtcccgcactgtgcaggcaccgcgacagctttcccgtccattcatggggtgggtggacggaaaccccctcgtaccgactcgtaatgctccggctgtggtggagccctgagctcgacctccgcgccccagtgctcttatcatgcgtctaaccagttgcgtgcacccgcatggtctgtttgtctcctcgcgcgcccctgttttcggcnnnnnnnnnnacatgccatctgggggagtgggcttccggcggtcccgacatggttgaaggctgcaatgaacctctgaatggccgagtctcaacgttnnnnnnnnnngcatgccacctgggggggagtgggcttccggcggtctcgacatggttgaaggctgcattgaacctctgaatggccgagtctcaacgttnnnnnnnnnncggtggagccctgagctcgacctccgcacccccagtgctcttctcgtgcgtctagccagtcgcgtgcacccgcatggtctctttgtctcctcgcgcgcccctgttttcggccgcgcaatcccgggacatgccgcccagcttcggcccggatcaggcagtacagtcgacacgcggtccatgcatggtccggactgggctcacgcacggggcnnnnnnnnnnnnnnnnnnnnnnnnnnnnnnnnnnnnnnnnnntcatctcttccatctcctcccctaggcacatggccgccccctaacctgctcctctatcctggctccggctcaccaggccattctacaacacagcactctacatccgcgccgccaggggccgcccagccagctccccaaacaggctgtaggcatgcaccttgtgcacgtgcaccatgaccaggctgccccgcagtgccgccccgtccccgtcaaagaagacgagcttgttgtgccgcgaccggcccatcgcctgccccgggtccttggggttgggcccctccactagcacctccagctcgcggtccaggaagcgctgcgcacgctggcccgccacccggttcaccaccgcgttcagccgctgcaggcggtcgctcttgatgaggtctgccacctggccgtcccaggccgcggcgggggtgccggggcggggggagaaggcggcggtgttgactcggtcgaaccccacctcctccaccagccgcagcgtgccctggaactgctcctcggtctcgcctgggcgaaggttgtcgtgtgcggggtgttgtcgcgatggatggcacagggcgtgcgggaggggggccccacttcggcgaatcacaaactccctccctaccttcttcttgccccacgggtgcggaggcgggggtgcaaaccctcacctgcaccccggagccccacctggggacaatccccccccaacctggctcacccgggaaccccacaatggcgnnnnnnnnnntcccgcaccccggagccccacctgaggacaatccccccccatcctggctcacccgggaaccccacaatggcgtccccgctgatggaggcgtcgggcatgcgccgccgaatgccatccacgatggcgcggtagcgcgcggcggtgtacccgcgtgccatgcgtcgcagcacctcatcatcgcccgactggaaggggacgtggaagaactcgcagagcttgggcaggtcggcgcaggcgtccaccaggcgctggctgaagtagcgcgggtggctggtggcgaagcggatgcgcgcgatgccgggcacgtcgtgcacggcgcgcagcaggtcggccagcgtgtgcgcgcgccggccggagccgtccggcgcggacccgggcagatcccggccgtaggcgtccacgttctgtcccagcagcgtgacctcgcggtacccggcctcgcccagggccgccatctcggcgcggatcgcggcgggggtccggctctgctcccgcccgcgcgtggtgggcacgatgcagtaggtgcagcgctcgttgcagccgtggatcaggttgacccaggcggagagggtggagtcgcggcgcggcacgctcacgtcctccgcccagtccagctcctcggtggccaccacctgggagccggagctcacctgctccagcagggcgggcaggcggtggacgtggtgcggccccatcaccaggtcgatctcggggacgcggcgcagcagcgccgcgccctcctgcgccgcgacacaccccgccacgacgatggtcaggtcggcgcccaggcgccgcttgcgcgccgcgtgcacgcccagcgcgccgtacagcttgtcctccgccttctggcggatggagcacgtgttgtacaccagcacgtcggccgcgcccgcgtcgggcgaccgcgcgtaccctgcggcgtccagcgcgccggccagccgctccgagtctgccaggttcatctnnnnnnnnnnnnnnnnnnnnnnnnnnnnnnnnnnnnnnnnnnnnngcctgtgagtgggagggggccagcggtgaggacggggtgtgtgctttggtggggacccacctcaatgcaagannnnnnnnnncgagtgggaggggggcagcggtgaggacagggtgtgcgctttggtggggacccacctcaatgcaagaatgcccgcagaaactgacgggcgatctgtccacggcctgtcaagcgacaccgggtggggaaaggaggccatcatggcccgtgccccaaccatggctgacacgcgccaacgaccccatgaaccacccgagccgcaccctnnnnnnnnnnatgtcaagcgacaccgggtggggaaagggggccatcatggcccgtgccccaaccctggctgacacgcatcaccgaccccatgaaccacccgagccgcaccctcggtgccgcaaaagcccgcgtcattctccaataatggagggaggagggtggtggcggaggcggtggcacgagagggggctgctgcctgcctcgcgcgacggggcacccgctggccacggaacgggggtggcgggggcgtggcggtggagcagctcgcgccagacaccacgcgtgcggcgtgcatcttggaggaagtcgcaaggattcaagagttggcggttctcatcggaggcatggacagtatatgcatgcaaggatgtgtcgagggaggggtggtccttggccttatcgagactggagcacctcagcgcgcgccaggtccaccaaaattggagtgggaactgtgcagcggcacgagcgcaccacttttcgcgagacttatcccttgcatcaaattcttcaacagctcaatgagaccatctgttgatttgagtagtcctggtcctgtcctaacacctgattggtacggttagaatccttcttcagatgctctgcaccagggggacatctatggagggatgccaaaactccagcaaaaggttaaacaggccattgggatgaagaaactgcggtgaggagtgcgttgcagcatcacttgagcctgcctnnnnnnnnnnagttggttgagtagtcctggtcctgtccttacacctgattggtacggttagaatcctttttcagatgctctgcaccagggggacatctannnnnnnnnnagaagtggcgtgcatgcctggaacgtaccgtggataagagtccctaagaccatgtttgccgcatggtgagggcaacggcccagcaacatcatctccctggtattcgtcgtggagacgccttttggagtccgccagcatcgatggtgctgagctagcatgctgtgcaccaaagcaggggatgagctcattccgggaaataagtttctcctccccgccacatgtctttgtacnnnnnnnnnncagacgccagttggagtccgtcggcattgatggtgctgagcaagcatggtgtgcatcaaagcaggggatgagctcattccggggagatacgtttctcctccccgccacatgtctttgtactattcaagaatcgtttgaacaattctgatcaaggccaccaggggggttgattgatatactattattgtgccactgcagcgcnnnnnnnnnngcaagtggcctgcatgcctggaacgtaccgttgataagagtccccaagaccatgtttgtcgcatggtgagggcgacggcccagcaacatcatctccctggtattnnnnnnnnnnagtttgaacaattctgatcaaggccatgggggtgggtgggtgatatactattattgtgccactgcagcgcatgcaaggcatatgagataaagagagcataaactatgactagctgtggggggagagggcgctgccaatgcgttgtcgcnnnnnnnnnnagcgaacatgcgaggatgatgaagacccgattgcaaggttggagggagcgcacaccacgtgctggcctttcaggagactcaaggtgaccaccaggtgatccagtcggagtctattgagcaggtgaggggggggcgcctgtattttgctgttccttctcactgattcttccagctcnnnnnnnnnntacggtagctagcacagcagttggcacgcaaacattgcgcctcacccctgcgnnnnnnnnnncacggtattcagcacagcagtcggcacgcaaacattgcgcctcacccctgcgnnnnnnnnnntgtgctggcatttcaggagattcaaggtcaccaccaggtgatccagtcggagtctgttgagcaggtgaggggggtgcctgtacttggctgttccttctcactgattcttccagctcnnnnnnnnnnacccagagatacgggcgcaatctcaaaggcgtgcaccggcggcacgaaggaggatcgcttcggggcacggtcgaccacgacgcgagaagacannnnnnnnnncgctggtgagacagacatgtcttgctgtgactatatgaggcaggggctcagttttcggatggcttggtggataaggaccctcccttcacgcccagagacacgggcgcgatctcgaaggcgtgcaccggcggcacgaaggaggaccgcttcagggcacggtcgaccacgacgcgagaagacaccttggcctgcgtcagtgtttgggtgtggagggggtgggaggcgcctgagcttcgctgctgaacaggcagtggccgggccacactgagccgaatagttgcatcacccaggcttgcacaggatgagatcatgacgcagtgtgaggggtgtctcccctgacgggaattctactggcctagaaaatgcacccccttccctcacccaccccgctcccctttccccccatacgcccnnnnnnnnnnccatgacgcagtgtgaggggtgtcccccctggcgggaattccactggcctggaaagggcacccccttccctcacccactccgccccccttttcccccataaggcccccnnnnnnnnnnccccccccctcccctttgcccacttcacccccttccctgtgcctcaccaggtcatcgacccccgccgctgcgatgcccaggtcccgctccctgtctgctgctgcggcgagggcgaagcccacggccgggtcctggcgatagcggtacgtgtagcagatggggatgtaggccaggagtgcgacgcccatgagcaccgccagcagccagaagaagtcgtcgatgtggccctggttcaggttgtcggccacccagccggcggcgccgccgcgcgtggacacgctggtgacggcggccacgaggcccacggccaggtagctgccggcggcgccggccacgaggctcagcgcggaggcgatggnnnnnnnnnntggccacccagccggtggcgccgccgcgcgtggacacgctggtgatggcggccacgaggctcacggccaggtagctgccggcggcggcggccacgaggctcagcgcggaggcgatggagcgcatggcctccggggactgggagtagaagaactccagggacccgacggaggcaaacacctccgacatgcccaccaggaagtactgcgggatctgccaccagactgagacggggacggagttgtcggtggggtccacattttggcgcggggagggagggcatgagggtgtggggcagggcgagaggggagcaggggagggccccgggccgtcgtggtggcatgctggcaggtggtcgggaggctgtggctggcaggtggtgggcgaccgcccctcaaccccgttcccaccccctgctcatatcccccccaaccccacacacagacctgcaggttgttggccctgactgccttcaagcgaaaaatctccaccagggcagcacagaccatggagaggatggcgatgccgaagccgacgcccatgcgcgtgaggcgggagatggggcggccgatgcgcctgaagtagggttcgatgcccaggtcaaagatggggacccagatgaggacggaggtggagtccagcacgttgaccatggtggcggggacgacccaggagcccaggtggcggtccatggcggagccttgcaggacgaagagcgtggacatctgggcgtagatggcaaagtagacggcgaggatcgccatggagggcagcaggcgcaccacgcacttcagctcctccacctcggtgacggtcaccagccagcggtcgtgcaagccgggggcgttgaccggtgtggccgccttgtccagccagcggaactcannnnnnnnnncgcacgccggcggcctcgaccggcgtggccgccttgtccagccagcggaactcaggggtgtggatcatcctggtctggccggggatgatgctcatgggcgtgtccacctcgtgcagctgcgtgggttggtggggttgcattggtcgggggcgagatgggttgggtgggttgggggtgagatgggttggagggcgtnnnnnnnnnnnnnnnnnnnnnnnnnnnnnnnnnnnnnnnnnnnnnnnnnnnnnnnnnnnnnnnnnnnnnnnnnnnnnnngcgtggcccaaccggccttgtgtgccaggcacacagccgcgtggagggcatagtcccctggccacgtgccatgttcattggccgtaccacccaggccaccccctttccccaccggcccagatcaccggtgcacctcagccctgccacgcagagccnnnnnnnnnnacgtggcccgaccggccttgggtgccgggcacacacccgcgtggagggcatagtccccgggccacgtgccatgttcattggccgtactacccaggccaccccctttccccacccacccagatcagcggtgcacctcagccctgccacgcagagccnnnnnnnnnntgggttggtggggttggatgggttggggacgagatgggttgggggggttgggggtgagatgggttggagggcgtggggcgagcagtccggggctgcgccgggccaggaccttgccatggcaggtacaacgccccgctcttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattcttgagcgtggcagggcgcgagccacagcactgccctcccgcccggccccaccccactcacgagccgagcgtcctctggtaccgcggcccgccagtgggcaaacgcgccggcaatgacgcggaaccagcgcgtcagggcgctgccgcctggaggcttgcggcggtaccatttggagccggcgaggaagatggcgatggcaatggcaaaggagacggtggggatcaggaagccaatcatccagctgcatggcggtcagggggaggactggggtgacgcgcgcgcgctgggagccgggggacggtgtgcctgggtgtgtgctgggccggcgtgcgatgggcaccaagcagattgctctggcgaatcaaagggagccgagcaggaacccccttctcccagaaggaccgccccgggtgcagcccacctgacgtccgtctggacccagacgatgagcgtgcaggccaggaaggcgccgatgttgatgaatgcatagaaccagttgtagaagcgtgggatcatggccagctccgcagggtcatcctcgtcaaactggtcagcgccaaaggtggacacgcagggcttgatgccgccggtgccgattgccaccaggtactgcaggcagacgagggaagggagtgggaacaaggggagggagcacgaccccaccagtacccttccagggctcttagcgggctgcctggacccatttcccccagggaagggggaaaggggggctggttcagttccatcatgcctgctccagatttggctgcatcggcgcacaacagcagagtcccggggcctgcaacccgcagaagccctcatgccaggctttgcagctcaccatgaacccccagaagaaggagagctggtgagcggtgggctgctcccccggcgccggcctcagggaggggaggccggcggagatggtgacgccagtgaggccctgtggaggtgtcattgccaggcagtactgaaactccatccaggtcgattgaagaaatatcagagggataaagctgatgcctgcttcttgccttgacatccgcaccaagcccctgcccacttcccctgaacatcgagcagaggcaggtcaggtctccaggtaaaggcttgcaaaaccatcagtctcaccagcatgtagatgatggaaccagaaaagatggcccagaaacgccccaggaaggtatcggcgacccatgcacccaggagaggagttaaatagcatgtgcccgaccaggcattcacctgcgagtgtgttggagggggtgtgggccagactggcaggcactgaggcgagggttcatgaggagactcaatccaggatcttcaatccgacatagtgtgcccttctcccgtgtcgacgcacattctgggctgcagtggcattggtttcattcagtaccgacgtcaggtaaaccacgatgttgatctgtgcggtggtgcatttggggggcaggggctgtgtgacctttcggcgcgttgatgggcgtgtcggagcctagtggtctctcgacgatcgggattcctctgaaggataggcgcaatgataacatgttattgcaccggtaaacctaccgaaattccgtagtaagcaagacgctcgcacaactcgttgcctgcgtggaatcgatgatgcgggggggggggggggggcgggnnnnnnnnnnttttcattcagtactgacatcaggcaaaccacgatgttgatctgtgcggcggtgcatttggggggcgggggctgtgtgacctttcggcgcgctgatgggcgtgccggcgcctagtggtctctcgacgatcggcattcctctgaaggataggcgcaatgataacatgttcttgcaccggtaaacctaccgacattccgtagtaatcaagacgctcgcacaactcgttgtctgcgtagaatcgatgatgcgggggggggtcggtcgtggacagctccgagggtttcgaccgcactcctgccacggctatgtttactggaccccacccaaagctcaccgagaataggaacagctcttagaaaagctcgacccattgagaccggtgactcggtcgtcgtcgatggagaggcatcctcgacaggggtgcttccggtgctgagcttctggtgtggtggtggctgacgtttgtcggcatccaagttagcgctcccactcgacaccttatttaagatcttgtgaatatcattctcgtccactccaggcattatgggaagtagtcaatctcaggggtccgtgaaaggtgtgagggtgggtcggggatctttgggtgtttctccaggctctggacacagccagttcgttttgaaaggctgtactagcagcgccnnnnnnnnnnatgctcccggtgctgtgcttctggtgttgtggtggctgacgtttgtcggcatccaagttagcactcccactcgacactttatttaagatcctgtgaacatcactctcgtccactccaggcatggtgggaagtagtcaatctcaggggtccgtgcaaggtgtgagggtgggtcggggatctttcgggtgtttctccaggcgctggatactgccaattcgttttgaaaggctgtactagcagcgcccagtaatcctgatggatcgcatccagcctcaagcttatcagagcaaacgtagggtcgccaaggggtaatcatgctcgcagtatacacctgagtcttcgacccgcgcccccccatcatcatcagcagcttcgtgcatagatctggtcgcggcctccggtcgctcatttttcgctgtggctgccccgttcccacctagacgcgacactccacgcaagcggatggtcgaaaatttttgttaagtttggatttgattcacatcgccctcattgtgtggcccatccaggccatttgatggttgcaatcctggaaggctaggtatgcgtcgggtatcggcgagatcaacatcatccggaagacccccagcctgcaaagcaccaagtctcccttcaagcagcatcgccgaggcagaggacacgaatcactcatctgagacaatactacggcatgcacaatgtagtgaccgcaagttctcaggtcaatgggagattcatttggaagactggcctggagtgtgggaatgtgtgttgtacactcgttagtgcccaacatgaataggattgctacaagtccggggtatgcacattgttggtgcagctcacagcctacgttagtattgtattccacgaaaggagcaacttcatcaagttggggagagggtgtttgctggctggtgcacaggcactggcgcagctaaccccctggccctctaccacgcaggctccagatgcaaaccggtgagtttatacatgttgtcggtacaccgtatcgcctcggattcgccggatgaagttactgtcgagtgctcatcttggattccaaacctcttacttcgcctcaccaatagtatgatgcactgtctgcctcccaaaaattatccttgagcgatttgcgccacttaagagcccgtccaagcaaaccatcagcacaatgtctaacgaggaccactgcttgcacgttccaagcgtgagaggaatgtgctgcacatcagcaccagagcatcgttgagctctaaggccgcacagcaaattttacatgaaccatctgcatgagtaaggggttgccacttgtttgagcctcgacgtgacactggcatgcagccatgtcaggaactctggatcaacaccaagcttgcaccactcgagggagttttgcaaggagtggggtgctgccaactcagtccatggatggaagcccattgaattgtagcctcctaatgtcatgtccgcaaannnnnnnnnngccttgcaccactcgagggagtttcgcaaggagtggggtgctgtcaactcggtccatggatggaagcccattggattgtagcctcctaatgtcatgtccgcaaaaccacatcgctctgccatggcccaagaccctgctggtaaccctcaggccctcgatgaccccctcggctgcaaattccagggaagcagggttccagaaagacagcatgccacttgtatcgcacgttagcgagcaccagaatcgccatgtcactgtattatcagtgggtagccttcaagatcaagagtctccattgagcgtgcgcataccggcaccgttgggttgctggtggcaggcgccttctctcacgtatgggtgcaacctacgagcagctcagaccgctaccagtcgagcacaactgtacacatcttcagataccactgcatgcacacggtatccagaagctgggcgttactctacgctgagcttaagatgataaatggctgatcgatgggggagtcgctttgccgtttggtggaaaggggtgcccaagacgtgaaaaaagcgcgccagcgcgggcgctcgtgcaccacgccgtgcctggctccacaaaacatgggtgcgccggcgccagttccacagcaagcagcaccacgaagctttcatacgatatacaggcgcattttcgtgcctgaaatcggccccgcttctctccgctcctcccccccttcggcggccctacccaccatggcttccacccgggacgccagtcccgtcgtcgcaaaggtgaagaagacgaagaaggccgaggcatccaatggggtcgagaagaaggagaagagctcgaagaagcggaaggtggccgaccccgtgctaggtgcgcggtgcggtgcgtggcgttgcggcggctccgtgggacaggcattacagtgcctctcgccctcggaagcaccagtgccgggccctagggttatgataataacatttcccctttacccgccgcagatgccccggtcgccagccccgagatcgtggagaagaagaagaagaagaaggaggcggcctcccccgccccctcaatcaccgactctcccgccccgtctacggctgagacccccgccccccacccccacgccctggataacttcgcgctgtccgcccccctgaagtccatgctgcgcagcaagggcatcgagtccctgtttgacatccaggcggcctgcctgaaccccctgctggaggggcgggacctggtgggccgcgcgcgcaccggctgcggcaagacccttgccttcgtgctgcccatcgtggagcggctgagccagcgcccgcgcggcgcgcacggtcgcgcgccctccgtcatcgtgctggcccccacccgcgagctggccaagcaggtgggcgcagacttcgagacgtacggccgctccgccggcctgacctgcgtctgcctgtacggcggcacgcccatgagcccgcaggagggcgcgctgcgccgcggcgtggacgtggtcatcggcacccccggccgcgtcaaggaccacatcgagcgcggcagcctgtcctgcgccaacctcgccttccgcgtgctggacgagtgcgacgagatgctcaacatgggcttcgtggacgacgtggagcgcatcctgaacacgggcgtggacaccaccgacatccagaccctgctcttctccgccacgctgccgccctgggtcaagcagatcaccacccgcttcctgaagcccaaccacgccaccgtggacctggtcggcaccgagaagatgaaggtaggggcgggatggggagtgtgggcggtgaatgcggaccgacggcaatgcccgcatcccgcatcccttaccagtcatgacgcccaacccgccctccctcacccacgaatccctcgacaggctagcacctcggtgcgtcacctgctnnnnnnnnnntgacggcaaggcccgcatcccgcatcccgcaccagtcatgacgcccaagcctccctccctcacccacgaatccctcaacaggctagcacctcggtgcgtcacctgctgctgccctgccactggagccagcgcgcggaggtgacccaagacctggtcaagtgctacggcgcgctggggcgcaccatcatcttcaccgagaccaagcgcgacgcggacgagctggcggcgcagctgtcggagacggtgggcgcgcgcccgctgcatggcgacatcgcgcagagccagcgcgaggtgacgctggccggcttccgctccggcaagtttgcggtgctggtggccaccgacgtcgcggcgcgcggtctggacatcaagtgcgtggagctggtggtccagtcggagccgcccaaggagccggagacgtacatccaccgcagcgggcgcacggggcgcgccaactccaccggcacctgcatcacgctggtggaccggcgcaaggaagggctcatccccgtcatcgagcgccgcgcgggcatgaagtttgagcgcatcggtgcgccccaacccgccgacatggcgcgcgtggcgggcgagcgcgccgtggacgcgctggccgaggtggacgcgggcgtggtggacgccttccggcccgcggcacgcacgctgctggcggcgtcggagagcgcggaggccgcgctggccgccgcgctggcgcgcatcacgggctacaccgcgctgcgcccgcgctcgctcatcacagcgcacgaggactacaccacgctgcgcctggcggccgccttccccgtggacaagccggggcaggtgtttggcgtgctgcgcaaggccctgcccgaggcctcggtggaggaggtgaagagcatgaccctgaccagcgacgggaagggggcggtgtttgacgtccccgccgccctggtccaggccttcaagcaggcgctgcccgagccggaggacggggatgtgggtgccgccaagaacggcgcctttgtctcgcagccctccacccttcccgaggtggtggagcgcgaggtggcagccgcctcgttcgggggctggggcggccgcggcggcggccgcggcggcgg

SEQ ID NO: 41178 - DNA, 67 bp, Chlorella protothecoides
tgagtaaatcgcacatgtcttccatttcaagaccatccacctgcattcgtggcggagttcgaagtgg

SEQ ID NO: 41179 - DNA, 68 bp, Chlorella protothecoides
ccggcgacgagcaggcaagtctggggaggttgggaagcgtgagtgtgtgtgtgtgtgtgtgtgtgtgt

SEQ ID NO: 41180 - DNA, 61 bp, Chlorella protothecoides
ccgggaggtccttgaagagcgcgatgacgatggcaaagccgagcatgacggccgaggccgc

SEQ ID NO: 41181 - DNA, 70 bp, Chlorella protothecoides
gggcatgctgtgcgcgtacgacgtggcgcgcgcgcatccgggcctggacgtcagctgctacacctttggc

SEQ ID NO: 41182 - DNA, 151 bp, Chlorella protothecoides
gctggctgggttattggatgtggcaacctcgccgctccaagcgcccaagactcctggagacttgaaatcggacacccagtcctcggagatagggtgagtgtgattggtccttgctggtttggcaaaatctggaaatcgaggcatcgccatc

SEQ ID NO: 41183 - DNA, 77 bp, Chlorella protothecoides
acgggtgttcaccgtgcgagccgagccgccggagggcgggccggggctgcggcccgtcagcctgaaccacgccgatt

SEQ ID NO: 41184 - DNA, 72 bp, Chlorella protothecoides
tccaggcgagcctgggtgctgagcagcacagtgcccggcgttccccttgtgtaggtccattgaactctggtc

SEQ ID NO: 41185 - DNA, 61 bp, Chlorella protothecoides
aaccccttgcatgggaccggtccaggcacagctggcagacaccacggagatggtggtgtat

SEQ ID NO: 41186 - DNA, 78 bp, Chlorella protothecoides
tgccaggaggggttgggagtgctgtggggggcggggagactggggatagagaaggtatgccaggaggggttgggagtg

SEQ ID NO: 41187 - DNA, 89 bp, Chlorella protothecoides
atgggccgctcgcggattcctgtacatcaatttccatgctctgctgctcatatcccttcctccaggatccgggctcagaaggagcgtct

SEQ ID NO: 41188 - DNA, 71 bp, Chlorella protothecoides
tgaaatgcggacgctgactgtgtgagtttgtgagggggggggttggggcctgaggcttggagggggttgca

SEQ ID NO: 41189 - DNA, 100 bp, Chlorella protothecoides
ccaaatcccaacctaaatcattgaacaaaattattcgagtatttgcatactcgaacaaaccgccagcaccaccctcgagatgatacagggggcagcggcc

SEQ ID NO: 41190 - DNA, 121 bp, Chlorella protothecoides
cacgggtggccaccggcgtggtctgcaggagggaggagggggtgggggaaagggtttaaacggtagcaaagcgtaggagtgaagggtgctattttggcctggcggacgtaccggcccatca

SEQ ID NO: 41191 - DNA, 78 bp, Chlorella protothecoides
gggccccatcaggccagagccgcgcctggcctccatccccagcaaccccctggtgaggggaggatgggtgggagggtt

SEQ ID NO: 41192 - DNA, 70 bp, Chlorella protothecoides
tccccgccccttccccctcttccacccacctgcacggagccctggcagcgggccagggcggccgtgcccg

SEQ ID NO: 41193 - DNA, 61 bp, Chlorella protothecoides
aactcggcatctgcatggcaagaggctggggtgatactcatcagacatgaagtctagccca

SEQ ID NO: 41194 - DNA, 61 bp, Chlorella protothecoides
gactccctgatcttagcatatggcgggggggacagctgtcccggaccccagcctgggcagc

SEQ ID NO: 41195 - DNA, 97 bp, Chlorella protothecoides
ggcgcgtgaaacatcccccccggtaatcctccggtcggaagccgacggcgcaaacccggtcgtgccgcggtgcaccagaaggtgatggaagcgcggc

SEQ ID NO: 41196 - DNA, 6796 bp, Chlorella protothecoides
  modified_base (689)..(698): a, c, t, g, unknown or other
  modified_base (1349)..(1358): a, c, t, g, unknown or other
  modified_base (2644)..(2653): a, c, t, g, unknown or other
  modified_base (3125)..(3134): a, c, t, g, unknown or other
  modified_base (3617)..(3626): a, c, t, g, unknown or other
  modified_base (4799)..(4862): a, c, t, g, unknown or other
  modified_base (5032)..(5041): a, c, t, g, unknown or other
  modified_base (5130)..(5139): a, c, t, g, unknown or other
  modified_base (5228)..(5329): a, c, t, g, unknown or other
  modified_base (6320)..(6329): a, c, t, g, unknown or other
gcgagtctgggatgagcgcttggtggttttgtgtgtgtgtgtgcatgggtgggtgggtgggggtgatcacagactggggtaggggtgaggtcgtaatgcgggcaccctgcagcccttgccgatgtcgtgtgcgaaagaacgcaaggcaccaagcgcttgcagtattgaccttcagacctgggtgaaccagacccctattcttatcctctccccccccccgccccctctctctacacacacacgcacacacacacacaaaaaccaccacaacccaatcgtctatcccaggcggcaaggtgaacaacagcttcagctggcgcggtgcggggcagggcgcactgtggacgctgtgcgtggagccgcggctgcagctggtggcctacggcggcgaggacggcgtggtgggcgtctttgtggccggcttccagcaggacaaccgcaagcggcctgcgcaccaccccgtcgcgggtgggctcgggagtggggcactgaaactgggtgggtgaatgcagaatgccacaggccctggttacccagcgtcgcccaggctgggtgcaccagggtctgcacactgttctcatggagacagaacaggcgcagatggcatggagacccgccctgtgcgcccatgcaggagtgcccagggatggctgtggctcttctttcctggccaagctgtggtccattgnnnnnnnnnnggacagaacaggggcagatggcatggagacccgcccggtgcgcccatgcaggagtgccgtgggatggctgtggcccttctttcctggccaagctgtggtccattgctcgccgcccctcgccacccctccccaccaacccaaccccaaccctccttttgccccccgtcctccccggcccagggttccagttcagggagggagcgctgcacgtgctggacccaggccagctggcggcctcgcacggcctgtacgcggggaagagcgtggagcggctgccggcgctgaagggccggcccttcccgccggaggcccaggccgtcacgcgcatggcctggcacccaaacgccggggagaaatggggcaggctggccacggggtgctgggcggggatggtgcgcgtgcagaccatctaccgacgctgaagccgggtggtgcttggcgtgagcagccgcagcagcaggatgttgctgcggcactcgggctggtgcaagaatgcttgcaaggcgcagtccccctggtcacagatcaccagtgctggctatggttgcctcttttgattcgagaagtgatctcaaagccaaggatcctccccagggtgcggattgatcacgatgggcatcgctgctatgagcctccgtgccgaggcgcgcnnnnnnnnnnatgagcagccgcagcagcaggatgctgctgcggcactcgagctggtgcaaggatgcttgcaaggcgcattttccctggtcacagatcaccagtgctggctatggttgcctctcttgattcgagatgtgatctcaaagccaaagatcctccccagggtgcggattgatcatgatgggcatggctgctatgagcctccgtgccgaggcgcgcgcgctcgggtatcgagagggcgtcaccccgcaggaaccatgcacgacgagctgcatgcatgcattgcacgcagaacagtggagctacaatacataggtcgtaatttcacatcgtttcccatgtttttacgcttgcagctttgttagactgacgtcgtcacggtgtctcggctgagaacccaccactgctctgtgcacgaggaccgcctgcctcccccgaggcgaagacgggagtcccctgaggtttcgcaagtcgaggtttagtcatggcgaaggcgagtctgaaacccaaggcggcatccaagggcaaggcgaaggctcccttaccggcaaaagctcctgcagccaagcagcctgcaggggtaccaggtgcgtcgatcatcatgtggtggatggctccttgggtttcggccatgcccaaacatgtcgaggatgtcagtgctcccgttgcgcatggtgcacccccatgccttgccccatgtcctccactgtgcttcccaggtgtggagaagaagaagagcaagcggaggtaccatgggcccccagccccgcggcaggagaagaagcctcgtggacccgccccagtcaaccctcccggctcgaggcaggcacggaaggcggaggaggaggccgcccaggcaaccactgccaccatcgcgggcgcccctgccacgcagcaggcggactggttgtgggaccgataccgcgcggagtccggcgccagcgagctggagaggcaggggctgacggcggggtgctttgcgccggcccacccctcggagtggctggaagagagcctggccagcctgccggagcaggcggcgttcctggggaggggcgggcagcacgtgcccgtcggctcgcctgccgtcctcgtagtgacgggggcggccattcgagcggtgtccctcatacggcaaatgcctgccgtgaacaaggtgggcactttcgattgtctggggtgtgttgcggcaggctgaagtcctttggggggatacggcggtctgcacaaaccctcgcaaggggttattttcttgagggaggcatcgcagggacaatgaattgttgcgctcaagnnnnnnnnnnaaatccggcggtctgcacaatccctcgcaagggattattttcttgagggaggcttcgcagggacaatgaattgttgcgctcaaggccgaggcagcattgtctgctgtgcacactctgtctcggtagagctgaattggctttgcggggagtggacgaggcagggtgatcccttcaccagcaacgatcctccacaccaccccatcgtccaggcatgcaaggttggcaagctctttgccaagcactttaagcaagcggagcaggaagctgtgttgtcgagcactgttatgcatgtggctgtgggaaccccaaaccgcctcatcaagctcatagaggcaggagctctgaagcttggcagactacgatatgtggtggtggatgtcgccatggatgccaaaaagaggtgcgttcatatatggctttggtgcgggggatagggaatcaacgatatatatgtcgaagacagctcgggggnnnnnnnnnngtggttttggtggggaggatagggaattgacgatatatatgtcgaagacagctcgggggttgaggtgaccgtcaacctgcggctgtgaagccctgcatgggtgcagggtccagcttcccgacccacgatcggccccgtcctccctccgcagaacggtcctggacatggcggagacgaaatccgacttctggacgctgttcgcgagccatctgaaacccaagttcgagtctggagcacaatttgtgctgacgagctgcaaagtcgacaaggatgggccccagtaactgacacgcatttcgtggaaccctcacatcgaacccaaacttgcggccgctgaatttgatgagaatacaacaattgattaggtggtctcacgctaacggcctcacgagcgggatggtcagtaccatgtcgggggacgatgccccacccccacatgcttacgtcaccagccagcatggagttgggaggggtgacaacatnnnnnnnnnnagctgaatttgatgagagtacaactatcgattcggtggtctcacgctgacggcctcacgagcgggatgttcagtaccatgtcgggggaggatgccccaaccccacatgcttacgtcaccatccagcatggagttgggaggggtgacaacatccacaacgaacgcggtgagtgcatcgtcgcgatcccgagaaggcgatggggatgccaaacacacatcgcagtccttgagcgttcttagcaagtacactgagctccgcacagatgaaggtggtgtgcacgcgcgcacccgcgtcccactcctgaaccctgcccaacgtcgacatcccatgcgcgacaccagagtttccccggccaacccaagaccttgaaaaaacaagtgtccatgaagtctcagagggcatgctggccagcggccctgggccgcaccgggagcaaggaggtgcaggaggaggaggaggtgacgccctcccgcccctcccgccggttcagcggttggtggggcagcgacgccgagtccggttccaagcccgacgccgcgtccaagctcgccccgcgcaccgttagcctcctgtcccagggcctggacctgctgtccctgaggatggcctccagcgccctgccaactgatgagcaggccgcggaagaggccgcccccccgcccaaggtctcccacgaccgcaagcggagctggtccatcacgggatccctgggcctgggccggaaggtggcaccccaggccgcggcggatgcgggccagagcgccatcggcgccgggattgcggccccgccgcccccggccccctcctcctccctcgccgacgactacgacatcgcggcggcgggcagcggcagcggccccacgctggacgactccagcgccggcagctccccgatcgccctcgtggcgggggcgggcggcgccgccgcctctccccacaagcacgccgccggcgcgggcgctggcgccggctcgcccgcgcgcgggcagggctaccgccgcctctggcagtctatcaccagcaccaagaagggcgaggcctcgcgcatgagccgcgcggggggcgaggtgactgtggacgagctggtccgcgccgtcaaggtgtggcccggggtggggagactggatgggggagcggaaggggaggcactgttgctgaggccaaggatcgatnnnnnnnnnnnnnnnnnnnnnnnnnnnnnnnnnnnnnnnnnnnnnnnnnnnnnnnnnnnnnnnngcgtattgcacggcctggatcccgcccccctgcggctgctgtgcctaagcttcggtgtctcgacctcccaccgcccccttccttcctctactccaacacaacaacctcccatccccgtccttccccccctttcctgccacagcgcctgggccccaagcagggcgtgatgnnnnnnnnnngtggcggcctgtacctgcctcggcccttccctgcccggactgcacagggtgtgacttaacgacagcattccgccgcccgtgctggcttnnnnnnnnnnctggcggcttgtacctgcctcggcccgtccctgcccggactgcacagggtgtgactttacgacagcattccgccgcccgtgctggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctactcaaacacaacaacctcccatccccgtcctttcccccctttcctgccgcagcgcctgggccccaagcagggcgtgatggagggcgtggaggcggggctggcctgcctggactcgcgcgccgtggcggccctgctcaaggagctggccaaggccggggcggggcaccgcgcgacggagctgttcgacgcgctgcgcgcgctgccccccggcgcgccgttggcccgcctggcggacctgtacacctacaccacggcggtgagccagtgcggcgcggggcagcagctgcggcgcgcgctggagctggtggcggagatgcgcgcgcggcgcgtggcctgcaacatccacacctactccgcgctcatgggagtgtgcgtgaagtgcggggagtgcgacctggccctggacgtgtaccgccaggcgctggacgaggggctggcccccaacgcggtcaccttcaacatcctggtggacgtgcacgggcgcgcggggcgctggcgcgaggccgccgccgtgctggacgcgttcgccggcgcggggctggccccggagtcacgcacgtacaacgcggtcattgcggtgtgcgcgcgcgcgggcgcgccggacgccgccggcgaggtgtacgcgcgcatgctggcggcgggggccgcgcccagctcgaccacctacacctccctcatctccgcctacggcaaggcggggcgggtggaggaggcgctggccgccgcgcgcggcatggccgcgcacggcctggagcccaacgtcatcaccttctcctccctggtctgcgcggcggagaaggcgcggcgcggggacctggccctcgccgttgttgccgacatgcgcgcgcgcgggtgccgtcccaacgtcgtcacctacaacgccctgctgggagcctgctgccagggtgggtcggcgtgtgggtggttggcgcgtgtgcagtgtggggtggaatgggggagagggatgggatacagtgaggtgtnnnnnnnnnngcggcgtgtgggtggtcggcgcgtgtgtagtgtggggtggaacgggggagagggatgggatacagtgaggtgtgaagcacggctgtcacaggtccacacccgcgtgcggctggggtgggcttggggctgtgcaagcgggggaggccaccgccactcccccccgcccccctccctggggcggccgcaccttccaccctccgtaactgcccaccacccacaccccttctcccctcgttcccagccaacatgtggcaggcggcgctggacgccttcacccagatgcgcagcgagggctgctggcccgacgcggtgtcctactcgctgctgatcgcggcgctgcgccgcggcggcgcctgggcccccgccctgggcgcctacgagggcatgctgggcgccgggctgcgccccgacgccggcgtgctggccagcctgctgggcgcgctgtgcgcgggcgggctggtggcccc

SEQ ID NO: 41197 - DNA, 73 bp, Chlorella protothecoides
ccctgacaccccccactccttcccatgacctgcagtactcgttggctcaccaggcacgaggccagtccgtcct

SEQ ID NO: 41198 - DNA, 179 bp, Chlorella protothecoides
cacggagggtgtgtgatggagggacccgcctcgcgccgtgggcgcggaggatggcctgcccccgagaccacccatccctcacctggggggggcccatgctcatctctttgcagcaagaaaccaccctttttgccccacccaccctcccctccgcttgcactgacgctcttctacacacg

SEQ ID NO: 41199 - DNA, 68 bp, Chlorella protothecoides
ggagcccgaagtcagggaggtctaggagcaggagccgggagggccgcgggagtgggaggaggcgggag

SEQ ID NO: 41200 - DNA, 61 bp, Chlorella protothecoides
ctgtgggctggagatggtgaattggctggggaagggaaggagctgcacgatgactgtcact

SEQ ID NO: 41201 - DNA, 62 bp, Chlorella protothecoides
tgtcaacctgcagttgcattttcctggtcaaatgtggtggctgtatctcctgccacactctc
